United States Patent 8,952,217 (PROCESS FOR DECREASING VERBASCOSE IN A PLANT BY EXPRESSION OF A CHLOROPLAST-TARGETED FIMD PROTEIN) - sequence listing, part 10

SEQ ID NO: 40591 - DNA, 1011 bp, Yersinia pseudotuberculosis IP 32953
  CDS (1)..(1011): transl_table=11
atgaatgtgttaaataagaaagatatgctcacttactttaaagagagcgggatttatgtggtgttgtttgtgctattggcaattattattatcaaggatccgacttttttaagtttgatgaatttaagtaacattctgactcaatcttcggtgcgtattattatcgcgttaggggtcgcgggtttgattgttacccaaggcacggatttgtccgcaggtcgtcaggtagggttagccgcagtggtcgctgcgacaatgctacaatcgatggataacgtgaataaagttttcccggacttgcagactgtacctattccagtggtcattctcgttgtctgcctgattggggcggttattggtttgattaacggtataattattgcgtacctgaatgtgactccatttattaccacattaggcactatgattatcgtttatggcgttaactcgctgtattacgattttgtcggtgcttcaccgattgccggttttgatcctgctttttcgacttttgctcaaggtttcttgcggtttggtgattttaaactgtcctatattaccttttacgccttaatagcaattatgtttgtatgggtactgtggaataagacccgttttggcaagaatatttttgctattggcggcaacccggaggcggcgaaagtctctggtgtgaatgtgccactgaatttgatcatgatttatgcattgtcgggggtgttctatgcctttggcggtatgctggaagcagggcgtatcggcagtgcgacgaacaatctcggatttatgtatgagctagatgcgatagcagcctgcgtggtgggtggggtgtccttcagtggtggcgtcggtaccgtgatcggcgtggtgaccggggttatcatcttcactgtcattaactatgggctcacgtatattggtgtgaacccgtactggcaatacattatcaagggcgggattatcatctttgcggttgcgttggattcactgaagtatgcgaagaagaaatag

SEQ ID NO: 40592 - protein, 336 aa, Yersinia pseudotuberculosis IP 32953
MNVLNKKDMLTYFKESGIYVVLFVLLAIIIIKDPTFLSLMNLSNILTQSSVRIIIALGVAGLIVTQGTDLSAGRQVGLAAVVAATMLQSMDNVNKVFPDLQTVPIPVVILVVCLIGAVIGLINGIIIAYLNVTPFITTLGTMIIVYGVNSLYYDFVGASPIAGFDPAFSTFAQGFLRFGDFKLSYITFYALIAIMFVWVLWNKTRFGKNIFAIGGNPEAAKVSGVNVPLNLIMIYALSGVFYAFGGMLEAGRIGSATNNLGFMYELDAIAACVVGGVSFSGGVGTVIGVVTGVIIFTVINYGLTYIGVNPYWQYIIKGGIIIFAVALDSLKYAKKK

SEQ ID NO: 40593 - DNA, 1050 bp, Yersinia pseudotuberculosis IP 32953
  CDS (1)..(1050): transl_table=11
atgtctagcgttactttgagttcggataaaaagaacccggtatcaactgaatcaaaaggtgggatcccacaacctcagcaaccacagaatgcgccgactaaaagtggcttaggattatcccgtatctgggacagctacggcatgctggtggtcttcgccgtggtctttattggttgcgtgatttttgtgcctaattttggctcctttatcaatatgaaagggttggggctggctatctcaatgtctgggatggtggcgtgcggtatgcttttttgtttggcatccggcgattttgacctctctgtggcctcggtcattgcctgcgcgggtgttaccaccgcggtggtgatcaatatgacagagagcctatggataggggtgggcgcaggtttgttattaggggcggcatgtgggctaattaatggttttgtgattgcccggctaaaaatcaatgcgctgatcaccacattggcgacgatgcaaattgttcgtggcctggcgtatatcatttctgatggtaaagccgtgggtatcgaagatgagcgcttcttcgccttgggttataccaactggtttggtctgccagcacccatctggatcaccgttgcctgtttggtgctgtttggtttcttactgaataaaaccacctttggccgtaacacgttggcgattggggggaatgaagatgctgcgcgtctggccggtgtgccggtcgtgcggaccaaaatcattatttttgtgctgtcaggtttggtgtctgccgccgcagggattattttggcttcacgcatgacgagcggccagccaatgacctcgattggttatgagctcattgttatctctgcttgcgtattaggcggggtatcactaaaaggcggcattggtaaaatttcttacgtcattgcggggatcttgattctgggaacagtagaaaatgccatgaacctattaaatatctccccgttctcacaatatgtggttcgtggtttgatcctgctggcggcggttatcttcgaccgttacaaacagttagctaaacggacgatataa

SEQ ID NO: 40594 - protein, 349 aa, Yersinia pseudotuberculosis IP 32953
MSSVTLSSDKKNPVSTESKGGIPQPQQPQNAPTKSGLGLSRIWDSYGMLVVFAVVFIGCVIFVPNFGSFINMKGLGLAISMSGMVACGMLFCLASGDFDLSVASVIACAGVTTAVVINMTESLWIGVGAGLLLGAACGLINGFVIARLKINALITTLATMQIVRGLAYIISDGKAVGIEDERFFALGYTNWFGLPAPIWITVACLVLFGFLLNKTTFGRNTLAIGGNEDAARLAGVPVVRTKIIIFVLSGLVSAAAGIILASRMTSGQPMTSIGYELIVISACVLGGVSLKGGIGKISYVIAGILILGTVENAMNLLNISPFSQYVVRGLILLAAVIFDRYKQLAKRTI

SEQ ID NO: 40595 - DNA, 1062 bp, Yersinia pseudotuberculosis IP 32953
  CDS (1)..(1062): transl_table=11
atgaacgagagaacccaaatgctgcatacggcacgctctacaccggccaaaagcgctgataagccgcgttatctgaagctttcgcgcttattactggaagggcgcgccttctttgcattattggtcattattgccgtgttttcactcctctcacccaactacttttctggcgcaaatttcctgacgatggcctcacatgtggcgatatttggcctcccggcgattggaatgctactggttattcttaatggtggaatcgatctttctgttggttcgacattgggtctgtctggcgtattcgcgggttttttaatgcaaggcatcagcattgagtcacttggcgtagtgctttatttgccggtctgggcggtggtaattatgaccctggcgctgggcgcattggttgggcttatcaatggcatcttgatcgccatttttcgggtacctgcttttgtggcaacactcggttcactctatgtagcacgtggcgcggcactgctgatgaccaatggcttaacctacaacaaactcgcgggtagccccgagctaggtaataccggttttgactggttgggatttaatcgcctctttaatattccgattggcgtgctggctctgggcgtcgtggcactggcctgtggatttttactgatgcgtaccgcatttggtcgctggttgtatgcctcgggaggcaatgagcgtgccgcggatctctcgggtgttccggttaaattcgtcaaaatcagcgtttatgttctctccggggtttgtgcggcactggccgggttggtgctctcttcgcagttaacctccgcaggcccgacagcgggcaccacgtatgagttgaccgccattgcggcggtggtgattggcggtgcggcgctgaccggagggcgtggcaacgttcgaggcacactacttggggcttttgttattggctttctttccgatggcttggtgattattggcgtatccgcctattggcagaccgtatttactggtgcggtgattgttatggcggtattgctcaatacgttgcagtacggccgacgaagtaaataa

SEQ ID NO: 40596 - protein, 353 aa, Yersinia pseudotuberculosis IP 32953
MNERTQMLHTARSTPAKSADKPRYLKLSRLLLEGRAFFALLVIIAVFSLLSPNYFSGANFLTMASHVAIFGLPAIGMLLVILNGGIDLSVGSTLGLSGVFAGFLMQGISIESLGVVLYLPVWAVVIMTLALGALVGLINGILIAIFRVPAFVATLGSLYVARGAALLMTNGLTYNKLAGSPELGNTGFDWLGFNRLFNIPIGVLALGVVALACGFLLMRTAFGRWLYASGGNERAADLSGVPVKFVKISVYVLSGVCAALAGLVLSSQLTSAGPTAGTTYELTAIAAVVIGGAALTGGRGNVRGTLLGAFVIGFLSDGLVIIGVSAYWQTVFTGAVIVMAVLLNTLQYGRRSK

SEQ ID NO: 40597 - DNA, 993 bp, Yersinia pseudotuberculosis IP 32953
  CDS (1)..(993): transl_table=11
atgatcagaactgaacactcttcttctacgcaagagagcggtagcactctccatcgccataaacgttgggaaaaattattacatcacccggccatgttgccatttattggttttgttgtgctctttgtcttaatgagtgggttaaatgacagttttttgaccgtaaataacctcactaacgtggcgcggcaggtgtcgattaatgccattatcgcggtaggcatgacttgcgcgatcttgaccggggggatcgatctttcggttgggccagtcatggcgttgtcagggtctattgctgccgggctgatgctggccggtattcctattccgttagccatgatggccgctctgttagtcggtgccttatttgggctggcgaatgggagttgtattgcttatctgcggatgccgcctatcatcgtgacgctggcctctatggggatcgcccgtggtttggcgttgttgtacaccggggggtaccccatctccggtttacctgacatgttttcattctttggccgaggtacggtactgggtattcaagtccccattctgatcatggccggtgtttatctgttcgcttggatcatgctcaaccatttatcgtttggtcgctatatttatgctatcggtggcaacgaagaagcggcgcgtttgagtggtatccgtgtgtcgcgctataaaatgctggtatatgtggtcagtggcctgacagccgcgttggccgggctggtactgacttcgcggctaatgagtgggcaacctaatgcgggcgaagggtttgaactggacgctatcgccgccgttgttttgggcggtgcggcaatctccggaggcaagggggcgattattggtacgttggtaggggcgatgatgttgggggtgttgaataatggcctcaacctgatgagcgtatcgccttatatccagaatgtcgtgaaaggcggcattattcttgcggcgatctatctcagttccgttcggcgcaaataa

SEQ ID NO: 40598 - protein, 330 aa, Yersinia pseudotuberculosis IP 32953
MIRTEHSSSTQESGSTLHRHKRWEKLLHHPAMLPFIGFVVLFVLMSGLNDSFLTVNNLTNVARQVSINAIIAVGMTCAILTGGIDLSVGPVMALSGSIAAGLMLAGIPIPLAMMAALLVGALFGLANGSCIAYLRMPPIIVTLASMGIARGLALLYTGGYPISGLPDMFSFFGRGTVLGIQVPILIMAGVYLFAWIMLNHLSFGRYIYAIGGNEEAARLSGIRVSRYKMLVYVVSGLTAALAGLVLTSRLMSGQPNAGEGFELDAIAAVVLGGAAISGGKGAIIGTLVGAMMLGVLNNGLNLMSVSPYIQNVVKGGIILAAIYLSSVRRK

SEQ ID NO: 40599 - DNA, 1029 bp, Yersinia pseudotuberculosis IP 32953
  CDS (1)..(1029): transl_table=11
atgagcgattccccccccttggtaatgtctctgacacggaccagtaaattcaggaaggccattcatcaatacgggatcatacttgcctttgttggcttgtgtgcggtcattgctctggctggtgaatttgcagtaaacagcgggacatggagcgagaattattttttatcacgggataatacactcattattctacgccaggtctcgatcaacggcatcctggccattgggatgacgttcgttattatcaccgcgggtgttgatctctccgttggcgcggttttaggcttggccggtattgtcgccgcgcgttttgcgacgaataacagtgccatcgccttgggggggaccgattggccactgttagtacccatcgtgattgccattggcatcggtttagtctgcggcgctatcaatggctttatcttaggcaaatatcgtctgcaaccctttattgtcacaatggggatgttatctgtcgcccgtggcctgacattactgactactggcggaaacccggtatcacaattaaccgatgaattccgttggttaggtaacggttatattttgggtattcccgtaccggtgttgatctttattattctgttcgccattgcctggtttgtcttgaataagatgacgtttggccgttacgtctacgcggtgggcgggaatgaaaaaagtgcccgcacatccgggatcaacgtattacgtattaaagtggcggtatataccctttgcggtattttggcggcgatcgcgggtttaattttaaccgcacgtactggctcggcacaaactggcgctggcgtatcctatgaattggatgctatcgcggcggtcgttattggcggcaccagtatggctggcggtattggaactctgcgcggaaccttatttggtgtgctgataataggtgtgatgaacaatgggcttgatttactcggcgtacaatcctattaccagcaaattatcaaaggtgttctgattgtctttgctgtcatgcttgacccatcccgtaagcaataa

SEQ ID NO: 40600 - protein, 342 aa, Yersinia pseudotuberculosis IP 32953
MSDSPPLVMSLTRTSKFRKAIHQYGIILAFVGLCAVIALAGEFAVNSGTWSENYFLSRDNTLIILRQVSINGILAIGMTFVIITAGVDLSVGAVLGLAGIVAARFATNNSAIALGGTDWPLLVPIVIAIGIGLVCGAINGFILGKYRLQPFIVTMGMLSVARGLTLLTTGGNPVSQLTDEFRWLGNGYILGIPVPVLIFIILFAIAWFVLNKMTFGRYVYAVGGNEKSARTSGINVLRIKVAVYTLCGILAAIAGLILTARTGSAQTGAGVSYELDAIAAVVIGGTSMAGGIGTLRGTLFGVLIIGVMNNGLDLLGVQSYYQQIIKGVLIVFAVMLDPSRKQ

SEQ ID NO: 40601 - DNA, 993 bp, Yersinia pseudotuberculosis IP 32953
  CDS (1)..(993): transl_table=11
atgactaactcaggcacgccgcagcaggtggcaaaatctgcctcgctgaaaaaagcgttttttagcgatttactgcaaaccgtgggtattttaccgattctggtgttgattgtggcggtattcgggtttctcgccccaaatttctttaccgaatctaacctacttaatatcgcccggcagtcatccataaatatcgtcctcgcggcgggaatgaccttcattattctgaccggaggtatcgacctttccgtggggtcaattctcgggactacggcagttaccgccatggcagtttcgctgatgcccggctgggaaggtctttctattccggcggcgctattaatgggtaccggtcttgggctgtttaacggcatgttggtggcatgggctggactgccgccatttattgttaccctcggcacatacacggcgctgcgtggtgtggcctacttactggctgatggcaccactattatcaactcgaacattaattttgagtggataggcaatgcttatctcggcccggtcccgtggctggtggttatcgccctactggtggttgccgtgtgctggtttattttacgccgcactacccttggcgttcacatatatgcggtgggcggcaatatgcaggcggcgcgcttgaccggcattaaagtgtggatggtgctgctgtttgtctatggcatgagcgggttgctgtccggactcggcggcgtcatgagtgcatcgcgactttacagcgctaacggcaatcttggtatgggctatgaattggacgccatcgcggcggttatcctcggggggaccagttttgttggtggagtaggcaccatcacaggcacgctggttggtgctctgattatcgccaccctcaataacggcatgacgctaatgggggtctcttatttctggcaattggtgatcaaaggggcggtgatcatcatagcggtgctgatagacaaataccgtacccgtcaccataactcataa

SEQ ID NO: 40602 - protein, 330 aa, Yersinia pseudotuberculosis IP 32953
MTNSGTPQQVAKSASLKKAFFSDLLQTVGILPILVLIVAVFGFLAPNFFTESNLLNIARQSSINIVLAAGMTFIILTGGIDLSVGSILGTTAVTAMAVSLMPGWEGLSIPAALLMGTGLGLFNGMLVAWAGLPPFIVTLGTYTALRGVAYLLADGTTIINSNINFEWIGNAYLGPVPWLVVIALLVVAVCWFILRRTTLGVHIYAVGGNMQAARLTGIKVWMVLLFVYGMSGLLSGLGGVMSASRLYSANGNLGMGYELDAIAAVILGGTSFVGGVGTITGTLVGALIIATLNNGMTLMGVSYFWQLVIKGAVIIIAVLIDKYRTRHHNS

SEQ ID NO: 40603 - DNA, 1185 bp, Yersinia pseudotuberculosis IP 32953
  CDS (1)..(1185): transl_table=11
atgtcacaagctaatcaatctgaatttaactcaccagaaaatggggataaaaagccattttttcggcttaaatccttaaatttacaagtttttgtcatgctggccgcgatcgccattattatgttgttcttcaccttcacgacagaaggggcctatctcagcgccagaaatatctctaacttgctgcgccagacggcgatcaccggcatcttggcggtcggtatggtgtttgtcattatctccgccgaaattgacttgtctgttggctcaatgatggggttattgggtggcatagcggccatttttgatgtctggctcggctggccgttgccgctgaccattgtcgttacgctggcgctggggctggtattaggggcatggaacggttggtgggtcgcgtatcgcaaagtgccttcgtttattgttacgctcgcgggcatgttggcttttcgtggcattttaattggtatcaccaatggcacgacggtttcgccgaccagtaatgcgatgtcgcagattggccagagctatctgccaagtggcattggttttggcatcggtgctattggcctgatgttgtttgtggcctggcaatggcgtcggcgtaatcaccgcatccgcttggggttaccggttgccgccccgcaaggggatgtgactcgccaaactattaccgcagttatcgttctgggtgccatatatttattgaatgattatcgtggtgtacctacgccggtactaatccttactgcattaatgctggcgggggtatttatggctactcgcaccgcttttggtcgccggatctacgctattggcggcaatattgatgcggcgcgcctgtctggaattaatgtagagcgcactaaactggcagtattcgcgattaacggactgatggtggcgatggctggtttgatcctcagttcacgtttaggcgcaggttcgccttctgcgggcaatatcgctgaattggatgcgattgcggcgtgtgtcattggcggtaccagcctggccggaggcgttggcagtgtggcgggggccgtaatgggcgcatttattatggcttctctcgataatgggatgagcatgctagatgtgccgacgttctggcagtacattgtcaaaggcgcaattttgctgctggccgtgtggatggattccgccaccaaacggcgggtgtga

SEQ ID NO: 40604 - protein, 394 aa, Yersinia pseudotuberculosis IP 32953
MSQANQSEFNSPENGDKKPFFRLKSLNLQVFVMLAAIAIIMLFFTFTTEGAYLSARNISNLLRQTAITGILAVGMVFVIISAEIDLSVGSMMGLLGGIAAIFDVWLGWPLPLTIVVTLALGLVLGAWNGWWVAYRKVPSFIVTLAGMLAFRGILIGITNGTTVSPTSNAMSQIGQSYLPSGIGFGIGAIGLMLFVAWQWRRRNHRIRLGLPVAAPQGDVTRQTITAVIVLGAIYLLNDYRGVPTPVLILTALMLAGVFMATRTAFGRRIYAIGGNIDAARLSGINVERTKLAVFAINGLMVAMAGLILSSRLGAGSPSAGNIAELDAIAACVIGGTSLAGGVGSVAGAVMGAFIMASLDNGMSMLDVPTFWQYIVKGAILLLAVWMDSATKRRV

SEQ ID NO: 40605 - DNA, 996 bp, Symbiobacterium thermophilum IAM 14863
  CDS (1)..(996): transl_table=11
gtggagggaactgaattggccaaggacatcgcggtgaagaagcgtctttcgttcagcgatgtatgggacaagtacagcactgtcctgattctcatcctcatgatcctcgtgtttggcgctctggagcccgtggccttcctcgggggcagcaatctgatcaagatcgtggagcagagcgcgatcaccatcctcctggcctgcggcgagttcttcgccatcctgctggccggcatcgacctgtcggtcagctcgaccatggccctgaccggcgtggtgaccgccaagctgctggttgcgggcgtgcaccccttcctggccgtggtcctgggcgccatcctgctgggcgggctgatcggcgccctcaacggcgggctgatcaacgccaccggccttccccccttcatcatcaccctcggcacccaggccatcctgcgggggctcacgctgaccgtctcctccgccagagccgtatcgggggttccggtcacgttcaccaaggcgatgggcggcaagctgttcggcgtggtgccgaccccgatcctcatcgcactgatcaccgccctggtgctgacattcttcacgaaaaagacccaggccgggcgcaacctgtacgccatcggcggcaacgctcagtcggcctggtttgccggcatcaatgtgaagcggcacaccctgctggccttcaccatcgccggcatctgcgccggcctcgcggggatggtcaacatcgcccgtctcggggcggccgagcccaacgccggcacgggctatgagaccttcgccatcgcggctgccatcatcggcgggaccagcttcttcggcggcgtcggcgtcgtgccgaaggtggtggtcggcggtctgatcatcggcgtcatcaacaacggcctgaacatggtgggcgtctcctcctactaccagcagatcgccatgggcgccctgatcatcgtcgccgtcaccctggaccgcttcttcggcgcgagccgcaagcgtggataa

SEQ ID NO: 40606 - protein, 331 aa, Symbiobacterium thermophilum IAM 14863
MEGTELAKDIAVKKRLSFSDVWDKYSTVLILILMILVFGALEPVAFLGGSNLIKIVEQSAITILLACGEFFAILLAGIDLSVSSTMALTGVVTAKLLVAGVHPFLAVVLGAILLGGLIGALNGGLINATGLPPFIITLGTQAILRGLTLTVSSARAVSGVPVTFTKAMGGKLFGVVPTPILIALITALVLTFFTKKTQAGRNLYAIGGNAQSAWFAGINVKRHTLLAFTIAGICAGLAGMVNIARLGAAEPNAGTGYETFAIAAAIIGGTSFFGGVGVVPKVVVGGLIIGVINNGLNMVGVSSYYQQIAMGALIIVAVTLDRFFGASRKRG

SEQ ID NO: 40607 - DNA, 1212 bp, Bacillus licheniformis ATCC 14580
  CDS (1)..(1212): transl_table=11
atgcagacaccggtgcaaacggataaagaccgcgctcagcccggctactttcagctgtttcgcgatatgtataagcagaatatccggaaatacagcatggtcattgcgctcgtgtttattatgctgctgtttcaaatattgacagacggaattttgctgagaccgctgaacattacgaacctgattttgcaaaacagctacattctcattttagcgattgggatgatgctcgtcatcatcacgggacacattgatctatcagtcggttcagtcgccgcttttgtcggcgccgtctccgcgatgatgatcattgaaaacgatatgccgctgtttgcggcggtcgtcctgtcgttgcttctgggagcggcaatcggcgcctggcagggtttttggatcgcttatgtcaagattccggccttcatcgtgacgctggcgggaatgcttttgttcagagggctcacgatgatcgtgctggaggggaaatcgatcgctccgtttcctgtgtccttccaaaaaatggcgtccggttttattccggactggctgaacggaggcacgttccatttgacgacgattgtcgccggagcgggtgtgtcgattctttatctcgtatatcagcttcagcagagaaacatgcagaagaaattccaatttgacttgcagggaaaaggtctgtttacagttaaggtgttttttatcatcgccattatcaacctttttacctacattctcgcgacttatgaaggtatacctctcattttgatcacattgttcgtcttaatcgccgggtatacattcgttatgaaaaaaaccgtcatcgggcggagaatctacgcgatcggcggcaatgaaaaagcagccgagctttcaggaatcaaaacaaaacggctcacctttatggtcttcgtcaatatgggcgtcttagcagccctttcaggcttgatttttgccgcccgtctaaacgcggccactccgaaagcaggaaacctgtttgaacttgacgccattgcggcctgcttcatcggcggggcttcggcttacggcggtatcggcacgatcggcggggccatcatcggcggtcttgtcatgggagtcatgaacaacggtatgtcgctgctcggcctgggcatcgactggcagcaggcgataaaaggcctcgtccttctgattgccgttgcatttgatatttacaataagaataaaacttcttaa

SEQ ID NO: 40608 - protein, 403 aa, Bacillus licheniformis ATCC 14580
MQTPVQTDKDRAQPGYFQLFRDMYKQNIRKYSMVIALVFIMLLFQILTDGILLRPLNITNLILQNSYILILAIGMMLVIITGHIDLSVGSVAAFVGAVSAMMIIENDMPLFAAVVLSLLLGAAIGAWQGFWIAYVKIPAFIVTLAGMLLFRGLTMIVLEGKSIAPFPVSFQKMASGFIPDWLNGGTFHLTTIVAGAGVSILYLVYQLQQRNMQKKFQFDLQGKGLFTVKVFFIIAIINLFTYILATYEGIPLILITLFVLIAGYTFVMKKTVIGRRIYAIGGNEKAAELSGIKTKRLTFMVFVNMGVLAALSGLIFAARLNAATPKAGNLFELDAIAACFIGGASAYGGIGTIGGAIIGGLVMGVMNNGMSLLGLGIDWQQAIKGLVLLIAVAFDIYNKNKTS

SEQ ID NO: 40609 - DNA, 963 bp, Bacillus licheniformis ATCC 14580
  CDS (1)..(963): transl_table=11
atgaaaactcaaccggctgtgaaaaaaagccttaatgttgattctgtaatgcaaaagctcggtccgtttctcggcctgatcattctcgtcgtcatcgtatcattgttaaatccgagctttttagaaccgttaaatattttaaacttgttaagacaagtcgccattaatgcgctgatcgcgtttggcatgacctttgtcattttaaccggcggcatcgatctttccgtcggagcgattttggcgctgtcaagcgcattgatcgccggaatgatcgccggcggcatcgatcctgttttcgccgtcatcatcggctgcctgatcggagccctgctcggcttggtcaacgggctgttaatcacgaaaggtaaaatggccccgttcatcgcaacacttgccacaatgacgattttccgcggattgacgatggtttatacagacggcaatccgattacagggctcggcaaccactacggcttccagcttttcggacgcggttactttttaggcatccccgtccctgcgattacaatggcagccgcctttatcatcctctgggtgatccttcacaaaacgcctttcggccgccgcacatatgcaatcggcggaaatgaaaaagcggccttgatctcgggcattaaagttccgcgcgtcaaaatgatgatttattctcttgcaggcctattatccgcgttggctggagccatcttgacgtcacggctaaactcagcccagccgacggcaggcacttcctatgaactcgacgccatagccgcagtcgtattaggcggcacaagccttgccggaggaagaggacgaattgccggcacactcatcggcgtcctgatcatcggaacgttgaataacggcttgaacctgcttggcgtctcttcctttttccaaatggtcgtcaaaggtgtcgtcattttgatcgcagtcctgctggaccgcaagaaatccgcttaa

SEQ ID NO: 40610 - protein, 320 aa, Bacillus licheniformis ATCC 14580
MKTQPAVKKSLNVDSVMQKLGPFLGLIILVVIVSLLNPSFLEPLNILNLLRQVAINALIAFGMTFVILTGGIDLSVGAILALSSALIAGMIAGGIDPVFAVIIGCLIGALLGLVNGLLITKGKMAPFIATLATMTIFRGLTMVYTDGNPITGLGNHYGFQLFGRGYFLGIPVPAITMAAAFIILWVILHKTPFGRRTYAIGGNEKAALISGIKVPRVKMMIYSLAGLLSALAGAILTSRLNSAQPTAGTSYELDAIAAVVLGGTSLAGGRGRIAGTLIGVLIIGTLNNGLNLLGVSSFFQMVVKGVVILIAVLLDRKKSA

SEQ ID NO: 40611 - DNA, 936 bp, Bacillus cereus E33L
  CDS (1)..(936): transl_table=11
atggctaagaaggggaatgtattacaacaacttgggtctttaattggactagcgctaattattgtagtaattacggctttaaatccagcgtttattgaaattccaaatttatttaatatactgcgtcaagtatcgattaatgcccttattgcattcggaatgacctttgtaattttaacagggggtattgacttatcggtaggttctattttagcattatcaagtgcacttgttgctggaatgatggcaagtggcatggacccgttccttgcgatggcagttggattattagctggtcttgtaatgggaattgtaaacggtatcatcatagcgaagggaaaagtagctccatttattgcgactttagcaacaatgactatttttcgcgggttgacgcttgtttatatggacggacgtccgatcactggtcttggtgatcatttaatgttccaaatgtttggccgcggttattttctcggtattccagtaccagctgttacaatgatgatcgctttcgcagtactttacttcattttgaagaaaacgacatttggtcgccgtacatttgcaattggtggaaatgaagaagcagcagcattatcaggtattaatgttacgagaattaaagtaatgatttacggtctttccggaattttggcagcgcttgcaggtattgtcttaacatcacgactagattctgcacagccgactgcaggtacttcttacgaattagatgcaattgcagcagttgtattaggtggaacaagtctttctgggggaagaggatggattgttggtacattcatcggtgtacttattatcggtgtactaaataacggtttaaatttattaggtgtatcttctttcttccaacaagttgtaaaaggacttgtaatcttactagctgtattaattgatcgtcgaaaagaagcgtaa

SEQ ID NO: 40612 - protein, 311 aa, Bacillus cereus E33L
MAKKGNVLQQLGSLIGLALIIVVITALNPAFIEIPNLFNILRQVSINALIAFGMTFVILTGGIDLSVGSILALSSALVAGMMASGMDPFLAMAVGLLAGLVMGIVNGIIIAKGKVAPFIATLATMTIFRGLTLVYMDGRPITGLGDHLMFQMFGRGYFLGIPVPAVTMMIAFAVLYFILKKTTFGRRTFAIGGNEEAAALSGINVTRIKVMIYGLSGILAALAGIVLTSRLDSAQPTAGTSYELDAIAAVVLGGTSLSGGRGWIVGTFIGVLIIGVLNNGLNLLGVSSFFQQVVKGLVILLAVLIDRRKEA

SEQ ID NO: 40613 - DNA, 954 bp, Bacillus cereus E33L
  CDS (1)..(954): transl_table=11
atgaaacgcatgctaaaaatgcacgaaacgtctatcataacgttactactaatttatatagctattgtaggaatgataaatcctagttttattcaatttaactcgttatctttaatggtgaaatcaagcgttattttagtcgtgttagcaattggccaatcgttcgtcttatttacgaaaaatatagatgtatcagttggttcaagcatggggttaagtgcagcagtttgcggaatgttgctaacgaatgaatatagtgcatccttgtcgatatttgctgctattacacttggcgctattatcggtttcgtaaacgggatgggcgttgcgaagtttcgagtaccagccattattatgacattaggcatgttaggaattattagaggtgccatgttaattttcacaggcgggaagtggattgaagatattccaaacgattttaagcagctgtcatctatcgtcattcttggtttacctataactgtatggttcgttcttattattttactactactatacttctttttaaggaaagtgccatttggaagatacttttatgcggtaggtgataatgaagatggcgcgagacttattggtatacctgttaataaagtgaagatatgtgcgtttatgatttcaggcataagtgctgcgctcgctggttgcatatttgttatgaatatcgggttcattccaaatcaaactggtacaggattagaattacaagtaatcgcagccgctgtactagggggcattcatttaaaaggaggaacaggatctttatttggagctgcattaggagcattctttttagaaacaataagcagttcactcgtctttctaaaaataccagcattttggaataatgctatttcaggttttttattattacttatcatcatactggatagtgttatgaaaaagtggaaggcagaaaggaggatgaatctatga

SEQ ID NO: 40614 - protein, 317 aa, Bacillus cereus E33L
MKRMLKMHETSIITLLLIYIAIVGMINPSFIQFNSLSLMVKSSVILVVLAIGQSFVLFTKNIDVSVGSSMGLSAAVCGMLLTNEYSASLSIFAAITLGAIIGFVNGMGVAKFRVPAIIMTLGMLGIIRGAMLIFTGGKWIEDIPNDFKQLSSIVILGLPITVWFVLIILLLLYFFLRKVPFGRYFYAVGDNEDGARLIGIPVNKVKICAFMISGISAALAGCIFVMNIGFIPNQTGTGLELQVIAAAVLGGIHLKGGTGSLFGAALGAFFLETISSSLVFLKIPAFWNNAISGFLLLLIIILDSVMKKWKAERRMNL

SEQ ID NO: 40615 - DNA, 975 bp, Mannheimia succiniciproducens MBEL55E
  CDS (1)..(975): transl_table=11
ttgattatgacttcaacaactcaagaaaaaagtgcgggttcattcagcaaaatctggaacgcttatggcatgctgttaatttttgcagtcatttttgtctgctcttgtgtatttatcccgaattttgccactgtggtgaatatgaaagggctgggtttggccatttctatgagcgggattgttgcctgcggtatgttgttctgcttagccgccggcgaaattgatctttccgtcgcttccgttattgcttgcgcgggggttgttacggcggtggtcattaatatgacgcaaagcgtgacaatcggtattcttgccggtctcggcctgggtattgccgtagggttaattaacggtttcgtaattgcgaaattaaaaatcaactcattaatcaccaccctcgccaccatgcagattgcccgcggtttcggttatattatttctgacggtaaagcggtgggtattaccaaagaagaattcttcgaattaggttatcaggatattttcggcgtgccgttaccgattatttttaccgttatctgtatggtcgtcttcggtttcttactcagtaaaaccacttacggacgcaataccctggctatcggcggtaatcaggaagcttcccgtttagccggtatcaatgtggacagaacaaaattaattatttttgtggtatcgggttttgtttccgcacttgccggcgtgattctggccgcccgtatgaccagcggtcaaccgatgacttccgtgggttttgaactggtggccatttcggcctgtgtattgggcggcgtttcattgaacggcggggtggcaaaaatttcatttattatcgccggggtgttaattctcggtaccatcgaaaatgccatgaacctactgaatatttcaccttttgcccaatatgtagtgcgcggtttaatcttgctgattgcggtaatttttgataaatataaacagaaatttatcaaatcttaa

SEQ ID NO: 40616 - protein, 324 aa, Mannheimia succiniciproducens MBEL55E
MIMTSTTQEKSAGSFSKIWNAYGMLLIFAVIFVCSCVFIPNFATVVNMKGLGLAISMSGIVACGMLFCLAAGEIDLSVASVIACAGVVTAVVINMTQSVTIGILAGLGLGIAVGLINGFVIAKLKINSLITTLATMQIARGFGYIISDGKAVGITKEEFFELGYQDIFGVPLPIIFTVICMVVFGFLLSKTTYGRNTLAIGGNQEASRLAGINVDRTKLIIFVVSGFVSALAGVILAARMTSGQPMTSVGFELVAISACVLGGVSLNGGVAKISFIIAGVLILGTIENAMNLLNISPFAQYVVRGLILLIAVIFDKYKQKFIKS

SEQ ID NO: 40617 - DNA, 933 bp, Mannheimia succiniciproducens MBEL55E
  CDS (1)..(933): transl_table=11
atgtcagcaattaaattaaatgtgcgggacgcaggtactcttgtcgggttagtgattatttttgtggttttctcatttttatcccccgtatttttcaccgtaccgaatctattaaatattctgcaacaatcatcactgaacgcagcaattgcacttggtatgactttagtgattatttccgcaggaattgatttatccgtcggtcccaccgcggcattgtccgcagtgcttggcgccagtttaatggtctccggcgttcccgttccgattgcggttttaggcgccctttgtatcgggtctttaggcgggcttttcaatggcgttttaatagcctatgccggtttgcagcctttcattgttacattaggcagtctttctctttatcgagcattatctttgatttatactggcggcaatcccatatttggtatcccggcggaatttagagcgtttatgaacggttctttattcggtattccaagctccattttaattgttgcaagtattgcattgattctatgggtagtattaaataaaaccccgttgggcgaatatatttttgctgtcggcggtaatgaggaagcggctcgggtttgtagcgttcctgtggcaaaaaccaaagttgcggtttatatgatttccggttttttggcttcggttgcaggtttagtactcgttggccgtcttggtgcggcagatcctaccctgggtaatttatgggagcttgatgctattgccgccgccgcaatcggcggagcatcactgatggggggaaaaggaagcattataggtaccatactgggtgcggttattctcggcgcattacgtaatggtctaacgctgttaaatattcaggcattctatcaattactcgcaacaggtttaattattattgtggccatgttaattgatagagcaacaagaggtaaataa

SEQ ID NO: 40618 - protein, 310 aa, Mannheimia succiniciproducens MBEL55E
MSAIKLNVRDAGTLVGLVIIFVVFSFLSPVFFTVPNLLNILQQSSLNAAIALGMTLVIISAGIDLSVGPTAALSAVLGASLMVSGVPVPIAVLGALCIGSLGGLFNGVLIAYAGLQPFIVTLGSLSLYRALSLIYTGGNPIFGIPAEFRAFMNGSLFGIPSSILIVASIALILWVVLNKTPLGEYIFAVGGNEEAARVCSVPVAKTKVAVYMISGFLASVAGLVLVGRLGAADPTLGNLWELDAIAAAAIGGASLMGGKGSIIGTILGAVILGALRNGLTLLNIQAFYQLLATGLIIIVAMLIDRATRGK

SEQ ID NO: 40619 - DNA, 1008 bp, Mannheimia succiniciproducens MBEL55E
  CDS (1)..(1008): transl_table=11
atggctggacaaaaaaataaaacatgggatttcttcaaacaaaatgccatttacttcgtcttattaattttattaggtgtaattattgctcaagacccatcattcttaaacctgatgaacttcagtaatattcttactcaatcttcggtgcgactaatcattgcattaggtatcgccggtttattggtggtacagggtaccgacttatcagccggtcgccaggtaggtttagccgctgtggtggccgccaccatgttacaggcaattgataacttaaaccgcgtatttccgaacctgcctgaaatgccgattttcgtagtgatactgattgtgtgctcaatcggtgccgtaatcggtttgatcaacggctttgtggtcgctatcttaaatgtaacgccgtttatcgccaccatgggtaccatgatcatcgtgtacggtttcaactcactttactatgatgcggtaggcggttcgccgattgccggattcagcgaaaacttttcttctttcgcgcaaggattcttccgtttcggttcctttaaactttcatacattacgatttacgccattatcgcgacaatcttaatgtggattttatggaacaaaactcgtttcggtaaaaatatctttgccatcggcggtaacccggaagcggcgcgtgtttcaggggtaaacgtaacacgcaacctattggttatctatatgttagccggcgtattctatgctttcggcggtatgttggaagccggccgtatcgggtctgcaaccaataacttaggtttcatgtacgaattggatgccatcgcagcctgtgtggtaggcggtgtatcattcgcgggcggcgtggggactatcatcggtgtagtaaccggggtgttaattttcaccgttatcaactacggtttaacctacatcggcgtaaacccgtactggcaatatattattaaaggtagcattatcatcttagccgttgctatcgactcattaaaatatgctaagaaaaaataa

SEQ ID NO: 40620 - protein, 335 aa, Mannheimia succiniciproducens MBEL55E
MAGQKNKTWDFFKQNAIYFVLLILLGVIIAQDPSFLNLMNFSNILTQSSVRLIIALGIAGLLVVQGTDLSAGRQVGLAAVVAATMLQAIDNLNRVFPNLPEMPIFVVILIVCSIGAVIGLINGFVVAILNVTPFIATMGTMIIVYGFNSLYYDAVGGSPIAGFSENFSSFAQGFFRFGSFKLSYITIYAIIATILMWILWNKTRFGKNIFAIGGNPEAARVSGVNVTRNLLVIYMLAGVFYAFGGMLEAGRIGSATNNLGFMYELDAIAACVVGGVSFAGGVGTIIGVVTGVLIFTVINYGLTYIGVNPYWQYIIKGSIIILAVAIDSLKYAKKK

SEQ ID NO: 40621 - DNA, 1029 bp, Mannheimia succiniciproducens MBEL55E
  CDS (1)..(1029): transl_table=11
atgttttcatttaaaaaattaatatccaaactgggaatcggattagtcttgttatttatgattataggcatgtctctgacctctcaggcgtttttatccaccaataatatcttcaatattttattgcaggtttccgtcatttgcgtgatttccgtggggatgacctacgttattctcaccggcggaatcgatttgtccgtaggttccatcgtggcgttaagtgcggtttgtctggggctgtttacccattggggagtggcatggcttggcgaaaatccgtcacaaggcgcattgctggctgtggtgttactgtccattgttggagccgttctggtcggtgccttatgcggctatgtgaacggcgtggtgattgtatacggcaaagttacctcgtttatcaccaccctcggtatgatggggatcgcacgcggcctggcgttaaccttatccgacggtaaaaccatttataatttccccgaacaactgcgttttttcggtaacggacgtcttgcggtgacggaaaatttcagtattccgattccggtgattatcgcccttatcgtcgtcttaatcagtttctatgtgttaactcaaaccgtgttcggtcgccagatttacgccctcggcggtaatcgcgaagcggtacggttgtccggtattaacgtgaataagttggaaatcaaaacctatgtgattaacggcgccttggcggccgtcggcgcggttattctggtggggcgtttaaacgccgcacaacctattgccggtacgggttatgagctggatgccattgccgcaacggtaatcggcggtaccagtctgatgggcggtgtgggttcggtggtcagcacctctatcggggcgcttattatgggggttctgcaaaacggtttgaccctattgaacgtaacctcttatctgcaacgcttgattatcggtatggtaattattcttgcggtattcctcgaccaattacgacgcggcgaagtatctaccggcggtttgagacgtattttcttcagagaataa

SEQ ID NO: 40622 - protein, 342 aa, Mannheimia succiniciproducens MBEL55E
MFSFKKLISKLGIGLVLLFMIIGMSLTSQAFLSTNNIFNILLQVSVICVISVGMTYVILTGGIDLSVGSIVALSAVCLGLFTHWGVAWLGENPSQGALLAVVLLSIVGAVLVGALCGYVNGVVIVYGKVTSFITTLGMMGIARGLALTLSDGKTIYNFPEQLRFFGNGRLAVTENFSIPIPVIIALIVVLISFYVLTQTVFGRQIYALGGNREAVRLSGINVNKLEIKTYVINGALAAVGAVILVGRLNAAQPIAGTGYELDAIAATVIGGTSLMGGVGSVVSTSIGALIMGVLQNGLTLLNVTSYLQRLIIGMVIILAVFLDQLRRGEVSTGGLRRIFFRE

SEQ ID NO: 40623 - DNA, 1005 bp, Burkholderia mallei ATCC 23344
  CDS (1)..(1005): transl_table=11
atgcatgaccggacggccgcgccgtctgcctcttgcgcgcccgccgccgcgagccccgctcgggccacgggccccgcgctcgccgcgctgcggcgctcgacgacgttctacccgctcgtcgggctcgtcgccgtgtgcgtcgcgatggtgttcgcgagcgacagcttcctgagcgcggcgaacctcgagaacgtgctgcggcaggtgtcgatcaacgcgatcatcggcgtcgggatgacctgcgtgatcctgacgggcggcatcgacctgtcggtcggctcggtgatggcgctgtccggcacgctcgcggcgggccttctcgtcgcgggcgcgaacggcgcggcggcgcttgccgcgggcatcggcgtcggggtcgcgctcggcgcggcgaacggcctgttcgtcgcgttcgccggcatgccgcccatcatcgtcacgctcgcgacgatgggcatcgcgcgcggcctcgcgctcatctacacgggcggctacccgatcgacgggctgcccgactgggtccgcttcttcggcagcggcaaggtgctcggcgtgcaaatgcccgtgctgacgatgctcgcggtctacgcgctcgcgtggctgatgctcgagcgcatgccgttcggccgctacgtctacgcgatcggcggcaacgagcacgcgacgcggctctcgggcgtgcgcgtgtcgcgcgtgaagctggccgtctatacgttcgcggggctcacgtccgcgctcgccgcgctcgtgctgacgggccgcctgatgagcgggcagccgaacgcggggggcggcttcgagctcgacgcgatcgccgccgtcgtgatgggcggcacgtcgatcgcgggcggccgcggctcgatcgtcggcacgcttgtcggcgcgctgctgctcggcgtgctgaacaacggcctgaacatgatcggcgtgaatccctacgtgcagaacgtgatcaagggcgccatcatcctgctcgcgatctacatcggccgcgagcgccgcacgtga

SEQ ID NO: 40624 - protein, 334 aa, Burkholderia mallei ATCC 23344
MHDRTAAPSASCAPAAASPARATGPALAALRRSTTFYPLVGLVAVCVAMVFASDSFLSAANLENVLRQVSINAIIGVGMTCVILTGGIDLSVGSVMALSGTLAAGLLVAGANGAAALAAGIGVGVALGAANGLFVAFAGMPPIIVTLATMGIARGLALIYTGGYPIDGLPDWVRFFGSGKVLGVQMPVLTMLAVYALAWLMLERMPFGRYVYAIGGNEHATRLSGVRVSRVKLAVYTFAGLTSALAALVLTGRLMSGQPNAGGGFELDAIAAVVMGGTSIAGGRGSIVGTLVGALLLGVLNNGLNMIGVNPYVQNVIKGAIILLAIYIGRERRT

SEQ ID NO: 40625 - DNA, 1005 bp, Burkholderia mallei ATCC 23344
  CDS (1)..(1005): transl_table=11
atgcaagcaagagagaatcttccaccggccgcggcgcacgcggcggccgtgccgaccgaggatcggcagcgctggcggcagcacgccgccgactacagtctcgtcgcgatcttcgcggcgatgttcgtcgcgatgtcgctgacggtcgatcatttcttctcgatcgacaacatgctcgggctcgcgctgtcgatctcgcagatcgggatggtcgcgtgcacgatgatgttctgcctcgcgtcgcgcgatttcgatctgtcgatcggctcgacggtcgcgttcgcgggcgtgctgtgcgcgatggtgctcaacgcgaccgacaacacgttcgtcgcgatcgcggcggcagtcgcggcgggcgccgtcatcggcttcgtcaacggcgcggtgatcgcctatctgcggatcaacgcgctgatcacgacgctcgcgacgatggagatcgtgcgcgggctcggcttcatcgtgtcgaaggggcaggcggtcggcgtgtcgtcggagacgttcatcgcgttgggcgggctcacgttcttcggcgtgtcgctgccgatctgggtgacgctcgcgtgcttcgtcgtgttcggcgtgctgctcaaccagaccgtgtacggccgcaacacgctcgcgatcggcggcaacccggaggcgtcgcggctcgccggcatcaacgtcgagcgcacgcgcgtctacatcttcctgatccagggcgcggtgaccgcgctcgcgggcgtgattctcgcgtcgcggatcacgtcgggccagccgaacgcggcgcagggcttcgagctgaacgtgatttccgcgtgcgtgctgggcggcgtgtcgctcgcgggcggacgcgcgtcgatctcgggcgtcgtgatcggcgtgctgatcatgggcaccgtcgagaacgtgatgaacctgctgaacatcgatgcgttctatcaatatctggtgcgcggcgcgatcctgctcgccgccgtgctgctcgaccagttgaagaaccgcggcgcgcgcgattga

SEQ ID NO: 40626 - protein, 334 aa, Burkholderia mallei ATCC 23344
MQARENLPPAAAHAAAVPTEDRQRWRQHAADYSLVAIFAAMFVAMSLTVDHFFSIDNMLGLALSISQIGMVACTMMFCLASRDFDLSIGSTVAFAGVLCAMVLNATDNTFVAIAAAVAAGAVIGFVNGAVIAYLRINALITTLATMEIVRGLGFIVSKGQAVGVSSETFIALGGLTFFGVSLPIWVTLACFVVFGVLLNQTVYGRNTLAIGGNPEASRLAGINVERTRVYIFLIQGAVTALAGVILASRITSGQPNAAQGFELNVISACVLGGVSLAGGRASISGVVIGVLIMGTVENVMNLLNIDAFYQYLVRGAILLAAVLLDQLKNRGARD

SEQ ID NO: 40627 - DNA, 1035 bp, Burkholderia pseudomallei K96243
  CDS (1)..(1035): transl_table=11
atgaaccaacagatcaagcaaagcgagaccgccgccgcgccgccgggcgcggcgcagccccgcgcgccgcggcgcgcggccgaccaccgcgcgcggatgcaggcgctgatgcgcacggccggcatgctgcccgtgctcgtgcttctgtgcgtgggcttcggcttcatgaccgacggcttcttcacgctgcagaacctgtcgatcgtcacgcagcaggcgtcgatcaacatcgtgctcgccgccggcatgacgttcgtgatcctgacgggcggcatcgacctgtcggtcggctcggtgctcgcggccgccgcggtcgcgtcgctgctcgcgtcgaacctccccggctggggctggctcggcattccggccgcgctcgccgtcgggctcgcgttcggcgtcgtcaacggcgggctgatctcgtttctgcgcctgccgcccttcatcgtcacgctcggcgcgctgaccgccgtgcgcggcatcgcgcgcctgatgggcaacgacacgacgatcttcaacccgcaactgccgttcgcgttcatcggcaacggctcgatcctcggcgtgccgtggctcgtcgtgatcgcgctcgccgtcgtcgcggtctcgtggttcatcctgcgccgcacggtgctcggcatgcggatctatgcggtcggcggcaaccccgaggccgcgcgcctgtcgggcatcaacgtgcgcggcatcgaactgttcgtctacgcgagctccggcctgctcgccggcctcggcgcgctgatgtccgccgcgcggctgtatgcggccaacggcctgcagctcggccagtcgtacgaactcgacgcgatcgccgcggtgatcctcggcggcacgagcttcgtcggcggcgtcggctcgatcgtcggcacgctggtcggcgcgctgatcatcgcggtgctgtcgaacgggctcgtgctgctcggcgtgtccgacatctggcagtacatcatcaaggggctcgtgatcatcggcgcggtcgcgctcgaccgctaccgtcagcacggatcggcccgcacctga

SEQ ID NO: 40628 - protein, 344 aa, Burkholderia pseudomallei K96243
MNQQIKQSETAAAPPGAAQPRAPRRAADHRARMQALMRTAGMLPVLVLLCVGFGFMTDGFFTLQNLSIVTQQASINIVLAAGMTFVILTGGIDLSVGSVLAAAAVASLLASNLPGWGWLGIPAALAVGLAFGVVNGGLISFLRLPPFIVTLGALTAVRGIARLMGNDTTIFNPQLPFAFIGNGSILGVPWLVVIALAVVAVSWFILRRTVLGMRIYAVGGNPEAARLSGINVRGIELFVYASSGLLAGLGALMSAARLYAANGLQLGQSYELDAIAAVILGGTSFVGGVGSIVGTLVGALIIAVLSNGLVLLGVSDIWQYIIKGLVIIGAVALDRYRQHGSART

SEQ ID NO: 40629 - DNA, 978 bp, Burkholderia pseudomallei K96243
  CDS (1)..(978): transl_table=11
atgaacactcagaccctgtcccgtctcgacgcggcgcccaggcgcgtgaacgtcgcggagctcgcgagccgcttcggcatcccgatcgtcttcgtcgcgctgtgcgtcgtgctcgcgttcgcgagcccgtacttcctcacctggcgcaactggagcgacatcctgcgccagacgtcgatcaacggcattctcgcgatcggcatgacgtacgtgatcctgaccaagggcatcgacctgtcggtgggctcggtgctcgcgctcgcgggcatcgtgagcggcctcgccggcgcggcggggcacgggctcgcggtgtcgctcgcggccggcgtcgcgtgcggcgcggcgctcggcgcgatcaacggcgtggcgatcgcgcgcttgaacgtgccgccgttcgtcgcgacgctcggcatgctgagcgtcgcgcgcggcgtcacgtacatcgccaacgacggcagcccggtcgcgaacctgcccgacgattacctgtcgctcggcatcggcaggctcggcccgctcggcatgccggtgctgatcttcgcgggcgtcgcgctcgcgtgctggtgggtgctgcgctacacgacatacggccgctatctgtatgcggtcggcggcaacgagaagagtgcgcgcacgtcgggcatcggcgtgcgcaaggtcgtgttctcggtgtacgtcgtctcgggcgcgctcgccggcctcgcggggatgatcctcgccgcgcgcacgacgtccgcgctgccgcaggcgggcgtgtcgtacgagctcgacgcgatcgcggccgtcgtgatcggcggcacgagcctgtcgggcgggcagggcggcgtcgtcggcacgctgttcggcgcgttgttgatcggcgtgatcaacaacgggctgaacctgctcggcgtgtcgtcgtattaccagcagatcgcgaagggactcatcatcgtgctggccgtgctcatcgacgtggcccgcaaacagcagcgctga

SEQ ID NO: 40630 - protein, 325 aa, Burkholderia pseudomallei K96243
MNTQTLSRLDAAPRRVNVAELASRFGIPIVFVALCVVLAFASPYFLTWRNWSDILRQTSINGILAIGMTYVILTKGIDLSVGSVLALAGIVSGLAGAAGHGLAVSLAAGVACGAALGAINGVAIARLNVPPFVATLGMLSVARGVTYIANDGSPVANLPDDYLSLGIGRLGPLGMPVLIFAGVALACWWVLRYTTYGRYLYAVGGNEKSARTSGIGVRKVVFSVYVVSGALAGLAGMILAARTTSALPQAGVSYELDAIAAVVIGGTSLSGGQGGVVGTLFGALLIGVINNGLNLLGVSSYYQQIAKGLIIVLAVLIDVARKQQR

SEQ ID NO: 40631 - DNA, 1176 bp, Photobacterium profundum SS9
  CDS (1)..(1176): transl_table=11
atggaacaggtaaaaagtgtggcgactcaaaggccaaaaagtaacctgcgtgaacagctacaaggtgtaaagttgcaattcatcgtaatggcggcagttatcgtcattattatgctgttcttcagcgtgatgacggaatggagttacctgtccccacggaacatttccaatctattcagacaaacagccattaccggtattctttccatcggaatggtgtttgtcatcattagcggtgaaattgatttatctgttggatcgatgatgggtttactagggggcgtggctgctattttagatgtgtggtttggcttacctttgcctttgaccattgtactcacattgatcgctggttttttgcttggtttatggaatggttggtgggtggcttatcgtaaagtgccgtcatttattgtgacgttagctggcatgttggcgtttcgtggcattcttattggcattactgatggcacaactgtggctcctacgtctcaggcaatggggttcattggtcaaagttacctccctagttggtttggcatgctccttggtgtgggtagcttgtccttatatatttattggcagcaacgtcgtagaagtatgaggcagcagtataatttacccgttccgatggcaagtacgtcgttggtgaagcaagcggctgtgggcgtggcggtattaagcattattcttgtgcttaatgattaccgtggcgttccgacgccagtattactgctcgtgaccttcttgatagtcggctcttttattgcgagtaaaactcggcttggtcgacgtgtttacgccattgggggcaatattgaagcaagccgattatcgggtattaatgtagagaaaaccaagttgtctgttttcgctatgagtggttttttggtggcggtagctgcattaattttaagcagtcgcttaggggcgggttcgccatcggctggtaatattgccgaactggatgccattgctgcctgtgttattggtggcacgagtatggcggggggggttggtaccgttattggtgcggtgatcggtgcatttatcatggcatcgttggataatggcatgagtatgatggatgtgcctaccttctggcaatatattgttaaaggtggaattttactgttagcagtgtggatggatagtgcgacaaaagcccgacgctaa

SEQ ID NO: 40632 - protein, 391 aa, Photobacterium profundum SS9
MEQVKSVATQRPKSNLREQLQGVKLQFIVMAAVIVIIMLFFSVMTEWSYLSPRNISNLFRQTAITGILSIGMVFVIISGEIDLSVGSMMGLLGGVAAILDVWFGLPLPLTIVLTLIAGFLLGLWNGWWVAYRKVPSFIVTLAGMLAFRGILIGITDGTTVAPTSQAMGFIGQSYLPSWFGMLLGVGSLSLYIYWQQRRRSMRQQYNLPVPMASTSLVKQAAVGVAVLSIILVLNDYRGVPTPVLLLVTFLIVGSFIASKTRLGRRVYAIGGNIEASRLSGINVEKTKLSVFAMSGFLVAVAALILSSRLGAGSPSAGNIAELDAIAACVIGGTSMAGGVGTVIGAVIGAFIMASLDNGMSMMDVPTFWQYIVKGGILLLAVWMDSATKARR

SEQ ID NO: 40633 - DNA, 1017 bp, Photobacterium profundum SS9
  CDS (1)..(1017): transl_table=11
atgctagctaaacttcttcaagccacttcagatcaaccgaagggcgcaaatacaaaacgctttatatccaaatacgctatctattttgtctttatcgcaatgtgtattgtgatgagtattttgtctcctgttttcttaacagtggccaacctacttaacgtaatgacacaaatggcaagtattggtctgctggcgcttggcgttaccattatcattattacacgaggtatcgatctttcatctggttctgttctcgctgttgcggccgttgtatctgcaagtaccgcccaatcacttgattggggcatgagaatgtaccctaacctgccagaactacctattattgtgccaattttagtggcacttgccgtcggtgcattatgtggtttgataaacggtgcacttattgcctatacgggtattcctccttttattgccacactaggtatgatgattatcgctcgtggtgctgcactactgtattcagatggtcgcccagtcagtagcctaatcgagtcataccagtggattggtcaaggaacgatagcggggatccccgtgcctgtggtgatatttttggtgatggcgttcattacgtacattttacttaattacactcgatttggtaaatacgcctacgccattggtggtaatgaaacagccgcatatgtatctggcattaacgtgactaaatacaagattcttgtctatgtatatgcaggtttacttgcaggtattgccgcactgattctgactgcacgtattaactcaggtcagccaggtcttggggtgatgtatgagcttgatgccatcgcatctgcaaccgttggtggtgtgagccatgccggtggtatcggcacaattcagggcaccattgtcggcgtcatgatcatgggtgtgctacaaaatgggcttgatttattgaatgtctcggcctattggcagcaagtcgtaaaaggcttagtcattgttgttgctgttattttcgatatgaaacgacagaaaaagagtaagtaa

SEQ ID NO: 40634 - protein, 338 aa, Photobacterium profundum SS9
MLAKLLQATSDQPKGANTKRFISKYAIYFVFIAMCIVMSILSPVFLTVANLLNVMTQMASIGLLALGVTIIIITRGIDLSSGSVLAVAAVVSASTAQSLDWGMRMYPNLPELPIIVPILVALAVGALCGLINGALIAYTGIPPFIATLGMMIIARGAALLYSDGRPVSSLIESYQWIGQGTIAGIPVPVVIFLVMAFITYILLNYTRFGKYAYAIGGNETAAYVSGINVTKYKILVYVYAGLLAGIAALILTARINSGQPGLGVMYELDAIASATVGGVSHAGGIGTIQGTIVGVMIMGVLQNGLDLLNVSAYWQQVVKGLVIVVAVIFDMKRQKKSK

SEQ ID NO: 40635 - DNA, 999 bp, Photobacterium profundum SS9
  CDS (1)..(999): transl_table=11
atgcgtgatcgtgtgcgttttcattgggatgctttaataaagcgtcatgaattttatctagcagctcttattggtttaatggttgttgggttaggaataagctctgaagattttttaacactgggcaatatttttgatatgtctgtgagttctgccattttgggtatcatggcttgtgggctttttgttgtactgatcgcgggtggtattgatatttcatttccagccactgctgcgatagcgcagtacgttatggcaacgtatgtgttgtctattggtggaaacttctttattgcttttctgattgccgctgttgtgggtatgttgcttggacttatcaatgccatattggtgtataagctgaaagtgccagccattatcattacgatttcgacgctcaatgtattctttggtttactgatttattttagtaatggtgcttggttatacggtttcccagattggtttatggatggggttgagttgtttacctttgtgggtagcgacggatacgactatggcttatctcttccaattataatgcttgtcgctgtcgttttatttacgtcatttttaatgtctaaaacacgtttaggtcgtcagatttatgcgatgggcggtaatgctgatgctgcgagtcgaattggtattaatttatttggtattcacctgtttgtttacggctacatgggggcattagcgggaattgcctcagtggtacaaacccaaattacacagtcagttgcacctaactcattaatgggctttgagctgacggttttagccgcggtggtattaggcggaacgagtatgacaggggggaaaggcacgttaataggggttgttcttggtgtggcgctgttagccattttgaagaatggattaacgctgctgggagttccttcctattggcatgcggttgtcactggtctcatcattgtattcagcatcagtatgactgctctgaatgaaaagaaacaagcattgcagggggcgtaa

SEQ ID NO: 40636 - protein, 332 aa, Photobacterium profundum SS9
MRDRVRFHWDALIKRHEFYLAALIGLMVVGLGISSEDFLTLGNIFDMSVSSAILGIMACGLFVVLIAGGIDISFPATAAIAQYVMATYVLSIGGNFFIAFLIAAVVGMLLGLINAILVYKLKVPAIIITISTLNVFFGLLIYFSNGAWLYGFPDWFMDGVELFTFVGSDGYDYGLSLPIIMLVAVVLFTSFLMSKTRLGRQIYAMGGNADAASRIGINLFGIHLFVYGYMGALAGIASVVQTQITQSVAPNSLMGFELTVLAAVVLGGTSMTGGKGTLIGVVLGVALLAILKNGLTLLGVPSYWHAVVTGLIIVFSISMTALNEKKQALQGA

SEQ ID NO: 40637 - DNA, 990 bp, Photobacterium profundum SS9
  CDS (1)..(990): transl_table=11
atgagcagcaacgcgatgaccaaaacagacgattcaaaaaacaaaacaggtaagctgttcactaaagaatggttaattgaacaaaaatcactgatcgcattgatcttactgattgttgtcgtgtctttccttaaccccaacttctttactgtcgacaacattttaaacattcttcgccaaacctcgataaacgcaattattgcagtcggtatgacactggttattttaactgcgggtatcgacctaagtgtgggatctgttttggcgctgtgtggtgcatttgccgccaccatgattggtcttgaaattccagccattattgccgtaccaacagcccttctagcgggtgctgctttaggtgcaatcagcggtattattattgccaaaggtaaagtgcaagcatttattgccaccttggtaaccatgacattgctgcgtggtgtcaccatggtttacaccgatggtcgccctatttctactggctttacagaggtagcagatggctttgcatggttcggtacaggttacgcaatgggtattcctgttcctatctggctaatggttattgtattcgcttctatctggtatttattgaatcacactcgcttcggtcgttacatctacgcactgggcggtaatgaatcagcaactcgcttatcaggcattaacgtagatcgcgtcaagattggcgtctacgctatctgtggcctgttagccgcccttgctggcatcattgtaacctctcgtctttcatctgctcagccaaccgctggtatgggatacgaactggatgcgattgctgctgtcgtattgggtggtaccagccttgctggtggtaaaggtcgcattatgggcacactggttggtgcgcttattatcggcttcttaaacaatgcactaaacctgttagacgtgtcttcatactaccaaatgattgcaaaagcagtggtaatcttgcttgcggtactggtagataataaaaataagtaa

SEQ ID NO: 40638 - protein, 329 aa, Photobacterium profundum SS9
MSSNAMTKTDDSKNKTGKLFTKEWLIEQKSLIALILLIVVVSFLNPNFFTVDNILNILRQTSINAIIAVGMTLVILTAGIDLSVGSVLALCGAFAATMIGLEIPAIIAVPTALLAGAALGAISGIIIAKGKVQAFIATLVTMTLLRGVTMVYTDGRPISTGFTEVADGFAWFGTGYAMGIPVPIWLMVIVFASIWYLLNHTRFGRYIYALGGNESATRLSGINVDRVKIGVYAICGLLAALAGIIVTSRLSSAQPTAGMGYELDAIAAVVLGGTSLAGGKGRIMGTLVGALIIGFLNNALNLLDVSSYYQMIAKAVVILLAVLVDNKNK

SEQ ID NO: 40639 - DNA, 1011 bp, Photobacterium profundum SS9
  CDS (1)..(1011): transl_table=11
atggaaactttaaaaaaactcagcatgatgcgctacctcaaagaagggggcatttatgcagtactatttattttattaacaattattattattcaagaaccaagctttttaagcttaagaaacctgagtaatattcttacccaatcatctgtacgtattattattgcattgggtgttgcagggcttattgttacccaaggtactgatttatccgcaggtcgtcaggtaggtttggctgcggtattatcggctaccttgcttcaagcggcagataacgttaataaggtttttcccaatgttggtgaaatcccaattgttggcgtcattatcgttgtgtgtgccgtgggtgcgctaatcggtttgattaacggcattatcgttgcgtatttacatgtgaccccgtttatagccacactgggttcaatgatcatggtatacggtgttaactcactatactttgattccgtaggggcatcaccggttgctggttttgatgagcgtttttctgaatttgctcaaggctttattcgctttggtgattttagattatcgtaccttacgttttacgccattattgccatcatatttgtctggattatatggaataaaactgtttttggtaagaacatttttgcgattgggggtaatccagaagcggcaaaagtatcgggtgttaacgtgccgatcacactgcttaaaatctatgccttatcgggtgtgttctacgcatttggcggcatgttagaagcggggcgaattggtagtgcgactaacaaccttggtttcatgtacgaacttgatgccattgctgcctgtgtagtgggtggtgtgtcatttgcgggtggtgtaggtagtgttgcaggtgttgtaacaggggtattaatctttaccgtgattaactacggcatgacgtatattggtgttagcccttactggcagtacattattaaaggcggcattattattttcgcagtagcgcttgattcaatgaagtatgcaaacaaaaaataa

SEQ ID NO: 40640 - protein, 336 aa, Photobacterium profundum SS9
METLKKLSMMRYLKEGGIYAVLFILLTIIIIQEPSFLSLRNLSNILTQSSVRIIIALGVAGLIVTQGTDLSAGRQVGLAAVLSATLLQAADNVNKVFPNVGEIPIVGVIIVVCAVGALIGLINGIIVAYLHVTPFIATLGSMIMVYGVNSLYFDSVGASPVAGFDERFSEFAQGFIRFGDFRLSYLTFYAIIAIIFVWIIWNKTVFGKNIFAIGGNPEAAKVSGVNVPITLLKIYALSGVFYAFGGMLEAGRIGSATNNLGFMYELDAIAACVVGGVSFAGGVGSVAGVVTGVLIFTVINYGMTYIGVSPYWQYIIKGGIIIFAVALDSMKYANKK

SEQ ID NO: 40641 - DNA, 1014 bp, Geobacillus kaustophilus HTA426
  CDS (1)..(1014): transl_table=11
atgagccagccagccgtttccacaacgccgtcgaaaaaaacggcgccgtccattcttgaatggttgtataaacacggcaccttgctggccattcttgccgttatcgcctacttcggcatcacgcaagaccgattttttacgtatgaaaacttcagtgacattttgcggtccatttcgatcgtgacgctcgtggcaatcggcattacgttttcgctcatcgtcgatggcttcgatttgtccgtcggctcgacggtgagcctagcgacgatcgcgagcgcagcggcgctcgtcctgtaccgccaagaaattttcatcaccctgctcgtgccgctgttgctcggcattgctgtcgggctcttgaactcgttgttgatcgtcaaattcaaattgcccgatttgctcgcgacgttggcgacgatgtacgccattaacggcgtgcagctcacctatacgaaagggttttcgatctacaacgacatgccgctgcccgatggcggcacggcgccgggcaaattcattccttcctttttatttatcggccagggagagctgttcggcgtgccgttttcggtcttgcttatgctgtttgtcgtcattgccgctcatctgtttttaacgtacacgaaacccggccgcctcttttatttgaccggggaaaaccgcgaggcggcaaggctctcaggcatcccggtcaaccgctatcggacatatgcatacgtcatcagcgggttttttgcggccttaggcggcatcgtccttgcctcgcgcatcggcaccgggcaagtgtcggccggcgcctcgcttttaatggacagcgtcgccgccgcctacatcggcttttccgtctttggcgccggcaagccgaacgtcatcggcacattgttcggctcgattttaatgggcgtgttgctgaacggcttgacgatggcaaacgttccgtattacgcccaagacattataaaaggcgccattttagtcggcgccctcgccttgtcgcattggcaaaaaaaataa

SEQ ID NO: 40642 - protein, 337 aa, Geobacillus kaustophilus HTA426
MSQPAVSTTPSKKTAPSILEWLYKHGTLLAILAVIAYFGITQDRFFTYENFSDILRSISIVTLVAIGITFSLIVDGFDLSVGSTVSLATIASAAALVLYRQEIFITLLVPLLLGIAVGLLNSLLIVKFKLPDLLATLATMYAINGVQLTYTKGFSIYNDMPLPDGGTAPGKFIPSFLFIGQGELFGVPFSVLLMLFVVIAAHLFLTYTKPGRLFYLTGENREAARLSGIPVNRYRTYAYVISGFFAALGGIVLASRIGTGQVSAGASLLMDSVAAAYIGFSVFGAGKPNVIGTLFGSILMGVLLNGLTMANVPYYAQDIIKGAILVGALALSHWQKK

SEQ ID NO: 40643 - DNA, 1200 bp, Geobacillus kaustophilus HTA426
  CDS (1)..(1200): transl_table=11
ttgtgcaacgggaggaaaatgaggatgaaaagcccgatttctatagcgaccttagagagtcaaacaaaagggaagatacgatggaaatttgattttcgttcttatacgctaattatagccttagtctttatcgctgttattttcagtgttttaactgacggagagtttgtatcgtcacgaaatttatcgaacttatttatgcagatgtctgtcatttcgattttggcgatcggcatgacactagtcattatagcaggccatattgacttatcagttggatctgttgtcggattgaccgggggaatcgctgcgattttgcaagtatggtatggctggggaacagtctctgttattgttgtggctattgttgctggcgtattaattggactttggcaaggatggtgggttgcttatcgaggtgttcctgctttcattgtaactttaggtgggatgttagtttttcgaggaattttgattggaattagcaatggcgagactgtagcgccgttagacaatagtttcgaagcgataggaaacagttatctcccttacgtaatcggctacattttagctgctgtcagcatcattttattgtttctttctttaggacgaaatagaaagaaacgaaaacagttaggcttaacgctcaattccaaaataaatgattatggcaaaacagcagtctactcgctatgcattttcgtattggtgtatatgttaaatcgttattacggtgttcctattccgatgctgatcgttgttttattggcgcttgtctttgtgtttattgccgttaaaaccccgtttggacgatatatttatgcgattggtggaaatattgaggcggccgctctatctgggatcaacatcaagcgtgttgtattggctgtcttcatcttaatgggagcgctttcggcggtggcgggtatcattttgacaagccgactcaatgcagcgacagtcagcgctggggagatgtatgaattggatgctattgctgcttgtgttattggtggcacgagtttaatggggggaaggggaaatattgttggggcgattatcggcgcccttattatggctagtatcgataacggtatgagcatgatgaacattgagaccttttggcaatacattgtgaaaggattaattttaattgttgccgtttggacggatatctcaagcaaaagtaaggcgagttga

SEQ ID NO: 40644 - protein, 399 aa, Geobacillus kaustophilus HTA426
MCNGRKMRMKSPISIATLESQTKGKIRWKFDFRSYTLIIALVFIAVIFSVLTDGEFVSSRNLSNLFMQMSVISILAIGMTLVIIAGHIDLSVGSVVGLTGGIAAILQVWYGWGTVSVIVVAIVAGVLIGLWQGWWVAYRGVPAFIVTLGGMLVFRGILIGISNGETVAPLDNSFEAIGNSYLPYVIGYILAAVSIILLFLSLGRNRKKRKQLGLTLNSKINDYGKTAVYSLCIFVLVYMLNRYYGVPIPMLIVVLLALVFVFIAVKTPFGRYIYAIGGNIEAAALSGINIKRVVLAVFILMGALSAVAGIILTSRLNAATVSAGEMYELDAIAACVIGGTSLMGGRGNIVGAIIGALIMASIDNGMSMMNIETFWQYIVKGLILIVAVWTDISSKSKAS

SEQ ID NO: 40645 - DNA, 1005 bp, Geobacillus kaustophilus HTA426
  CDS (1)..(1005): transl_table=11
atggaaagccaagtttctgttacgaacaagcgggagaaggcaggggtttcttccacggccacgtcgaaggacaaattgtatcgatttttcgaccgctatggaatgttgatgattctcattgggctcgtcattttgatgtccattctttcgccgacgttttttacaaccggcaacttattaaatatcgttcggcaaatgtcggtcgtcggcattgtcgcgattggcgtcacgattgtcattattacgaccggcattgatttgtcatcgggatccgtcattgcacttgtgtcggttgtggccgccagttttgcccacccggatacgtatcccgtgattgttccgattttgattggtcttgggttagggcttttgactggggtcataaacggaacgattatttcgaaggcgaacattgccccgtttatcgtcacattgggcatgatgacggccgcgagaggggcagcgctgttattcagcgacgggagaccgattgggaatttgtcgccatcgttcttatggattggccaaggagatgttttggggattccggttccgattctcatctttgcgcttgtaggggtcatttcttacattctcttaaataaaacgaagtttggcaaatatgtctatgcaatcggcggaaatgagcaggccgccgtcattgccggggtcaatgtcgataaatataagattttcgtttacggatacgctggtctgttgtccggattggcgggggtcatcttgacttcgcgcatttcctcggggcagccgacggcagggatgatgtatgaactcgatgccatcgctgcggcggtcattggcggtacaagccttgctggcgggattgggacgatcggcggcacgattgtcggtgcgctcattatcggggtgatgaacaacggacttgacttgttaaacgtttcgccgtattggcaacaaattctgaaaggcgtcattattacggtggcggtgttcatcgattcccgcaaaaaccggaaatcataa

SEQ ID NO: 40646 - protein, 334 aa, Geobacillus kaustophilus HTA426
MESQVSVTNKREKAGVSSTATSKDKLYRFFDRYGMLMILIGLVILMSILSPTFFTTGNLLNIVRQMSVVGIVAIGVTIVIITTGIDLSSGSVIALVSVVAASFAHPDTYPVIVPILIGLGLGLLTGVINGTIISKANIAPFIVTLGMMTAARGAALLFSDGRPIGNLSPSFLWIGQGDVLGIPVPILIFALVGVISYILLNKTKFGKYVYAIGGNEQAAVIAGVNVDKYKIFVYGYAGLLSGLAGVILTSRISSGQPTAGMMYELDAIAAAVIGGTSLAGGIGTIGGTIVGALIIGVMNNGLDLLNVSPYWQQILKGVIITVAVFIDSRKNRKS

SEQ ID NO: 40647 - DNA, 1224 bp, Geobacillus kaustophilus HTA426
  CDS (1)..(1224): transl_table=11
atgggagcactaatgcaaaaaacagcacaacattctccaaagcggtctacagaaagtcagcagttatcgttgaagcagatgatcaaaaacaatatgagaagttacagtatggtcatcgctctcattttgattatgttattgttccaagtgttaactggaggcattttgttgcggccattaaatattacaaacttgattttgcaaaacagttatattttggtgctggctgttggcatgatgcttgttattatcactgggcatattgatttgtccgtcggatcggtggcagcttttgtcggggcattggctggcattctgatggttcagcaccatgtatcagtatggttgacggtgctcatttgtttattgctcggtgccttgattggcgcatggcaaggattttgggtagcgtacgtaaaaattccatcattcattgttacattagcagggatgttgctgttccgaggattaacgatggtcattttggaaggacagtcgatcgccccgttcccaaaaacattccaaaatatgagttccgggtttctccctgacgtatttcatggaggagagatccatctgttcaccattgtgatcggcttcgccgcttctctcttatttgttgtactggaatggagaaaacgaaacagccagaaaaaatatgggtttgcggtcacccctgcgtcgatgtttaccttgaagctggctgtgattgccgctgtaatcatgattttcacttatattttagcgacgtacgaaggaattccaacgattctagtgattttggctgcgttgatcatcgcttattcctttgtggcgaatcggacggtcgtcggccgccatatttatgcgattggtggtaatgagaaggctgcgcaactgtccgggattaaaacgaaacgtgtcacgttttgggtgtttgtcaacatgggcgtgttggccgctttgtccggattgatttttgccgctcgcctcaacgctgcgacgccgaaagcggggaacttgtttgagctcgatgccattgcggcgtgctttattggaggcgcatccgcttatggaggaatcggcacgattagcggagcgatcatcggcggtctagtcatgggcgtaatgaataacgggatgtccttgctggggctcggtattgactggcaacaggccatcaaagggcttgtattgcttattgctgtggcttttgatatttacaacaaaaataaagctgcttaa

SEQ ID NO: 40648 - protein, 407 aa, Geobacillus kaustophilus HTA426
MGALMQKTAQHSPKRSTESQQLSLKQMIKNNMRSYSMVIALILIMLLFQVLTGGILLRPLNITNLILQNSYILVLAVGMMLVIITGHIDLSVGSVAAFVGALAGILMVQHHVSVWLTVLICLLLGALIGAWQGFWVAYVKIPSFIVTLAGMLLFRGLTMVILEGQSIAPFPKTFQNMSSGFLPDVFHGGEIHLFTIVIGFAASLLFVVLEWRKRNSQKKYGFAVTPASMFTLKLAVIAAVIMIFTYILATYEGIPTILVILAALIIAYSFVANRTVVGRHIYAIGGNEKAAQLSGIKTKRVTFWVFVNMGVLAALSGLIFAARLNAATPKAGNLFELDAIAACFIGGASAYGGIGTISGAIIGGLVMGVMNNGMSLLGLGIDWQQAIKGLVLLIAVAFDIYNKNKAA

SEQ ID NO: 40649 - DNA, 945 bp, Geobacillus kaustophilus HTA426
  CDS (1)..(945): transl_table=11
atgatgggagcaaagcgaaaatgggatgtgaaaaaactagggcctttgatcgggctgtttctgctatgcatcgtgctttccatattgagcgatgactttttgacgatggacaactggctcaatctcctgcggcaagtatcgattaacgcgctcatcgcctttggcatgacgtttgtcattttaacgggaggcattgatttatcggtcggttcggtgttggcgttatcaagcacgatcacagcaggaatgatggcgcaaggggtcaatggatttgttgcgatattcgtcggcttattagcaggcgcggccatgggcgtcttgaacggagtcttggtcaccaaaggaaaagtggctccttttattgccacgctggcgaccatgacggcgtttcgcggcttgactctcgtttacacggacggtcgcccgattacagggtttgcgtctgatgacatcctgtttcagatgatggggcgcggttatttcttcggcattcccgtacctattatattgatgctcacggtctatatcgctttgtatgtagtattgaaaaagactacatttggccgccatacgtacgcgattggcgggaacgaagaagcgagccgtctatcgggacttcgcgttgatcgactcaaaatatatgtgtatgccctaacaggggcgttatctgctttggcggggctcattttaacttcccgtttgaattccgcgcagccgacagcgggaacggcgtacgagttggatgccattgcggccgttgttttaggcggcaccagtttgtcaggaggaagaggctggattttcggcacgttagtcggcgccttgattatcggtgtattgaacaatggattgaacttgctcaatgtgtcgtcgttttaccagcaagtcatcaaaggagcggtcattcttcttgcggtgctgttagaccgccgcaaagaagtatga

SEQ ID NO: 40650 - protein, 314 aa, Geobacillus kaustophilus HTA426
MMGAKRKWDVKKLGPLIGLFLLCIVLSILSDDFLTMDNWLNLLRQVSINALIAFGMTFVILTGGIDLSVGSVLALSSTITAGMMAQGVNGFVAIFVGLLAGAAMGVLNGVLVTKGKVAPFIATLATMTAFRGLTLVYTDGRPITGFASDDILFQMMGRGYFFGIPVPIILMLTVYIALYVVLKKTTFGRHTYAIGGNEEASRLSGLRVDRLKIYVYALTGALSALAGLILTSRLNSAQPTAGTAYELDAIAAVVLGGTSLSGGRGWIFGTLVGALIIGVLNNGLNLLNVSSFYQQVIKGAVILLAVLLDRRKEV

SEQ ID NO: 40651 - DNA, 1011 bp, Salmonella enterica subsp. enterica serovar Paratyphi A str. ATCC
  CDS (1)..(1011): transl_table=11
atgagtgcgttaaacaagaaaagctttttgacctggctgaaagagggcggaatttacgtcgttcttttagtgttgctggcgattattattttccaggacccgacttttttaagtttgctgaatttaagtaatattctgacgcaatcttcggtacgtattattatcgcgctgggcgtggcgggactcatcgtcacccaggggacagacctgtcggcggggcgtcaggtagggctggcggcggtcgtggcggcaacattactgcaatcaatggaaaacgccaataaagtgtttccggaaatggcgaccatgccgattgcgctggtcatcctgattgtctgcgcgattggcgcggtgattggcctggtgaacggcatcatcattgcttacctgaacgtgacgccgtttattaccacgcttggcacgatgattatcgtttatgggatcaactccctttactatgattttgtcggcgcttcgcccatttccggctttgacagcggcttttccacctttgcacagggctttgtggcgatgggcagtttccggctctcatacatcaccttttacgctctgattgcggtagcgtttgtctgggtgctgtggaataagacccgttttggtaaaaacatttttgctattggcggcaacccggaggcggcgaaagtttctggcgtaaacgtggcgctgaacctgctgatgatttatgcgctctccggcgtgttttatgccttcggcagcttactggaagcagggcgtattggttctgccaccaacaacctcggctttatgtatgaactggatgcgattgccgcgtgcgttgtcgggggcgtatcgtttagcggcggagtggggacggtcttcggcgtggtgaccggcgtcattatctttaccgtcatcaactatggcctgacctatatcggggtaaacccgtactggcagtacattatcaaaggcggcattatcattttcgccgtggcgctggactcgctgaaatacgcgcgtaagaagtag

SEQ ID NO: 40652 - protein, 336 aa, Salmonella enterica subsp. enterica serovar Paratyphi A str. ATCC
MSALNKKSFLTWLKEGGIYVVLLVLLAIIIFQDPTFLSLLNLSNILTQSSVRIIIALGVAGLIVTQGTDLSAGRQVGLAAVVAATLLQSMENANKVFPEMATMPIALVILIVCAIGAVIGLVNGIIIAYLNVTPFITTLGTMIIVYGINSLYYDFVGASPISGFDSGFSTFAQGFVAMGSFRLSYITFYALIAVAFVWVLWNKTRFGKNIFAIGGNPEAAKVSGVNVALNLLMIYALSGVFYAFGSLLEAGRIGSATNNLGFMYELDAIAACVVGGVSFSGGVGTVFGVVTGVIIFTVINYGLTYIGVNPYWQYIIKGGIIIFAVALDSLKYARKK

SEQ ID NO: 40653 - DNA, 1044 bp, Salmonella enterica subsp. enterica serovar Paratyphi A str. ATCC
  CDS (1)..(1044): transl_table=11
atgttgaaattcatccaaaataaccgggaagcgacggcactgctggcaatagtctgtttattcgtgtttcctggcgcgctggatagccagtatttgagcgtgcaaacgctgacaatggttttcagtagcgcgcaaattttgatgctgttggcgattggcgcgacgatggtaatgctcacccgcaatattgatgtatcggtgggctcgacgacaggaatgtgcgcggtattgctgggagtgatgttaaacgccggctatagcctgccggtcgcctgcctggccacactaatattaggaattgtcgccggattttttaatggcgtactggttgcctggttgaagatacccgccattgtcgccacgctgggaacgctgggcttgtatcgtgggatcatgctgctatggacagggggaaaatggattgaaggattacccgcaggcttaaagcaactctctgctccggtgtttctgggaatttccgcaatcggctggtttaccctggtgttagcgctgcttatggcctggctcctggcgaaaaccgcctttggccgcaatttttacgccaccggcgataacctgcagggcgcccggcaattgggtgtccgtaccgagatggtacgcatcatggcattttcacttaatggcggtatggcggcattggctggaatcgtgtttgcctcgcagattggcttcattcccaatcaaaccggcacggggctggaaatgaaagccatcgcggcctgcgtattggggggaattagcctgttaggcgggtcaggcacggtcatcggcgctattctcggcgcttattttcttacgcaaatcgatagtgtgttagtgctgctgcgtatccccgcctggtggaacgattttattgctggcctggtattgttgggcgtactggtattcgatgggcggctgcgttgcgcattacaacgcaatctgcgccgccagaaatatgcccgttttatatcaccacccactccactacagacggaagcaaaaacgcacgcacaacagaataaaaacaaagaggtggcatga

SEQ ID NO: 40654 - protein, 347 aa, Salmonella enterica subsp. enterica serovar Paratyphi A str. ATCC
MLKFIQNNREATALLAIVCLFVFPGALDSQYLSVQTLTMVFSSAQILMLLAIGATMVMLTRNIDVSVGSTTGMCAVLLGVMLNAGYSLPVACLATLILGIVAGFFNGVLVAWLKIPAIVATLGTLGLYRGIMLLWTGGKWIEGLPAGLKQLSAPVFLGISAIGWFTLVLALLMAWLLAKTAFGRNFYATGDNLQGARQLGVRTEMVRIMAFSLNGGMAALAGIVFASQIGFIPNQTGTGLEMKAIAACVLGGISLLGGSGTVIGAILGAYFLTQIDSVLVLLRIPAWWNDFIAGLVLLGVLVFDGRLRCALQRNLRRQKYARFISPPTPLQTEAKTHAQQNKNKEVA

SEQ ID NO: 40655 - DNA, 1299 bp, Silicibacter pomeroyi DSS-3
  CDS (1)..(1299): transl_table=11
atgactcattccgaggcggagctgtccccggcacatcccaagaaatcctttgtacagacgctggaactggatctgcgccttctgggcatgatcggggcctttgcgatcctgtgcgtcgggttcgacatcgtgaccggcggccgtttcctgacaccgcgcaacatcttcaacctgaccatccagaccgtttcggttgcgatcatggccaccggcatggtgttcgtcatcgtcacccgtcatatcgatctgagcgtcggcgccctgctggccacctgctcggcagtgatggcgatgacccagaccgagatcctgcccaacatgctgggcctggggctgggccatccgctgatcccctgggtgaccatccttgtcggcctgctggtggggtcgctgatcggtgcctttcacggctggctggtgggctatctcgccatccccgcctttatcgtcacgctgggcggactgctggtctggcgcaatgtcggctggtacctgaccagcggcaagaccatcggcccgctggacccgaccttcatgcaattcggcggcatcaatggaacgctgggcgccacctggtcctggatcgtcggtctgctggcgctggccgccgcgctctatggtctgtgggcgagccgcaagaacaagctccgccatgggttcccggtcaagccgctctgggccgagggggttctggcggcgctgatctcgggcgcgatcctgggctttgtcgccatcctgaacgcctatgaggtgccactggcccggctcaagcgcgatttcgcggcgcagggcctgaccttgcccgaaggctataccgaggcttatggcatcccgatctcggtgcttctgctgatctttatcgcggtgggcatgaccatgctggcacgccgaacccggctgggccgctatatctttgccaccgggggcaacccggatgcggcggaactgagcggcatcaacacccggctgctgacggtcaagatctttgcgctgatgggcgcgctctgcgccatctcggcggtggtggcctcggcccggctgaccaaccattccaacgacatcggcacgctggacgaactgcgcgtgatcgcggccgccgtgatcggcggcaccgcgctggcggggggcttcggcaccatccacggcgccatcctgggcgcgctgatcatgcagtcgctgcaatcgggcatggccatggtcggtgtcgacgcgcccttgcagaatatcgtcgtgggcgcggttctggtgctggcggttctgatcgacattctctatcgcagaaagacgggggcacggtga

SEQ ID NO: 40656 - protein, 432 aa, Silicibacter pomeroyi DSS-3
MTHSEAELSPAHPKKSFVQTLELDLRLLGMIGAFAILCVGFDIVTGGRFLTPRNIFNLTIQTVSVAIMATGMVFVIVTRHIDLSVGALLATCSAVMAMTQTEILPNMLGLGLGHPLIPWVTILVGLLVGSLIGAFHGWLVGYLAIPAFIVTLGGLLVWRNVGWYLTSGKTIGPLDPTFMQFGGINGTLGATWSWIVGLLALAAALYGLWASRKNKLRHGFPVKPLWAEGVLAALISGAILGFVAILNAYEVPLARLKRDFAAQGLTLPEGYTEAYGIPISVLLLIFIAVGMTMLARRTRLGRYIFATGGNPDAAELSGINTRLLTVKIFALMGALCAISAVVASARLTNHSNDIGTLDELRVIAAAVIGGTALAGGFGTIHGAILGALIMQSLQSGMAMVGVDAPLQNIVVGAVLVLAVLIDILYRRKTGAR

SEQ ID NO: 40657 - DNA, 1161 bp, Bacillus clausii KSM-K16
  CDS (1)..(1161): transl_table=11
atgaaagcatttcttaatattgtccaaaacaacatgcgccaatatagcatgacttgtgcgttgctgtttattatgcttttattccagctgttaacagatggcattttgctgcagccgttaaatattacaaatatcattttacaaaacagctatattttaattttggcgattggaatggtcatgattatcattacaggccatattgatttatccgttggctctgtcgctgcttttatcggtgcgctgtcagcgattttaatgattgagttaaatgtccacccagtgttagctgttctcatctgcctcatcgccggcgctctcgttggcgcttggcaagggttttgggtcgcatatgtacaaattcctgccttcattgtgacattagcaggcatgctcatttttagaggaattacgttaatcatgcttgaagggcagtccattgcttcctatccgccaacttttcaacaactaagctcagggtttttgcctgatttgtttaatggcgagtcgattcatcttttttcgatgttccttggagtcgtgctaacagctgttttgatcgcgatccaaattaaggggagaaagaaacaacttcatcatgatttgccagttgttactccggcctggtttaccgttaaattagtagcaatcgcagcagttattctagtgtttacctttgtattagccagttaccgcggcattccaaacattcttatcttgcttgtcgccttaattgccttttacgccttcgtcacgaaaaaaacggtgtttggccgtcacatttatgcggttggcgggaatgaaaaagccgccgcattgtctgggattaaaacaaaacgggtgacgtttgctgtgtttgtcaacatggggatacttgcagcgctgtcaggcctcatttttgccgctaggctaaatgctgccaccccacgggcagggaatttattcgaactcgatgcgatagcggctgcctttattggcggtgcttctgcttatggcggcgtcgggacgatcattggcgctgtcgtcggcggcctcgtcatgggtgtgatgaacaacggcatgtcgattctcggacttggcatcgattggcaacaggctattaaagggcttgtgctattggctgctgtcgcattcgacgtcgtcaataagcgccgtggataa

SEQ ID NO: 40658 - protein, 386 aa, Bacillus clausii KSM-K16
MKAFLNIVQNNMRQYSMTCALLFIMLLFQLLTDGILLQPLNITNIILQNSYILILAIGMVMIIITGHIDLSVGSVAAFIGALSAILMIELNVHPVLAVLICLIAGALVGAWQGFWVAYVQIPAFIVTLAGMLIFRGITLIMLEGQSIASYPPTFQQLSSGFLPDLFNGESIHLFSMFLGVVLTAVLIAIQIKGRKKQLHHDLPVVTPAWFTVKLVAIAAVILVFTFVLASYRGIPNILILLVALIAFYAFVTKKTVFGRHIYAVGGNEKAAALSGIKTKRVTFAVFVNMGILAALSGLIFAARLNAATPRAGNLFELDAIAAAFIGGASAYGGVGTIIGAVVGGLVMGVMNNGMSILGLGIDWQQAIKGLVLLAAVAFDVVNKRRG

SEQ ID NO: 40659 - DNA, 945 bp, Bacillus clausii KSM-K16
  CDS (1)..(945): transl_table=11
atgttcaccaataaacgagtcaaggcattaacagcgacgcttggtccatttatcggccttttccttatcatattaattattagcattctaaacccaggattcttatcagcgccgaatctcctcaatgtccttcggcaagtatccattaatgcgctcattgcatttggaatgacgtttgtcattttgacaggtgggattgatttatcagttggtgcaattcttgctttttctggagcggtcactgcaaccttactttcgtcagggatggacccgatcttagcgatcttaattggattgcttgttggagcagcacttggtgcaataaatggcataatcattgcaaaaggaaaagtagcaccatttattgcgacactggcgacgatgacgatttaccgaggcgcgaccttaatgtttacagatggcaggcctgtatcaaacttaggtgattctacattgttccaaatgcttggaggcggctacttttttggaattccaatgccggcgattacgatgatgattagctttgttatcttgtacttgattttaaagaaaaccacatttggccgtcgcgtatatgcagttggtggcaatgaggaagcatcgattctatcaggcatcaaagtcgaccgaattaagatttacgtatactctctgactggatttttggcagccgttgctggtgtgattttaacgtcgaggctaaattcagctcaaccaacggctggcacgatgtacgaacttgacgcgattgctgcggttgtgctcgggggaacgagtttaacaggtggaaaagggtggattgtcggaacgcttattggtgccttaatcataggagtgttgaataatgggttgaatttgcttggtgtcagctcttttttccagcaaatggttaaaggaagtgtcattttacttgcagtcttgcttgatcgcagaaaaacagcttaa

SEQ ID NO: 40660 - protein, 314 aa, Bacillus clausii KSM-K16
MFTNKRVKALTATLGPFIGLFLIILIISILNPGFLSAPNLLNVLRQVSINALIAFGMTFVILTGGIDLSVGAILAFSGAVTATLLSSGMDPILAILIGLLVGAALGAINGIIIAKGKVAPFIATLATMTIYRGATLMFTDGRPVSNLGDSTLFQMLGGGYFFGIPMPAITMMISFVILYLILKKTTFGRRVYAVGGNEEASILSGIKVDRIKIYVYSLTGFLAAVAGVILTSRLNSAQPTAGTMYELDAIAAVVLGGTSLTGGKGWIVGTLIGALIIGVLNNGLNLLGVSSFFQQMVKGSVILLAVLLDRRKTA

SEQ ID NO: 40661 - DNA, 1023 bp, Gluconobacter oxydans 621H
  CDS (1)..(1023): transl_table=11
atgtcgcttgaaaccactgttccggcaacgccctcacagcagccgccgaaggcccccccactcaaggcgctcgtctcccgtctggcaggaaatccgctggggggcgtcattgcggcgctggtcatcatattcggggcgtcctgtgcgctttcaccgcattttctgacgaccttcaacatggtcatcattgcccgggcgctggcctttatcgggctggtcaccatcggccagtccatcctgatgatcctcggcgagcttgatctgtccgtcggtgcgattggcgggcttgcgggtgtggtgggtggcatcctgatggtgcagctcggactcaatccctggctgtcgctggggctgtgcctgctgatgggtggagcatgcggcctgctgaacggggcgctgatcacgcagctccgtctccactcgctggtgctgacgatcggcatggccggcgtatatggcggtgccaacctcgttgcgaccaagggtgttgcgatcacgggtgtgccgcgggacatcacgttccttggccgtgggctcgtgatgggcgtgccggtgccgttcctggtgctgctggtctgtctggcgatcgtggcattcgtcatgctgcgcacaccggtcgggcgttatatctacgccatcggcagcaatcctgatgcggcgcggatgctgggcatccgggtcaatgcgatccgcatgggggcgttcgcgctggccgggttcctttcggcgctggcaggcatcctgatggtggcgcgtctgggcacggcccagccttccatcggtgacacctgggtgctcggaccgattgccgctgctgtcattggtggcgtggcgacgacgggtggcattggcagcccgatcggggcggttctgggcgccgtcatcatcggcatcatcgaagacatcatcgttctgtttggcatctcgccgtactggcagtcggtcgtcagtggagggatcgtcgtgctggcgatttccttcgatgcgctggcccgccgctacctcaaccgtgatgccgtctga

SEQ ID NO: 40662 - protein, 340 aa, Gluconobacter oxydans 621H
MSLETTVPATPSQQPPKAPPLKALVSRLAGNPLGGVIAALVIIFGASCALSPHFLTTFNMVIIARALAFIGLVTIGQSILMILGELDLSVGAIGGLAGVVGGILMVQLGLNPWLSLGLCLLMGGACGLLNGALITQLRLHSLVLTIGMAGVYGGANLVATKGVAITGVPRDITFLGRGLVMGVPVPFLVLLVCLAIVAFVMLRTPVGRYIYAIGSNPDAARMLGIRVNAIRMGAFALAGFLSALAGILMVARLGTAQPSIGDTWVLGPIAAAVIGGVATTGGIGSPIGAVLGAVIIGIIEDIIVLFGISPYWQSVVSGGIVVLAISFDALARRYLNRDAV

SEQ ID NO: 40663 - DNA, 858 bp, Lactobacillus acidophilus NCFM
  CDS (1)..(858): transl_table=11
ttgccccccaataatttattaaacttattacgtcaagcttcggttaatgctttaattgcgtttggtatgacgtttgtaattttaacggctggtatcgatttatctgtaggctcaattctagcttttactggtgcaattatagccatgatgattttaaatggtactcctgcatggttagctggttttataggtttaatgcttggtgctgttctaggtgccataaacggtttgtttattacttggggtagagtaacgccatttattgctacattagctacgatgactatttggagaggcgctacttatgtatttacaggtggtaacccagttactgggggaaaaatgaatacaagtttcttctttcaatttattgggcaaggttacttatttggaattccgtttccagtcattattacgttaatcgcttttataatttgttatattttacttcataaaactgcatttggtcgtaaaatatttgctcttggtggtaatgagaaagctgcttttgttgcgggtgtaaaaactaaaaaacttttaattataatttatactatttcaggattattagcagctcttgccggttttattttaacttcaagattaggatcagcacaaccagatgcgggtatgtcatatgaaatggatgccattgcctcaacagttattggtggtgctagtctaatgggtggtaaaggtagaatgtcaggcacattagttggtgctttacttattgcttctttaagtaatggtatgaatttattaggtattaatagtttttaccagcaaattgttaaaggtgttgtaattttaattgctgttatgatagattctcaaactcaaagaaatcgtgaatga

SEQ ID NO: 40664 - protein, 285 aa, Lactobacillus acidophilus NCFM
MPPNNLLNLLRQASVNALIAFGMTFVILTAGIDLSVGSILAFTGAIIAMMILNGTPAWLAGFIGLMLGAVLGAINGLFITWGRVTPFIATLATMTIWRGATYVFTGGNPVTGGKMNTSFFFQFIGQGYLFGIPFPVIITLIAFIICYILLHKTAFGRKIFALGGNEKAAFVAGVKTKKLLIIIYTISGLLAALAGFILTSRLGSAQPDAGMSYEMDAIASTVIGGASLMGGKGRMSGTLVGALLIASLSNGMNLLGINSFYQQIVKGVVILIAVMIDSQTQRNRE

SEQ ID NO: 40665 - DNA, 987 bp, Vibrio fischeri ES114
  CDS (1)..(987): transl_table=11
atgagcaccaaatcaatgacttcaactgaaacacaacaaaagaaaggcggcattttttctaaagagtggctgattgaacaaaaatcattaatcgcgctattgcttttgattgtcgtggtatcctttttgaacgacaacttttttactgtcgacaacatcctaaacatcctacgtcaaacctcagttaacgcgattattgcggtaggtatgacgttagttatcttaacggcaggtatcgacttaagcgttggctctgtattagccctttgtggtgcttttgcggcaaccatgattggccttgaaattccggtgatgattgcggttccaacagcactacttgctggtgcagctctaggtgcaatcagcggtattattatcgcaaaaggtaaagttcaagcattcattgcgacgctagtaaccatgacgttattacgtggtgtgacaatggtttacacagaaggtcgccctatctctactggttttactgatgttgctgacagctttgcatggttcggtacaggttacgcgcttggtatcccagttcctatctggctaatggttatcgtgtttgcatctgtatggtacttactaaaccacacacgttttggtcgctacgtttatgctctaggtggcaatgaatcagcaactcgcctatctggtatcaatgtggatcgcgttaagatcggtgtttacgctatctgtggtctacttgctgcactggctggtttaatcgtaacgtctcgtctttcttcagctcaaccaacagcaggtatgggctacgagctagacgctatcgcagcggttgtacttggtggtacaagccttgcgggtggtaaaggtcgcatcatgggtacattaattggtgcgcttatcatcggcttcttaaacaacgctctgaacttattagatgtttcttcttactaccaaatgattgccaaagcagtggttatcctactggcagtattagtggacaacaaaaacaagtaa

SEQ ID NO: 40666 - protein, 328 aa, Vibrio fischeri ES114
MSTKSMTSTETQQKKGGIFSKEWLIEQKSLIALLLLIVVVSFLNDNFFTVDNILNILRQTSVNAIIAVGMTLVILTAGIDLSVGSVLALCGAFAATMIGLEIPVMIAVPTALLAGAALGAISGIIIAKGKVQAFIATLVTMTLLRGVTMVYTEGRPISTGFTDVADSFAWFGTGYALGIPVPIWLMVIVFASVWYLLNHTRFGRYVYALGGNESATRLSGINVDRVKIGVYAICGLLAALAGLIVTSRLSSAQPTAGMGYELDAIAAVVLGGTSLAGGKGRIMGTLIGALIIGFLNNALNLLDVSSYYQMIAKAVVILLAVLVDNKNK

SEQ ID NO: 40667 - DNA, 1011 bp, Salmonella enterica subsp. enterica serovar Choleraesuis str
  CDS (1)..(1011): transl_table=11
atgagtgcgttaaacaagaaaagctttttgacctggctgaaagagggcggaatttacgtcgttcttttagtgctgctggcgattattattttccaggacccgacttttttaagtttgctgaatttaagtaatattctgacgcaatcttcggtacgtattattatcgcgctgggcgtggcgggactcatcgtcacccaggggacagacctgtcggcggggcgtcaggtagggctggcggcggttgtggcggcaacattactgcaatcaatggaaaacgccaacaaagtgtttccggaaatggcgaccatgccgattgcgctggtcatcctgattgtctgcgcgattggcgcggtgattggcctggtgaacggcatcatcattgcttacctgaacgtgacgccgtttattaccacgcttggcacgatgattatcgtttatgggatcaactccctttactatgactttgtcggcgcttcgcccatttccggctttgacagcggcttttccacctttgcgcagggctttgtggcgatgggcagtttccggctctcctacatcaccttttacgctctgattgcggtagcgtttgtctgggtgctgtggaataagacccgctttggtaaaaacatttttgctattggcggcaacccggaagcggcgaaagtttctggcgtaaacgtggcgctgaacctgctgatgatttatgcgctctccggcgtgttttatgccttcggcggcttactggaagcagggcgtattggttctgccaccaataacatcggctttatgtatgaactggatgcgattgccgcgtgcgtggtcgggggcgtatcgtttagcggcggagtgggtacggtcttcggcgtggtgaccggcgtcattatctttaccgtcatcaactacggcctgacctatatcggggtaaacccgtactggcagtacattatcaaaggcggcattatcattttcgccgtggcgctggactcgctgaaatacgcgcgtaagaagtag

SEQ ID NO: 40668 - protein, 336 aa, Salmonella enterica subsp. enterica serovar Choleraesuis str
MSALNKKSFLTWLKEGGIYVVLLVLLAIIIFQDPTFLSLLNLSNILTQSSVRIIIALGVAGLIVTQGTDLSAGRQVGLAAVVAATLLQSMENANKVFPEMATMPIALVILIVCAIGAVIGLVNGIIIAYLNVTPFITTLGTMIIVYGINSLYYDFVGASPISGFDSGFSTFAQGFVAMGSFRLSYITFYALIAVAFVWVLWNKTRFGKNIFAIGGNPEAAKVSGVNVALNLLMIYALSGVFYAFGGLLEAGRIGSATNNIGFMYELDAIAACVVGGVSFSGGVGTVFGVVTGVIIFTVINYGLTYIGVNPYWQYIIKGGIIIFAVALDSLKYARKK

SEQ ID NO: 40669 - DNA, 993 bp, Salmonella enterica subsp. enterica serovar Choleraesuis str
  CDS (1)..(993): transl_table=11
atgacaacccaggctgtttctggtcgccgttatttcactaaagcgtggcttcttgagcagaagtcgctcattgccctgctggtgttgatcgcgattgtttcgacgttgagccccaacttttttaccgttaataatctgttcaatattcttcaacagacctccgtcaacgccattatggcggtggggatgacgttggtgattctgacatcggggatcgatctgtccgtcggttccctgctggcgctcaccggcgcggttgccgcttcaatcgtcggcgttgaagtgaatgcgctggtcgcggttgccgccgcgctggcgctgggcgctgcgattggcgccgtcactggcgttatcgtcgcgaaaggccgcgtacaggcgtttatcgctacgctggtgatgatgctgctactgcgcggtgtaacgatggtttacaccgacggtagcccggtcaacaccggctttaccgataacgccgatctgtttggctggttcggtatcggccgtccgctgggcgttcctacgccggtctggatcatggctatcgtctttatcgccgcctggtatatgctgcatcacacccgtctgggacgctatatctacgcgctgggcggtaacgaagcggcgacgcgcctgtctggcattagcgtgagcaaagtgaaaattatcgtctattcactttgcggcctgacagcgtcgctggcgggcatcattgaagtggcgcgcctctcttccgcgcagccgacggcgggtaccggctatgagctggatgctattgccgccgtggtgctgggcggcaccagccttgcaggcggtaaaggacgcattgttgggacattgatcggcgcattgattctcggcttccttaataatggtttgaatttgttaggtgtttcctcctattaccagatgatcgtcaaagcggtggtgattttactggcggtactggtagacaacaaaagcagtaacaacgactacaggacatctgaaatatga

SEQ ID NO: 40670 - protein, 330 aa, Salmonella enterica subsp. enterica serovar Choleraesuis str
MTTQAVSGRRYFTKAWLLEQKSLIALLVLIAIVSTLSPNFFTVNNLFNILQQTSVNAIMAVGMTLVILTSGIDLSVGSLLALTGAVAASIVGVEVNALVAVAAALALGAAIGAVTGVIVAKGRVQAFIATLVMMLLLRGVTMVYTDGSPVNTGFTDNADLFGWFGIGRPLGVPTPVWIMAIVFIAAWYMLHHTRLGRYIYALGGNEAATRLSGISVSKVKIIVYSLCGLTASLAGIIEVARLSSAQPTAGTGYELDAIAAVVLGGTSLAGGKGRIVGTLIGALILGFLNNGLNLLGVSSYYQMIVKAVVILLAVLVDNKSSNNDYRTSEI

SEQ ID NO: 40671 - DNA, 1044 bp, Salmonella enterica subsp. enterica serovar Choleraesuis str
  CDS (1)..(1044): transl_table=11
atgttgaaattcatccaaaataaccgggaagcgacggcactgctggcaatagtctgtttattcgtgtttcctggcgcgctggatagccagtatttgagcgtgcaaacgctgacaatggttttcagtagcgcgcaaattttgatgctgttggcgattggcgcgacgatggtaatgctcacccgcaatattgatgtatcggtgggctcgacgacaggaatgtgcgcggtattgctgggagtgatgttaaacgccggctatagcctgccggtcgcctgcctggccacactaatattaggaattgtcgccggattttttaatggcgtactggttgcctggttgaagatacccgccattgtcgccacgctgggaacgctgggcttgtatcgtgggatcatgctgctatggacaggggggaaatggattgaaggattacccgcaggcttaaagcaactctctgctccggtgtttctgggaatttccgcaatcggctggtttaccctggtgttagcgctgcttatggcctggctcctggcgaaaaccgcctttggccgcaatttttacgccaccggcgataacctgcagggcgcccggcaattgggtgtccgtaccgagatggtacgcatcatggcattttcacttaatggcggtatggcggcattggctggaatcgtgtttacctcgcagattggcttcattcccaatcaaaccggcacggggctggaaatgaaagccatcgcggcctgcgtattggggggaattagcctgttaggcgggtcaggcacggtcatcggcgctattctcggcgcttattttcttacgcaaatcgatagtgtgttagtgctgctgcgtatccccgcctggtggaacgattttattgccggcctggtattgttgggcgtactggtattcgatgggcggctgcgttgcgcattacaacgcaatctgcgccgccagaaatatgcccgttttatatcaccacccactccacttcaggcggaagcaaaaacgcacgcacaacagaataaaaacaaagaggtggcatga

SEQ ID NO: 40672 - protein, 347 aa, Salmonella enterica subsp. enterica serovar Choleraesuis str
MLKFIQNNREATALLAIVCLFVFPGALDSQYLSVQTLTMVFSSAQILMLLAIGATMVMLTRNIDVSVGSTTGMCAVLLGVMLNAGYSLPVACLATLILGIVAGFFNGVLVAWLKIPAIVATLGTLGLYRGIMLLWTGGKWIEGLPAGLKQLSAPVFLGISAIGWFTLVLALLMAWLLAKTAFGRNFYATGDNLQGARQLGVRTEMVRIMAFSLNGGMAALAGIVFTSQIGFIPNQTGTGLEMKAIAACVLGGISLLGGSGTVIGAILGAYFLTQIDSVLVLLRIPAWWNDFIAGLVLLGVLVFDGRLRCALQRNLRRQKYARFISPPTPLQAEAKTHAQQNKNKEVA

SEQ ID NO: 40673 - DNA, 1005 bp, Brucella abortus biovar 1 str. 9-941
  CDS (1)..(1005): transl_table=11
gtgtccaccacagaaaacaattcatcgacgagctggtttggctccgaacgccgcaggctggtgatccaggaatacggcatattcatcgccttcctgcttttggccacgattctctcgttctccaacgaatatttcctcaccgcgggcaatatttccaacgtcctgttgcagacctcgatcaacggcattctcgccatcggcatgacgttcgttattctgacgcgcggtatcgacctttccgttggctccgtggttgccttggctggcattgtgagcgccagctttgcaaccacatctgcaatggcgggtattgcgggcgcaccatattcaccgtttatagccatttgcgtcggcctgctggtggggataggttgcggcgcactggtcggtacgattgtctcgcgctttgcggttccagccttcgtggcaacattgggcatgctttccgcagcgcgcggcctgacgctcatctatggcggcggcaagcctgtgcctgcgcttgttccggatttccggtggattggaaccggcaatatactgggtgttccggtaccggtcattctgcttgcaatcgtgttcctggtatcgtggtggatcctcaaccgatcgaggtttggccgctatatctatgcggttggcggcaatcctcatgctgcgaacacctccggcatcaatatctccagggtgcgtttttcggtttatgtcatttcaggcgggttggcgggccttgccgggatgattctgtctgcccgcaccgggtctgccttgccgcaagcgggtatcagttatgaactggacgccatcgcagcggtcgtcattggcggcaccagcctgtctggtggcatcggtcgcatcaccggaacccttatcggcgcgctcatcattggcgtcatgaacaacggtctcgatctgatgggcatccagtcctactaccagcaggttctcaagggtgcgctgatcgtgggagcggtcatgctcgaccagaaacgcagtcagggaggctag

SEQ ID NO: 40674 - protein, 334 aa, Brucella abortus biovar 1 str. 9-941
MSTTENNSSTSWFGSERRRLVIQEYGIFIAFLLLATILSFSNEYFLTAGNISNVLLQTSINGILAIGMTFVILTRGIDLSVGSVVALAGIVSASFATTSAMAGIAGAPYSPFIAICVGLLVGIGCGALVGTIVSRFAVPAFVATLGMLSAARGLTLIYGGGKPVPALVPDFRWIGTGNILGVPVPVILLAIVFLVSWWILNRSRFGRYIYAVGGNPHAANTSGINISRVRFSVYVISGGLAGLAGMILSARTGSALPQAGISYELDAIAAVVIGGTSLSGGIGRITGTLIGALIIGVMNNGLDLMGIQSYYQQVLKGALIVGAVMLDQKRSQGG

SEQ ID NO: 40675 - DNA, 1191 bp, Brucella abortus biovar 1 str. 9-941
  CDS (1)..(1191): transl_table=11
atgagcgagaatgtaatccagagcggccagcagagcagcgtggggcgctatctcaagaacaatctgcgtgaatccgggatgctgctttcgctcgttgcaatcatgatcttcttccagatcgtgaccggcggcgttctcatgaagccgctgaacctcaccaatctcgttttgcagaacagctatatcgtcatcatggcgcttggaatgctgctcatcatcgtcacgggccatatcgatctttcggtcggttcggtctgcggctttatcggggcgctcgctgccgtcatgatggtaaagctcggcattccctttcccattgcggccattctctgcctcattgtcggcgggttgatcggcgcgatccagggtttttgggtcgcctatttcaatatcccctccttcattgtgacattggccggtatgctcgtgttcaaggggatgatgcttgccgttctgggcggacagtcggtcggaccttttccggtcgtgttccagaagctctcgtcgggcttcattccagaggtgatcggcacgtttgacggcgtttatctcacctcgctcatcatcggcgttctgcttgcggttttcctcatctggcagagcatgcggtcgcgcgcgcgccatattgcccatgaggtggagaccgagcccttcggccttttcgtggtcaagtgcatcctctatttcgccgcaattgcctatctttcgctgctcatttcctcacatcgcggtatgccgaacgtactcatcatcatggcggtgctgattgccgcctatgcgtttctcaccaatcgcaccgtgatcggccgccagatctatgcggtgggcggcaatcgtcacgccgccaagctttccggcgtgaaaaccgagcggctgacgtttctcaccttcgtcaatatgggtgtgctggcagcacttgcgggtctcgtcttcgccgcccgtctcaatacggcgacgccgaaagctggcatcggctttgaactggacgtcatcgcggcctgcttcatcggtggcgcttcggcctatggcggtgtggggcgggttacgggtgccgtgatcggcgcgctcatcatgggcgtgatgaacaacggcatgtcgatcctcggcatcggtatcgactatcagcaggtcatcaagggtatcgtgctgctgggggcggtttgtatcgacgtctataaccagaaacgctga

SEQ ID NO: 40676 - protein, 396 aa, Brucella abortus biovar 1 str. 9-941
MSENVIQSGQQSSVGRYLKNNLRESGMLLSLVAIMIFFQIVTGGVLMKPLNLTNLVLQNSYIVIMALGMLLIIVTGHIDLSVGSVCGFIGALAAVMMVKLGIPFPIAAILCLIVGGLIGAIQGFWVAYFNIPSFIVTLAGMLVFKGMMLAVLGGQSVGPFPVVFQKLSSGFIPEVIGTFDGVYLTSLIIGVLLAVFLIWQSMRSRARHIAHEVETEPFGLFVVKCILYFAAIAYLSLLISSHRGMPNVLIIMAVLIAAYAFLTNRTVIGRQIYAVGGNRHAAKLSGVKTERLTFLTFVNMGVLAALAGLVFAARLNTATPKAGIGFELDVIAACFIGGASAYGGVGRVTGAVIGALIMGVMNNGMSILGIGIDYQQVIKGIVLLGAVCIDVYNQKR

SEQ ID NO: 40677 - DNA, 1041 bp, Brucella abortus biovar 1 str. 9-941
  CDS (1)..(1041): transl_table=11
atgtcagtcacgagcaccaacaaggaaacagcggctccgaccggcgcgaagcggaagaccagcctcgtgcatctgctgctcgagggtcgcgcattctttgcgctgatcgcgatcatcgccgtcttctcgttcctttcgccctattactttacggtcgataatttcctcatcatgtcgtcgcatgtggccattttcggccttctggcgattggtatgctgctcgtcatcctcaatggcggcatcgacctttcggtcggctccacgctggggctggccggtgtggtcgcgggcttcctgatgcagggcgtgaccttgcaggaattcggcatcatcctttatttcccggtctgggccgtggtgctcatcacctgcgcgctcggcgccttcgtcggcgcggtcaatggtgtgttgatcgcttatctgcgcgttccggccttcgtggcgacgcttggcgttctttattgcgcgcgtggcgtagcgcttttgatgaccaacggtctcacctacaacaatctcggcggtcgccccgaacttggcaatacgggctttgactggctcggcttcaacaagcttttcggcgtgccgatcggtgtgctggtgctggcaattctcgccatcatctgcgccattgttttgaaccgcactgcattcggccgctggctctatgcctcgggcggcaatgaacgggcggcggaactttccggtgttccggtcaagcgggtcaaggtgtcggtctatgtcatttccggcatctgcgctgccattgcggggctggttctttcctcgcagctcacctctgctgggccgacggctggcaccacctacgaactgacggcaatcgctgccgtggtgatcggtggcgctgcgctcactggggggcgcggtacgatacagggcacacttctcggtgctttcgtgatcggtttcctttccgacggcctcgtgattatcggcgtgtcctcttactggcagaccgtctttaccggcgcggtgatcgtgctcgcggttctgctcaacagcattcaatattcccggcgatga

SEQ ID NO: 40678 - protein, 346 aa, Brucella abortus biovar 1 str. 9-941
MSVTSTNKETAAPTGAKRKTSLVHLLLEGRAFFALIAIIAVFSFLSPYYFTVDNFLIMSSHVAIFGLLAIGMLLVILNGGIDLSVGSTLGLAGVVAGFLMQGVTLQEFGIILYFPVWAVVLITCALGAFVGAVNGVLIAYLRVPAFVATLGVLYCARGVALLMTNGLTYNNLGGRPELGNTGFDWLGFNKLFGVPIGVLVLAILAIICAIVLNRTAFGRWLYASGGNERAAELSGVPVKRVKVSVYVISGICAAIAGLVLSSQLTSAGPTAGTTYELTAIAAVVIGGAALTGGRGTIQGTLLGAFVIGFLSDGLVIIGVSSYWQTVFTGAVIVLAVLLNSIQYSRR

SEQ ID NO: 40679 - DNA, 1239 bp, Brucella abortus biovar 1 str. 9-941
  CDS (1)..(1239): transl_table=11
atgaacgatatcaatacgctgcttgatcgtcaggatgtacgggtgcgccacgataaaggcgtttctggcgccatccgcacctttatcgaccgggtcaagtcgggcgatctcggttcattgccggtcattgttggccttctcatcatctggacagttttccagacgttgaacccggttttcctttccagcaacaacctcgtgaacctgctattcgattgctcgaccatcggcgtcatttcgctcggcatcgtctgcgtattgatgctgggtgagatcgacctttcggtcggttccattagtgggctttcttcggctatcatcggtgtattatgggtcaataatggctggccggtgggcgtcgccatcattgcagcactttgcgcaggcgcactggctggcttcctctacgcgctcctctataaccgcttcagcatgccaagcttcgtttccacactggctgggctgctcgcagcccttgggcttcagctttacctcctcggcaatacaggctccatcaatctgccttacggttcgtggctggtcagcttcggccagcttctggtaatgccgcgtccgctttcttatgcgctggcgctggtcgcgggacttgcgatctttttcacgggttttcgcgccgcgcagcgccgccgcacggcagggctttccgctccctcggctgcgggcattgcgctcaaagctttggtcatcacgctcattatcggctgtggggtattttatctcaaccagtcgcgcggcgtgccatggatgtttgccctgttcgtggcgctggtgatcgcgatgaactatgcgcttacgcgcaccagatggggccgctgcgtgcaggcggttggcggcaatcgcgaggctgcgcgtcgtgccggcatcaatgtgaatttcatctatgtctcggccttcatggcctgctccacactcgcggctgccggtggtatcatggcggcggcgcgtctggcctcatccagccagcaggcaggcaccggtgacgtcaacctcaatgctatcgcggcagcggttatcggcggtaccagcctattcggcgggcgcggcagcgcgtggtcggccctgctcggtattatcgtcatccagtcgattgcgagcggtttgacgcttctcgatctgtcgtcttcgcttcgctacatgattacgggtgcagtgcttgccatcgccgtgattgtcgattcccttgcccgccgttcgcgccagtcgcacggccgcgcctag

SEQ ID NO: 40680 - protein, 412 aa, Brucella abortus biovar 1 str. 9-941
MNDINTLLDRQDVRVRHDKGVSGAIRTFIDRVKSGDLGSLPVIVGLLIIWTVFQTLNPVFLSSNNLVNLLFDCSTIGVISLGIVCVLMLGEIDLSVGSISGLSSAIIGVLWVNNGWPVGVAIIAALCAGALAGFLYALLYNRFSMPSFVSTLAGLLAALGLQLYLLGNTGSINLPYGSWLVSFGQLLVMPRPLSYALALVAGLAIFFTGFRAAQRRRTAGLSAPSAAGIALKALVITLIIGCGVFYLNQSRGVPWMFALFVALVIAMNYALTRTRWGRCVQAVGGNREAARRAGINVNFIYVSAFMACSTLAAAGGIMAAARLASSSQQAGTGDVNLNAIAAAVIGGTSLFGGRGSAWSALLGIIVIQSIASGLTLLDLSSSLRYMITGAVLAIAVIVDSLARRSRQSHGRA

SEQ ID NO: 40681 - DNA, 1170 bp, Brucella abortus biovar 1 str. 9-941
  CDS (1)..(1170): transl_table=11
atgacgttgacaggcaaaagcctcagaaaatttctctcagaatacaaaatcgtggcactgctgattgttgtcgccctgatctgggcattcttcgccatcatgacctacgatcccgagatgggccggtcgcagtttctcaccgcgcgcaatttctccaatcttttgcgccagatggcaatcaccggcatgctggcttcagccatggtgtttgtcatcgtggcgggtgaaatcgatctgtcggtgggggctttgctcggcctgttaggcggtgtcgcggcggtgctcgatgtggtttacggctggccgttatgggccactatcgctacggttctggtgctgggtggagtgcttggcggtttcaacggctggctcaccgcctatctcggcattccgtccttcatcgttacgctgggcgggcaattggtgtttcgcggtattgtgctgggtatcatgggcggtgtcaccattgcgccgatttcgcccgagttcaaatatatcgggcaaggctatttgcccggctggcttggcaatgtctgtgccatagcgctgtttacagtgcttgtcctgattacgctcagaacccgttccagcaagcgcaaacacaatttgcaaacgctttcaccggcgatggaaaccgctcgccttctgggcacgggtatcctgatccttggttttatcctggtcctcaacagctatcagggcgtaccggttccggttctcgtgctgctggttattcttggcgtcttcaccgttatttcccgccagactgttttcggccggcatatttatgcggtcggttccaatcctgaagccacgcgcttttccggtgtcaacgtgaatttcgtcaaaatggccgtgtttgcgctgatgggacttatggcggcagtggcgggcctcaccacgactgcgcgccttgcggccggtacgccatcggcaggtttgggcggcgaacttgatgccatcgcatcatgctttatcggcggcacatccatgcgcggcggcgtgggatccgtgattgctgcgctggtcggtgcgcttatcatgtcaagcctcgataatggtatgtcgatgctgggcgtcgatacattctggcagcaaatcatcaagggcagtattcttgtgctggccgtttatctcgatatcgtatcatcaggcacacgtcgcgcctga

SEQ ID NO: 40682 - protein, 389 aa, Brucella abortus biovar 1 str. 9-941
MTLTGKSLRKFLSEYKIVALLIVVALIWAFFAIMTYDPEMGRSQFLTARNFSNLLRQMAITGMLASAMVFVIVAGEIDLSVGALLGLLGGVAAVLDVVYGWPLWATIATVLVLGGVLGGFNGWLTAYLGIPSFIVTLGGQLVFRGIVLGIMGGVTIAPISPEFKYIGQGYLPGWLGNVCAIALFTVLVLITLRTRSSKRKHNLQTLSPAMETARLLGTGILILGFILVLNSYQGVPVPVLVLLVILGVFTVISRQTVFGRHIYAVGSNPEATRFSGVNVNFVKMAVFALMGLMAAVAGLTTTARLAAGTPSAGLGGELDAIASCFIGGTSMRGGVGSVIAALVGALIMSSLDNGMSMLGVDTFWQQIIKGSILVLAVYLDIVSSGTRRA

SEQ ID NO: 40683 - DNA, 975 bp, Corynebacterium glutamicum ATCC 13032
  CDS (1)..(975): transl_table=11
ttgagcaccgccgtagtttcacagaagaagtccacaacggcatccaaaattggacattggatgctcaataacggtgcgttggtggggctgattgcactgtgtgttggactttttattgcaacaccccactttctcaccattcctaacctgatcaacatcggtatccaatcggcgacggtggcgatcctggcgttcggcatgaccttcgtcatcgttaccgcaggcattgatttgtctgtgggatcagtggctgcgttgggtgcgatgacctcggcgtatttcttcgcggaagttggtttgccgggctggatcacgctgctgattggcctgttcatcggattgttggcgggtgcgatctctggcatttctattgcttatggcaagttgcctgcgtttattgccaccttggccatgatgtcgatcgccaggggaatcaccttggtcatttcccaaggctcaccaattcccagtgcaccagctgtgaacgctttggggcgcacctactttggcatcccgatgccgattctgatgatggcactggctggcattgtgtgttggtttattttgagccgcaccgtgctgggacggtccatgtacgccattggcggaaacatggaagcagcccgactatctggtctgccagtgaagaaaatcctggtcatggtctatgcactggctggtgtgtatgcagcacttgcgggtctggtcatgacgggacgcttgtcgtccgcgcagccgcaggcaggcgtgggatacgaactcgatgcgattgccgccgtggtcattggtggtgcgtcacttgctggcggaaccggaaaagcaacgggcactttgattggtgccatcttgttggccgtgatccgcaatggcttgaacattttgaacgtgtcctcgttctggcagcagattgtcatcggttgtgtcatcgcgcttgcggtgggcttcgatgtcatccgaaacaaaacctctaagtaa

SEQ ID NO: 40684 - protein, 324 aa, Corynebacterium glutamicum ATCC 13032
MSTAVVSQKKSTTASKIGHWMLNNGALVGLIALCVGLFIATPHFLTIPNLINIGIQSATVAILAFGMTFVIVTAGIDLSVGSVAALGAMTSAYFFAEVGLPGWITLLIGLFIGLLAGAISGISIAYGKLPAFIATLAMMSIARGITLVISQGSPIPSAPAVNALGRTYFGIPMPILMMALAGIVCWFILSRTVLGRSMYAIGGNMEAARLSGLPVKKILVMVYALAGVYAALAGLVMTGRLSSAQPQAGVGYELDAIAAVVIGGASLAGGTGKATGTLIGAILLAVIRNGLNILNVSSFWQQIVIGCVIALAVGFDVIRNKTSK

SEQ ID NO: 40685 - DNA, 1020 bp, Pseudomonas syringae pv. syringae B728a
  CDS (1)..(1020): transl_table=11
atgaaaacgctcgatctcacgcgccaacgcattctgccgcagtcgctgttcaagcgcctgctgcatgattttcccggcgtggtcagcatcggcctgtttttcgccctgtgctttgtgctgttcgcactggtgaccgataactttttaagcggtgccaatctgctcaacgttatccggcaaaacgcgccgttattgattgtcgcggtggcgatgacgctggtggtcaccaccggcggcatcgacctgtcggtcggctcgaccctggcgctggtcggtgcgctggcggccatggcgctcaatgcctggcacctgccctggccgctggttctgctcggcgggcttgcggtcggcgcgatgatcggggcgctgaacggctacttcatcgcctacgcgggcatcccggcctttatcgtcaccctggccaccctgaccattattcgtggcctggcgatgctgctgacgcaaggctattcgatccccgtcccacgcgaagaagcggcgtttctggccctcgggcgcggctggtttctcggcgtgccgctgaccgcctggctggccttgctggtcacgctgggcggggtgctggtgctcggcaaaatgcgttttggccgctacctcacgggcatcggtgccaacgctgaaagcgtgcgccgcgccggggtgaatcatcgcggtgtgctgctgcgggtctacatgctcagcggcatggcggccgccctggccggcatgatcgtcaccgccaggctgggcagtggttcctcgaatcagggcgaaggtttcgaactggaagtgattgctgccgtggtcctcggcagcaccagcctgttcggtggcttcggcacgattgtcggcacactgttaggggtgcttaccatggctgcaatcaagaacgggctgattctggcccacgtctcaccgttttacacgcaaatcgccacgggcctgatcgtactgctggcgatctggctgaacacacgcattctacgtaccggccgtccactcgggagggctggagcatga

SEQ ID NO: 40686 - protein, 339 aa, Pseudomonas syringae pv. syringae B728a
MKTLDLTRQRILPQSLFKRLLHDFPGVVSIGLFFALCFVLFALVTDNFLSGANLLNVIRQNAPLLIVAVAMTLVVTTGGIDLSVGSTLALVGALAAMALNAWHLPWPLVLLGGLAVGAMIGALNGYFIAYAGIPAFIVTLATLTIIRGLAMLLTQGYSIPVPREEAAFLALGRGWFLGVPLTAWLALLVTLGGVLVLGKMRFGRYLTGIGANAESVRRAGVNHRGVLLRVYMLSGMAAALAGMIVTARLGSGSSNQGEGFELEVIAAVVLGSTSLFGGFGTIVGTLLGVLTMAAIKNGLILAHVSPFYTQIATGLIVLLAIWLNTRILRTGRPLGRAGA

SEQ ID NO: 40687 - DNA, 990 bp, Pseudomonas syringae pv. syringae B728a
  CDS (1)..(990): transl_table=11
atgaacaataaaaaagaggtgcgtatgtctaccgaatccagcctgcaggctccccgtcagggcatgaacctgcgtcgtttcgccgatgactgggtgatgctcctggccgccgtggggattttcctgctgtgtgccgtgttcatcgataacttcatgtcgccgctgaacatgcgcggtctgggcctggcgatttccactgtaggtatcgctgcctgcaccatgctcttttgcctggcgtccgggcacttcgacctctcggtcggttcggtgctggcttgttccggggtgatcgccagtatcgtcatccgcgacaccgacagcgtatttctgggtgtctcggcagccctggcgctcgggttggtcgtgggtctgatcaacggcattgtgatcgccaagctgcgcatcaatgccctgatcacgactctggcaaccatgcagatcgtgcgcggcctggcgtacattttctccaacggcaaggccgtcggcgtttccaacgaggacttcttcatctttggcaatggccaggtgtatggcgtgccggtgccgatcctgatcaccattgcctgcttcatattcttcggctggctgctcaactacaccacctatgggcgcaacaccatggccatcggcggcaaccaggaagccgcgctgctggcgggtgtccacgtggaccgcaccaagatcatcattttcgccgtccacggcctggtcggtgcattggctggcgtagtcctggcttcgcgcatgacttcggggcaaccgatgatcgggcagggcttcgagctgacgatcatctctgcctgcgtattgggcggggtttcgctgagtggcggcatcggcatgatccggcatgtgatcgccggggtgctgattcttgcaatcatcgagaatgcgatgaacctgaagaacatcgatacgttctaccagtatgtgattcgcggcacgatcctgttgctggcggtgatcatcgaccgcatgaagcgccgctga

SEQ ID NO: 40688 - protein, 329 aa, Pseudomonas syringae pv. syringae B728a
MNNKKEVRMSTESSLQAPRQGMNLRRFADDWVMLLAAVGIFLLCAVFIDNFMSPLNMRGLGLAISTVGIAACTMLFCLASGHFDLSVGSVLACSGVIASIVIRDTDSVFLGVSAALALGLVVGLINGIVIAKLRINALITTLATMQIVRGLAYIFSNGKAVGVSNEDFFIFGNGQVYGVPVPILITIACFIFFGWLLNYTTYGRNTMAIGGNQEAALLAGVHVDRTKIIIFAVHGLVGALAGVVLASRMTSGQPMIGQGFELTIISACVLGGVSLSGGIGMIRHVIAGVLILAIIENAMNLKNIDTFYQYVIRGTILLLAVIIDRMKRR

SEQ ID NO: 40689 - DNA, 978 bp, Pseudomonas syringae pv. syringae B728a
  CDS (1)..(978): transl_table=11
atgaatgcaaaaaccattatcgccccagcttccacgtctccacgcagccgcctgcgcctgtctctcgaccgtttcggcctgccgttggtgtttattctgttgtgcctggtactggcttttgccagcgaatatttcatgacctggcgcaactggatggacatcctgcgccagacctcgatcaacggcattctcgcggtcggcatgacctacgtgatcctgaccaagggcatcgacctttccgtcggctcgattctggcgttcgccggattgtgcagcgcactggtcgcgacccagggctatggcctgctggcggcggtcagcgcaggcatgtttgccggtgccatgctcggcgtagtcaatggcttcatggtcgccaatctttcgattccaccgtttgtggccaccttgggcatgctcagcatcgcccgcggcatgaccttcatcctcaacgacggcagcccggtgaccgacctgcccgaagaatacctggcgttgggcatcggccggatcggcccgattggtgtgccgatcattatcttcgcggtggtcgcgctgattttctggatggtactgcgctacaccacctacggccgttacgtgtacgccgtcggcggcaacgaaaagagcgcgcgcacctccggtatcggtgtgcgcaaggtgatgttttcggtgtacgtggtttccgggctgctcgccggactggcaggcgtagtgctgtccgccagaaccacctccgccctgccccaggccggcatgtcctacgaactggacgccatcgcagcagtggtcatcggcggcaccagcctgtcgggcggtactggcagcatcgttggcacactgtttggcgcactgctgatcggcgtgatcaacaacggcctgaacctgctcggcgtgtcctcctattaccagcaggtcgccaagggcctgatcatcgtgttcgcagtgttgattgatgtgtggcgcaagaaaaaacgctag

SEQ ID NO: 40690 - protein, 325 aa, Pseudomonas syringae pv. syringae B728a
MNAKTIIAPASTSPRSRLRLSLDRFGLPLVFILLCLVLAFASEYFMTWRNWMDILRQTSINGILAVGMTYVILTKGIDLSVGSILAFAGLCSALVATQGYGLLAAVSAGMFAGAMLGVVNGFMVANLSIPPFVATLGMLSIARGMTFILNDGSPVTDLPEEYLALGIGRIGPIGVPIIIFAVVALIFWMVLRYTTYGRYVYAVGGNEKSARTSGIGVRKVMFSVYVVSGLLAGLAGVVLSARTTSALPQAGMSYELDAIAAVVIGGTSLSGGTGSIVGTLFGALLIGVINNGLNLLGVSSYYQQVAKGLIIVFAVLIDVWRKKKR

SEQ ID NO: 40691 - DNA, 1137 bp, Pseudomonas syringae pv. syringae B728a
  CDS (1)..(1137): transl_table=11
atgaaccaggtcaaacaattctttacccgctacaaaatgctcgcgctggtgattgccatcgccgttatctggctgttcttcagctggcagaccgagggcggcttcctcaccccgcgcaacttgtccaacctgctgcgccagatgtccattaccgggattctggcctgcggcatggtgctggtgatcatcagcggcgagattgacctgtcggtaggctcattgcttggcctgctcggtggcctggcggcgattctggatgtcgtttaccacgtcccgctactggcaaacctgagtgtggtggccctgtgcggcctgatgatcggcctggccaacggctatatgaccgcctacctgcggatcccctcgttcatcgtcgggctgggtggcatgctggcgtttcgcggcgttctgctggggatcactggcggcacgaccatcgccccggtgtcgccgtcgctggtctatatcggccagggctatctgccacatgcggtcggcaccgggctcgggattctgctgctggcgctgacgctgttcctgacctggaaacaacggcgcaacagagcgctgcacggcctggcagcgcattcgctgattcgtgatgtgttgcgtgtggtgttgatcggcgccgtgctgggcggctttgtctatgtgctcaacagctacgacggaatccctgttccagtgttgctgttgctggtcctgctcggcgtattcagctacgtcaccagccagacggtattcggacgccgcgtctacgccgtcggcagcaacatggaggccacgcgcctgtccggcatcaacgtacaggccgtgaagctatggatcttcggcatcatgggcgtgatgtgcgcgttcgccgggctggtcaatacagcacgcctggccgccggctcaccctcggcaggcaacatgggcgaactcgacgccatcgccgcatgcttcatcggcggcacatcgatgcgcggtggttcaggcactgtctacggcgccctgctcggcgcactggtgattaccagtctcgacaacggcatgtcgatgctcgacgtcgacagttactggcagatgatcgtcaagggcggcattctggtgctggcggtatgggtggacgtgagtacccgcgccgggcggcgctga

SEQ ID NO: 40692 - protein, 378 aa, Pseudomonas syringae pv. syringae B728a
MNQVKQFFTRYKMLALVIAIAVIWLFFSWQTEGGFLTPRNLSNLLRQMSITGILACGMVLVIISGEIDLSVGSLLGLLGGLAAILDVVYHVPLLANLSVVALCGLMIGLANGYMTAYLRIPSFIVGLGGMLAFRGVLLGITGGTTIAPVSPSLVYIGQGYLPHAVGTGLGILLLALTLFLTWKQRRNRALHGLAAHSLIRDVLRVVLIGAVLGGFVYVLNSYDGIPVPVLLLLVLLGVFSYVTSQTVFGRRVYAVGSNMEATRLSGINVQAVKLWIFGIMGVMCAFAGLVNTARLAAGSPSAGNMGELDAIAACFIGGTSMRGGSGTVYGALLGALVITSLDNGMSMLDVDSYWQMIVKGGILVLAVWVDVSTRAGRR

SEQ ID NO: 40693 - DNA, 1026 bp, Pseudomonas syringae pv. syringae B728a
  CDS (1)..(1026): transl_table=11
atgagcgacgcgattctgcaaaataaaccggccatgacgccgaccagaagcaaacggcggctgcccaccgagctgagcatctttctggtgctgatcggcatcggcctgatctttgaactgttcggctggatcgtccgcgatcaaagcttcctgctcaattcgcagcgtctggtattgatgatcctgcaggtgtcgatcatcggcttgctggccatcggtgtgacccaggtgatcatcaccaccggcatcgacctctcctccggctcggtgctcgcgctttcagcgatgattgccgcgagcctggctcagacttccgacttctcccgggcggtgttcccgtcgctgaccgacctgccggtatggattccggtcgtcgtcggtctcggggtcgggctgctggccggtgccatcaacggcagcatcattgctataaccggcattcctcccttcattgccacgctgggcatgatggtctctgcgcgcggcctggcacgtttctataccgaaggccagccggtgagcatgctctccgactcgtacacggccattggccagggcgcgatgccggtgatcatcttcctggtggtggcggtcatctttcacatcgccctgcgttacaccaagtacggcaagtacacctacgccattggcggcaacatgcaggcggcacgtacgtctgggatcaacgtcaagcgccatctggtcatcgtctacagcatcgccgggctgctggccgggctggcgggtgtggttgcctcggcgcgagcggcaaccgggcaggccgggatgggcatgtcctacgagctggacgccatcgccgctgcggtcatcggtggcaccagcctttccggtggggtggggcggatcactggtacagtgatcggtgcgctgatcctcggcgtgatggccagcggcttcacctttgtcggcgtggacgcctatgtgcaggacattatcaaaggcctgatcattgtcgtggccgtggtaatcgatcaatatcgcaacaagcgcaagaccaagcgctga

SEQ ID NO: 40694 - protein, 341 aa, Pseudomonas syringae pv. syringae B728a
MSDAILQNKPAMTPTRSKRRLPTELSIFLVLIGIGLIFELFGWIVRDQSFLLNSQRLVLMILQVSIIGLLAIGVTQVIITTGIDLSSGSVLALSAMIAASLAQTSDFSRAVFPSLTDLPVWIPVVVGLGVGLLAGAINGSIIAITGIPPFIATLGMMVSARGLARFYTEGQPVSMLSDSYTAIGQGAMPVIIFLVVAVIFHIALRYTKYGKYTYAIGGNMQAARTSGINVKRHLVIVYSIAGLLAGLAGVVASARAATGQAGMGMSYELDAIAAAVIGGTSLSGGVGRITGTVIGALILGVMASGFTFVGVDAYVQDIIKGLIIVVAVVIDQYRNKRKTKR

SEQ ID NO: 40695 - DNA, 972 bp, Haemophilus influenzae 86-028NP
  CDS (1)..(972): transl_table=11
atgatgaaaaatgaaacatctaattttcaaataggaagatttttgattgaacagcgttcttttattgcgttgattattcttatcgcgattgtatcaatgattaatcctgatttttttagcgtagataatattttgaatattttacgccaaacttcggttaatgcgattattgcagtgggtatgactttcgttattttaattgcaggtatagatctttctgttggatctgtattggcattgacaggtgcaatcgccgcttcaatggtgagtatcgaattgcctatttttttagtcattcctgtggttttattgattggaacacttcttggtggcataagtggtgtaattgtggcaaaagggaaagttcaggcttttattgctaccttggttaccatgaccttactgcgtggtataacaatggtttatacagatggtcgtcctattacgacaggtttttcggataatgctgatctatttgctagcattggtacaggctatgttttaggtatcccagtaccaatttggattatgagtatcgtgtttgcggttgcttggtatattttaaaacacacaccaatcggtcgctatatttatgctttaggtggaaatgaggcagcgacccaactttctggtattaacgtcaataaaatcaaagtatttgtttttgcggtgagtggatttctttctgcgctggcgggtttaattgtaacttcacgtttatcttccgctcaacccactgctggcgtatcttatgaattagatgcaattgccgccgtggtagtcggtggaaccagtttgatgggggggaaaggtcgtgtaatgggaactctcatcggtgcattaatcatcggatttttaaacaatgcattaaatttattagatatttcatcttactatcaaatgatagcaaaagcgttggttattttggttgctgttttagccgataactatcttggtacaaaaaaactgtaa

SEQ ID NO: 40696 - protein, 323 aa, Haemophilus influenzae 86-028NP
MMKNETSNFQIGRFLIEQRSFIALIILIAIVSMINPDFFSVDNILNILRQTSVNAIIAVGMTFVILIAGIDLSVGSVLALTGAIAASMVSIELPIFLVIPVVLLIGTLLGGISGVIVAKGKVQAFIATLVTMTLLRGITMVYTDGRPITTGFSDNADLFASIGTGYVLGIPVPIWIMSIVFAVAWYILKHTPIGRYIYALGGNEAATQLSGINVNKIKVFVFAVSGFLSALAGLIVTSRLSSAQPTAGVSYELDAIAAVVVGGTSLMGGKGRVMGTLIGALIIGFLNNALNLLDISSYYQMIAKALVILVAVLADNYLGTKKL

SEQ ID NO: 40697 - DNA, 1011 bp, Haemophilus influenzae 86-028NP
  CDS (1)..(1011): transl_table=11
atgagtgccttagaaaaaaacaaatcctttgatctcttaaaacaaaatgcgatttattttgtgttattgattttgctcggcatcatcattgcacaagatccgacattcttaaatttagtcaatttcagtaacatcttaacccaatcttctgtacgtttaattattgctttaggggttgcgggtttattgattacacaagggactgacttatctgcaggtcgtcaagttggtttgtctgcagttatctctgcaacaatgttgcaatcaatggaaaatattaaccgcgtgttccctgaaatgggacaaataccaattccagtggttattctcgcagtttgtgctatcggtgcagtaattggtttagtgaatggtttagttatcgcttacttaaatgtaactccattcatcgcaaccatgggtacaatgatcatcatatatggtttcaactcactatactatgatgctgtaggtggttctccaatcgcaggttttagtgaaaatttctcaacatttgctcaaggattcttccgagtcggcagctttaaactctcttacatcacgatttatgcagctattgcagcattattagtatggattatgtggaacaaaactcgtttcggtaaaaacgtatttgctattgggggtaacccagaagcagctaaagtttcaggcgtgaatgttgctcgtaacttagttgcaatctatatgattgcaggtatgttctatgcctttggtggtatgcttgaagcgggtcgtatcggttctgcaactaacaacttaggttttatgtatgaattagatgctatcgccgcttgcgtagtgggtggcgtatcttttgctggtggggtaggtacagtaattggtgttatcactggggttattatctttactgttatcaactacggtttaacttacatcggtgtaaacccttactggcaatacatcattaaaggtagcattatcattctagcggtagccattgactcgttaaaatatgcgaagaaaaaataa

SEQ ID NO: 40698 - protein, 336 aa, Haemophilus influenzae 86-028NP
MSALEKNKSFDLLKQNAIYFVLLILLGIIIAQDPTFLNLVNFSNILTQSSVRLIIALGVAGLLITQGTDLSAGRQVGLSAVISATMLQSMENINRVFPEMGQIPIPVVILAVCAIGAVIGLVNGLVIAYLNVTPFIATMGTMIIIYGFNSLYYDAVGGSPIAGFSENFSTFAQGFFRVGSFKLSYITIYAAIAALLVWIMWNKTRFGKNVFAIGGNPEAAKVSGVNVARNLVAIYMIAGMFYAFGGMLEAGRIGSATNNLGFMYELDAIAACVVGGVSFAGGVGTVIGVITGVIIFTVINYGLTYIGVNPYWQYIIKGSIIILAVAIDSLKYAKKK

SEQ ID NO: 40699 - DNA, 939 bp, Staphylococcus haemolyticus JCSC1435
  CDS (1)..(939): transl_table=11
atgaaacagttaacagctaaaacatcgttcatggaaaagattattccatttattggtctgattttactaattattgtagtgagtattttaaacccatcatttttagatttatctaatttactcaatttattaagacaaatttctatcaatggtctgattgcctttggtatgacattcattatcttaactggtggtatagacttatcagttggttcaattcttgcattatcatcggcgtttattgcattaatgattacgagtggtgttgacccaataattgcattaattattggcgtactgattggttttgttttaggtgcagtgaacggtttattagttactaaaggaaatatggcgccatttattgcaacacttgcgacgatgacgattttccgtggattaacattagttattactgacggaaatccaataacaaatttaggggatagttatttattccaattatttggtaagggctactttatcggtattccagtaccagcagtaacaatgattatcgtgtttgtgattttgcttattattcttcaaaaaacaacgtttggacgtcatacatatgcaattggtgggaatgaagtagctgctaaaatttcaggtattaaagttaataaaattaaaattttaatttatggaatttcagggctaatgtcagcgttagcaggaggcatattaacatcacgtttaaattctgcacaaccaacagcgggtacttcttatgagttagacgctattgctgccgtagtacttggtggtacgtcattaacaggtggtaaaggacgaattgttggaacattaataggtgtacttattataggtgttttaaataatggattaaatttacttggtgtttcttcattctaccaacaagtcgttaaaggtgtagttattttaattgcggtattaattgatcgtaaaaaataa

SEQ ID NO: 40700 - protein, 312 aa, Staphylococcus haemolyticus JCSC1435
MKQLTAKTSFMEKIIPFIGLILLIIVVSILNPSFLDLSNLLNLLRQISINGLIAFGMTFIILTGGIDLSVGSILALSSAFIALMITSGVDPIIALIIGVLIGFVLGAVNGLLVTKGNMAPFIATLATMTIFRGLTLVITDGNPITNLGDSYLFQLFGKGYFIGIPVPAVTMIIVFVILLIILQKTTFGRHTYAIGGNEVAAKISGIKVNKIKILIYGISGLMSALAGGILTSRLNSAQPTAGTSYELDAIAAVVLGGTSLTGGKGRIVGTLIGVLIIGVLNNGLNLLGVSSFYQQVVKGVVILIAVLIDRKK

SEQ ID NO: 40701 - DNA, 1023 bp, Pseudomonas fluorescens Pf-5
  CDS (1)..(1023): transl_table=11
atgaacgcgataatcgacaacaaacccgcggcggtggcagtcaagccccggcgacgactgcccaccgagctgagcatcttcctggtgctgatcggtatcggcctggtgttcgagctgtttggctggatcgtccgcgaccagagtttcctgctcaattcccagcgcctggtgctgatgattctccaggtctcggtgatcggcctgctggccatcggcgtgacccaggtgatcatcaccaccggcatcgacctgtcttccggttcggtgctggccctgtcggcgatgattgccgcaagcctggcccagacctcggacttcacccgggcggtgtttccatccctgaccgacctgccggtgtggatcccggtgctggccgggctcggggtcggcctcctggcgggggcgatcaacggcagtgtgattgccctgaccggcattcctccctttattgccaccctgggaatgatggtctcggcccgggggctggcgcgttactacacccagggccagccggtgagcatgctctccgattcctacaccgccatcggccacggggcgatgccggtggtgatcttcctggtggtggcgctgatctttcatatcgccctgcgctacaccaagtacggcaagtacacctatgccatcggcggcaacatgcaggcggcgcggacttcggggatcaacgtcaagcgccacctggtgattgtctacagcattgccgggctgttggcggggctggccggggtggtggcctcggcacgggccgccaccgggcaggcggggatgggcatgtcttacgagctggacgcgattgccgcggcagtgatcggcggcaccagcctggccggcggggtggggcgcatcaccggcaccgtgatcggcgcgctgatcctcggggtcatggccagtggcttcacctttgtcggggtcgatgcctacatccaggacatcatcaagggcctgatcatcgtggtggcggtggtcatcgaccagtaccgcaacaagcgcaagctcaagcgctga

SEQ ID NO: 40702 - protein, 340 aa, Pseudomonas fluorescens Pf-5
MNAIIDNKPAAVAVKPRRRLPTELSIFLVLIGIGLVFELFGWIVRDQSFLLNSQRLVLMILQVSVIGLLAIGVTQVIITTGIDLSSGSVLALSAMIAASLAQTSDFTRAVFPSLTDLPVWIPVLAGLGVGLLAGAINGSVIALTGIPPFIATLGMMVSARGLARYYTQGQPVSMLSDSYTAIGHGAMPVVIFLVVALIFHIALRYTKYGKYTYAIGGNMQAARTSGINVKRHLVIVYSIAGLLAGLAGVVASARAATGQAGMGMSYELDAIAAAVIGGTSLAGGVGRITGTVIGALILGVMASGFTFVGVDAYIQDIIKGLIIVVAVVIDQYRNKRKLKR

SEQ ID NO: 40703 - DNA, 1137 bp, Pseudomonas syringae pv. phaseolicola 1448A
  CDS (1)..(1137): transl_table=11
atgaaccaggtcaaacagttcttcacccgctacaaaatgcttgcgctggtgattgccatcgcagtgatctggctgttcttcagttggcagaccgatggagggtttctgaccccgcgcaacctttccaacctgctgcggcagatgtccatcaccggcattctggcttgcggcatggtattggtgatcatcagtggcgagatcgacctgtcggtgggttcattgctgggcctgctcggggggctggcggcgattctggatgtggtttaccaggtgccgctgctggcaaacctgagcgtggttgcgctatgtgggctgatgattggcctggccaacggctacatgacggcctacctgcgcattccctccttcattgtcgggctgggcggtatgctggcctttcgcggcattcttctggggattaccggcggcacgaccatcgccccggtatcgccttcgctggtctacgtcggccagggatatttgccgcactctgtcggtacagcgcttggcgtactgttgctggccctgacgctgttcctgacctggaaacaacggcgcaatagagccctgcacgggctggcggcacattcgatgatccgtgatgtgttacgcgtggtattgatcggcgctgtgttgggcgggtttgtctatgtgctcaacagctacgacggaatccccgttccggtattgctgttgctggtcctgctcggtgtgttcagttatgtcaccagccagacggttttcggacggcgcgtctatgcggtgggcagcaacatggaagccacgcggttatccggcatcaacgtacaggccgtaaaactgtggatcttcggcatcatgggcgtcatgtgtgccttcgccgggctggtcaataccgcacgcctggctgcaggctcaccctcggccggcaacatgggcgaactggacgccattgccgcctgttttatcggcggcacgtccatgcgcggtggctcgggcactgtctacggtgcactgcttggcgcgctggtcatcaccagtctcgataacggcatgtccatgctcgacgtcgacagttactggcagatgatcgtcaagggcggcatcctcgtgctggcggtgtgggtggacgtgagcacacgggccggacggcggtga

SEQ ID NO: 40704 - protein, 378 aa, Pseudomonas syringae pv. phaseolicola 1448A
MNQVKQFFTRYKMLALVIAIAVIWLFFSWQTDGGFLTPRNLSNLLRQMSITGILACGMVLVIISGEIDLSVGSLLGLLGGLAAILDVVYQVPLLANLSVVALCGLMIGLANGYMTAYLRIPSFIVGLGGMLAFRGILLGITGGTTIAPVSPSLVYVGQGYLPHSVGTALGVLLLALTLFLTWKQRRNRALHGLAAHSMIRDVLRVVLIGAVLGGFVYVLNSYDGIPVPVLLLLVLLGVFSYVTSQTVFGRRVYAVGSNMEATRLSGINVQAVKLWIFGIMGVMCAFAGLVNTARLAAGSPSAGNMGELDAIAACFIGGTSMRGGSGTVYGALLGALVITSLDNGMSMLDVDSYWQMIVKGGILVLAVWVDVSTRAGRR

SEQ ID NO: 40705 - DNA, 963 bp, Pseudomonas syringae pv. phaseolicola 1448A
  CDS (1)..(963): transl_table=11
atgtctaccgaatccagcctgcaggctccccgtcagggcatgaacctgcgtcgttttgccgatgactgggtgatgctcctggctgccgtgggaatcttcctgctgtgcgccgtgttcatcgacaacttcatgtcaccgctgaacatgcgggggctaggccttgcgatttccaccgtgggcattgctgcctgcaccatgctcttttgtctggcgtccgggcacttcgacctttcggtcggttcggtgctggcctgttccggggtcatcgccgggattgttatccgcgacaccgacagcgtgtttctcggtgtttccgccgcgctggcgctggggctggtggttggtctgatcaatggcatcgtgattgccaagctgcgcatcaatgccctgatcacgaccctggcgaccatgcagatcgtgcgcggccttgcgtatatcttctccaacggcaaggccgtcggcgtctccaacgaggatttcttcatcttcggcaatggccagatatatggcgtgccggtgccgatcctgatcaccatcgcctgtttcatattcttcggctggttgctcaactacaccacctacgggcgcaacaccatggccatcggtggcaaccaggaagctgcattgctggcgggtgtgcatgtcgatcgcaccaagatcatcatcttcgcggttcacgggcttgtcggggcactggctggcgtggttctggcttcgcgtatgacctcggggcagccaatgatcggtcagggcttcgagctgaccatcatctcggcttgcgtactgggcggtgtttcgctgagcggcggcatcggcatgatccgccatgtaatcgctggtgtgctgattctggcgatcatcgagaatgcgatgaacctgaagaatatcgatacgttctaccaatacgtgattcgcggcacgattctgttgctggcggtgatcatcgaccgactgaaacgctga

SEQ ID NO: 40706 - protein, 320 aa, Pseudomonas syringae pv. phaseolicola 1448A
MSTESSLQAPRQGMNLRRFADDWVMLLAAVGIFLLCAVFIDNFMSPLNMRGLGLAISTVGIAACTMLFCLASGHFDLSVGSVLACSGVIAGIVIRDTDSVFLGVSAALALGLVVGLINGIVIAKLRINALITTLATMQIVRGLAYIFSNGKAVGVSNEDFFIFGNGQIYGVPVPILITIACFIFFGWLLNYTTYGRNTMAIGGNQEAALLAGVHVDRTKIIIFAVHGLVGALAGVVLASRMTSGQPMIGQGFELTIISACVLGGVSLSGGIGMIRHVIAGVLILAIIENAMNLKNIDTFYQYVIRGTILLLAVIIDRLKR

SEQ ID NO: 40707 - DNA, 1884 bp, Pseudomonas syringae pv. phaseolicola 1448A
  CDS (1)..(1884): transl_table=11
atgatcatggacgagcccacctcggcgattggcgagcgcgaggcgcaaaccctgttcaaggccatccgccgactggctgctcgaggcgcaggcatcatctatgtctctcaccgcctcagcgagctggcgcagattgccgacgactacagcatctttcgcgatggcgctttcgtcgaaagcggacgcatggctgatatcgaccgggcacacctggtgcgcggtatcgtgggccaggagttgcagcgcatcgaccacaaggtgggtcgtgaatgcgccgccgagtgctgcctgaatgtcgaaagcctgagccgcaacggcgaattcgaagacatcagcctgcacgtgcgccacggtgaaattctcggcatctacgggctgatggggtcgggtcgcagcgagtttctcaactgcctgtacggcctgaccacgcccgattcgggcagtgtcaccctgcaaggcaaacccatgccgatcggtctgcccaaggcaaccatccgcgcaggcgtttcactggtcaccgaagaccgcaaggacagcggcctggtgctcagtggcagcattctttccaacatcgccttgtcggcttatagacagctgtcgaactggtcgctgatcgatgcgcgcaaagagcacaagctggccgaagacatggtcaggcgcctgcagatcaagaccgcatcactggatctgcccgttgcgtcgatgagcggcggcaaccagcagaaagtggttctcgccaaatgcctttcgaccgagccggtctgcctgctctgcgacgagccgacccgaggcattgacgagggcgccaaacaggaaatctatcacctgctggatcagttcgtacgcggatgccgatctttcccaggaagtcctgctgagtcttgcctcatgaatgccaaaaccattgtcgcccctgccaccactgccaccactgccaccactgcgccacgcagccgcctgcgcttgtccgttgatcgctttggcctgccgctagtgttcattctgctgtgcctggtgatggcctttgccagcgaatatttcatgacctggcgcaactggatggacattctgcgccagacgtcgatcaacggcattctcgcggtcggcatgacctacgtcatcctgaccaagggcatcgacctttccgtcggctctattctggcgtttgccgggttgtgcagcgcactggtggcaacgcagggttacggccttctggctgcggtcagcgccgggatgttcgccggggccatgctaggcgtggtcaacggtttcatggtcgccaacctttcaatcccgccgtttgtggccactctgggcatgctcagtatcgcccgaggcatgaccttcatcctcaatgatggcagcccggtgacagacctgcccgaagagtatctggcgctgggcatcggcagggtcggcccgattggtgtgcccatcatcatctttgccgtggtcgcgctgattttctggatggtcctgcgctacaccacttatggccgctatgtgtacgccgtcggcggcaacgaaaagagcgcacgcacctccgggatcggtgtgcgcaaggtgatgttttcggtgtacgtggtttccgggctgctggcagggctggctggcgtggtgctgtccgccagaaccacctccgccctgccccaggccggtatgtcttatgagctggacgccatcgccgcggtggtcatcggcggcaccagcctgtcgggaggcaccggcagcatcgtcggcacactgttcggcgcattgctgatcggggtgatcaacaacggcctgaacctgctcggcgtgtcttcctattaccagcaggtcgccaagggcctgattatcgtgtttgcggtgttgattgacgtgtggcgcaagaaaaaacgctaa

SEQ ID NO: 40708 - protein, 627 aa, Pseudomonas syringae pv. phaseolicola 1448A
MIMDEPTSAIGEREAQTLFKAIRRLAARGAGIIYVSHRLSELAQIADDYSIFRDGAFVESGRMADIDRAHLVRGIVGQELQRIDHKVGRECAAECCLNVESLSRNGEFEDISLHVRHGEILGIYGLMGSGRSEFLNCLYGLTTPDSGSVTLQGKPMPIGLPKATIRAGVSLVTEDRKDSGLVLSGSILSNIALSAYRQLSNWSLIDARKEHKLAEDMVRRLQIKTASLDLPVASMSGGNQQKVVLAKCLSTEPVCLLCDEPTRGIDEGAKQEIYHLLDQFVRGCRSFPGSPAESCLMNAKTIVAPATTATTATTAPRSRLRLSVDRFGLPLVFILLCLVMAFASEYFMTWRNWMDILRQTSINGILAVGMTYVILTKGIDLSVGSILAFAGLCSALVATQGYGLLAAVSAGMFAGAMLGVVNGFMVANLSIPPFVATLGMLSIARGMTFILNDGSPVTDLPEEYLALGIGRVGPIGVPIIIFAVVALIFWMVLRYTTYGRYVYAVGGNEKSARTSGIGVRKVMFSVYVVSGLLAGLAGVVLSARTTSALPQAGMSYELDAIAAVVIGGTSLSGGTGSIVGTLFGALLIGVINNGLNLLGVSSYYQQVAKGLIIVFAVLIDVWRKKKR

SEQ ID NO: 40709 - DNA, 1026 bp, Pseudomonas syringae pv. phaseolicola 1448A
  CDS (1)..(1026): transl_table=11
atgagcaacgcgatttcgcaaaacaaaccagccttggcaccgaccaggaacaaacggcggctgccaaccgagctgagtatttttctggtgctgatcggtataggtctgatctttgagctgtttggctggatcgtccgtgatcagagctttctgctcaactcccagcgtctggtactgatgatccttcaggtgtcgatcatcggcttgctggccatcggcgtgactcaggtgatcattaccacaggcatcgacctgtcgtccggttcggtgctggcactgtcagcgatgattgccgcgagcctggcgcaaacctcggacttttcccgggcggtatttccttccttgaccgacctgcccgtgtggattccgatcgtggtcgggctcggagtcgggctgctggcgggtgccatcaacggcagcatcattgccataaccggtattccgccattcattgccacgctgggcatgatggtctccgcgcgtggcctggcgcgcttctacaccgaaggtcagccggtgagcatgctctctgactcctacacggctatcggacagggcgcgatgccggtgatcatctttctggtggtggcggtgatcttccacattgccctgcgttacaccaagtacggcaaatacacctacgccatcggcggcaacatgcaggctgcgcgtacttccgggatcaacgtcaagcgccacctggttatcgtctatagcatcgccgggctgctggccgggctggcaggggtggttgcctcggcacgtgccgcaaccgggcaggccagaatgggcatgtcctatgaactggacgctatcgctgccgcagtcatcggcggcaccagcctgtccggtggagtagggcgaatcaccggcactgtgatcggtgcgctgattctcggcgtaatggccagtggtttcacctttgtcggcgtagacgcttatgttcaggacattatcaaaggcctgatcattgtagtggcggtggtaatcgatcaatatcgcaacaagcgcaagaccaagcgctga

SEQ ID NO: 40710 - protein, 341 aa, Pseudomonas syringae pv. phaseolicola 1448A
MSNAISQNKPALAPTRNKRRLPTELSIFLVLIGIGLIFELFGWIVRDQSFLLNSQRLVLMILQVSIIGLLAIGVTQVIITTGIDLSSGSVLALSAMIAASLAQTSDFSRAVFPSLTDLPVWIPIVVGLGVGLLAGAINGSIIAITGIPPFIATLGMMVSARGLARFYTEGQPVSMLSDSYTAIGQGAMPVIIFLVVAVIFHIALRYTKYGKYTYAIGGNMQAARTSGINVKRHLVIVYSIAGLLAGLAGVVASARAATGQARMGMSYELDAIAAAVIGGTSLSGGVGRITGTVIGALILGVMASGFTFVGVDAYVQDIIKGLIIVVAVVIDQYRNKRKTKR

SEQ ID NO: 40711 - DNA, 1251 bp, Mycoplasma hyopneumoniae J
  CDS (1)..(1251): transl_table=4
atggaattttttaataattttaaaaataatttaaaagattttgcaaaaccagttaaaaattatctaaatgagacaaaaagtggacattatcttcaagccagcctccaccatctaaaaaaattttcaatgttatatatttttcttctggtttttgttatttttttagggattaccaaaggaactttattacaagcaaatacattcacccttttatttcaaaataattcttatattattattttggcaatggggatgctacttgtaattttaagtggaaatattgatctttctgttggaactcttgtcggtcttttaggactattttcggtttatatttataataataccggccaaagtatttgactaacttttatacttacaacgctaatcggggctgcaattggttttatccaaggctgacttattggttatggaaatatcccggcatttattgtaactttaggtggatttcttgcttttaaaggggctcaacttgtctattcaaatggggcaacactgactccaattggatccgttgattcaacttatattaagggaacaattgaaggaatccctgatctaaaagtagggaatatttgaattttttctttacttttacctctaattttaggcgcaattattgttagtctgcgaacttgaggatattatacaaaaagaaaatttggcattaaagttcaaaatattattatttttacaataattcaagtaattattttttctttattccttgcttgtggtataatattttcacttggagataaatcaatgcgttactatgttttatatgtaggtattgcactggctttatttacttttcttagccaaaataccgcttttgggcgctctgtttatgcaattggtggcaaccggaaagctgctctattatccggagtcaatgttaaaagaacaacaatgataatttttattatcattggcgcactagccggattttcttcgattattttcacagctacttattcttctgcgacttcttcgcgaggtgatgatcttgctcttgatgtcatttcagttgtctttactggtggagcttcagtctatggtggaattggatcggttagtggaacgatattaggaacatcaattatcggggtaatcaaccaaggtttgcttgttctaaatgttgccgaatcacaaaaatacataattaaaggactaattttagttgctgttgttggatgagatgttctctcaaataagaaaaataactaa

SEQ ID NO: 40712 - protein, 416 aa, Mycoplasma hyopneumoniae J
MEFFNNFKNNLKDFAKPVKNYLNETKSGHYLQASLHHLKKFSMLYIFLLVFVIFLGITKGTLLQANTFTLLFQNNSYIIILAMGMLLVILSGNIDLSVGTLVGLLGLFSVYIYNNTGQSIWLTFILTTLIGAAIGFIQGWLIGYGNIPAFIVTLGGFLAFKGAQLVYSNGATLTPIGSVDSTYIKGTIEGIPDLKVGNIWIFSLLLPLILGAIIVSLRTWGYYTKRKFGIKVQNIIIFTIIQVIIFSLFLACGIIFSLGDKSMRYYVLYVGIALALFTFLSQNTAFGRSVYAIGGNRKAALLSGVNVKRTTMIIFIIIGALAGFSSIIFTATYSSATSSRGDDLALDVISVVFTGGASVYGGIGSVSGTILGTSIIGVINQGLLVLNVAESQKYIIKGLILVAVVGWDVLSNKKNN

SEQ ID NO: 40713 - DNA, 1251 bp, Mycoplasma hyopneumoniae 7448
  CDS (1)..(1251): transl_table=4
atggaattttttaataatttaaaaaataatttaaaagattttgcaaaaccagttaaaaattatctaaatgagacaaaaagtggacattatcttcaagccagcctccaccatctaaaaaaattttcaatgttatatatttttcttctggtttttgttatttttttagggattaccaaaggaactttattacaagcaaatacattcacccttttatttcaaaataattcttatattattattttggcaatggggatgctacttgtaattttaagtggaaatattgatctttctgttggaactcttgtcggtcttttaggactattttcggtttatatttataataataccggccaaagtatttgactaacttttatacttacaacgctaatcggggccgcaattggttttatccaaggctgacttattggttatggaaatatcccggcatttattgtaactttaggtggatttcttgcttttaaaggggctcaacttgtctattcaaatggggcaactctgactccgattggatctgttggatcaacttatattaaaggaacaattgaaggaatccctgatctaaaagtagggaatatttgaattttttctttacttttacctctaattttaggcgcaattattgttagtctgcgaacttgaggatattatacaaaaagaaaatttggcattaaagttcaaaatattattatttttacaataattcaagtaattattttttctttattccttgcttgtggtataatattttcacttggagataaatcaatgcgttactatgttttatatgtaggtatcgcactggctttatttacttttcttagccaaaataccgcttttgggcgctctgtttatgcaattggtggaaaccggaaagctgctctattatccggagtcaatgttaaaagaacaacaatgataatttttattatcattggcgcacttgctggattttcttcgattattttcacagctacttattcttctgcgacttcttcgcgaggtgatgatcttgctcttgatgtcatttcagttgtctttactggtggagcttcagtctatggtggaattggatcggttagtggaacaattctaggaacatcaattatcggggtaatcaaccaaggtttacttgttctaaatgttgccgaatcacagaaatacataattaaaggactaattttagttgctgttgttggatgagatgttctctcaaataagaaaaataactaa

SEQ ID NO: 40714 - protein, 416 aa, Mycoplasma hyopneumoniae 7448
MEFFNNLKNNLKDFAKPVKNYLNETKSGHYLQASLHHLKKFSMLYIFLLVFVIFLGITKGTLLQANTFTLLFQNNSYIIILAMGMLLVILSGNIDLSVGTLVGLLGLFSVYIYNNTGQSIWLTFILTTLIGAAIGFIQGWLIGYGNIPAFIVTLGGFLAFKGAQLVYSNGATLTPIGSVGSTYIKGTIEGIPDLKVGNIWIFSLLLPLILGAIIVSLRTWGYYTKRKFGIKVQNIIIFTIIQVIIFSLFLACGIIFSLGDKSMRYYVLYVGIALALFTFLSQNTAFGRSVYAIGGNRKAALLSGVNVKRTTMIIFIIIGALAGFSSIIFTATYSSATSSRGDDLALDVISVVFTGGASVYGGIGSVSGTILGTSIIGVINQGLLVLNVAESQKYIIKGLILVAVVGWDVLSNKKNN

SEQ ID NO: 40715 - DNA, 1254 bp, Thermobifida fusca YX
  CDS (1)..(1254): transl_table=11
atggctcagcaaaccaccccggctccccagggcgccacggtcgcccgggacccccggctcatcatggacggctccggtctaggcgggctggtgcgcggcgcgctgcgccggctccgcagcggagaactcggcccgctgccggtcctcgtcggactcatcgtgatcgccggcgtcttctggagcctcaaccccaagttcctcaccgcccagaatctgtccaacctcaccctgcagatcgtcgccgtcggcttcatggcctgcggcgtgatcatggtgctgctgctcggggagatcgacctctccgtcggatcggtcgcaggcgtgtgcggcgtgatcgtgacgctcctggcagtcaactaccagtggaacgagatcgccgcgatcgtggtcgccatcctcgccggcaccctcatcggcaccctgcacggcacgatcttcgccaagatcggggtacccgccttcgtggtcaccttggccggattgatcggctggcagggcgcccagctctacctgctcggccctgaaggcacgatcaacgtcccctacaacggcctgatcggtgccatcacccacacctatctcgtcccggcggtcggctgggggatcggaatcaccgcggtcgccctctacgggctgatcagcgtccgcggggcgcgccgccgcgccgcggccgggctgcccgccaagtcggtcacggagatcggggtgcgcaccgcgctcctcgccctccccgtcctcggcggggtgtgggtgctcaactccttccgcggagtgcccgtcgctttcctgctcttcgtcggggtcgtggtgctcttcgacctgatcctgcggaagacccgctacgggcggatggtgttcgccgtgggcggcagcgcagaagcggcacgccgcgccggcatcaacgtcgacctgatccgcatctccgtgttcgctctcgcctccaccctggccggggtgggcggcatcctcctcgtgtcgcgcagctacgccgtcaaccagctcaccgggggcggcgacgacctgatgatggcgatcgcggccgcggtcatcggcggcaccagcctcttcggcggacgcggcagcgcctactcggccctgctcggcggcctcgtgctcggcgcgatctcctcggggctgtacctgctgcagatggactcctcggtgcggttcatgatcaccgcggtggtcctcctggtagcggtcatcctcgacgcggtgtcccgccggacccgcaaagcccacgcccgggagtag

SEQ ID NO: 40716 - protein, 417 aa, Thermobifida fusca YX
MAQQTTPAPQGATVARDPRLIMDGSGLGGLVRGALRRLRSGELGPLPVLVGLIVIAGVFWSLNPKFLTAQNLSNLTLQIVAVGFMACGVIMVLLLGEIDLSVGSVAGVCGVIVTLLAVNYQWNEIAAIVVAILAGTLIGTLHGTIFAKIGVPAFVVTLAGLIGWQGAQLYLLGPEGTINVPYNGLIGAITHTYLVPAVGWGIGITAVALYGLISVRGARRRAAAGLPAKSVTEIGVRTALLALPVLGGVWVLNSFRGVPVAFLLFVGVVVLFDLILRKTRYGRMVFAVGGSAEAARRAGINVDLIRISVFALASTLAGVGGILLVSRSYAVNQLTGGGDDLMMAIAAAVIGGTSLFGGRGSAYSALLGGLVLGAISSGLYLLQMDSSVRFMITAVVLLVAVILDAVSRRTRKAHARE

SEQ ID NO: 40717 - DNA, 1023 bp, Ralstonia eutropha JMP134
  CDS (1)..(1023): transl_table=11
atgcgcaattccattcatcccacggcgcacgccgttgcttcacaaggcgcggcgcgcacgcttggtcgccccggcggcgccaccacgcaggaacgccttcgagccctcggcatgctgccggtgctggtgctgctgtgcgccggcttcacggtgctgaccgacaacttcgccagcctgcaaaacctgtcgatcatcgcgcagcaggcgtcgatcaacctggtgctggcggccggcatgaccttcgtcatcctgacgggcgggatcgacctgtcggtcggttccatcctgtcgatctcggcggtggcggcgatgctgacgtcgctgacgccggaactgagtgcgctcagcgtgcccgccgcgctgctgtgcggcctgctgttcgggctggtgaacggcgcgctgattgccttcatgaagctgccgccgttcatcgtcacgctcggaagcctgaccgcagtgcgcgggctggcgcggctggtcgggcatgacagcacgctctacaacccggacatcggttttgccttcatcggcaatggcgacgtgctgggcgtgccgtggctcgtgatcatcgcgggtgccgtgatcgcggtgtcctgggtcgtgctgcgccggaccgtactggggctgcagatctacgccgtgggcggcaacgccgaggcggcgcggctgtcgggcatcaaggtgtgggtggtgctgctgttcgtctatgccgtgtctggcctgctggcggggctgggcggcgtgatgtccgcctcgcgcctgtacgcggccaacggcctgcagttgggccagtcttatgagctcgatgcgatcgccgcggtgatcctcggtggcacgagcttcgtgggcggcgtcggctccatcggcggcacgctgatcggcgcgctgatcattgccgcgctttccaatgggctggtgctgctgggtgtgtcggacatctggcaatacatcatcaagggtctggtcatcatcggcgcggtggcgctggaccgctatcgccagaagggctcggcccggacctga

SEQ ID NO: 40718 - protein, 340 aa, Ralstonia eutropha JMP134
MRNSIHPTAHAVASQGAARTLGRPGGATTQERLRALGMLPVLVLLCAGFTVLTDNFASLQNLSIIAQQASINLVLAAGMTFVILTGGIDLSVGSILSISAVAAMLTSLTPELSALSVPAALLCGLLFGLVNGALIAFMKLPPFIVTLGSLTAVRGLARLVGHDSTLYNPDIGFAFIGNGDVLGVPWLVIIAGAVIAVSWVVLRRTVLGLQIYAVGGNAEAARLSGIKVWVVLLFVYAVSGLLAGLGGVMSASRLYAANGLQLGQSYELDAIAAVILGGTSFVGGVGSIGGTLIGALIIAALSNGLVLLGVSDIWQYIIKGLVIIGAVALDRYRQKGSART

SEQ ID NO: 40719 - DNA, 966 bp, Ralstonia eutropha JMP134
  CDS (1)..(966): transl_table=11
atgagctccgccatcctgaacatgccgctgtccgcggactcccgcgcgcttgtcggccgcctgctggcgctggccgtgctgtgcgcgctgctgtcggtatcgtcggacgcgttcctgacgctgggcaacctgctcaatgtgctgcggcaggcgagcctgctgttcctgctcgcttctgggctgacgcttgtgatcctgacgggcggcctcgacctttccgtcggggccaacgtggcgatgtccgcgtgtctggcggcaagcgtcatgaaggcgacggaatcgaccatgctcggcgtaggtgccggtctcggttgcggcgtgctgatcggcctggcgaacggcctgctggtggctgcgctgcgtatcccgccgttcattgccacgtacggcatgttgtgggtgctgcatggcctgacgtactggttcatggcgggtgaaaccatccacggattcgcgccggaattccgcgccatcggcagcggctacctgtggggcgtgccagtgcccgtgttcctgatgctcgccttcctgacagccggcacggtgatctcccagaagaccacctacggccaggagatctatgcgatcggcgccaacccggtcgcggcgcggctctctggcgtgccggtaacctgtcgcctgctgctggtctacgtggtcagcggcgccatggccgggctggcgagcctggtgttcctggcgcgcctgaactccgccgaaggcgatatcggcgaaacgctcacgctgccggccatcgcggcggtgctgatcgggggcacatcgctgttcggcggcgtagggcgggtatccggcacgctcgtcggcgccatcctgctgacgctggtgctgaacggcatgaacctgctcacggtcagcgccaactggcagccgctggtgaccggggtcatcgtggtgctggcggtggtcctagacacgctgtcccgtcgccgtctcggcaagtcatga

SEQ ID NO: 40720 - protein, 321 aa, Ralstonia eutropha JMP134
MSSAILNMPLSADSRALVGRLLALAVLCALLSVSSDAFLTLGNLLNVLRQASLLFLLASGLTLVILTGGLDLSVGANVAMSACLAASVMKATESTMLGVGAGLGCGVLIGLANGLLVAALRIPPFIATYGMLWVLHGLTYWFMAGETIHGFAPEFRAIGSGYLWGVPVPVFLMLAFLTAGTVISQKTTYGQEIYAIGANPVAARLSGVPVTCRLLLVYVVSGAMAGLASLVFLARLNSAEGDIGETLTLPAIAAVLIGGTSLFGGVGRVSGTLVGAILLTLVLNGMNLLTVSANWQPLVTGVIVVLAVVLDTLSRRRLGKS

SEQ ID NO: 40721 - DNA, 942 bp, Staphylococcus saprophyticus subsp. saprophyticus ATCC 15305
  CDS (1)..(942): transl_table=11
atgaaacaatctagcttatcattttcatatttagaaaaaattattccatttattggtttaatattattagtcattatcattagtgtattaaatagtgcatttttagaaccatctaatctgtttaacttattgagacaagtttctataaatggattaattgcatttggtatgacatttgtaattttaacgggcggcatagacttatctgttggttctacactagcgttatccagtgcgcttatagctattttaatggtctcaggtgtagattctatgattgcgctattagtaggctgtattttaggtgcgattttaggtgctattaacgggcttttaattacgcttggtaagatggcgccatttatagcgactttggctacaatgactgtctttagaggtttgacactggttattacagatggcaatccaattactaatttaaatggcagctatgcctttcaattatttggacgaggttattttttaggtattccagttccagcagtgacaatgtttattactttcattattttgtatatcattttacataaaacaatatttggtagacaaacttatgctatgggtggtaatgaaaaggcagcttttatctctggtattaaagtgaataaattaaaaatcatgatttatagtttagctggtttaatgtctgcaatggctggtgcgattctcacatctcgtttaaactcagcgcagccaactgcaggtatgtcatatgaattggatgcaatcgctgctgttgtattgggtggtacatctttaacaggtggtaagggacgtatacttggcacattaataggtgtattaattataggtgtgttgaataatggactaaatttattaggggtttcttcattttaccaacaagtagttaaaggagttgtcattattattgcagtactcattgatagaaagaataaataa

SEQ ID NO: 40722 - protein, 313 aa, Staphylococcus saprophyticus subsp. saprophyticus ATCC 15305
MKQSSLSFSYLEKIIPFIGLILLVIIISVLNSAFLEPSNLFNLLRQVSINGLIAFGMTFVILTGGIDLSVGSTLALSSALIAILMVSGVDSMIALLVGCILGAILGAINGLLITLGKMAPFIATLATMTVFRGLTLVITDGNPITNLNGSYAFQLFGRGYFLGIPVPAVTMFITFIILYIILHKTIFGRQTYAMGGNEKAAFISGIKVNKLKIMIYSLAGLMSAMAGAILTSRLNSAQPTAGMSYELDAIAAVVLGGTSLTGGKGRILGTLIGVLIIGVLNNGLNLLGVSSFYQQVVKGVVIIIAVLIDRKNK

SEQ ID NO: 40723 - DNA, 990 bp, Shigella sonnei Ss046
  CDS (1)..(990): transl_table=11
atgatgtcttctgtttctacatcgggttctggcgcacctaagtcgtcattcagcttcgggcgtatctgggatcagtacggcatgctggtggtgtttgcggtgctctttatcgcctgtgccatttttgtcccaaattttgccaccttcattaatatgaaagggttgggcctggcaatttccatgtcggggatggtggcgtgtggcatgttgttctgccttgcttccggtgactttgacctttctgtcgcctccgtaattgcctgtgcgggtgtcaccacggcggtggttatcaacctgactgaaagcctgtggattggcgtggcagcggggttgctgcttggcattctctgtggcctggtcaatggctttgttatcgccaaactgaaaataaatgctctgatcacaacactggcaacgatgcagattgttcgaggtctggcgtacatcatttcagacggtaaagcggtcggtatcgaagatgaaagcttctttgcccttggttacgctaactggttcggtctgcctgcgccaatctggctcaccgtcgcgtgtctgattatctttggtttgttgctgaataaaaccacctttggtcgtaacaccctggcgattggcgggaacgaagaggctgcgcgtctggcgggtgtaccggttgttcgcaccaaaattattatctttgttctctctggcctggtatctgcgatagccggaattattctggcttcacgtatgactagtgggcagccaatgacgtcgattggttatgagcttattgttatctccgcctgcgttttaggtggcgtttctctgaaaggtggcatcggaaaaatctcatatgtggtggcgggtatcttaattttaggcaccgtggaaaacgccatgaacctgcttaatatttctcctttcgcgcagtacgtggttcgcggcttaatcctgctggcagcggtgatcttcgaccgttacaagcaaaaagcgaaacgcattgtctga

SEQ ID NO: 40724 - protein, 329 aa, Shigella sonnei Ss046
MMSSVSTSGSGAPKSSFSFGRIWDQYGMLVVFAVLFIACAIFVPNFATFINMKGLGLAISMSGMVACGMLFCLASGDFDLSVASVIACAGVTTAVVINLTESLWIGVAAGLLLGILCGLVNGFVIAKLKINALITTLATMQIVRGLAYIISDGKAVGIEDESFFALGYANWFGLPAPIWLTVACLIIFGLLLNKTTFGRNTLAIGGNEEAARLAGVPVVRTKIIIFVLSGLVSAIAGIILASRMTSGQPMTSIGYELIVISACVLGGVSLKGGIGKISYVVAGILILGTVENAMNLLNISPFAQYVVRGLILLAAVIFDRYKQKAKRIV

SEQ ID NO: 40725 - DNA, 999 bp, Shigella sonnei Ss046
  CDS (1)..(999): transl_table=11
atgtctgcttcgtcattaccattgccgcagggcaagagcgtctcgctcaaacaatttgtcagtcgccatattaatgagatcggtttgctggtggtgattgccattctttatctggtcttctccctgaacgcgcctggctttatctcattgaataaccagatgaacgtgctgcgcgatgccgccaccattgggattgccgcctgggcgatgacgctgattattatctccggtgaaattgatgtcagcgttgggccgatggtggcttttgtctcggtgtgcctggcatttttgctgcaatttgaagttccgttggcgattgcttgtctgctggtgttgctgttaggcgcgctgatgggaacgctcgccggggtgctgcgcggcgtgtttaacgtaccaagtttcgttgccacactggggctgtggagcgccctgcgcggaatggggctgtttatgaccaacgcactgccagtgccgattgacgaaaacgaggtgctggactggctgggcggacaatttctcggtgtgccagtatccgcgctgatcatgatggtgttgtttgcgctgtttgtgttcattagccgaaaaaccgccttcgggcgctcggtttttgccgttggcggtaatgccacggcggcgcagttgtgcggtattaacgttcgtcgggtgcgcattcttatctttaccctttcgggattattagcggcggtgaccggcattttgctggcggcacgcctcggttccggtaacgcaggtgccgcaaacggtctggagtttgacgtcatcgccgcggtcgtggtcggcggtacggcactttccggcggtcgcggttccctgttcggtacattgcttggtgtgctggtgattacgctaatcggtaacggtctggtgctgctcggtattaactcctttttccagcaggtggtacgcggcgtcatcatcgtggtggcggtgctggcgaatatcttgctgacccagcgaagcagtaaagcgaaacgctaa

SEQ ID NO: 40726 - protein, 332 aa, Shigella sonnei Ss046
MSASSLPLPQGKSVSLKQFVSRHINEIGLLVVIAILYLVFSLNAPGFISLNNQMNVLRDAATIGIAAWAMTLIIISGEIDVSVGPMVAFVSVCLAFLLQFEVPLAIACLLVLLLGALMGTLAGVLRGVFNVPSFVATLGLWSALRGMGLFMTNALPVPIDENEVLDWLGGQFLGVPVSALIMMVLFALFVFISRKTAFGRSVFAVGGNATAAQLCGINVRRVRILIFTLSGLLAAVTGILLAARLGSGNAGAANGLEFDVIAAVVVGGTALSGGRGSLFGTLLGVLVITLIGNGLVLLGINSFFQQVVRGVIIVVAVLANILLTQRSSKAKR

SEQ ID NO: 40727 - DNA, 1128 bp, Haemophilus somnus 129PT
  CDS (1)..(1128)
atgaataagttcaaatcaatcaatttacaagtctatattatgctgattgccattatggtgattatgttttttttctcaattgcaacagaaggggcttatttaagtgcaagaaatatctctaacttattacgtcaaactgctatcaccggtattcttgctattggtatggtgtttgtgattatctctgcagaaattgacttatcagttggttcactaatggggctactcggtggctttgcggcaattagtaatgtttggtggggttggccgttacccttaactatccttgttaccttgctcttaggtttactaatcggggcgtggagcggttggtgggttgcttatcaaaaagtaccatctttcatcgttaccttagcaggcatgcttgcatttcggggaattttgatcggattaacgaatggtactaccgtttcccccatcagtaatgatatgacaattatcggtcaaggttatctttccgacactatagggataattttagggagcatcataatattttgctttattgcttggggaagttatcagcgtaaagccagacaaaacctaaatttaccagttgccaaaatgcccaaagaaacagtgaaatatggcatgatagcaatccttattcttggtgcaatttatctgcttaacgattatcgaggcatgccaattccagtattaattctctgtggattagccattataggaacattcatttcgaaaaaaacagcatttggtcgacatatttacgcaattggtggcaatattgatgcagctcgcctatcaggtattgccgtggaaaaagttaaattaaccatttttgctcttaacggcttattagtggcaatagccggcttgattttaagttcccgtttaggagccggagcaccctctgccggtcaaaatgcagaactcgatgctattgccgcttgtgttatcggtggagccagtttagccggcggtatcggcagtatttttggcgtagtaatcggggcatttatcatcgccttattggataacggaatgagtatgctggatgtaccgactttttggcaatatattgtaaaaggtggcattttattactagcagtatggatagataccattagtaagaaaaaggtctaa

SEQ ID NO: 40728 - protein, 375 aa, Haemophilus somnus 129PT
MNKFKSINLQVYIMLIAIMVIMFFFSIATEGAYLSARNISNLLRQTAITGILAIGMVFVIISAEIDLSVGSLMGLLGGFAAISNVWWGWPLPLTILVTLLLGLLIGAWSGWWVAYQKVPSFIVTLAGMLAFRGILIGLTNGTTVSPISNDMTIIGQGYLSDTIGIILGSIIIFCFIAWGSYQRKARQNLNLPVAKMPKETVKYGMIAILILGAIYLLNDYRGMPIPVLILCGLAIIGTFISKKTAFGRHIYAIGGNIDAARLSGIAVEKVKLTIFALNGLLVAIAGLILSSRLGAGAPSAGQNAELDAIAACVIGGASLAGGIGSIFGVVIGAFIIALLDNGMSMLDVPTFWQYIVKGGILLLAVWIDTISKKKV

SEQ ID NO: 40729 - DNA, 1128 bp, Actinobacillus pleuropneumoniae serovar 1 str. 4074
  CDS (1)..(1128)
atgttgaagctaaaatctgtcaatttacaagtttatattatgctcattgctattgttgtgattatgagctttttctcggtagcaaccgacggtgcctatttaagcgcacgtaatatttcaaacttattacgccaaacctccattaccgggattttagcgatcgggatggtatttgtgattatctcggcggaaattgacctatccgtcggttcattaatggggttattaggcggattcgccgctatcgccgacgtttggtggggctggtctttaccgcttactattgcggtaacacttgtgctaggtacattattaggtgcttggaacggttggtgggtctcttatcgtaaagtaccgtcctttatcgtcaccttagcggggatgttagccttccgcggtattttaatcggcttaaccaacggtacgaccgtttcaccgattagtaatgatatgaccgctatcggtcaaggctatattccggatgttaccggtatgattctcggtttagtggcggtattctgtttcgttacttgggggacttatcaacgtaaagcgcgtaaaaacttaaacttgaatgtgcctgatgcgacgaaagacattatgaaatacggcttatttgctatctgtgtcttaggtgcgatttacttattgaacgattatcgcggtatcccgttccctgtactggtattagcgattttaaccgtggtcggtatgtttatcgcacgtaaaaccgcatttggtcgccatatttatgccatcggcggtaatattgaggcggcaagactttcagggattaacgttgaaaaagtaaaattaaccattttcgcaatcaacggttttatggtagcgattgccggtttaatccttagtgcgcgtttaggtgcgggggcgccgtctgcaggtcaaaatgcggagctggatgcgattgcggcttgtgtcatcggcggggtaagtttagccggcggtatcggtagcgtatatggcgttattatcggtgcctttattatcgctttacttgataacggtatgagtatgttagacgtgccgactttctggcaatatatcgtaaaaggtgcgattctattattagcggtttgggtcgatactatgagtaagaaaaaaatgtaa

SEQ ID NO: 40730 - protein, 375 aa, Actinobacillus pleuropneumoniae serovar 1 str. 4074
MLKLKSVNLQVYIMLIAIVVIMSFFSVATDGAYLSARNISNLLRQTSITGILAIGMVFVIISAEIDLSVGSLMGLLGGFAAIADVWWGWSLPLTIAVTLVLGTLLGAWNGWWVSYRKVPSFIVTLAGMLAFRGILIGLTNGTTVSPISNDMTAIGQGYIPDVTGMILGLVAVFCFVTWGTYQRKARKNLNLNVPDATKDIMKYGLFAICVLGAIYLLNDYRGIPFPVLVLAILTVVGMFIARKTAFGRHIYAIGGNIEAARLSGINVEKVKLTIFAINGFMVAIAGLILSARLGAGAPSAGQNAELDAIAACVIGGVSLAGGIGSVYGVIIGAFIIALLDNGMSMLDVPTFWQYIVKGAILLLAVWVDTMSKKKM

SEQ ID NO: 40731 - DNA, 1128 bp, Haemophilus influenzae R2866
  CDS (1)..(1128)
atgtttaagttaaaatccgtaaatttacaagtttacattatgttaatagctattgccgtcattatagcattctttagtgttgctactgatggtgcttatttaagtgcaagaaatatttctaacttgttacgccaaacttcaattactggcattcttgcaattggaatggtttttgtcattatttctgctgaaattgacttatctgttggttcacttatgggcctactgggcggatttgcagctattgccgatgtttggtggggcttcccattacctgtaactattattgcaacaattgctcttggtttaatttttggtatttggaatggttggtgggtggcttatcgcaaagtgccatcctttattgttacacttgcaggttatctcgcattccgtggaattttgattggtttgactaatggcacaactgtatctcctattagtggatctatgacagttattggacaaggttatttatcagatattgcaggatttatcttaggtggtattgcagttattggatttgttctttggggaaattatcaacgtagaagtcgccagcagcttcagctggaagtgtctgcattatcaaaagattttacgaaatatgctttgtttgcagtaattgtattaggagcaatttatttacttaatgattatcgtggcattccatttcctgttttagtactagcagttcttgcaatcttagggttattcctctctcgtaaaacttcattcggccgccacgtttatgcgattggtggcaatattgatgcggcaaaattatctggtatcaatgtagagaaaacaaaactgattatctttgcaatgaatggtgtgttagttgcaatagcagggttgattttaagtgctcgtttaggtgcaggctcaccatcggcagggcaaaatgcagaactagatgcgattgcagcttgtgtcattggaggggcaagcttagcgggtggtgtaggaagtgtgtttggggttgttattggtgcacttatcatcgcatcgcttgataatggtatgagtatgcttgatgtgccaactttttggcaatatattgtcaaaggtgccattttgttacttgctgtatggatagatactagtaataagaaaaagatgtaa

SEQ ID NO: 40732 - protein, 375 aa, Haemophilus influenzae R2866
MFKLKSVNLQVYIMLIAIAVIIAFFSVATDGAYLSARNISNLLRQTSITGILAIGMVFVIISAEIDLSVGSLMGLLGGFAAIADVWWGFPLPVTIIATIALGLIFGIWNGWWVAYRKVPSFIVTLAGYLAFRGILIGLTNGTTVSPISGSMTVIGQGYLSDIAGFILGGIAVIGFVLWGNYQRRSRQQLQLEVSALSKDFTKYALFAVIVLGAIYLLNDYRGIPFPVLVLAVLAILGLFLSRKTSFGRHVYAIGGNIDAAKLSGINVEKTKLIIFAMNGVLVAIAGLILSARLGAGSPSAGQNAELDAIAACVIGGASLAGGVGSVFGVVIGALIIASLDNGMSMLDVPTFWQYIVKGAILLLAVWIDTSNKKKM

SEQ ID NO: 40733 - DNA, 1137 bp, Pseudomonas fluorescens PfO-1
  CDS (1)..(1137)
atgaatcaggtcaaacaactcttcacccgctacaagatgctcgcactggtgtttgccgtggcgttgatctggctgttcttcagctggcagaccgagggcggattcctgacaccacgcaacctctccaacctgctgcgccagatgtccatcaccgggatcctcgcctgcggcatggtgctggtcatcatcagcggcgagatcgatctgtccgtcggctcattgctgggcctgctcggtggcgtggcagccattctcgacgttgtctatcacataccactgctggcgaacctgagccttgtggtggtgtgcggactgctgatcggcctcgccaacggctacatggcggcctacctgcgcattccgtcgttcatcgtggggctgggaggcatgctggcttttcgggggattttgctggggatcaccggcggcacgaccattgcgccggtgtcgccggaactcgtctacattggccagggttatctgccccatacggtcggcgcgggtctgggtgtcctgctgttcgcactgacgttgttcctgacctggaaacaacggcgcaatcgcgcccttcacggcctcgcggcacattcactggcgcgtgacgtggcacgcgtgttgctgatcggcgcggtgctggccgggtttgtccagaccctcaacagctatgacggcattcccgtgccggtcctgctcctgctgatcctgctgggcggattcagctatgtgaccagccagaccgtgttcggccgacgcgtctattccgtgggcagcaacatggaagcgacgcgcctgtccggtatcaatgtgcaggccgtgaagctctggatcttcgggatcatgggcgtgatgtgcgccctcgccggcgtggtcaacaccgcgcgcctggccgccggctccccctcggccggcagcatgggcgaactcgacgccatcgccgcctgcttcatcggtggcacctcgatgcgtggcggttccggcacagtctatggcgccctcctcggcgccctggtcatcaccagcctggacaacggcatgtccatgctcgacgtcgacagctactggcagatgatcgtcaagggcagcattctggtgttggcggtttgggttgatgtgagtacgcggactgggcggcgttga

SEQ ID NO: 40734 - protein, 378 aa, Pseudomonas fluorescens PfO-1
MNQVKQLFTRYKMLALVFAVALIWLFFSWQTEGGFLTPRNLSNLLRQMSITGILACGMVLVIISGEIDLSVGSLLGLLGGVAAILDVVYHIPLLANLSLVVVCGLLIGLANGYMAAYLRIPSFIVGLGGMLAFRGILLGITGGTTIAPVSPELVYIGQGYLPHTVGAGLGVLLFALTLFLTWKQRRNRALHGLAAHSLARDVARVLLIGAVLAGFVQTLNSYDGIPVPVLLLLILLGGFSYVTSQTVFGRRVYSVGSNMEATRLSGINVQAVKLWIFGIMGVMCALAGVVNTARLAAGSPSAGSMGELDAIAACFIGGTSMRGGSGTVYGALLGALVITSLDNGMSMLDVDSYWQMIVKGSILVLAVWVDVSTRTGRR

SEQ ID NO: 40735 - DNA, 1200 bp, Burkholderia fungorum LB400
  CDS (1)..(1200)
atgacgcccgacgttacttcccaacgcgccgatgaagccctgccgcgaggcgcattcggcggtccgcagcgccttcagcaactgtttgcgcgctacaagattctcgcgctgctgatcgccgtggccgcgatctggattttcttttcggtgctgacgcacggcgctttcgttacgccgcgcaatctgtcgaacctgctgcggcagatgtcgattaccggcatgctcgcgtgcggcatggtgttcgtgatcattgccggcgagatcgatctgtcggtcgggtcgctactcggtttgctcggcggcgtggcggcgatactcgacgtcaaccggcactggccgctcgccgtcacgttacccgtggtgatgttgctcggcgtgctgatcggcatgttcaacggatggtggtcgacttaccggcgcgtgccgtcgttcattgtcgggctcggcggcatgctggcgtatcgcggcattctgctcggcgtgacaggcggctcgacgattgcgccggtgtcggacggcttcgtgttcgtcgggcaaggatatctgccgaggctcgcgggcgatacgcttgccgtggtgctgtttgtgctgctggcatttctgacgatacggcagcggcgaaaccgcgagcgttatcagttgcgtgtggtgccggtttggcaggacgtcgtgaaagtggtgggcgcgggcgtgattctcgccggctttgtcgctacgctcgaccgttacggcggtattccggtgccggtcctgttgctgctcgcgctgctgggtatctttacgtggatcgccacgcagacggtgttcgggcggcgcatctatgcggttggttcgaacctcgaagcgacgcgactctcgggcgtcaacaccaaccgcgtgaaactggcgattttcgcgctgatggggctgatgtgcgcgttcggcggcatcgtcaatacggcgcggcttgctgccgggtcgccttcggccggatcgatgggcgagctcgatgctattgcggcttgctttatcggtgggacgtcgatgcgcggtggttccggcacggtctacggtgcgttgatcggcgcactggtcatggcgagcctcgataacggcatgtcgatgctcgatgtcgatgcttactggcagatgatcgtgaagggcagcattctcgtgctggccgtgtggatcgatgtggtgtcggggtcgaaccggcggtga

SEQ ID NO: 40736 - protein, 399 aa, Burkholderia fungorum LB400
MTPDVTSQRADEALPRGAFGGPQRLQQLFARYKILALLIAVAAIWIFFSVLTHGAFVTPRNLSNLLRQMSITGMLACGMVFVIIAGEIDLSVGSLLGLLGGVAAILDVNRHWPLAVTLPVVMLLGVLIGMFNGWWSTYRRVPSFIVGLGGMLAYRGILLGVTGGSTIAPVSDGFVFVGQGYLPRLAGDTLAVVLFVLLAFLTIRQRRNRERYQLRVVPVWQDVVKVVGAGVILAGFVATLDRYGGIPVPVLLLLALLGIFTWIATQTVFGRRIYAVGSNLEATRLSGVNTNRVKLAIFALMGLMCAFGGIVNTARLAAGSPSAGSMGELDAIAACFIGGTSMRGGSGTVYGALIGALVMASLDNGMSMLDVDAYWQMIVKGSILVLAVWIDVVSGSNRR

SEQ ID NO: 40737 - DNA, 1200 bp, Burkholderia vietnamiensis G4
  CDS (1)..(1200): transl_table=11
atgaataccgaactttcctcctcttccgccgtgccgccggacgccgacgcgcgccgcctgcgcggccatccgctgcggcagatcttcgtgcgctacaaggtgctcgcgctgctgttcgcggtcgtcgcgatctgggcgttcttctcggtgctgaccgacggcgcgttcgtcacgccgcgcaacgtgtcgaacctgctgcggcagatgtcgatcaccggcatgctcgcgtgcgggatggtgttcgtcatcatcgccggcgagatcgacctgtcggtcggctcgctgctcgggctgctcggcggcgtcgcggcgatcctcgacgtcaaccgccactggccggtggccgcgacggtgccggcggtgctcgcgctcggcgtgctggtcgggctgttcaatggctggtggtcgacctatcggcgcgtgccgtcgttcatcgtcgggctcggcgggatgctcgcattccgcgggatcctgctcggcgtgaccggcggctcgacgatcgcgccggtgtccgacggcttcgtgttcctcggccagggctatctgccgcgcgcggtgggcgacggcctcgcggtgctgttgttcgcgctcgtcgcgctgctggtcgtgcggcagcgcggcacgcggcgccgctaccggctcgcggtcgtgccgccgtggcaggacgtcgcgaaggtcgtcggcgccggcgccgtgctgttcgcgttcgtcgcgacgctcgatcgctacggcggcattccggtgccggtgctgctgctgctcgcgctgctcggcgtgttctcgtggatcgcgacgcagacggtgttcggccggcgcatctatgcggtcggctcgaacctggaggccacgcgcctgtccggcgtcgataccgatcgcgtgaagctcgcgatcttcgcgctgatggggctgatgtgcgcgtttgccggcatcgtcaacaccgcgcggctcgcggccggctcgccgtcggccggcacgatgggcgagctcgacgcgatcgccgcgtgcttcatcggcggcacgtcgatgcgcggcgggtcgggcaccgtgtacggcgcgctgatcggcgcgctcgtgatggcgagcctcgacaacgggatgtcgatgctcgacgtcgacgcgtactggcagatgatcgtgaagggcgcggtgctggtgctggccgtgtggatcgacgtggtgtcgcgctcgaaccggcgctga

SEQ ID NO: 40738 - protein, 399 aa, Burkholderia vietnamiensis G4
MNTELSSSSAVPPDADARRLRGHPLRQIFVRYKVLALLFAVVAIWAFFSVLTDGAFVTPRNVSNLLRQMSITGMLACGMVFVIIAGEIDLSVGSLLGLLGGVAAILDVNRHWPVAATVPAVLALGVLVGLFNGWWSTYRRVPSFIVGLGGMLAFRGILLGVTGGSTIAPVSDGFVFLGQGYLPRAVGDGLAVLLFALVALLVVRQRGTRRRYRLAVVPPWQDVAKVVGAGAVLFAFVATLDRYGGIPVPVLLLLALLGVFSWIATQTVFGRRIYAVGSNLEATRLSGVDTDRVKLAIFALMGLMCAFAGIVNTARLAAGSPSAGTMGELDAIAACFIGGTSMRGGSGTVYGALIGALVMASLDNGMSMLDVDAYWQMIVKGAVLVLAVWIDVVSRSNRR

SEQ ID NO: 40739 - DNA, 1200 bp, Burkholderia cenocepacia AU 1054
  CDS (1)..(1200): transl_table=11
atgaattccgaactttcttcctcgaccccggcgacgccggatgcaggcgccggccgcgcgccgcggctgccattgcgccatgtcttcacgcgctacaaggtgctcgcgctgctgttcgcggtcgtcgcgatctgggcattcttctcggtgctgacggacggcgcgttcgtcacgccccgcaacgtatcgaacctgctgcggcagatgtcgatcaccggcatgctcgcgtgcggcatggtgttcgtcatcatcgcgggcgagatcgacctgtcggtcggctcgctgctcgggctgctcggcggcgtcgccgcgatcctcgacgtcaaccgccactggccggtcgcggcgacggtcccggccgtgctcgcgctcggcgtgctgatcgggctcttcaacggctggtggtcgacctatcggcgcgtgccgtcgttcatcgtcgggctcggcgggatgctcgcgtttcgcggcatcctgctcggcgtgacgggcggctcgacgatcgcgcccgtgtcggacggcttcgtgttcatcgggcagggctatctgccgcgcgtggccggcgacggcctcgcggtcctgctgttcgtggtcgcgacgctgctggtggtgcggcagcgcggcacgcggcggcgctaccggctcgcggtcgccccgctgtggcaggacgtcgcgaagatcgtcggcgcgggggcggtgctgttcgcgttcgtcgcgacgctcgaccgttacggcggtattccggtgcccgtgctgctgctgctcgcgctgctcggcgtgttctcgtggatcgcgacgcagacggtattcggccggcgcatctatgcagtggggtcgaacctggaggcgacgcggctgtcgggcgtggacaccgatcgcgtgaaactcgcgatcttcgcgctgatgggcctgatgtgcgcgttcgccggcctcgtcaacacggcgcggctcgcggccgggtcgccgtccgccggcacgatgggcgagctcgacgcgatcgccgcgtgcttcatcggcggcacctcgatgcgcggcgggtcgggcacggtctacggcgcgctgatcggcgcgctcgtgatggcgagcctcgacaacgggatgtcgatgctggacgtcgacgcgtactggcagatgatcgtcaagggcgcggtgctggtgctggcggtgtggatcgacgtggtgtcgcgctcgaaccggcggtga

SEQ ID NO: 40740 - protein, 399 aa, Burkholderia cenocepacia AU 1054
MNSELSSSTPATPDAGAGRAPRLPLRHVFTRYKVLALLFAVVAIWAFFSVLTDGAFVTPRNVSNLLRQMSITGMLACGMVFVIIAGEIDLSVGSLLGLLGGVAAILDVNRHWPVAATVPAVLALGVLIGLFNGWWSTYRRVPSFIVGLGGMLAFRGILLGVTGGSTIAPVSDGFVFIGQGYLPRVAGDGLAVLLFVVATLLVVRQRGTRRRYRLAVAPLWQDVAKIVGAGAVLFAFVATLDRYGGIPVPVLLLLALLGVFSWIATQTVFGRRIYAVGSNLEATRLSGVDTDRVKLAIFALMGLMCAFAGLVNTARLAAGSPSAGTMGELDAIAACFIGGTSMRGGSGTVYGALIGALVMASLDNGMSMLDVDAYWQMIVKGAVLVLAVWIDVVSRSNRR

SEQ ID NO: 40741 - DNA, 1152 bp, Chromohalobacter salexigens DSM 3043
  CDS (1)..(1152): transl_table=11
atgtccaatatgaaccaaaccgcttccagctcgcgttcgcaaggcggcggacgtcgtttcgacgtggcgcgcatgctgctggaggggcgcgctttcttcgccttgatcgcgatcatcgtcatcttctcgttgctgtcgcctgtctacttttcgaccagcaactttctgaccatgtcgtcgcacgtcgccatcttcgggttgctgtcgctggggatgttgctggtgatcttgacggggggcatcgatctgtccgtggggtccacgcttggcctggcgggcgtgttcgcgggatttctgatgcagggcgtctcgttcgaagcctttggcgtggtggtgtatccgcccgtttgggtggtggtcgtgctgacgtgtggcctgggggccctggtcggagcgatcaacggcgttctcatcgcctatttcaaggtgccggcgttcgtggcgaccttggggctcttgtacgtggcccgtggcgttgcgctgctgatgaccgatggcttgacctacaacaacctcggtggaagcgaggcgctgggcaataccgggttcgattggctggggttcaatcggctgttcggcatcccggtcggcgtgctgatcctggcggccgtggcgatcgcctgcctgttgctgctgtcgcgcacgccgttcgggcgctgggtgtattccaccggcggcaacgcgcgggccgccgagctttccggggtgccggtcaagcgcgtgcaggtctcggtgtatgtgctgtccggtatctgcgcggcgatcgccggcctggtgctgtcctcgcagttgacctcggcggggccgacggccggcacgacctatgagctcaccgcgatcgcgggggtggtcatcggtggcgcggcactcaccggtggtcgcggcaacgtgcgcggcaccctgctgggcgccttcgtgatcgggtttctctccgacgggctggtgatcatcggggtctcgtcgtactggcagaccgtgttcaccggggccgtcatcattctcgcggttctgctcaacagcattcagtacagcggtcggaagaacagcaagcccgcttccgatggcaagccgacttcaccgcaaccggaaggcgccagcgagcgctcgccggccacgggaagcactaccggcaaagccggtgcacaatcataa

SEQ ID NO: 40742 - protein, 383 aa, Chromohalobacter salexigens DSM 3043
MSNMNQTASSSRSQGGGRRFDVARMLLEGRAFFALIAIIVIFSLLSPVYFSTSNFLTMSSHVAIFGLLSLGMLLVILTGGIDLSVGSTLGLAGVFAGFLMQGVSFEAFGVVVYPPVWVVVVLTCGLGALVGAINGVLIAYFKVPAFVATLGLLYVARGVALLMTDGLTYNNLGGSEALGNTGFDWLGFNRLFGIPVGVLILAAVAIACLLLLSRTPFGRWVYSTGGNARAAELSGVPVKRVQVSVYVLSGICAAIAGLVLSSQLTSAGPTAGTTYELTAIAGVVIGGAALTGGRGNVRGTLLGAFVIGFLSDGLVIIGVSSYWQTVFTGAVIILAVLLNSIQYSGRKNSKPASDGKPTSPQPEGASERSPATGSTTGKAGAQS

SEQ ID NO: 40743 - DNA, 1194 bp, Moorella thermoacetica ATCC 39073
  CDS (1)..(1194): transl_table=11
gtgtttaatcttattaaaactatttcccctgcagaaacggtacaatctaaacctaaagcgaatgggtatttaagtagaatagatatacgcgcttatacaatgatattagccttattgggtatatgggctattttcacttatactacccagggtgcttttttgacttcccgtaatctatcaaacctcttcaggcagatgtcaattacctctattttagcgataggtatggtctttgtaatagtagccggtcatattgacctttccgtaggttctctcatgggacttactggaggggtagcggcaattttacaggtctggtatggttggcagaccattcctgctatttttataagctttttaattggtctgctggccggcttatggcagggctggtgggttgcctataaaaaggtgcctgctttcattgtcaccctgggcggtatgatggtatttcggggaattctaataggaattagtcatggcgaaacagtttcgcctctcatggatagttttaaacaaataggccaatcctatgtacctgaaagtacaggcttcttattagcattcctgggtattatttatgtgatctatgttactgtaaagcaacggtatactagaattaagtatggttttactgtgccttctttagctctggaaataatgcgtaccattttttacgcctttctcattggcctttttgtctatctaatgaatgattaccagggtatacctgtacctgtcctaatcgtagtggcgatggcatttatttttacgggtttagcaacgaaaactcgcttcgggcgttatgtctacgcaattggtggtaacagtgaagcagcacgtttatccggtattaatattcgatataacatcctggccgtttttgttatcagtgggttaatggctgccttaagcggtatcctgttaactgcaagattaaacggtgcttcagtagctgcagggcaaaatgctgagcttgatgccattgcagcgtgcgttataggtggtacaagtcttatgggtggtacaggtagtattggtggggcgatgataggagcacttgttatggccagtttagataatggcctgagcatgatgaataccccgaccttctggcagtttatagttaaaggtttgattcttgtgctggcggtatggatcgatatcgcaactaaaacaagggctcaaaattga

SEQ ID NO: 40744 - protein, 397 aa, Moorella thermoacetica ATCC 39073
MFNLIKTISPAETVQSKPKANGYLSRIDIRAYTMILALLGIWAIFTYTTQGAFLTSRNLSNLFRQMSITSILAIGMVFVIVAGHIDLSVGSLMGLTGGVAAILQVWYGWQTIPAIFISFLIGLLAGLWQGWWVAYKKVPAFIVTLGGMMVFRGILIGISHGETVSPLMDSFKQIGQSYVPESTGFLLAFLGIIYVIYVTVKQRYTRIKYGFTVPSLALEIMRTIFYAFLIGLFVYLMNDYQGIPVPVLIVVAMAFIFTGLATKTRFGRYVYAIGGNSEAARLSGINIRYNILAVFVISGLMAALSGILLTARLNGASVAAGQNAELDAIAACVIGGTSLMGGTGSIGGAMIGALVMASLDNGLSMMNTPTFWQFIVKGLILVLAVWIDIATKTRAQN

SEQ ID NO: 40745 - DNA, 1200 bp, Burkholderia ambifaria AMMD
  CDS (1)..(1200): transl_table=11
atgaataccgaactgtcttcctcttccgccgtgccgccggacgccgacgcgcgccgcgggcaccgccatccgttgcgtcaggtcttcgtgcgctacaaggtgctcgcgctgctgttcgcggtcgcggcgatctgggtgttcttttcggtgctgaccgacggggcattcgtcacgccgcgcaacgtgtcgaacctgctgcggcagatgtcgatcaccggaatgctcgcgtgcgggatggtgttcgtgatcatcgcgggcgagatcgacctgtcggtcggctcgttgctcgggctgctcggcggcgtcgcggcgatcctcgacgtcaatcggcactggcccgtcgccgcgacggtgccggcggtgctcgcgctcggcgtgctggtcgggttgttcaacggctggtggtcgacctaccgtcgcgtgccgtcgttcatcgtcgggctgggcggaatgctcgcgttccgcggcatcctgctcggcgtgacgggcggctcgacgatcgcgccggtgtccgacggcttcgtgttcatcggtcagggctacctgccgcgcatggcgggcgacggcctcgcgctgctgctgttcgcgctcgtcgcgctgctggtcgtccggcagcgcggcacgcggcgccgttaccggctcgcggtcgcgccgctgtggcaggacgtcgcgaaggtcgtcggcgccggggccgtgctgttcgcgttcgtcgcgatgctcgaccgctacggcggcattcccgtgcccgtgctgctgctgctcgcgctgctcggcgcgttctcgtggatcgcgacgcagaccgtgttcggccgacgcatctatgcggtgggttcgaacctggaggcgacgcggctgtcgggcgtcgatacggatcgcgtgaagctggcgatcttcgcgctgatggggctgatgtgcgcgttcgcggggatcatcaataccgcgcggctcgcggccggctcgccgtcggccggcacgatgggcgaactcgacgcgatcgccgcgtgcttcatcggcggcacgtcgatgcgcggcgggtcgggcaccgtctatggcgcgctgatcggtgcgctcgtgatggcgagcctcgacaacgggatgtcgatgctcgacgtcgacgcgtactggcagatgatcgtcaagggcgcggtgctggtactggcggtgtggatcgacgtggtgtcgcgttcgaaccggcggtga

SEQ ID NO: 40746 - protein, 399 aa, Burkholderia ambifaria AMMD
MNTELSSSSAVPPDADARRGHRHPLRQVFVRYKVLALLFAVAAIWVFFSVLTDGAFVTPRNVSNLLRQMSITGMLACGMVFVIIAGEIDLSVGSLLGLLGGVAAILDVNRHWPVAATVPAVLALGVLVGLFNGWWSTYRRVPSFIVGLGGMLAFRGILLGVTGGSTIAPVSDGFVFIGQGYLPRMAGDGLALLLFALVALLVVRQRGTRRRYRLAVAPLWQDVAKVVGAGAVLFAFVAMLDRYGGIPVPVLLLLALLGAFSWIATQTVFGRRIYAVGSNLEATRLSGVDTDRVKLAIFALMGLMCAFAGIINTARLAAGSPSAGTMGELDAIAACFIGGTSMRGGSGTVYGALIGALVMASLDNGMSMLDVDAYWQMIVKGAVLVLAVWIDVVSRSNRR

SEQ ID NO: 40747 - DNA, 1179 bp, Bacillus sp
  CDS (1)..(1179): transl_table=11
atgaaaagtttggtttcttttcgagcctccatggattcagaaaaacggagaaggctgcttccaaaattggatttccgctcatatacgcttgtcattgcccttgtgcttatagcgcttatttttggagtgttaacagacggggagttcctatcgtcacgcaatttgtccaacttatttatgcaaatgtctgtaatctcgattttagcaatcgggatgacactagttattatagcaggtcatattgatttatctgtaggctcggtcgttggattaacaggaggaattgcagccattttacaagtttggtatggttggggaactgtttctgttattgttgtggcaattattgtcggtgcattgataggactttggcaaggctggtgggtttcttatcgcaatgtgcctgcgtttattgttacactaggcggcatgctgatttttaggggaattttaatcgggatcagtaatggagagacgattgccccgttgaataaaagttttgaagcaattgggaatagttatctgccatatgcagttggatatgtactagcaatcatcggtattatcatgctatttgtttttgtgaatagaaaccgcaaaaagaggaagctattagggttaactgtccataccaaagccaatgattatggaaaagcggcgatttactcactgtgcattttggtattagtttacatgttaaaccgctactacggtattccgatcccaatgcttattgtcgttctacttgctatccttttcgtttttatcgctgtcaaaactccatttggaagatacatttacgccattggcgggaatattgaagcagcagctctctcagggataaatatcaaacgtgttgtacttactatatttgttttaatgggagcgctttctggagtagcaggcattattttaacgagtagattgaatgcggcaacagtaagtagcggggaaatgtatgagttagatgcaattgctgcctgcgtcattggaggcacaagcctaatgggcggaagaggaaatataatcggagctatgatcggcgcccttattatggctagcatcgataatgggatgagcatgatgaacatcgaaaccttttggcaatttattgtaaaaggattgattcttattatcgctgtctggattgatatatcgagtaaaagccgaactaactaa

SEQ ID NO: 40748 - protein, 392 aa, Bacillus sp
MKSLVSFRASMDSEKRRRLLPKLDFRSYTLVIALVLIALIFGVLTDGEFLSSRNLSNLFMQMSVISILAIGMTLVIIAGHIDLSVGSVVGLTGGIAAILQVWYGWGTVSVIVVAIIVGALIGLWQGWWVSYRNVPAFIVTLGGMLIFRGILIGISNGETIAPLNKSFEAIGNSYLPYAVGYVLAIIGIIMLFVFVNRNRKKRKLLGLTVHTKANDYGKAAIYSLCILVLVYMLNRYYGIPIPMLIVVLLAILFVFIAVKTPFGRYIYAIGGNIEAAALSGINIKRVVLTIFVLMGALSGVAGIILTSRLNAATVSSGEMYELDAIAACVIGGTSLMGGRGNIIGAMIGALIMASIDNGMSMMNIETFWQFIVKGLILIIAVWIDISSKSRTN

SEQ ID NO: 40749 - DNA, 1734 bp, Mycobacterium leprae
  CDS (1)..(1734): transl_table=11
gtggtagacatcgacggacggattgagtccattaatcccgccgctactcggatattgggcttacgagcccacgatgtcgttgacatgaagcatggccatccattctgcttctacgatacagacaatcagcgggttgatcttgagcgtgaggtcatgcgcgtcgtacgacgcgaagtaacaacggtaagcaaagtcgtcggcattgaccaacacagtggccagcggttatggctatcggtaaacgtgagcctgcttgcgtacaaggctcccccacactctgcactggtagtctcgttttctgacatttctgcccaccacctttcgatcgaacggctcacctacgaggcaacccacgactgtctcaccggtcttgccaatcgcaggtttgcggaagaccagatcaccaaatcactgcagcatgacgaacgctctcgattagctgctgtactgcttcttgacctcgacgatttcaaagtgatcaacgactcactaggccacgacgtaggtgacgcggtgttgcagactgtagcgcagcgactacgctcggctgtgcggcccgacgatgtcgtcgcgcggctgggcggagacgagttcatcgtactactccggggtcccctttcggacatgaatgctaacgacgtcgcaaaaagactgcacacaacactgtccgagtcactcgtggtcgaccagctcacggtgcctatcggagcgagtgttggcatccttgaggtgagacctgacgatcgacggcgggccgccgacattttgcgtgatgccgactccgcgatgtatgcagccaagaacaagaaacaatgtgccgtcacgccgcagcagctggtaccgttcgtcgcgctgatcgcactgtttgtgttttttacagctgcggccggagctaagttctatgcaccatcaaatctgctggtcattctccaacaaaccgtggtgctggcgatcgtcggatacggcatgactttcgttatcatggcaggctccgttgaactatcggtgggctcgatcgtcgcattgactggagtcaccgcggcactcgtggctgcacagaatcaattcgctgcgatcgtcaccgccctgctggtggggttggctgctgggatggtaaacggcatcgtttttgcctacgggaagattccgtcattcgttagcaccctcggcatgcttcaagtctgccgtggtatcaccctgatgatcagcgacagttctgccaaaccgatgccgtttcacggaatactgggtgcaatgggagccatgccgtggatcctcatcgtctgtcttttcgtcacaatcctggcagggatcttattccaattcaccatgtttggtcggtgggtcaaagccatcggtggcaacgaacgtgtcgcaacgttagccggggtacctacccgcgggatcaaagtcgcgatcttcgcgatctgcggactgacagcaggcctcggcggtatcgtgcttgcttcccgcctcggagccgggacacccaccgcagcaacaggtttcgagatcgatgtcatcgccgcagtcgtcatcggcggcacgcccttaaccggcggattgggacgactcagcggaacgctgatcggtgcaataatcatctcgatgctctccaacggcatggtgtttatgggtgttgggaatgccgcctcgcagatcatcaagggaattatgctcgccgctgcggtttttgtcttcctacaacgccgcaagatcggcattatcaaatga

SEQ ID NO: 40750 - protein, 577 aa, Mycobacterium leprae
MVDIDGRIESINPAATRILGLRAHDVVDMKHGHPFCFYDTDNQRVDLEREVMRVVRREVTTVSKVVGIDQHSGQRLWLSVNVSLLAYKAPPHSALVVSFSDISAHHLSIERLTYEATHDCLTGLANRRFAEDQITKSLQHDERSRLAAVLLLDLDDFKVINDSLGHDVGDAVLQTVAQRLRSAVRPDDVVARLGGDEFIVLLRGPLSDMNANDVAKRLHTTLSESLVVDQLTVPIGASVGILEVRPDDRRRAADILRDADSAMYAAKNKKQCAVTPQQLVPFVALIALFVFFTAAAGAKFYAPSNLLVILQQTVVLAIVGYGMTFVIMAGSVELSVGSIVALTGVTAALVAAQNQFAAIVTALLVGLAAGMVNGIVFAYGKIPSFVSTLGMLQVCRGITLMISDSSAKPMPFHGILGAMGAMPWILIVCLFVTILAGILFQFTMFGRWVKAIGGNERVATLAGVPTRGIKVAIFAICGLTAGLGGIVLASRLGAGTPTAATGFEIDVIAAVVIGGTPLTGGLGRLSGTLIGAIIISMLSNGMVFMGVGNAASQIIKGIMLAAAVFVFLQRRKIGIIK

SEQ ID NO: 40751 - DNA, 1242 bp, Streptomyces kanamyceticus
  CDS (1)..(1242): transl_table=11
atgacgaccacgaccactcccccgggctcctcccgggacgcgtccgacgccccgccacccgcgcggtggccggcgggcgcgctgctgctgcgaagcgtgcgctccaacacgcgccagtacggcatgctcatcgccctggcgttcctcgtcgtgctgttccagatctggaccgacgggacgctgctgctcccgaacaacgtctccaacctgatccagcagaacggctacatcctcatcctggccatcggcatgatgatcgtcatcatcgcgggccacatcgacctctccgtgggctcgttggtcgccttcgtcggcgccatgtcggcggtcatgatggtcaagcacgacatgccctgggtgctcgccctggtcctctcgctcctgatcggcgcggtcgcgggggcctggcagggcttcttcatcgcgtacgtcggcatcccctcgttcatcgtgacgctggccgggatgctgctcttccgcggactcacccagatcgtccttgagggccagtcgctcgcgccgttccccgacgggttccagaacatcgccaagggcttcatcccggagatgggcccctacacccagtaccacaacccgacgctcgtcctcggcctgctcgccgtcgcgttgctgctcctgcgtgaacggcgcgctcgcaagcgccagttggcgtacgagctcgatgtcctgccgaccggtctgtgggcggccaagtgcgtggcgatgaccgcggccgtggtggcgttcaccctcaccctcgccagcttccacggcgtgcccgtcgtcatgctcatcatgtgcggcctgctcatcgcgctgggctatgtcatgcgcaacgccgtcatcggccgccatgtgtacgccctcggcggcaacaaggccgcggcgaagctgtcgggcgtcaaggacaagcgggtcaccctcctggtcttcgtgaacatgggcgtcctcgcggcgctcgcgggctgcgtgtacgcggcgcgcctgaacgcgggcaccccgcaggccgggctcaacttcgaactggaggcgatcgccgcctcgttcatcggcggcgcgtcgatgagcggcggcgtcggcacggtccttggcgcggtcatcggcggcctcgtcctcggcgtcctgaacaacggcatgtccctggtcggcatcggcacggactaccagcaggtcatcaaggggctcgtactgctcgccgcggtcggcttcgacgtctggaacaagcgcaaggcgggccgctag

SEQ ID NO: 40752 - protein, 413 aa, Streptomyces kanamyceticus
MTTTTTPPGSSRDASDAPPPARWPAGALLLRSVRSNTRQYGMLIALAFLVVLFQIWTDGTLLLPNNVSNLIQQNGYILILAIGMMIVIIAGHIDLSVGSLVAFVGAMSAVMMVKHDMPWVLALVLSLLIGAVAGAWQGFFIAYVGIPSFIVTLAGMLLFRGLTQIVLEGQSLAPFPDGFQNIAKGFIPEMGPYTQYHNPTLVLGLLAVALLLLRERRARKRQLAYELDVLPTGLWAAKCVAMTAAVVAFTLTLASFHGVPVVMLIMCGLLIALGYVMRNAVIGRHVYALGGNKAAAKLSGVKDKRVTLLVFVNMGVLAALAGCVYAARLNAGTPQAGLNFELEAIAASFIGGASMSGGVGTVLGAVIGGLVLGVLNNGMSLVGIGTDYQQVIKGLVLLAAVGFDVWNKRKAGR

SEQ ID NO: 40753 - DNA, 1167 bp, Thermoanaerobacter ethanolicus
  CDS (1)..(1167): transl_table=11
atgatggaaagcaaagtgagcaaaacaactgaaaagcgcattttaaatcatttcaagatagatataaggtcatatactatgatattagctttattggggatatggattattttttcaatattgacccatggcgattttctatctccgagaaacttgtccatgcttgccaggcaaatgtctataacagcaattttagcttcaggtatggttttagttatagttgctgggcatatagacttatctgttggttctgtggcagggtttacaggagctatagctgcaattcttcaggtgatatatcattgggatacagtgccgacaataatagtgactcttatggctgggcttgctattggagtttggcaaggattttggatagcctatagaaaagtgcctgcttttatagtgaccttaagctcaatgcttgtttttagaggtggaattttattaattacaaaaggtgttactatatctcctttaaaacaggacttcacagtcgtaggacagggatatattcctccattgtttagcgttattcttgctgtggtggcaggtgttttgtatgtaatcatggaccttaagaatagaaattctcgaattaaatacggcttaagtgtgtccagctggggaatagaactggcaaaaattgcaggagtattgattttcatcgctttgtttacaagtgttatgatatcttatgaaggaattcctgtgccagtattacttgttttggtaattgtgattttgcttacttttgtggctcaaaatacgacttttggacgttatgtttatgcgataggcggaaataaagaagcagcagcttactcaggaataaacatagctaagacgaacatgacgattttcttgattatgggggttttatcggcaattgcaggtatagttttgacttcaaggttaaatgctgctacaactagtgcaggaaatttgtttgagctggatgctatagcttcggcaattatcggtggaacaagcacgttaggaggagaaggaacagtaccaggagcgattttaggtgctcttattatggctagcatagataatggcatgagtcttatgaatatagattattctatattgacaattgtaaagggccttgtattagtacttgcagtgtgggtggatatttcaacaaagaagaggggataa

SEQ ID NO: 40754 - protein, 388 aa, Thermoanaerobacter ethanolicus
MMESKVSKTTEKRILNHFKIDIRSYTMILALLGIWIIFSILTHGDFLSPRNLSMLARQMSITAILASGMVLVIVAGHIDLSVGSVAGFTGAIAAILQVIYHWDTVPTIIVTLMAGLAIGVWQGFWIAYRKVPAFIVTLSSMLVFRGGILLITKGVTISPLKQDFTVVGQGYIPPLFSVILAVVAGVLYVIMDLKNRNSRIKYGLSVSSWGIELAKIAGVLIFIALFTSVMISYEGIPVPVLLVLVIVILLTFVAQNTTFGRYVYAIGGNKEAAAYSGINIAKTNMTIFLIMGVLSAIAGIVLTSRLNAATTSAGNLFELDAIASAIIGGTSTLGGEGTVPGAILGALIMASIDNGMSLMNIDYSILTIVKGLVLVLAVWVDISTKKRG

SEQ ID NO: 40755 - DNA, 981 bp, Rhizobium sp
  CDS (1)..(981): transl_table=11
atgactgactctctcgcaatcgctgctcagcccatcgcaactggccgcaggcacttcgtcgacatcgcgctacgttacgggctgattatcgtgcttgtcgtcctggtcgccgtcagccagttcctgtatccacgttttctcgatccgcaaaacatcaagaatattctgagccagaacgcgccgctcggcatcgtagcggtcggcatgacgctcgtcatgatcacccgtggtttcgatctctcggttggcgcgagctacgctgccggcgcgaccgtttttgcaagccttgcagttgccggatggtccctatggtgggccggcgcggtgacgctactcatcggccttgtggccggcctgatcaacgggacgatcatcacgcgtatcaacgtcaatccgttcgtggcaacgctcggcaccacctcggtcttcagcggtctcgccttgctctactcgaattcctcgcctttcgtggtctccgacaagaccttcgccatgatcggccgcgggagtttcctcgacgtgccgatcagcatctggatcctcgctgcggtgctcgtcgtcggcgagctcgtgctggcgcgtaccgtctacggccgctccctctacgcgatcggcggcaatgacgaggcggctcgcctcgccgggcttcccacagcgatgctgcgtacttcgacatatgtcatttgcggcgtgtgcgccgcgctcggcggcatgatcatcgcctcgcgcctttccatagggcaagcggatatcggcacgtcgatggcgctcgattccatcgccgtggtggtcatcggcggcacgtcactgatgggcggcgagggatccgtctggcgaagcgccatcggcctcatgatcgttgcggtgctgaccaatcttctcgacagtctggcggtcgattccaactaccagctcgtcatcaagggaacgatcgtggttgccgcggtcgcgctcgacgccttcgctcggtcgcgccgatga

SEQ ID NO: 40756 - protein, 326 aa, Rhizobium sp
MTDSLAIAAQPIATGRRHFVDIALRYGLIIVLVVLVAVSQFLYPRFLDPQNIKNILSQNAPLGIVAVGMTLVMITRGFDLSVGASYAAGATVFASLAVAGWSLWWAGAVTLLIGLVAGLINGTIITRINVNPFVATLGTTSVFSGLALLYSNSSPFVVSDKTFAMIGRGSFLDVPISIWILAAVLVVGELVLARTVYGRSLYAIGGNDEAARLAGLPTAMLRTSTYVICGVCAALGGMIIASRLSIGQADIGTSMALDSIAVVVIGGTSLMGGEGSVWRSAIGLMIVAVLTNLLDSLAVDSNYQLVIKGTIVVAAVALDAFARSRR

SEQ ID NO: 40757 - DNA, 1146 bp, Streptomyces olivaceoviridis
  CDS (1)..(1146): transl_table=11
atgaaggcgggcgaactggggtccatccccgtcgtcgtcggcctgatcctcatctgcgtcatcttccagagcctgaactcggcgttcctgtccgcgcagaacatcagcgacatcaccgtcacgatggtcggcaccggcatgatctcggtcggcatcgtcttcgtgctgctgctcggcgagatcgacctgtccgtcggctcggtcagcggcgcctccagcgccatcgcggccgtcctcgccgtgaaccagggcctgcccgagtggctggcggtgctgctcgccgtcgccgccggcgcggccatcggcgcggcccacggcttcttcttcgcggtgctcggcgcccccgccttcgccgtgaccctggccggcctgctgttctggctcggcttcatgctcaagatcctgggcgagaacggcaccatcaacctcgacagcgacggtctgatcgggcagctgacgacgtacttcttcgcggacgtcgccgccgcctacggcctggccgccctcgtcgtcgcggtgttcttcatcacctccttcctgggcaaccggcgccgcgaagccgcgggcatcccgtcccggccgctcagcgacatcgtgctgcgcaccgtgctgctggccgtcgtctccttcgccgcggcgatcatgtacaaccagtacaagggcctgccgctggccacggtgatcttcctcgccttcctcatcggcacggacttcctgctccgccgcaccgcctacggccgcaaggtcttcgccctcggcggcagcgtcgaggcgtcccgccgcgccggcatcaacgtcacggcgatccgcatctccgtgttcggcatcgcgggcggcttcgccgcgatcggcggcctgttcctggcctccaagatcgcgtccgccaaccagagcgccggtaccggtgacctgctgatgaacgcgatcgccgcggccgtgatcggcggcacgtcgctgttcggcggtcgcggccggacctggaacgcgctgctcggtgtgctggtgatcgtctccatccagtacgggctccagctggagtccatcgcggagccggtgaagtacatgatcaccgcggcggtcctgctgaccaccgtcgtgatcgactccgtgacgcgccggacgcagaagaccgcgggccgggcgtag

SEQ ID NO: 40758 - protein, 381 aa, Streptomyces olivaceoviridis
MKAGELGSIPVVVGLILICVIFQSLNSAFLSAQNISDITVTMVGTGMISVGIVFVLLLGEIDLSVGSVSGASSAIAAVLAVNQGLPEWLAVLLAVAAGAAIGAAHGFFFAVLGAPAFAVTLAGLLFWLGFMLKILGENGTINLDSDGLIGQLTTYFFADVAAAYGLAALVVAVFFITSFLGNRRREAAGIPSRPLSDIVLRTVLLAVVSFAAAIMYNQYKGLPLATVIFLAFLIGTDFLLRRTAYGRKVFALGGSVEASRRAGINVTAIRISVFGIAGGFAAIGGLFLASKIASANQSAGTGDLLMNAIAAAVIGGTSLFGGRGRTWNALLGVLVIVSIQYGLQLESIAEPVKYMITAAVLLTTVVIDSVTRRTQKTAGRA

SEQ ID NO: 40759 - DNA, 1002 bp, Rhizobium leguminosarum bv
  CDS (1)..(1002): transl_table=11
atggcaagactgatcagaaaacgcgaaaccctgctgttcctcatcatcgtcgtgatgatcgtggtcttttcgacgcgggctgcggatttcgccacacccggcaatctcgccggcatcttcaacgatacctcgatcctgatcatcctggcgctggcgcagatgacggtcatcctgacgaaatcgatcgacctgtcggtcgctgccaacctcgccttcaccggcatggcaatcgcgatgatgaacgccgcccaccccgatctgccgctcgtcgtgctgatcctgatggccgtcgtcatcggcgcctgtctcggcgccatcaacggctttctcgtctgggcgctggaaatcccgccgatcgtcgtcaccctcggcacgctcaccatctatcgcggcatggccttcgtgctttccggcggcgcctgggtcaacgcgcaccagatgacgccgatcttcctgtcggtgccgcgcacgccggtcctcggcctgcccgtgctcagttgggtgggcatcatcatcgtcatcctgatgtatgtgcttcttcgatatacccagttcggccgctccgcctatgcaaccggcggcaacccgactgccgccgtctatgccggtatcgatacgggctggacgaaattcctcgccttcgtcctctcgggcgctctggccggcctcgccagctatctctgggtatcgcgttatgccgtcgcctatgtcgatatcgccaacggcttcgagctcgacagcgtcgcggcttgcgtcatcggcggcatctcgattgccggtggcgtcggctcggtcgccggcaccgtgctcggcgcgcttttcctcggcgtcatcaaaaacgccctgccggtgatcggcatttcacccttcacgcagatggcgatatcaggcaccgtcatcattctcgccgtcgccttcaacgcccggcgcgagcgcaaccgcggccgcatcatcctgcgtgaccgcgccgcgaccgaaatcaaagcggaggccgcagcatga

SEQ ID NO: 40760 - protein, 333 aa, Rhizobium leguminosarum bv
MARLIRKRETLLFLIIVVMIVVFSTRAADFATPGNLAGIFNDTSILIILALAQMTVILTKSIDLSVAANLAFTGMAIAMMNAAHPDLPLVVLILMAVVIGACLGAINGFLVWALEIPPIVVTLGTLTIYRGMAFVLSGGAWVNAHQMTPIFLSVPRTPVLGLPVLSWVGIIIVILMYVLLRYTQFGRSAYATGGNPTAAVYAGIDTGWTKFLAFVLSGALAGLASYLWVSRYAVAYVDIANGFELDSVAACVIGGISIAGGVGSVAGTVLGALFLGVIKNALPVIGISPFTQMAISGTVIILAVAFNARRERNRGRIILRDRAATEIKAEAAA

SEQ ID NO: 40761 - DNA, 1224 bp, Bacillus stearothermophilus
  CDS (1)..(1224): transl_table=11
atgggagcactaatgcaaaaaacagcacaacattctccaaagcggtctacagaaagtcagcagttatcgttgaagcagatgatcaaaaacaatatgagaagttacagtatggtcatcgctctcattttgattatgttattgttccaagtgttaactggaggcattttgttgcggccattaaatattacaaacttgattttgcaaaacagttatattttggtgctggctgttggcatgatgcttgtcattatcaccggacatattgatttgtccgtcggatcggtggcagcttttgtcggggcattggccggcattctgatggttcagcaccatgcatcagtatggttgacggtgctcatttgtttattgctcggagccttgattggcgcatggcaaggattttgggtggcgtacgtaaaaattccatcattcattgttacattagcagggatgttgctgttccgaggattgacgatggttattttggaaggacagtcgatcgccccgtttccgaaaacattccaaaatatgagttctgggtttctccctgacgtatttcatggaggagagatccatctgttcaccattgtgatcggtttcgccgcttctctcttatttgttgtactggaatggagaaaacgaaacagtcagaaaaaatatgggtttgcggtcacccctgcggcgatgtttgccttgaagctggctgtgattgccgctgtgatcatgatttttacttatattttagcgacgtatgaacgaattccgacgattctagtgattttggttgcgttgatcattgcttattcctttgtggcgaaccggacggtcgtcggccgccatatttatgcgattggtggtaatgagaaggctgcgcaattgtccgggattaaaacgaaacgtgtcacgttttgggtgtttgtcaacatgggcgtgttggccgctttgtccggattgatttttgccgctcgcctcaacgctgcgacgccgaaagcggggaacttgtttgagctcgatgccattgcggcgtgctttattggaggcgcatccgcttatggaggaatcggcacgattagcggagcgatcatcggcggtctagtcatgggcgtaatgaataacgggatgtccttgctggggctcggtattgactggcaacaggccatcaaagggcttgtattgcttattgctgtggcttttgatatttacaacaaaaataaagctgcttaa

SEQ ID NO: 40762 - protein, 407 aa, Bacillus stearothermophilus
MGALMQKTAQHSPKRSTESQQLSLKQMIKNNMRSYSMVIALILIMLLFQVLTGGILLRPLNITNLILQNSYILVLAVGMMLVIITGHIDLSVGSVAAFVGALAGILMVQHHASVWLTVLICLLLGALIGAWQGFWVAYVKIPSFIVTLAGMLLFRGLTMVILEGQSIAPFPKTFQNMSSGFLPDVFHGGEIHLFTIVIGFAASLLFVVLEWRKRNSQKKYGFAVTPAAMFALKLAVIAAVIMIFTYILATYERIPTILVILVALIIAYSFVANRTVVGRHIYAIGGNEKAAQLSGIKTKRVTFWVFVNMGVLAALSGLIFAARLNAATPKAGNLFELDAIAACFIGGASAYGGIGTISGAIIGGLVMGVMNNGMSLLGLGIDWQQAIKGLVLLIAVAFDIYNKNKAA

SEQ ID NO: 40763 - DNA, 990 bp, Escherichia coli
  CDS (1)..(990): transl_table=11
atgatgtcttctgtttctacatcggggtctggcgcacctaagtcgtcattcagcttcgggcgtatctgggatcagtacggcatgctggtggtgtttgcggtgctctttatcgcctgtgccatttttgtcccaaattttgccaccttcattaatatgaaagggttgggcctggcaatttccatgtcggggatggtggcttgtggcatgttgttctgcctcgcttccggtgactttgacctttctgtcgcctccgtaattgcctgtgcgggtgtcaccacggcggtggttattaacctgactgaaagcctgtggattggcgtggcagcggggttgttgctgggcgttctctgtggcctggtcaatggctttgttatcgccaaactgaaaataaatgctctgatcacgacattggcaacgatgcagattgttcgaggtctggcgtacatcatttcagacggtaaagcggtcggtatcgaagatgaaagcttctttgcccttggttacgccaactggttcggtctgcctgcgccaatctggctcaccgtcgcgtgtctgattatctttggtttgctgctgaataaaaccacctttggtcgtaacaccctggcgattggcgggaacgaagaggccgcgcgtctggcgggtgtaccggttgttcgcaccaaaattattatctttgttctctcaggcctggtatcagcgatagccggaattattctggcttcacgtatgaccagtgggcagccaatgacgtcgattggttatgagctgattgttatctccgcctgcgttttaggtggcgtttctctgaaaggtggcatcggaaaaatctcatatgtggtggcgggtatcttaattttaggcaccgtggaaaacgccatgaacctgcttaatatttctcctttcgcgcagtacgtggttcgcggcttaatcctgctggcagcggtgatcttcgaccgttacaagcaaaaagcgaaacgcactgtctga

SEQ ID NO: 40764 - protein, 329 aa, Escherichia coli
MMSSVSTSGSGAPKSSFSFGRIWDQYGMLVVFAVLFIACAIFVPNFATFINMKGLGLAISMSGMVACGMLFCLASGDFDLSVASVIACAGVTTAVVINLTESLWIGVAAGLLLGVLCGLVNGFVIAKLKINALITTLATMQIVRGLAYIISDGKAVGIEDESFFALGYANWFGLPAPIWLTVACLIIFGLLLNKTTFGRNTLAIGGNEEAARLAGVPVVRTKIIIFVLSGLVSAIAGIILASRMTSGQPMTSIGYELIVISACVLGGVSLKGGIGKISYVVAGILILGTVENAMNLLNISPFAQYVVRGLILLAAVIFDRYKQKAKRTV

SEQ ID NO: 40765 - DNA, 1011 bp, Escherichia coli
  CDS (1)..(1011): transl_table=11
atgagtgcgttaaataagaaaagttttcttacttacctgaaagagggcggtatttacgtcgttcttttagttttgctggcgattattattttccaggacccaacatttttaagtctgttgaacttaagtaatattctcacccagtcatcggtgcgtattattatcgcgctcggtgtggcagggttaattgtcacccaggggaccgatctttctgctggtcgtcaggtagggctggcggcagtggtggctgcgacattattgcagtccatggataacgccaacaaagtgttcccggaaatggcgacgatgccgattgcgctggttattctgattgtctgtgccattggtgcggtgatcggtttgatcaacggtctgattatcgcttatctcaacgtgacgccgttcattaccacgctcggcacgatgatcatcgtctatggcatcaactcgctctattacgactttgtcggggcgtcgccaatttctggttttgacagtggcttctctacctttgctcagggctttgtcgcgctggggagtttccgtctctcttacatcaccttctacgcgttgattgcggtggcgttcgtctgggtgttgtggaacaaaacccgcttcggtaagaacatttttgccattggcggtaacccggaagcggcaaaagtatctggtgtcaacgtcggcctgaacctgctgatgatctacgcgttgtctggcgtgttctatgcctttggcgggatgttagaagccggacgtatcggctctgccaccaacaacctcggctttatgtatgagctggatgctatcgcggcgtgcgtggtaggcggtgtatcgttcagcggcggtgtggggacggtgattggcgtggtgaccggggtaattatttttaccgtcatcaactatggcctgacgtatatcggcgtaaacccatactggcagtacatcatcaaaggggcgattattatcttcgccgtagcgctggattcactgaaatacgcgcgtaagaaatga

SEQ ID NO: 40766 - protein, 336 aa, Escherichia coli
MSALNKKSFLTYLKEGGIYVVLLVLLAIIIFQDPTFLSLLNLSNILTQSSVRIIIALGVAGLIVTQGTDLSAGRQVGLAAVVAATLLQSMDNANKVFPEMATMPIALVILIVCAIGAVIGLINGLIIAYLNVTPFITTLGTMIIVYGINSLYYDFVGASPISGFDSGFSTFAQGFVALGSFRLSYITFYALIAVAFVWVLWNKTRFGKNIFAIGGNPEAAKVSGVNVGLNLLMIYALSGVFYAFGGMLEAGRIGSATNNLGFMYELDAIAACVVGGVSFSGGVGTVIGVVTGVIIFTVINYGLTYIGVNPYWQYIIKGAIIIFAVALDSLKYARKK

SEQ ID NO: 40767 - DNA, 1011 bp, Haemophilus influenzae
  CDS (1)..(1011): transl_table=11
atgagtgccttagaaaaaaacaaatcctttgatctcttaaaacaaaatgcgatttattttgtgttattgattttgctcggcatcatcattgcacaagatccgacattcttaaatttagtcaatttcagtaacatcttaacccaatcttctgtacgtttaattattgctttaggggttgcgggtttattgattacacaagggactgacttatctgcaggtcgtcaagttggtttggctgcagttatctctgcaacaatgttgcaatcaatggaaaatattaaccgcgtgttccctgaaatgggacaaataccaattccagtggttattctcgcagtttgtgctatcggtgcagtaattggtttagtgaatggtttagttatcgcttacttaaatgtaactccattcatcgcaaccatgggtacaatgatcatcatatatggtttcaactcactatactatgatgctgtaggtggttctccaatcgcaggttttagtgaaaatttctcaacatttgctcaaggattcttccgagtcggcagctttaaactctcttacatcacgatttatgcagctattgcagcattattagtatggattatgtggaacaaaactcgtttcggtaaaaacgtatttgctatcggtggtaacccagaagcagctaaagtatctggtgtaaacgttgcacgtaacttagttgcaatctatatgattgcaggtatgttctatgcctttggtggtatgcttgaagcgggtcgtatcggttctgcaactaacaacttaggttttatgtatgaattagatgctatcgccgcttgcgtagtgggtggtgtatcttttgctggtggggtaggtacagtaattggtgttatcactggggttattatctttactgttatcaactacggtttaacttacatcggtgtaaacccttactggcaatacatcattaaaggtagcattatcattctagcggtagccattgactcgttaaaatatgcgaagaaaaaataa

SEQ ID NO: 40768 - protein, 336 aa, Haemophilus influenzae
MSALEKNKSFDLLKQNAIYFVLLILLGIIIAQDPTFLNLVNFSNILTQSSVRLIIALGVAGLLITQGTDLSAGRQVGLAAVISATMLQSMENINRVFPEMGQIPIPVVILAVCAIGAVIGLVNGLVIAYLNVTPFIATMGTMIIIYGFNSLYYDAVGGSPIAGFSENFSTFAQGFFRVGSFKLSYITIYAAIAALLVWIMWNKTRFGKNVFAIGGNPEAAKVSGVNVARNLVAIYMIAGMFYAFGGMLEAGRIGSATNNLGFMYELDAIAACVVGGVSFAGGVGTVIGVITGVIIFTVINYGLTYIGVNPYWQYIIKGSIIILAVAIDSLKYAKKK

SEQ ID NO: 40769 - DNA, 1011 bp, Salmonella typhimurium
  CDS (1)..(1011): transl_table=11
atgagtgcgttaaacaagaaaagctttttgacctggctgaaagagggcggaatttacgtcgttcttttagtgttgctggcgattattattttccaggacccgacttttttaagtttgctgaatttaagtaatattctgacgcaatcttcggtacgtattattatcgcgctgggcgtggcgggactcatcgtcacccaggggacagatctgtcggcggggcgtcaggtagggctggcggcggtcgtggcggcaacattactgcaatcaatggaaaacgccaataaagtgtttccggaaatggcgaccatgccgattgcgctggtcatcctgattgtctgcgcgattggcgcggtgattggcttggtgaacggcatcatcattgcttacctgaacgtgacgccgtttattaccacgcttggcacgatgattatcgtttatgggatcaactccctttactatgactttgtcggcgcttcgcccatttccggctttgacagcggcttttccacctttgcacagggctttgtggcgatgggcagtttccggctctcatacatcaccttttacgctctgattgcggtagcgtttgtctgggtgctgtggaataagacccgttttggtaaaaacatttttgctattggcggcaacccggaagcggcgaaagtttctggcgtaaacgtggcgctgaacctgctgatgatttatgcgctctccggcgtgttttatgccttcggcggcttactggaagcagggcgtattggttctgccaccaacaacctcggctttatgtatgaactggatgcgattgccgcgtgcgtggtcgggggcgtatcgtttagcggcggagtgggtacggtcttcggcgtggtgaccggcgtcattatctttaccgtcatcaactacggcctgacctatatcggggtaaacccgtactggcagtacattatcaaaggcggcattatcattttcgccgtggcgctggactcgctgaaatacgcgcgtaagaagtag

SEQ ID NO: 40770 - protein, 336 aa, Salmonella typhimurium
MSALNKKSFLTWLKEGGIYVVLLVLLAIIIFQDPTFLSLLNLSNILTQSSVRIIIALGVAGLIVTQGTDLSAGRQVGLAAVVAATLLQSMENANKVFPEMATMPIALVILIVCAIGAVIGLVNGIIIAYLNVTPFITTLGTMIIVYGINSLYYDFVGASPISGFDSGFSTFAQGFVAMGSFRLSYITFYALIAVAFVWVLWNKTRFGKNIFAIGGNPEAAKVSGVNVALNLLMIYALSGVFYAFGGLLEAGRIGSATNNLGFMYELDAIAACVVGGVSFSGGVGTVFGVVTGVIIFTVINYGLTYIGVNPYWQYIIKGGIIIFAVALDSLKYARKK

SEQ ID NO: 40771 - DNA, 969 bp, Bacillus subtilis
  CDS (1)..(969): transl_table=11
atgaaaacggaacaactgcaaacagaacaaaaacggattcacttcgacggagtcatgcaaaaactcggcccgtttcttggtttatttattctcgttatcattgtatctattttaaatcccagctttcttgaaccgctgaatattttaaacctgcttcgccaggtcgccattaacggattaatcgcgttcgggatgacctttgttattttgacaggcggcattgatctttctgttggcgctattcttgccctgtccagtgctttagttgcggggatgattgtgtccggtgtcgatccggttctcgcgatcatccttggctgtatcattggtgccgtactaggcatgatcaacggattattgattactaaaggaaaaatggcgccctttatcgccacgcttgcgaccatgactgtgtttcgcggactgacgctagtgtatacagatggaaatccgattaccggacttggcacaaactacggttttcagatgttcggacgcggttactttttaggcattcctgtaccggcaattacgatggttcttgcctttgtcatcctttgggtgcttcttcataaaacaccattcggacgccgaacgtacgctatcggcggcaacgaaaaagccgcgctcatttcaggcatcaaagtgacgcgcgtgaaagtgatgatctattctttagccgggcttttatccgctcttgcaggtgccatattgacttcccgcctgcattcggcccagccgactgcgggagaatcgtacgaacttgatgctatcgcggcagtcgtcttaggagggacaagtctttccggcggccgaggacgcattgtcggcacgttaatcggggtgctgatcatcggcacacttaataacggacttaatctgcttggcgtctcatcattttatcagctggttgtcaaagggattgttatcttaattgcggtattgttagaccgcaagaagtcagcttag

SEQ ID NO: 40772 - protein, 322 aa, Bacillus subtilis
MKTEQLQTEQKRIHFDGVMQKLGPFLGLFILVIIVSILNPSFLEPLNILNLLRQVAINGLIAFGMTFVILTGGIDLSVGAILALSSALVAGMIVSGVDPVLAIILGCIIGAVLGMINGLLITKGKMAPFIATLATMTVFRGLTLVYTDGNPITGLGTNYGFQMFGRGYFLGIPVPAITMVLAFVILWVLLHKTPFGRRTYAIGGNEKAALISGIKVTRVKVMIYSLAGLLSALAGAILTSRLHSAQPTAGESYELDAIAAVVLGGTSLSGGRGRIVGTLIGVLIIGTLNNGLNLLGVSSFYQLVVKGIVILIAVLLDRKKSA

SEQ ID NO: 40773 - DNA, 966 bp, Escherichia coli
  CDS (1)..(966): transl_table=11
atgacaacccagactgtctctggtcgccgttatttcacgaaagcgtggctgatggagcagaaatcgcttatcgctctgctggtgctgatcgcgattgtctcgacgttaagcccgaactttttcaccatcaataacttattcaatattctccagcaaacctcagtgaacgccattatggcggtcgggatgacgctggtgatcctgacgtcgggcatcgacttgtcggtaggttctctgttggcgctaaccggcgcagttgctgcatctatcgtcggcattgaagtcaatgcgctggtggctgtcgctgccgctctcgcgttaggtgccgcaattggtgcggtaaccggagtgattgtagcgaaaggtcgcgtccaggcgtttatcgctacgctggttatgatgcttttactgcgcggcgtgaccatggtttataccaacggtagcccagtgaataccggctttactgagaacgccgatctgtttggctggtttggtattggtcgtccgctgggcgtaccgacgccagtctggatcatggggattgtcttcctcgcggcctggtacatgctgcatcacacgcgtctggggcgttacatctacgcgctgggcggcaacgaagcggcaacgcgtctttctggtatcaacgtcaataaaatcaaaatcatcgtctattctctttgtggtctgctggcatcactggccgggatcattgaagtggcgcgtctctcctccgcacaacccacggcggggactggctatgagctggatgctattgctgcggtggttctgggcggtacgagtctggcgggcggaaaaggtcgcattgttgggacgttgatcggcgcattaattcttggcttccttaataatggattgaatttgttaggtgtttcctcctattaccagatgatcgtcaaagcggtggtgattttgctggcggtgctggtagacaacaaaaagcagtaa

SEQ ID NO: 40774 - protein, 321 aa, Escherichia coli
MTTQTVSGRRYFTKAWLMEQKSLIALLVLIAIVSTLSPNFFTINNLFNILQQTSVNAIMAVGMTLVILTSGIDLSVGSLLALTGAVAASIVGIEVNALVAVAAALALGAAIGAVTGVIVAKGRVQAFIATLVMMLLLRGVTMVYTNGSPVNTGFTENADLFGWFGIGRPLGVPTPVWIMGIVFLAAWYMLHHTRLGRYIYALGGNEAATRLSGINVNKIKIIVYSLCGLLASLAGIIEVARLSSAQPTAGTGYELDAIAAVVLGGTSLAGGKGRIVGTLIGALILGFLNNGLNLLGVSSYYQMIVKAVVILLAVLVDNKKQ

SEQ ID NO: 40775 - DNA, 972 bp, Haemophilus influenzae
  CDS (1)..(972): transl_table=11
atgatgaaaaatgaaacatctaattttcaaataggaagatttttgattgaacagcgttcttttattgcattgattattcttatcgcgattgtatcaatgattaatcctgatttttttagcgtagataatattttgaatattttacgccaaacttcggttaatgcgattattgcagtgggtatgactttcgttattttaattgcaggtatagatctttctgttggatctgtattggcattgacaggtgcaatcgccgcttcaatggtgagtattgaattgcctatttttttagtcattcctgtggttttattgattggaacacttcttggtggcataagtggtgtaattgtggcaaagggaaaagttcaggcttttattgctaccttggttaccatgaccttactgcgtggtataacaatggtttatacagatggtcgtcctattacgacaggtttttcggataatgctgatctatttgctagcattggtacaggctatgttttaggtatcccagtaccaatttggattatgagtatcgtgtttgcggttgcttggtatattttaaaagacacaccaatcggtcgctatatttatgctttaggtggaaatgaggcagcgacccaactttctggtattaacgtcaataaaatcaaagtatttgtttttgcggtgagtggatttctttctgcgctggcgggtttaattgtaacttcacgtttatcttccgctcaacccactgctggcgtatcttatgaattagatgcaattgccgccgtggtagtcggtggaaccagtttgatgggggggaaaggtcgtgtaatgggaactctcatcggtgcattaatcatcggatttttaaacaatgcattaaatttattagatatttcatcttactatcaaatgatagcaaaagcgttggttattttggttgctgttttagccgataactatcttggtacaaaaaaactgtaa

SEQ ID NO: 40776 - protein, 323 aa, Haemophilus influenzae
MMKNETSNFQIGRFLIEQRSFIALIILIAIVSMINPDFFSVDNILNILRQTSVNAIIAVGMTFVILIAGIDLSVGSVLALTGAIAASMVSIELPIFLVIPVVLLIGTLLGGISGVIVAKGKVQAFIATLVTMTLLRGITMVYTDGRPITTGFSDNADLFASIGTGYVLGIPVPIWIMSIVFAVAWYILKDTPIGRYIYALGGNEAATQLSGINVNKIKVFVFAVSGFLSALAGLIVTSRLSSAQPTAGVSYELDAIAAVVVGGTSLMGGKGRVMGTLIGALIIGFLNNALNLLDISSYYQMIAKALVILVAVLADNYLGTKKL

SEQ ID NO: 40777 - DNA, 1128 bp, Haemophilus influenzae
  CDS (1)..(1128): n means a or g or c or t/u, s means g or c
atgtttaagttaaaatccgtaaatttacaagtttacattatgttaatagctattgcagtcattatggcattctttagtgttgctactgatggcgcttatttaagtgcaagaaatatttctaacttgttacgccaaacytcaattactggcawtcttgcaattggaatggtttttgtcattatttctgctgaaattgacttatctgttggttcacttatgggcctactgggcggatttgcagctattgccgatgtttggtggggcttcccattacctgtaactattattgcaacaattgctcttggtttaatttttggtatttggaatggttggtgggtggcttatcgcaaagtgccatccttcattgttacacttgcaggttatctcgcatttcgtggaattttgattggtttgactaatggtacaactgtatctcctattagtggaactatgacagttattgggcaaggttatttatcagatattgcaggggttatcttaggtggtattgcagttattggatttgttctttggggaaattatcaacgtagaagtcgccagcagcttcagctggaagtgtctgcattatcaaaagattttacgaaatatgctttgtttgcagtaattgtattaggagcaatttatttacttaatgattatcgtggcattccatttcctgttttagtactggcagttcttgcaatcttagggttattcctctctcgtaaaacttcattcggccgccacgtttatgcaattggtggcaatattgatgcggcaaaattatctggtatcaatgtagagaaaacaaaactgattatctttgcaatgaatggtgtgttagttgcaatagcagggttgattttaagtgctcgtttaggtgcaggatcaccatctgctgggcaaaatgcagaactagatgcgattgcagcttgtgtcattggaggggcaagcttagctggtggtgtaggaagtgtgtttggggtcgttattggcgcacttatcatcgcatcgcttgataatggtatgagtatgcttgatgtgccaactttttggcaatatattgtcaaaggtggcattttgttacttgctgtatggatagatactagtaataagaaaaagatgtaa

SEQ ID NO: 40778 - protein, 375 aa, Haemophilus influenzae
  Xaa in position is unknown
MFKLKSVNLQVYIMLIAIAVIMAFFSVATDGAYLSARNISNLLRQTSITGXLAIGMVFVIISAEIDLSVGSLMGLLGGFAAIADVWWGFPLPVTIIATIALGLIFGIWNGWWVAYRKVPSFIVTLAGYLAFRGILIGLTNGTTVSPISGTMTVIGQGYLSDIAGVILGGIAVIGFVLWGNYQRRSRQQLQLEVSALSKDFTKYALFAVIVLGAIYLLNDYRGIPFPVLVLAVLAILGLFLSRKTSFGRHVYAIGGNIDAAKLSGINVEKTKLIIFAMNGVLVAIAGLILSARLGAGSPSAGQNAELDAIAACVIGGASLAGGVGSVFGVVIGALIIASLDNGMSMLDVPTFWQYIVKGGILLLAVWIDTSNKKKM

SEQ ID NO: 40779 - DNA, 1029 bp, Escherichia coli
  CDS (1)..(1029): transl_table=11
atgctgaagtttattcagaacaaccgtgaaatcacggcactgctggcggtggtgctgctgtttgtattacccggttttctcgaccgccagtatttaagtgtgcaaacgctgaccatggtttatagcagcgcgcaaatcctgatcctgctggcaatgggcgcgacgctggtaatgcttacgcgcaatattgatgtttcagtgggttcgattaccggaatgtgcgcggtgctgttggggatgttactgaacgcaggatattcactacctgttgcttgtgtcgcgactttactgcttggtttgctcgcgggatttttcaacggtgtcctggtcgcgtggctaaagatccctgccattgttgccacccttggcacgttagggttgtacagaggcatcatgttgctgtggactggcggcaaatggattgaagggttacccgccgaactgaaacagctctccgccccgctgctgcttggcgtttcagcaattggttggttgacgataattctggtggcatttatggcctggctgctggcaaagacggcgtttggacgcagtttttatgccacgggcgataatttacagggcgctcgtcaactgggcgttcgtactgaagccattcgcattgtggcattttcgttgaacggctgcatggcggcactggcgggaattgtgtttgcttcgcagattggttttatccccaaccagaccggtaccgggctggagatgaaagcaattgcagcctgcgtgctgggcggcattagtttgctcggtggttccggtgcgatcattggtgcggtactcggcgcatggttcctgacgcagatcgatagcgtactggtgctgttgcgcattccggcatggtggaatgattttatcgcgggtctggttctgctggcggtgctggtgtttgatggacgcctgcgttgtgcgctggaacgtaatctacggcggcaaaaatatgcccgctttatgacgccaccgccatccgttaaacccgcttcgtcaggtaaaaaacgggaggccgcataa

SEQ ID NO: 40780 - protein, 342 aa, Escherichia coli
MLKFIQNNREITALLAVVLLFVLPGFLDRQYLSVQTLTMVYSSAQILILLAMGATLVMLTRNIDVSVGSITGMCAVLLGMLLNAGYSLPVACVATLLLGLLAGFFNGVLVAWLKIPAIVATLGTLGLYRGIMLLWTGGKWIEGLPAELKQLSAPLLLGVSAIGWLTIILVAFMAWLLAKTAFGRSFYATGDNLQGARQLGVRTEAIRIVAFSLNGCMAALAGIVFASQIGFIPNQTGTGLEMKAIAACVLGGISLLGGSGAIIGAVLGAWFLTQIDSVLVLLRIPAWWNDFIAGLVLLAVLVFDGRLRCALERNLRRQKYARFMTPPPSVKPASSGKKREAA

SEQ ID NO: 40781 - DNA, 999 bp, Escherichia coli
  CDS (1)..(999): transl_table=11
atgtctgcttcgtcattaccattgccgcagggcaagagcgtctcgctcaaacaatttgtcagtcgccatattaatgagatcggtttgctggtggtgattgccattctttatctggtcttctccctgaacgcgcctggctttatctcattgaataaccagatgaacgtgctgcgcgatgccgccaccattgggattgccgcctgggcgatgacgctgattattatctccggtgaaattgatgtcagcgttgggccgatggtggcttttgtctcggtgtgcctggcatttttgctgcaatttgaagttccgctggcggtggcgtgcctgctggtgttgctgttaggcgcgctgatgggaacgctggccggggtgctgcgcggcgtgtttaatgtaccaagtttcgttgccacactggggctgtggagcgccctgcgcggaatggggctgtttatgacgaacgcactgccagtgccgattgatgaaaacgaggtgctggactggctgggcggacaatttctcggtgtgccggtatccgcgctgatcatgattgtgttgtttgcgctgtttgtgttcatcagccgcaaaaccgccttcgggcgctcggtttttgccgttggcggtaatgctacggcggcgcagttgtgcggcatcaacgttcgtcgggtgcgcattcttatctttaccctttcgggattattagcggcggtgaccggcattttgttggcggcgcgcctcggttctggtaacgcaggtgccgcaaacggtctggagtttgacgtcatcgccgcggtcgtggtcggcggtacggcactttccggcggtcgcggttccctgttcggtacattgcttggtgtgctggtgattacgctaatcggtaacggtctggtgctgctcggtattaactcctttttccagcaggtggtacgcggcgtcatcatcgtggtggcggtgctggcgaatatcttgctgacccagcgaagcagtaaagcgaaacgctaa

SEQ ID NO: 40782 - protein, 332 aa, Escherichia coli
MSASSLPLPQGKSVSLKQFVSRHINEIGLLVVIAILYLVFSLNAPGFISLNNQMNVLRDAATIGIAAWAMTLIIISGEIDVSVGPMVAFVSVCLAFLLQFEVPLAVACLLVLLLGALMGTLAGVLRGVFNVPSFVATLGLWSALRGMGLFMTNALPVPIDENEVLDWLGGQFLGVPVSALIMIVLFALFVFISRKTAFGRSVFAVGGNATAAQLCGINVRRVRILIFTLSGLLAAVTGILLAARLGSGNAGAANGLEFDVIAAVVVGGTALSGGRGSLFGTLLGVLVITLIGNGLVLLGINSFFQQVVRGVIIVVAVLANILLTQRSSKAKR

SEQ ID NO: 40783 - DNA, 22 bp, Artificial sequence
  (1)..(22): primer
atgtcgaaaagcaatccgtctg

SEQ ID NO: 40784 - DNA, 24 bp, Artificial sequence
  (1)..(24): primer
ttaagaacggcgtttggttgcgga

SEQ ID NO: 40785 - protein, 468 aa, Artificial sequence
  Variant (2)..(3): xaa in position 2 to 3 is any amino acid
  Variant (5)..(14): xaa in position 5 to 14 is any amino acid
  Variant (15)..(21): xaa in position 15 to 21 is any or no amino acid
  Variant (23)..(25): xaa in position 23 to 25 is any amino acid
  Variant (26)..(26): xaa in position 26 is any or no amino acid
  Variant (28)..(30): xaa in position 28 to 30 is any amino acid
  Variant (32)..(35): xaa in position 32 to 35 is any amino acid
  Variant (37)..(39): xaa in position 37 to 39 is any amino acid
  Variant (40)..(40): xaa in position 40 is any or no amino acid
  Variant (44)..(44): xaa in position 44 is any amino acid
  Variant (47)..(48): xaa in position 47 to 48 is any amino acid
  Variant (52)..(54): xaa in position 52 to 54 is any amino acid
  Variant (55)..(56): xaa in position 55 to 56 is any or no amino acid
  Variant (64)..(64): xaa in position 64 is any amino acid
  Variant (67)..(72): xaa in position 67 to 72 is any amino acid
  Variant (74)..(84): xaa in position 74 to 84 is any amino acid
  Variant (85)..(163): xaa in position 85 to 163 is any or no amino acid
  Variant (165)..(166): xaa in position 165 to 166 is any amino acid
  Variant (167)..(167): xaa in position 167 is any or no amino acid
  Variant (169)..(170): xaa in position 169 to 170 is any amino acid
  Variant (172)..(174): xaa in position 172 to 174 is any amino acid
  Variant (176)..(177): xaa in position 176 to 177 is any amino acid
  Variant (180)..(181): xaa in position 180 to 181 is any amino acid
  Variant (183)..(186): xaa in position 183 to 186 is any amino acid
  Variant (188)..(189): xaa in position 188 to 189 is any amino acid
  Variant (192)..(192): xaa in position 192 is any amino acid
  Variant (196)..(196): xaa in position 196 is any amino acid
  Variant (198)..(200): xaa in position 198 to 200 is any amino acid
  Variant (203)..(209): xaa in position 203 to 209 is any amino acid
  Variant (211)..(226): xaa in position 211 to 226 is any amino acid
  Variant (227)..(320): xaa in position 227 to 320 is any or no amino acid
  Variant (322)..(337): xaa in position 322 to 337 is any amino acid
  Variant (339)..(341): xaa in position 339 to 341 is any amino acid
  Variant (343)..(344): xaa in position 343 to 344 is any amino acid
  Variant (347)..(348): xaa in position 347 to 348 is any amino acid
  Variant (355)..(356): xaa in position 355 to 356 is any amino acid
  Variant (359)..(360): xaa in position 359 to 360 is any amino acid
  Variant (364)..(369): xaa in position 364 to 369 is any amino acid
  Variant (371)..(371): xaa in position 371 is any amino acid
  Variant (374)..(374): xaa in position 374 is any amino acid
  Variant (376)..(376): xaa in position 376 is any amino acid
  Variant (378)..(380): xaa in position 378 to 380 is any amino acid
  Variant (387)..(389): xaa in position 387 to 389 is any amino acid
  Variant (392)..(392): xaa in position 392 is any amino acid
  Variant (395)..(398): xaa in position 395 to 398 is any amino acid
  Variant (399)..(399): xaa in position 399 is any or no amino acid
  Variant (401)..(403): xaa in position 401 to 403 is any amino acid
  Variant (406)..(407): xaa in position 406 to 407 is any amino acid
  Variant (411)..(411): xaa in position 411 is any amino acid
  Variant (416)..(416): xaa in position 416 is any amino acid
  Variant (419)..(419): xaa in position 419 is any amino acid
  Variant (422)..(422): xaa in position 422 is any amino acid
  Variant (424)..(424): xaa in position 424 is any amino acid
  Variant (426)..(426): xaa in position 426 is any amino acid
  Variant (428)..(428): xaa in position 428 is any amino acid
  Variant (430)..(430): xaa in position 430 is any amino acid
  Variant (432)..(432): xaa in position 432 is any amino acid
  Variant (436)..(437): xaa in position 436 to 437 is any amino acid
  Variant (439)..(440): xaa in position 439 to 440 is any amino acid
  Variant (443)..(443): xaa in position 443 is any amino acid
  Variant (446)..(446): xaa in position 446 is any amino acid
  Variant (447)..(447): xaa in position 447 is any or no amino acid
  Variant (449)..(452): xaa in position 449 to 452 is any amino acid
  Variant (454)..(454): xaa in position 454 is any amino acid
  Variant (457)..(457): xaa in position 457 is any amino acid
  Variant (459)..(459): xaa in position 459 is any amino acid
  Variant (463)..(463): xaa in position 463 is any amino acid
  Variant (466)..(467): xaa in position 466 to 467 is any amino acid
LXXLXXXXXXXXXXXXXXXXXFXXXXNXXXIXXXXSXXXXILAXGMXXVILXXXXXIDLSVGSXLAXXXXXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXLXXGXXXGXXNGXXIXXXXVXXFIXTLGXMXXXRGXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXXXXXXLXXXTXXGRXXYAIGGNXXAAXXSGIXXXXXXIXVYXLXGXXXALAGIIXXXRLXSAXXXXXGXXXELXXIAAXVIGGXSLXGGXGXIXGXLXGXLIIXXLXXGLXLLXXVXXXXQXIIXGXVILXAVXXD

SEQ ID NO: 40786 - protein, 44 aa, Artificial sequence
  Variant (2)..(9): xaa in position 2 to 9 is any amino acid
  Variant (10)..(10): xaa in position 10 is Ala, Gly, Ser, Thr or Val
  Variant (11)..(15): xaa in position 11 to 15 is any amino acid
  Variant (16)..(16): xaa in position 16 is Ala, Gly, Ser, Thr or Val
  Variant (17)..(17): xaa in position 17 is any amino acid
  Variant (18)..(18): xaa in position 18 is Ala, Gly or Thr
  Variant (19)..(22): xaa in position 19 to 22 is any amino acid
  Variant (23)..(23): xaa in position 23 is Phe, Ile, Leu, Met or Val
  Variant (24)..(28): xaa in position 24 to 28 is any amino acid
  Variant (29)..(29): xaa in position 29 is Asp or Glu
  Variant (32)..(32): xaa in position 32 is any amino acid
  Variant (33)..(39): xaa in position 33 to 39 is any or no amino acid
  Variant (41)..(43): xaa in position 41 to 43 is any amino acid
  Variant (44)..(44): xaa in position 44 is Ala, Cys, Gly, Ser or Val
NXXXXXXXXXXXXXXXXXXXXXXXXXXXXLSXXXXXXXXGXXXX

SEQ ID NO: 40787 - protein, 32 aa, Artificial sequence
  Variant (2)..(3): xaa in position 2 to 3 is any amino acid
  Variant (4)..(4): xaa in position 4 is any or no amino acid
  Variant (6)..(8): xaa in position 6 to 8 is any amino acid
  Variant (10)..(16): xaa in position 10 to 16 is any amino acid
  Variant (17)..(17): xaa in position 17 is Ile, Leu, Met or Val
  Variant (18)..(18): xaa in position 18 is any amino acid
  Variant (19)..(19): xaa in position 19 is Ala, Asp, Pro or Ser
  Variant (20)..(20): xaa in position 20 is Phe, Ile, Leu or Val
  Variant (21)..(21): xaa in position 21 is Ala, Ile, Leu or Val
  Variant (22)..(22): xaa in position 22 is any amino acid
  Variant (25)..(25): xaa in position 25 is Ala, Gly, Ser, Thr or Val
  Variant (26)..(31): xaa in position 26 to 31 is any amino acid
  Variant (32)..(32): xaa in position 32 is Ala, Gly, Asn or Ser
GXXXGXXXGXXXXXXXXXXXXXTLXXXXXXXX

SEQ ID NO: 40788 - protein, 36 aa, Artificial sequence
  Variant (2)..(2): xaa in position 2 is any amino acid
  Variant (4)..(4): xaa in position 4 is Asp, Gly or Ser
  Variant (6)..(7): xaa in position 6 to 7 is any amino acid
  Variant (8)..(8): xaa in position 8 is any or no amino acid
  Variant (10)..(12): xaa in position 10 to 12 is any amino acid
  Variant (13)..(13): xaa in position 13 is any or no amino acid
  Variant (15)..(15): xaa in position 15 is Ile, Leu or Val
  Variant (16)..(24): xaa in position 16 to 24 is any amino acid
  Variant (25)..(25): xaa in position 25 is Phe or Tyr
  Variant (26)..(28): xaa in position 26 to 28 is any amino acid
  Variant (30)..(32): xaa in position 30 to 32 is any amino acid
  Variant (33)..(33): xaa in position 33 is Ala, Gly or Ser
  Variant (34)..(34): xaa in position 34 is any amino acid
  Variant (35)..(35): xaa in position 35 is Ala, Gly, Ser, Thr or Val
  Variant (36)..(36): xaa in position 36 is Ala, Gly or Ser
AXGXNXXXAXXXXGXXXXXXXXXXXXXXGXXXXXXX

SEQ ID NO: 40789 - protein, 61 aa, Artificial sequence
  Variant (2)..(2): xaa in position 2 is any amino acid
  Variant (3)..(4): xaa in position 3 to 4 is any or no amino acid
  Variant (6)..(6): xaa in position 6 is Phe, Leu or Met
  Variant (7)..(7): xaa in position 7 is any amino acid
  Variant (8)..(8): xaa in position 8 is Ala, Ile or Val
  Variant (10)..(11): xaa in position 10 to 11 is any amino acid
  Variant (12)..(12): xaa in position 12 is Ala, Cys, Ser, Thr or Val
  Variant (13)..(13): xaa in position 13 is any amino acid
  Variant (14)..(14): xaa in position 14 is Ile, Leu, Met or Val
  Variant (17)..(20): xaa in position 17 to 20 is any amino acid
  Variant (23)..(23): xaa in position 23 is any amino acid
  Variant (25)..(31): xaa in position 25 to 31 is any amino acid
  Variant (33)..(34): xaa in position 33 to 34 is any amino acid
  Variant (35)..(35): xaa in position 35 is Phe, Ile, Leu, Met or Val
  Variant (36)..(38): xaa in position 36 to 38 is any amino acid
  Variant (39)..(39): xaa in position 39 is Ile, Leu, Met or Val
  Variant (40)..(60): xaa in position 40 to 60 is any amino acid
  Variant (61)..(61): xaa in position 61 is Phe, Ile, Leu or Met
GXXXEXXXIXXXXXGGXXXXGGXGXXXXXXXGXXXXXXXXXXXXXXXXXXXXXXXXXXXXX

SEQ ID NO: 40790 - DNA, 1431 bp, Escherichia coli; identical to SEQ ID NO: 14875
  CDS (1)..(1431)

SEQ ID NO: 40791 - protein, 476 aa, Escherichia coli; identical to SEQ ID NO: 14876

SEQ ID NO: 40792 - DNA, 1638 bp, Fusobacterium nucleatum subsp. nucleatum ATCC 25586; identical to SEQ ID NO: 14877
  CDS (1)..(1638): transl_table=11

SEQ ID NO: 40793 - protein, 545 aa, Fusobacterium nucleatum subsp. nucleatum ATCC 25586; identical to SEQ ID NO: 14878

SEQ ID NO: 40794 - DNA, 1392 bp, Clostridium tetani E88; identical to SEQ ID NO: 14879
  CDS (1)..(1392): transl_table=11

SEQ ID NO: 40795 - protein, 463 aa, Clostridium tetani E88; identical to SEQ ID NO: 14880

SEQ ID NO: 40796 - DNA, 1380 bp, Bacteroides thetaiotaomicron VPI-5482; identical to SEQ ID NO: 14881
  CDS (1)..(1380): transl_table=11

SEQ ID NO: 40797 - protein, 459 aa, Bacteroides thetaiotaomicron VPI-5482; identical to SEQ ID NO: 14882

SEQ ID NO: 40798 - DNA, 1380 bp, Porphyromonas gingivalis W83; identical to SEQ ID NO: 14883
  CDS (1)..(1380): transl_table=11

SEQ ID NO: 40799 - protein, 459 aa, Porphyromonas gingivalis W83; identical to SEQ ID NO: 14884

SEQ ID NO: 40800 - DNA, 1449 bp, Rhodopseudomonas palustris CGA009; identical to SEQ ID NO: 14885
  CDS (1)..(1449): transl_table=11

SEQ ID NO: 40801 - protein, 482 aa, Rhodopseudomonas palustris CGA009; identical to SEQ ID NO: 14886

SEQ ID NO: 40802 - DNA, 1380 bp, Treponema denticola ATCC 35405; identical to SEQ ID NO: 14887
  CDS (1)..(1380): transl_table=11

SEQ ID NO: 40803 - protein, 459 aa, Treponema denticola ATCC 35405; identical to SEQ ID NO: 14888

SEQ ID NO: 40804 - DNA, 1380 bp, Treponema denticola ATCC 35405; identical to SEQ ID NO: 14889
  CDS (1)..(1380): transl_table=11

SEQ ID NO: 40805 - protein, 459 aa, Treponema denticola ATCC 35405; identical to SEQ ID NO: 14890

SEQ ID NO: 40806 - DNA, 1617 bp, Entamoeba histolytica HM-1:IMSS; identical to SEQ ID NO: 14891
  CDS (1)..(1617)

SEQ ID NO: 40807 - protein, 538 aa, Entamoeba histolytica HM-1:IMSS; identical to SEQ ID NO: 14892

SEQ ID NO: 40808 - DNA, 1389 bp, Desulfovibrio vulgaris subsp. vulgaris str. Hildenborough; identical to SEQ ID NO: 14893
  CDS (1)..(1389): transl_table=11

SEQ ID NO: 40809 - protein, 462 aa, Desulfovibrio vulgaris subsp. vulgaris str. Hildenborough; identical to SEQ ID NO: 14894

SEQ ID NO: 40810 - DNA, 1377 bp, Propionibacterium acnes KPA171202; identical to SEQ ID NO: 14895
  CDS (1)..(1377): transl_table=11

SEQ ID NO: 40811 - protein, 458 aa, Propionibacterium acnes KPA171202; identical to SEQ ID NO: 14896

SEQ ID NO: 40812 - DNA, 1365 bp, Symbiobacterium thermophilum IAM 14863; identical to SEQ ID NO: 14897
  CDS (1)..(1365): transl_table=11

SEQ ID NO: 40813 - protein, 454 aa, Symbiobacterium thermophilum IAM 14863; identical to SEQ ID NO: 14898

SEQ ID NO: 40814 - DNA, 1416 bp, Symbiobacterium thermophilum IAM 14863; identical to SEQ ID NO: 14899
  CDS (1)..(1416): transl_table=11

SEQ ID NO: 40815 - protein, 471 aa, Symbiobacterium thermophilum IAM 14863; identical to SEQ ID NO: 14900

SEQ ID NO: 40816 - DNA, 1443 bp, Photobacterium profundum SS9; identical to SEQ ID NO: 14901
  CDS (1)..(1443): transl_table=11

SEQ ID NO: 40817 - protein, 480 aa, Photobacterium profundum SS9; identical to SEQ ID NO: 14902

SEQ ID NO: 40818 - DNA, 1467 bp, Photobacterium profundum SS9; identical to SEQ ID NO: 14903
  CDS (1)..(1467): transl_table=11

SEQ ID NO: 40819 - protein, 488 aa, Photobacterium profundum SS9; identical to SEQ ID NO: 14904

SEQ ID NO: 40820 - DNA, 1401 bp, Photobacterium profundum SS9; identical to SEQ ID NO: 14905
  CDS (1)..(1401): transl_table=11

SEQ ID NO: 40821 - protein, 466 aa, Photobacterium profundum SS9; identical to SEQ ID NO: 14906

SEQ ID NO: 40822 - DNA, 1344 bp, Haloarcula marismortui ATCC 43049; identical to SEQ ID NO: 14907
  CDS (1)..(1344): transl_table=11

SEQ ID NO: 40823 - protein, 447 aa, Haloarcula marismortui ATCC 43049; identical to SEQ ID NO: 14908

SEQ ID NO: 40824 - DNA, 1449 bp, Azoarcus sp. EbN1; identical to SEQ ID NO: 14909
  CDS (1)..(1449): transl_table=11

SEQ ID NO: 40825 - protein, 482 aa, Azoarcus sp. EbN1; identical to SEQ ID NO: 14910

SEQ ID NO: 40826 - DNA, 1404 bp, Nostoc punctiforme PCC 73102; identical to SEQ ID NO: 14911
  CDS (1)..(1404)

SEQ ID NO: 40827 - protein, 467 aa, Nostoc punctiforme PCC 73102; identical to SEQ ID NO: 14912

SEQ ID NO: 40828 - DNA, 1416 bp, Haemophilus somnus 129PT; identical to SEQ ID NO: 14913
  CDS (1)..(1416)

SEQ ID NO: 40829 - protein, 471 aa, Haemophilus somnus 129PT; identical to SEQ ID NO: 14914

SEQ ID NO: 40830 - DNA, 1569 bp, Fusobacterium nucleatum subsp. vincentii ATCC 49256; identical to SEQ ID NO: 14915
  CDS (1)..(1569): transl_table=11

SEQ ID NO: 40831 - protein, 522 aa, Fusobacterium nucleatum subsp. vincentii ATCC 49256; identical to SEQ ID NO: 14916

SEQ ID NO: 40832 - DNA, 1383 bp, Fusobacterium nucleatum subsp. vincentii ATCC 49256; identical to SEQ ID NO: 14917
  CDS (1)..(1383): transl_table=11

SEQ ID NO: 40833 - protein, 460 aa, Fusobacterium nucleatum subsp. vincentii ATCC 49256; identical to SEQ ID NO: 14918

SEQ ID NO: 40834 - DNA, 1182 bp, Haemophilus influenzae 86-028NP; identical to SEQ ID NO: 14919
  CDS (1)..(1182)

SEQ ID NO: 40835 - protein, 393 aa, Haemophilus influenzae 86-028NP; identical to SEQ ID NO: 14920

SEQ ID NO: 40836 - DNA, 1347 bp, Solibacter usitatus Ellin6076; identical to SEQ ID NO: 14921
  CDS (1)..(1347): transl_table=11

SEQ ID NO: 40837 - protein, 448 aa, Solibacter usitatus Ellin6076; identical to SEQ ID NO: 14922

SEQ ID NO: 40838 - DNA, 1374 bp, Desulfitobacterium hafniense DCB-2; identical to SEQ ID NO: 14923
  CDS (1)..(1374): transl_table=11

SEQ ID NO: 40839 - protein, 457 aa, Desulfitobacterium hafniense DCB-2; identical to SEQ ID NO: 14924

SEQ ID NO: 40840 - DNA, 1389 bp, Desulfitobacterium hafniense DCB-2; identical to SEQ ID NO: 14925
  CDS (1)..(1389): transl_table=11

SEQ ID NO: 40841 - protein, 462 aa, Desulfitobacterium hafniense DCB-2; identical to SEQ ID NO: 14926

SEQ ID NO: 40842 - DNA, 1443 bp, uncultured bacterium; identical to SEQ ID NO: 14927
  CDS (1)..(1443)

SEQ ID NO: 40843 - protein, 480 aa, uncultured bacterium; identical to SEQ ID NO: 14928

SEQ ID NO: 40844 - DNA, 1365 bp, Symbiobacterium thermophilum; identical to SEQ ID NO: 14929
  CDS (1)..(1365)

SEQ ID NO: 40845 - protein, 454 aa, Symbiobacterium thermophilum; identical to SEQ ID NO: 14930

SEQ ID NO: 40846 - DNA, 1365 bp, Symbiobacterium thermophilum; identical to SEQ ID NO: 14897
  CDS (1)..(1365)

SEQ ID NO: 40847 - protein, 454 aa, Symbiobacterium thermophilum; identical to SEQ ID NO: 14898

SEQ ID NO: 40848 - DNA, 1386 bp, Chromobacterium violaceum; identical to SEQ ID NO: 14933
  CDS (1)..(1386): transl_table=11

SEQ ID NO: 40849 - protein, 461 aa, Chromobacterium violaceum; identical to SEQ ID NO: 14934

SEQ ID NO: 40850 - DNA, 1419 bp, Clostridium tetani; identical to SEQ ID NO: 14935
  CDS (1)..(1419): transl_table=11

SEQ ID NO: 40851 - protein, 472 aa, Clostridium tetani; identical to SEQ ID NO: 14936

SEQ ID NO: 40852 - DNA, 1389 bp, Enterobacter aerogenes; identical to SEQ ID NO: 14937
  CDS (1)..(1389): transl_table=11

SEQ ID NO: 40853 - protein, 462 aa, Enterobacter aerogenes; identical to SEQ ID NO: 14938

SEQ ID NO: 40854 - DNA, 1419 bp, Haemophilus influenzae; identical to SEQ ID NO: 14939
  CDS (1)..(1419): transl_table=11

SEQ ID NO: 40855 - protein, 472 aa, Haemophilus influenzae; identical to SEQ ID NO: 14940

SEQ ID NO: 40856 - DNA, 1347 bp, Halobacterium salinarium; identical to SEQ ID NO: 14941
  CDS (1)..(1347)

SEQ ID NO: 40857 - protein, 448 aa, Halobacterium salinarium; identical to SEQ ID NO: 14942

SEQ ID NO: 40858 - DNA, 1416 bp, Pasteurella multocida; identical to SEQ ID NO: 14943
  CDS (1)..(1416): transl_table=11

SEQ ID NO: 40859 - protein, 471 aa, Pasteurella multocida; identical to SEQ ID NO: 14944

SEQ ID NO: 40860 - DNA, 1401 bp, Photorhabdus luminescens; identical to SEQ ID NO: 14945
  CDS (1)..(1401): transl_table=11

SEQ ID NO: 40861 - protein, 466 aa, Photorhabdus luminescens; identical to SEQ ID NO: 14946

SEQ ID NO: 40862 - DNA, 1398 bp, Proteus inconstans; identical to SEQ ID NO: 14947
  CDS (1)..(1398): transl_table=11

SEQ ID NO: 40863 - protein, 465 aa, Proteus inconstans; identical to SEQ ID NO: 14948

SEQ ID NO: 40864 - DNA, 1404 bp, Proteus vulgaris; identical to SEQ ID NO: 14949
  CDS (1)..(1404): transl_table=11

SEQ ID NO: 40865 - protein, 467 aa, Proteus vulgaris; identical to SEQ ID NO: 14950

SEQ ID NO: 40866 - DNA, 1365 bp, Rhodobacter capsulatus; identical to SEQ ID NO: 14951
  CDS (1)..(1365): transl_table=11

SEQ ID NO: 40867 - protein, 454 aa, Rhodobacter capsulatus; identical to SEQ ID NO: 14952

SEQ ID NO: 40868 - DNA, 1389 bp, Thermoanaerobacter tengcongensis; identical to SEQ ID NO: 14953
  CDS (1)..(1389): transl_table=11

SEQ ID NO: 40869 - protein, 462 aa, Thermoanaerobacter tengcongensis; identical to SEQ ID NO: 14954

SEQ ID NO: 40870 - DNA, 1419 bp, Vibrio cholerae; identical to SEQ ID NO: 14955
  CDS (1)..(1419): transl_table=11

SEQ ID NO: 40871 - protein, 472 aa, Vibrio cholerae; identical to SEQ ID NO: 14956

SEQ ID NO: 40872 - DNA, 1401 bp, Vibrio parahaemolyticus; identical to SEQ ID NO: 14957
  CDS (1)..(1401): transl_table=11

SEQ ID NO: 40873 - protein, 466 aa, Vibrio parahaemolyticus; identical to SEQ ID NO: 14958

SEQ ID NO: 40874 - DNA, 1422 bp, Vibrio vulnificus; identical to SEQ ID NO: 14959
  CDS (1)..(1422): transl_table=11

SEQ ID NO: 40875 - protein, 473 aa, Vibrio vulnificus; identical to SEQ ID NO: 14960

SEQ ID NO: 40876 - DNA, 1371 bp, Citrobacter freundii; identical to SEQ ID NO: 14961
  CDS (1)..(1371): transl_table=11

SEQ ID NO: 40877 - protein, 456 aa, Citrobacter freundii; identical to SEQ ID NO: 14962

SEQ ID NO: 40878 - DNA, 1383 bp, Clostridium tetani; identical to SEQ ID NO: 14963
  CDS (1)..(1383)

SEQ ID NO: 40879 - protein, 460 aa, Clostridium tetani; identical to SEQ ID NO: 14964

SEQ ID NO: 40880 - DNA, 1371 bp, Enterobacter agglomerans; identical to SEQ ID NO: 14965
  CDS (1)..(1371): transl_table=11

SEQ ID NO: 40881 - protein, 456 aa, Enterobacter agglomerans; identical to SEQ ID NO: 14966

SEQ ID NO: 40882 - DNA, 1383 bp, Fusobacterium nucleatum; identical to SEQ ID NO: 14967
  CDS (1)..(1383): transl_table=11

SEQ ID NO: 40883 - protein, 460 aa, Fusobacterium nucleatum; identical to SEQ ID NO: 14968

SEQ ID NO: 40884 - DNA, 1377 bp, Pasteurella multocida; identical to SEQ ID NO: 14969
  CDS (1)..(1377): transl_table=11

SEQ ID NO: 40885 - protein, 458 aa, Pasteurella multocida; identical to SEQ ID NO: 14970

SEQ ID NO: 40886 - DNA, 1377 bp, Symbiobacterium sp; identical to SEQ ID NO: 14971
  CDS (1)..(1377): transl_table=11

SEQ ID NO: 40887 - protein, 458 aa, Symbiobacterium sp; identical to SEQ ID NO: 14972

SEQ ID NO: 40888 - DNA, 27 bp, Artificial sequence
  (1)..(27): primer
atgaaggattatgtaatggaaaacttt

SEQ ID NO: 40889 - DNA, 26 bp, Artificial sequence
  (1)..(26): primer
ttaaacttctttaagttttgcggtga

SEQ ID NO: 40890 - protein, 533 aa, Artificial sequence; identical to SEQ ID NO: 14975
  Variant (2)..(2): xaa in position 2 is any amino acid
  Variant (7)..(7): xaa in position 7 is any amino acid
  Variant (10)..(10): xaa in position 10 is any amino acid
  Variant (12)..(18): xaa in position 12 to 18 is any amino acid
  Variant (20)..(22): xaa in position 20 to 22 is any amino acid
  Variant (24)..(25): xaa in position 24 to 25 is any amino acid
  Variant (27)..(28): xaa in position 27 to 28 is any amino acid
  Variant (30)..(30): xaa in position 30 is any amino acid
  Variant (32)..(32): xaa in position 32 is any amino acid
  Variant (34)..(34): xaa in position 34 is any amino acid
  Variant (36)..(37): xaa in position 36 to 37 is any amino acid
  Variant (49)..(49): xaa in position 49 is any amino acid
  Variant (53)..(54): xaa in position 53 to 54 is any amino acid
  Variant (56)..(56): xaa in position 56 is any or no amino acid
  Variant (61)..(61): xaa in position 61 is any amino acid
  Variant (70)..(71): xaa in position 70 to 71 is any amino acid
  Variant (73)..(74): xaa in position 73 to 74 is any amino acid
  Variant (76)..(78): xaa in position 76 to 78 is any amino acid
  Variant (80)..(80): xaa in position 80 is any amino acid
  Variant (83)..(83): xaa in position 83 is any amino acid
  Variant (86)..(88): xaa in position 86 to 88 is any amino acid
  Variant (89)..(134): xaa in position 89 to 134 is any or no amino acid
  Variant (137)..(137): xaa in position 137 is any amino acid
  Variant (145)..(145): xaa in position 145 is any amino acid
  Variant (147)..(150): xaa in position 147 to 150 is any amino acid
  Variant (153)..(160): xaa in position 153 to 160 is any amino acid
  Variant (161)..(170): xaa in position 161 to 170 is any or no amino acid
  Variant (172)..(173): xaa in position 172 to 173 is any amino acid
  Variant (175)..(175): xaa in position 175 is any amino acid
  Variant (178)..(179): xaa in position 178 to 179 is any amino acid
  Variant (181)..(184): xaa in position 181 to 184 is any amino acid
  Variant (187)..(190): xaa in position 187 to 190 is any amino acid
  Variant (192)..(195): xaa in position 192 to 195 is any amino acid
  Variant (197)..(202): xaa in position 197 to 202 is any amino acid
  Variant (203)..(210): xaa in position 203 to 210 is any or no amino acid
  Variant (214)..(215): xaa in position 214 to 215 is any amino acid
  Variant (218)..(218): xaa in position 218 is any amino acid
  Variant (221)..(223): xaa in position 221 to 223 is any amino acid
  Variant (225)..(227): xaa in position 225 to 227 is any amino acid
  Variant (229)..(230): xaa in position 229 to 230 is any amino acid
  Variant (231)..(231): xaa in position 231 is any or no amino acid
  Variant (233)..(234): xaa in position 233 to 234 is any amino acid
  Variant (236)..(238): xaa in position 236 to 238 is any amino acid
  Variant (241)..(241): xaa in position 241 is any amino acid
  Variant (243)..(244): xaa in position 243 to 244 is any amino acid
  Variant (252)..(252): xaa in position 252 is any amino acid
  Variant (256)..(259): xaa in position 256 to 259 is any amino acid
  Variant (261)..(263): xaa in position 261 to 263 is any amino acid
  Variant (265)..(265): xaa in position 265 is any amino acid
  Variant (267)..(267): xaa in position 267 is any amino acid
  Variant (269)..(270): xaa in position 269 to 270 is any amino acid
  Variant (273)..(273): xaa in position 273 is any amino acid
  Variant (275)..(276): xaa in position 275 to 276 is any amino acid
  Variant (283)..(285): xaa in position 283 to 285 is any amino acid
  Variant (287)..(288): xaa in position 287 to 288 is any amino acid
  Variant (290)..(292): xaa in position 290 to 292 is any amino acid
  Variant (295)..(296): xaa in position 295 to 296 is any amino acid
  Variant (298)..(299): xaa in position 298 to 299 is any amino acid
  Variant (301)..(301): xaa in position 301 is any amino acid
  Variant (303)..(303): xaa in position 303 is any amino acid
  Variant (307)..(309): xaa in position 307 to 309 is any amino acid
  Variant (316)..(316): xaa in position 316 is any amino acid
  Variant (323)..(323): xaa in position 323 is any amino acid
  Variant (325)..(327): xaa in position 325 to 327 is any amino acid
  Variant (329)..(330): xaa in position 329 to 330 is any amino acid
  Variant (331)..(348): xaa in position 331 to 348 is any or no amino acid
  Variant (351)..(357): xaa in position 351 to 357 is any amino acid
  Variant (359)..(360): xaa in position 359 to 360 is any amino acid
  Variant (363)..(364): xaa in position 363 to 364 is any amino acid
  Variant (370)..(370): xaa in position 370 is any amino acid
  Variant (375)..(375): xaa in position 375 is any amino acid
  Variant (379)..(379): xaa in position 379 is any amino acid
  Variant (382)..(382): xaa in position 382 is any amino acid
  Variant (384)..(388): xaa in position 384 to 388 is any amino acid
  Variant (391)..(392): xaa in position 391 to 392 is any amino acid
  Variant (395)..(395): xaa in position 395 is any amino acid
  Variant (398)..(398): xaa in position 398 is any amino acid
  Variant (401)..(403): xaa in position 401 to 403 is any amino acid
  Variant (405)..(407): xaa in position 405 to 407 is any amino acid
  Variant (410)..(413): xaa in position 410 to 413 is any amino acid
  Variant (414)..(414): xaa in position 414 is any or no amino acid
  Variant (416)..(416): xaa in position 416 is any or no amino acid
  Variant (421)..(421): xaa in position 421 is any amino acid
  Variant (426)..(429): xaa in position 426 to 429 is any amino acid
  Variant (431)..(433): xaa in position 431 to 433 is any or no amino acid
  Variant (436)..(439): xaa in position 436 to 439 is any amino acid
  Variant (443)..(444): xaa in position 443 to 444 is any amino acid
  Variant (446)..(448): xaa in position 446 to 448 is any amino acid
  Variant (451)..(453): xaa in position 451 to 453 is any amino acid
  Variant (457)..(458): xaa in position 457 to 458 is any amino acid
  Variant (460)..(460): xaa in position 460 is any amino acid
  Variant (462)..(467): xaa in position 462 to 467 is any amino acid
  Variant (468)..(470): xaa in position 468 to 470 is any or no amino acid
  Variant (472)..(479): xaa in position 472 to 479 is any or no amino acid
  Variant (481)..(482): xaa in position 481 to 482 is any amino acid
  Variant (485)..(485): xaa in position 485 is any amino acid
  Variant (489)..(490): xaa in position 489 to 490 is any amino acid
  Variant (493)..(494): xaa in position 493 to 494 is any amino acid
  Variant (498)..(498): xaa in position 498 is any amino acid
  Variant (500)..(505): xaa in position 500 to 505 is any amino acid
  Variant (507)..(512): xaa in position 507 to 512 is any amino acid
  Variant (514)..(514): xaa in position 514 is any amino acid
  Variant (515)..(515): xaa in position 515 is any or no amino acid
  Variant (518)..(521): xaa in position 518 to 521 is any amino acid
  Variant (524)..(525): xaa in position 524 to 525 is any amino acid
  Variant (526)..(527): xaa in position 526 to 527 is any or no amino acid
  Variant (530)..(530): xaa in position 530 is any amino acid
  Variant (532)..(532): xaa in position 532 is any amino acid

SEQ ID NO: 40891 - protein, 85 aa, Artificial sequence; identical to SEQ ID NO: 14976
  Variant (2)..(2): xaa in position 2 is Pro or Ser
  Variant (3)..(4): xaa in position 3 to 4 is any amino acid
  Variant (5)..(5): xaa in position 5 is Ile, Leu or Met
  Variant (6)..(8): xaa in position 6 to 8 is any amino acid
  Variant (10)..(10): xaa in position 10 is any amino acid
  Variant (11)..(18): xaa in position 11 to 18 is any or no amino acid
  Variant (20)..(25): xaa in position 20 to 25 is any amino acid
  Variant (26)..(26): xaa in position 26 is Ala, Ser or Val
  Variant (27)..(28): xaa in position 27 to 28 is any amino acid
  Variant (30)..(30): xaa in position 30 is any amino acid
  Variant (32)..(32): xaa in position 32 is any amino acid
  Variant (33)..(33): xaa in position 33 is Ile or Leu
  Variant (34)..(34): xaa in position 34 is any amino acid
  Variant (35)..(35): xaa in position 35 is Ala, Gly or Ser
  Variant (36)..(39): xaa in position 36 to 39 is any amino acid
  Variant (49)..(49): xaa in position 49 is Ala, Gly, Asn, Ser or Thr
  Variant (51)..(51): xaa in position 51 is Ile, Met or Val
  Variant (52)..(52): xaa in position 52 is Ser or Thr
  Variant (53)..(53): xaa in position 53 is Asp, Asn, Gln or Ser
  Variant (54)..(56): xaa in position 54 to 56 is any amino acid
  Variant (57)..(57): xaa in position 57 is Ala, Gly or Ser
  Variant (58)..(58): xaa in position 58 is Ala or Gly
  Variant (59)..(59): xaa in position 59 is Ile, Leu, Met or Val
  Variant (60)..(60): xaa in position 60 is Phe, Ile, Leu or Met
  Variant (61)..(61): xaa in position 61 is any amino acid
  Variant (65)..(65): xaa in position 65 is Ala or Ser
  Variant (67)..(67): xaa in position 67 is Ala or Ser
  Variant (69)..(69): xaa in position 69 is Ala, Gly or Ser
  Variant (70)..(70): xaa in position 70 is any amino acid
  Variant (71)..(71): xaa in position 71 is Asn or Ser
  Variant (72)..(72): xaa in position 72 is Phe, Trp or Tyr
  Variant (73)..(74): xaa in position 73 to 74 is any amino acid
  Variant (75)..(75): xaa in position 75 is Phe, Leu or Met
  Variant (76)..(78): xaa in position 76 to 78 is any amino acid
  Variant (79)..(79): xaa in position 79 is Ala, Gly, Ile or Val
  Variant (80)..(83): xaa in position 80 to 83 is any amino acid
  Variant (84)..(84): xaa in position 84 is Asp, Gly, Asn or Pro
  Variant (85)..(85): xaa in position 85 is Phe or Tyr

SEQ ID NO: 40892 - protein, 41 aa, Artificial sequence; identical to SEQ ID NO: 14977
  Variant (2)..(2): xaa in position 2 is Ala or Thr
  Variant (7)..(7): xaa in position 7 is Ala or Gly
  Variant (10)..(10): xaa in position 10 is any amino acid
  Variant (11)..(15): xaa in position 11 to 15 is any or no amino acid
  Variant (17)..(40): xaa in position 17 to 40 is any amino acid
  Variant (41)..(41): xaa in position 41 is Ala, Glu, Gly, Gln or Thr

SEQ ID NO: 40893 - protein, 100 aa, Artificial sequence; identical to SEQ ID NO: 14978
  Variant (2)..(13): xaa in position 2 to 13 is any amino acid
  Variant (14)..(17): xaa in position 14 to 17 is any or no amino acid
  Variant (19)..(19): xaa in position 19 is Cys, Asn, Ser or Val
  Variant (21)..(22): xaa in position 21 to 22 is any amino acid
  Variant (27)..(27): xaa in position 27 is Ile or Val
  Variant (29)..(29): xaa in position 29 is Ile, Leu or Met
  Variant (30)..(30): xaa in position 30 is any amino acid
  Variant (32)..(32): xaa in position 32 is Ile, Leu or Met
  Variant (33)..(33): xaa in position 33 is any amino acid
  Variant (34)..(34): xaa in position 34 is Ala, Asp, Glu, Gly or Ser
  Variant (35)..(37): xaa in position 35 to 37 is any amino acid
  Variant (38)..(38): xaa in position 38 is Ile, Leu, Met or Val
  Variant (39)..(39): xaa in position 39 is Ala, Cys or Thr
  Variant (40)..(43): xaa in position 40 to 43 is any amino acid
  Variant (44)..(44): xaa in position 44 is Ile or Val
  Variant (45)..(45): xaa in position 45 is any amino acid
  Variant (46)..(46): xaa in position 46 is Phe, Ile, Leu, Met or Val
  Variant (47)..(48): xaa in position 47 to 48 is any amino acid
  Variant (50)..(50): xaa in position 50 is Ala, Ser or Val
  Variant (51)..(51): xaa in position 51 is Ala, Cys or Thr
  Variant (53)..(53): xaa in position 53 is any amino acid
  Variant (54)..(54): xaa in position 54 is Ala, Cys, Ser or Val
  Variant (57)..(57): xaa in position 57 is Ala or Cys
  Variant (58)..(58): xaa in position 58 is His, Trp or Tyr
  Variant (60)..(60): xaa in position 60 is Ile or Val
  Variant (61)..(62): xaa in position 61 to 62 is any amino acid
  Variant (63)..(63): xaa in position 63 is Asp, Gln or Arg
  Variant (64)..(64): xaa in position 64 is Asp or Glu
  Variant (65)..(68): xaa in position 65 to 68 is any amino acid
  Variant (69)..(69): xaa in position 69 is Asp, Glu, Gly, Asn or Ser
  Variant (70)..(71): xaa in position 70 to 71 is any amino acid
  Variant (72)..(72): xaa in position 72 is Ile, Leu, Pro or Val
  Variant (73)..(73): xaa in position 73 is any amino acid
  Variant (74)..(74): xaa in position 74 is Asp, Glu, Gln, Ser or Thr
  Variant (75)..(75): xaa in position 75 is Ile or Val
  Variant (76)..(77): xaa in position 76 to 77 is any amino acid
  Variant (78)..(78): xaa in position 78 is Asp, Glu or Lys
  Variant (79)..(83): xaa in position 79 to 83 is any amino acid
  Variant (84)..(84): xaa in position 84 is Asp or Glu
  Variant (85)..(88): xaa in position 85 to 88 is any amino acid
  Variant (90)..(90): xaa in position 90 is Ala, Gly or Ser
  Variant (94)..(94): xaa in position 94 is Ala, Cys, Gly, Pro or Thr
  Variant (95)..(95): xaa in position 95 is Phe, Ile, Leu or Met
  Variant (96)..(96): xaa in position 96 is Ala, Leu or Val
  Variant (97)..(97): xaa in position 97 is Asn, Pro or Gln
  Variant (98)..(98): xaa in position 98 is Ile or Met

SEQ ID NO: 40894 - protein, 84 aa, Artificial sequence; identical to SEQ ID NO: 14979
  Variant (2)..(4): xaa in position 2 to 4 is any amino acid
  Variant (8)..(8): xaa in position 8 is Leu or Met
  Variant (9)..(9): xaa in position 9 is Ala, Glu, Asn, Ser or Thr
  Variant (11)..(11): xaa in position 11 is any amino acid
  Variant (12)..(12): xaa in position 12 is Ala or Asp
  Variant (13)..(13): xaa in position 13 is Ile, Leu or Met
  Variant (14)..(16): xaa in position 14 to 16 is any amino acid
  Variant (18)..(18): xaa in position 18 is any amino acid
  Variant (20)..(20): xaa in position 20 is Phe, Ile or Leu
  Variant (21)..(31): xaa in position 21 to 31 is any amino acid
  Variant (33)..(33): xaa in position 33 is Ile or Val
  Variant (34)..(34): xaa in position 34 is any amino acid
  Variant (36)..(39): xaa in position 36 to 39 is any amino acid
  Variant (40)..(40): xaa in position 40 is Ala, Gly, Asn or Val
  Variant (41)..(42): xaa in position 41 to 42 is any amino acid
  Variant (44)..(46): xaa in position 44 to 46 is any amino acid
  Variant (47)..(47): xaa in position 47 is Asp, Glu, Gly or Asn
  Variant (48)..(48): xaa in position 48 is Ile or Val
  Variant (49)..(49): xaa in position 49 is Ala, Ile, Leu, Pro or Val
  Variant (50)..(52): xaa in position 50 to 52 is any amino acid
  Variant (53)..(53): xaa in position 53 is Ala or Pro
  Variant (54)..(54): xaa in position 54 is any amino acid
  Variant (56)..(56): xaa in position 56 is any or no amino acid
  Variant (58)..(58): xaa in position 58 is Ala, Gly or Thr
  Variant (59)..(60): xaa in position 59 to 60 is any amino acid
  Variant (61)..(61): xaa in position 61 is Ile, Leu or Val
  Variant (62)..(62): xaa in position 62 is Asp or Glu
  Variant (63)..(63): xaa in position 63 is Ala, Gly or Thr
  Variant (64)..(67): xaa in position 64 to 67 is any amino acid
  Variant (68)..(68): xaa in position 68 is Glu, Asn, Pro or Thr
  Variant (69)..(75): xaa in position 69 to 75 is any amino acid
  Variant (76)..(76): xaa in position 76 is Gly, Ile or Pro
  Variant (77)..(77): xaa in position 77 is Ala, Asp, Gly or Ser
  Variant (78)..(80): xaa in position 78 to 80 is any amino acid
  Variant (81)..(81): xaa in position 81 is Ala, Cys, Gly, Asn, Ser, Thr or Val
  Variant (82)..(83): xaa in position 82 to 83 is any amino acid
  Variant (84)..(84): xaa in position 84 is Ile, Leu or Val

SEQ ID NO: 40895 - DNA, 1041 bp, Escherichia coli; identical to SEQ ID NO: 14980
  CDS (1)..(1041)

SEQ ID NO: 40896 - protein, 346 aa, Escherichia coli; identical to SEQ ID NO: 14981

SEQ ID NO: 40897 - DNA, 1152 bp, Pyrococcus abyssi GE5; identical to SEQ ID NO: 14982
  CDS (1)..(1152): transl_table=11

SEQ ID NO: 40898 - protein, 383 aa, Pyrococcus abyssi GE5; identical to SEQ ID NO: 14983

SEQ ID NO: 40899 - DNA, 1122 bp, Aeropyrum pernix K1; identical to SEQ ID NO: 14984
  CDS (1)..(1122): transl_table=11

SEQ ID NO: 40900 - protein, 373 aa, Aeropyrum pernix K1; identical to SEQ ID NO: 14985

SEQ ID NO: 40901 - DNA, 1014 bp, Aquifex aeolicus VF5; identical to SEQ ID NO: 14986
  CDS (1)..(1014): transl_table=11

SEQ ID NO: 40902 - protein, 337 aa, Aquifex aeolicus VF5; identical to SEQ ID NO: 14987

SEQ ID NO: 40903 - DNA, 825 bp, Thermotoga maritima MSB8; identical to SEQ ID NO: 14988
  CDS (1)..(825): transl_table=11

SEQ ID NO: 40904 - protein, 274 aa, Thermotoga maritima MSB8; identical to SEQ ID NO: 14989

SEQ ID NO: 40905 - DNA, 900 bp, Vibrio cholerae O1 biovar eltor str. N16961; identical to SEQ ID NO: 14990
  CDS (1)..(900): transl_table=11

SEQ ID NO: 40906 - protein, 299 aa, Vibrio cholerae O1 biovar eltor str. N16961; identical to SEQ ID NO: 14991

SEQ ID NO: 40907 - DNA, 837 bp, Vibrio cholerae O1 biovar eltor str. N16961; identical to SEQ ID NO: 14992
  CDS (1)..(837): transl_table=11

SEQ ID NO: 40908 - protein, 278 aa, Vibrio cholerae O1 biovar eltor str. N16961; identical to SEQ ID NO: 14993

SEQ ID NO: 40909 - DNA, 1212 bp, Pasteurella multocida subsp. multocida str. Pm70; identical to SEQ ID NO: 14994
  CDS (1)..(1212): transl_table=11

SEQ ID NO: 40910 - protein, 403 aa, Pasteurella multocida subsp. multocida str. Pm70; identical to SEQ ID NO: 14995

SEQ ID NO: 40911 - DNA, 897 bp, Lactococcus lactis subsp. lactis Il1403; identical to SEQ ID NO: 14996
  CDS (1)..(897): transl_table=11

SEQ ID NO: 40912 - protein, 298 aa, Lactococcus lactis subsp. lactis Il1403; identical to SEQ ID NO: 14997

SEQ ID NO: 40913 - DNA, 816 bp, Methanothermobacter thermautotrophicus str. Delta H; identical to SEQ ID NO: 14998
  CDS (1)..(816)

SEQ ID NO: 40914 - protein, 271 aa, Methanothermobacter thermautotrophicus str. Delta H; identical to SEQ ID NO: 14999

SEQ ID NO: 40915 - DNA, 837 bp, Methanothermobacter thermautotrophicus str. Delta H; identical to SEQ ID NO: 15000
  CDS (1)..(837)

SEQ ID NO: 40916 - protein, 278 aa, Methanothermobacter thermautotrophicus str. Delta H; identical to SEQ ID NO: 15001

SEQ ID NO: 40917 - DNA, 1212 bp, Deinococcus radiodurans R1; identical to SEQ ID NO: 15002
  CDS (1)..(1212): transl_table=11

SEQ ID NO: 40918 - protein, 403 aa, Deinococcus radiodurans R1; identical to SEQ ID NO: 15003

SEQ ID NO: 40919 - DNA, 1290 bp, Mycobacterium leprae TN; identical to SEQ ID NO: 15004
  CDS (1)..(1290): transl_table=11

SEQ ID NO: 40920 - protein, 429 aa, Mycobacterium leprae TN; identical to SEQ ID NO: 15005

SEQ ID NO: 40921 - DNA, 1170 bp, Mycobacterium tuberculosis CDC1551; identical to SEQ ID NO: 15006
  CDS (1)..(1170): transl_table=11

SEQ ID NO: 40922 - protein, 389 aa, Mycobacterium tuberculosis CDC1551; identical to SEQ ID NO: 15007

SEQ ID NO: 40923 - DNA, 1218 bp, Sulfolobus solfataricus P2; identical to SEQ ID NO: 15008
  CDS (1)..(1218): transl_table=11

SEQ ID NO: 40924 - protein, 405 aa, Sulfolobus solfataricus P2; identical to SEQ ID NO: 15009

SEQ ID NO: 40925 - DNA, 897 bp, Clostridium acetobutylicum ATCC 824; identical to SEQ ID NO: 15010
  CDS (1)..(897): transl_table=11

SEQ ID NO: 40926 - protein, 298 aa, Clostridium acetobutylicum ATCC 824; identical to SEQ ID NO: 15011

SEQ ID NO: 40927 - DNA, 1002 bp, Synechocystis sp. PCC 6803; identical to SEQ ID NO: 15012
  CDS (1)..(1002): transl_table=11

SEQ ID NO: 40928 - protein, 333 aa, Synechocystis sp. PCC 6803; identical to SEQ ID NO: 15013

SEQ ID NO: 40929 - DNA, 1152 bp, Synechocystis sp. PCC 6803; identical to SEQ ID NO: 15014
  CDS (1)..(1152): transl_table=11

SEQ ID NO: 40930 - protein, 383 aa, Synechocystis sp. PCC 6803; identical to SEQ ID NO: 15015

SEQ ID NO: 40931 - DNA, 1041 bp, Salmonella typhimurium LT2; identical to SEQ ID NO: 15016
  CDS (1)..(1041): transl_table=11

SEQ ID NO: 40932 - protein, 346 aa, Salmonella typhimurium LT2; identical to SEQ ID NO: 15017

SEQ ID NO: 40933 - DNA, 909 bp, Listeria innocua Clip11262; identical to SEQ ID NO: 15018
  CDS (1)..(909): transl_table=11

SEQ ID NO: 40934 - protein, 302 aa, Listeria innocua Clip11262; identical to SEQ ID NO: 15019

SEQ ID NO: 40935 - DNA, 1179 bp, Nostoc sp. PCC 7120; identical to SEQ ID NO: 15020
  CDS (1)..(1179): transl_table=11

SEQ ID NO: 40936 - protein, 392 aa, Nostoc sp. PCC 7120; identical to SEQ ID NO: 15021

SEQ ID NO: 40937 - DNA, 1032 bp, Ralstonia solanacearum GMI1000; identical to SEQ ID NO: 15022
  CDS (1)..(1032): transl_table=11

SEQ ID NO: 40938 - protein, 343 aa, Ralstonia solanacearum GMI1000; identical to SEQ ID NO: 15023

SEQ ID NO: 40939 - DNA, 1062 bp, Ralstonia solanacearum GMI1000; identical to SEQ ID NO: 15024
  CDS (1)..(1062): transl_table=11

SEQ ID NO: 40940 - protein, 353 aa, Ralstonia solanacearum GMI1000; identical to SEQ ID NO: 15025

SEQ ID NO: 40941 - DNA, 1233 bp, Pyrobaculum aerophilum str. IM2; identical to SEQ ID NO: 15026
  CDS (1)..(1233): transl_table=11

SEQ ID NO: 40942 - protein, 410 aa, Pyrobaculum aerophilum str. IM2; identical to SEQ ID NO: 15027

SEQ ID NO: 40943 - DNA, 819 bp, Clostridium perfringens str. 13; identical to SEQ ID NO: 15028
  CDS (1)..(819): transl_table=11

SEQ ID NO: 40944 - protein, 272 aa, Clostridium perfringens str. 13; identical to SEQ ID NO: 15029

SEQ ID NO: 40945 - DNA, 1128 bp, Pyrococcus furiosus DSM 3638; identical to SEQ ID NO: 15030
  CDS (1)..(1128): transl_table=11

SEQ ID NO: 40946 - protein, 375 aa, Pyrococcus furiosus DSM 3638; identical to SEQ ID NO: 15031

SEQ ID NO: 40947 - DNA, 1128 bp, Corynebacterium glutamicum ATCC 13032; identical to SEQ ID NO: 15032
  CDS (1)..(1128): transl_table=11

SEQ ID NO: 40948 - protein, 375 aa, Corynebacterium glutamicum ATCC 13032; identical to SEQ ID NO: 15033

SEQ ID NO: 40949 - DNA, 990 bp, Methanopyrus kandleri AV19; identical to SEQ ID NO: 15034
  CDS (1)..(990): transl_table=11

SEQ ID NO: 40950 - protein, 329 aa, Methanopyrus kandleri AV19; identical to SEQ ID NO: 15035

SEQ ID NO: 40951 - DNA, 999 bp, Methanosarcina acetivorans C2A; identical to SEQ ID NO: 15036
  CDS (1)..(999): transl_table=11

SEQ ID NO: 40952 - protein, 332 aa, Methanosarcina acetivorans C2A; identical to SEQ ID NO: 15037

SEQ ID NO: 40953 - DNA, 1475 bp, Streptomyces coelicolor A3(2); identical to SEQ ID NO: 15038
  CDS (363)..(1475)

SEQ ID NO: 40954 - protein, 370 aa, Streptomyces coelicolor A3(2); identical to SEQ ID NO: 15039

SEQ ID NO: 40955 - DNA, 909 bp, Methanosarcina mazei Go1; identical to SEQ ID NO: 15040
  CDS (1)..(909): transl_table=11

SEQ ID NO: 40956 - protein, 302 aa, Methanosarcina mazei Go1; identical to SEQ ID NO: 15041

SEQ ID NO: 40957 - DNA, 1092 bp, Xanthomonas campestris pv. campestris str. ATCC 33913; identical to SEQ ID NO: 15042
  CDS (1)..(1092): transl_table=11

SEQ ID NO: 40958 - protein, 363 aa, Xanthomonas campestris pv. campestris str. ATCC 33913; identical to SEQ ID NO: 15043

SEQ ID NO: 40959 - DNA, 1092 bp, Xanthomonas axonopodis pv. citri str. 306; identical to SEQ ID NO: 15044
  CDS (1)..(1092): transl_table=11

SEQ ID NO: 40960 - protein, 363 aa, Xanthomonas axonopodis pv. citri str. 306; identical to SEQ ID NO: 15045

SEQ ID NO: 40961 - DNA, 1020 bp, Xanthomonas axonopodis pv. citri str. 306; identical to SEQ ID NO: 15046
  CDS (1)..(1020): transl_table=11

SEQ ID NO: 40962 - protein, 339 aa, Xanthomonas axonopodis pv. citri str. 306; identical to SEQ ID NO: 15047

SEQ ID NO: 40963 - DNA, 1041 bp, Yersinia pestis KIM; identical to SEQ ID NO: 15048
  CDS (1)..(1041): transl_table=11

SEQ ID NO: 40964 - protein, 346 aa, Yersinia pestis KIM; identical to SEQ ID NO: 15049

SEQ ID NO: 40965 - DNA, 1134 bp, Bifidobacterium longum NCC2705; identical to SEQ ID NO: 15050
  CDS (1)..(1134): transl_table=11

SEQ ID NO: 40966 - protein, 377 aa, Bifidobacterium longum NCC2705; identical to SEQ ID NO: 15051

SEQ ID NO: 40967 - DNA, 864 bp, Streptococcus mutans UA159; identical to SEQ ID NO: 15052
  CDS (1)..(864): transl_table=11

SEQ ID NO: 40968 - protein, 287 aa, Streptococcus mutans UA159; identical to SEQ ID NO: 15053

SEQ ID NO: 40969 - DNA, 1122 bp, Corynebacterium efficiens YS-314; identical to SEQ ID NO: 15054
  CDS (1)..(1122): transl_table=11

SEQ ID NO: 40970 - protein, 373 aa, Corynebacterium efficiens YS-314; identical to SEQ ID NO: 15055

SEQ ID NO: 40971 - DNA, 822 bp, Vibrio vulnificus CMCP6; identical to SEQ ID NO: 15056
  CDS (1)..(822): transl_table=11

SEQ ID NO: 40972 - protein, 273 aa, Vibrio vulnificus CMCP6; identical to SEQ ID NO: 15057

SEQ ID NO: 40973 - DNA, 1026 bp, Bradyrhizobium japonicum USDA 110; identical to SEQ ID NO: 15058
  CDS (1)..(1026)

SEQ ID NO: 40974 - protein, 341 aa, Bradyrhizobium japonicum USDA 110; identical to SEQ ID NO: 15059

SEQ ID NO: 40975 - DNA, 888 bp, Clostridium tetani E88; identical to SEQ ID NO: 15060
  CDS (1)..(888): transl_table=11

SEQ ID NO: 40976 - protein, 295 aa, Clostridium tetani E88; identical to SEQ ID NO: 15061

SEQ ID NO: 40977 - DNA, 876 bp, Lactobacillus plantarum WCFS1; identical to SEQ ID NO: 15062
  CDS (1)..(876): transl_table=11

SEQ ID NO: 40978 - protein, 291 aa, Lactobacillus plantarum WCFS1; identical to SEQ ID NO: 15063

SEQ ID NO: 40979 - DNA, 1071 bp, Tropheryma whipplei str. Twist; identical to SEQ ID NO: 15064
  CDS (1)..(1071): transl_table=11

SEQ ID NO: 40980 - protein, 356 aa, Tropheryma whipplei str. Twist; identical to SEQ ID NO: 15065

SEQ ID NO: 40981 - DNA, 1071 bp, Tropheryma whipplei TW08/27; identical to SEQ ID NO: 15066
  CDS (1)..(1071): transl_table=11

SEQ ID NO: 40982 - protein, 356 aa, Tropheryma whipplei TW08/27; identical to SEQ ID NO: 15067

SEQ ID NO: 40983 - DNA, 1026 bp, Pseudomonas syringae pv. tomato str. DC3000; identical to SEQ ID NO: 15068
  CDS (1)..(1026): transl_table=11

SEQ ID NO: 40984 - protein, 341 aa, Pseudomonas syringae pv. tomato str. DC3000; identical to SEQ ID NO: 15069

SEQ ID NO: 40985 - DNA, 828 bp, Vibrio parahaemolyticus RIMD 2210633; identical to SEQ ID NO: 15070
  CDS (1)..(828): transl_table=11

SEQ ID NO: 40986 - protein, 275 aa, Vibrio parahaemolyticus RIMD 2210633; identical to SEQ ID NO: 15071

SEQ ID NO: 40987 - DNA, 822 bp, Vibrio parahaemolyticus RIMD 2210633; identical to SEQ ID NO: 15072
  CDS (1)..(822): transl_table=11

SEQ ID NO: 40988 - protein, 273 aa, Vibrio parahaemolyticus RIMD 2210633; identical to SEQ ID NO: 15073

SEQ ID NO: 40989 - DNA, 1110 bp, Bacteroides thetaiotaomicron VPI-5482; identical to SEQ ID NO: 15074
  CDS (1)..(1110): transl_table=11

SEQ ID NO: 40990 - protein, 369 aa, Bacteroides thetaiotaomicron VPI-5482; identical to SEQ ID NO: 15075

SEQ ID NO: 40991 - DNA, 1107 bp, Streptomyces avermitilis MA-4680; identical to SEQ ID NO: 15076
  CDS (1)..(1107)

SEQ ID NO: 40992 - protein, 368 aa, Streptomyces avermitilis MA-4680; identical to SEQ ID NO: 15077

SEQ ID NO: 40993 - DNA, 1113 bp, Mycobacterium bovis AF2122/97; identical to SEQ ID NO: 15078
  CDS (1)..(1113): transl_table=11

SEQ ID NO: 40994 - protein, 370 aa, Mycobacterium bovis AF2122/97; identical to SEQ ID NO: 15079

SEQ ID NO: 40995 - DNA, 1125 bp, Mycobacterium bovis AF2122/97; identical to SEQ ID NO: 15080
  CDS (1)..(1125): transl_table=11

SEQ ID NO: 40996 - protein, 374 aa, Mycobacterium bovis AF2122/97; identical to SEQ ID NO: 15081

SEQ ID NO: 40997 - DNA, 993 bp, Prochlorococcus marinus subsp. marinus str. CCMP1375; identical to SEQ ID NO: 15082
  CDS (1)..(993): transl_table=11

SEQ ID NO: 40998 - protein, 330 aa, Prochlorococcus marinus subsp. marinus str. CCMP1375; identical to SEQ ID NO: 15083

SEQ ID NO: 40999 - DNA, 1041 bp, Bordetella pertussis Tohama I; identical to SEQ ID NO: 15084
  CDS (1)..(1041): transl_table=11

SEQ ID NO: 41000 - protein, 346 aa, Bordetella pertussis Tohama I; identical to SEQ ID NO: 15085

SEQ ID NO: 41001 - DNA, 1041 bp, Bordetella bronchiseptica RB50; identical to SEQ ID NO: 15086
  CDS (1)..(1041)

SEQ ID NO: 41002 - protein, 346 aa, Bordetella bronchiseptica RB50; identical to SEQ ID NO: 15087

SEQ ID NO: 41003 - DNA, 972 bp, Prochlorococcus marinus subsp. pastoris str. CCMP1986; identical to SEQ ID NO: 15088
  CDS (1)..(972): transl_table=11

SEQ ID NO: 41004 - protein, 323 aa, Prochlorococcus marinus subsp. pastoris str. CCMP1986; identical to SEQ ID NO: 15089

SEQ ID NO: 41005 - DNA, 1011 bp, Synechococcus sp. WH 8102; identical to SEQ ID NO: 15090
  CDS (1)..(1011): transl_table=11

SEQ ID NO: 41006 - protein, 336 aa, Synechococcus sp. WH 8102; identical to SEQ ID NO: 15091

SEQ ID NO: 41007 - DNA, 1038 bp, Chromobacterium violaceum ATCC 12472; identical to SEQ ID NO: 15092
  CDS (1)..(1038): transl_table=11

SEQ ID NO: 41008 - protein, 345 aa, Chromobacterium violaceum ATCC 12472; identical to SEQ ID NO: 15093

SEQ ID NO: 41009 - DNA, 840 bp, Wolinella succinogenes DSM 1740; identical to SEQ ID NO: 15094
  CDS (1)..(840): transl_table=11

SEQ ID NO: 41010 - protein, 279 aa, Wolinella succinogenes DSM 1740; identical to SEQ ID NO: 15095

SEQ ID NO: 41011 - DNA, 927 bp, Wolinella succinogenes DSM 1740; identical to SEQ ID NO: 15096
  CDS (1)..(927): transl_table=11

SEQ ID NO: 41012 - protein, 308 aa, Wolinella succinogenes DSM 1740; identical to SEQ ID NO: 15097

SEQ ID NO: 41013 - DNA, 1014 bp, Gloeobacter violaceus PCC 7421; identical to SEQ ID NO: 15098
  CDS (1)..(1014): transl_table=11

SEQ ID NO: 41014 - protein, 337 aa, Gloeobacter violaceus PCC 7421; identical to SEQ ID NO: 15099

SEQ ID NO: 41015 - DNA, 1017 bp, Gloeobacter violaceus PCC 7421; identical to SEQ ID NO: 15100
  CDS (1)..(1017): transl_table=11

SEQ ID NO: 41016 - protein, 338 aa, Gloeobacter violaceus PCC 7421; identical to SEQ ID NO: 15101

SEQ ID NO: 41017 - DNA, 1044 bp, Gloeobacter violaceus PCC 7421; identical to SEQ ID NO: 15102
  CDS (1)..(1044): transl_table=11

SEQ ID NO: 41018 - protein, 347 aa, Gloeobacter violaceus PCC 7421; identical to SEQ ID NO: 15103

SEQ ID NO: 41019 - DNA, 1050 bp, Gloeobacter violaceus PCC 7421; identical to SEQ ID NO: 15104
  CDS (1)..(1050): transl_table=11

SEQ ID NO: 41020 - protein, 349 aa, Gloeobacter violaceus PCC 7421; identical to SEQ ID NO: 15105

SEQ ID NO: 41021 - DNA, 1041 bp, Photorhabdus luminescens subsp. laumondii TTO1; identical to SEQ ID NO: 15106
  CDS (1)..(1041): transl_table=11

SEQ ID NO: 41022 - protein, 346 aa, Photorhabdus luminescens subsp. laumondii TTO1; identical to SEQ ID NO: 15107

SEQ ID NO: 41023 - DNA, 825 bp, Vibrio vulnificus YJ016; identical to SEQ ID NO: 15108
  CDS (1)..(825): transl_table=11

SEQ ID NO: 41024 - protein, 274 aa, Vibrio vulnificus YJ016; identical to SEQ ID NO: 15109

SEQ ID NO: 41025 - DNA, 1086 bp, Corynebacterium diphtheriae NCTC 13129; identical to SEQ ID NO: 15110
  CDS (1)..(1086): transl_table=11

SEQ ID NO: 41026 - protein, 361 aa, Corynebacterium diphtheriae NCTC 13129; identical to SEQ ID NO: 15111

SEQ ID NO: 41027 - DNA, 1005 bp, Rhodopseudomonas palustris CGA009; identical to SEQ ID NO: 15112
  CDS (1)..(1005): transl_table=11

SEQ ID NO: 41028 - protein, 334 aa, Rhodopseudomonas palustris CGA009; identical to SEQ ID NO: 15113

SEQ ID NO: 41029 - DNA, 1011 bp, Rhodopseudomonas palustris CGA009; identical to SEQ ID NO: 15114
  CDS (1)..(1011): transl_table=11

SEQ ID NO: 41030 - protein, 336 aa, Rhodopseudomonas palustris CGA009; identical to SEQ ID NO: 15115

SEQ ID NO: 41031 - DNA, 1029 bp, Geobacter sulfurreducens PCA; identical to SEQ ID NO: 15116
  CDS (1)..(1029): transl_table=11

SEQ ID NO: 41032 - protein, 342 aa, Geobacter sulfurreducens PCA; identical to SEQ ID NO: 15117

SEQ ID NO: 41033 - DNA, 1137 bp, Mycobacterium avium subsp. paratuberculosis str. k10; identical to SEQ ID NO: 15118
  CDS (1)..(1137): transl_table=11

SEQ ID NO: 41034 - protein, 378 aa, Mycobacterium avium subsp. paratuberculosis str. k10; identical to SEQ ID NO: 15119

SEQ ID NO: 41035 - DNA, 879 bp, Desulfovibrio vulgaris subsp. vulgaris str. Hildenborough; identical to SEQ ID NO: 15120
  CDS (1)..(879): transl_table=11

SEQ ID NO: 41036 - protein, 292 aa, Desulfovibrio vulgaris subsp. vulgaris str. Hildenborough; identical to SEQ ID NO: 15121

SEQ ID NO: 41037 - DNA, 1041 bp, Erwinia carotovora subsp. atroseptica SCRI1043; identical to SEQ ID NO: 15122
  CDS (1)..(1041)

SEQ ID NO: 41038 - protein, 346 aa, Erwinia carotovora subsp. atroseptica SCRI1043; identical to SEQ ID NO: 15123

SEQ ID NO: 41039 - DNA, 1152 bp, Propionibacterium acnes KPA171202; identical to SEQ ID NO: 15124
  CDS (1)..(1152): transl_table=11

SEQ ID NO: 41040 - protein, 383 aa, Propionibacterium acnes KPA171202; identical to SEQ ID NO: 15125

SEQ ID NO: 41041 - DNA, 867 bp, Streptococcus pyogenes MGAS10394; identical to SEQ ID NO: 15126
  CDS (1)..(867): transl_table=11

SEQ ID NO: 41042 - protein, 288 aa, Streptococcus pyogenes MGAS10394; identical to SEQ ID NO: 15127

SEQ ID NO: 41043 - DNA, 1095 bp, Leifsonia xyli subsp. xyli str. CTCB07; identical to SEQ ID NO: 15128
  CDS (1)..(1095): transl_table=11

SEQ ID NO: 41044 - protein, 364 aa, Leifsonia xyli subsp. xyli str. CTCB07; identical to SEQ ID NO: 15129

SEQ ID NO: 41045 - DNA, 855 bp, Symbiobacterium thermophilum IAM 14863; identical to SEQ ID NO: 15130
  CDS (1)..(855): transl_table=11

SEQ ID NO: 41046 - protein, 284 aa, Symbiobacterium thermophilum IAM 14863; identical to SEQ ID NO: 15131

SEQ ID NO: 41047 - DNA, 918 bp, Bacillus licheniformis ATCC 14580; identical to SEQ ID NO: 15132
  CDS (1)..(918): transl_table=11

SEQ ID NO: 41048 - protein, 305 aa, Bacillus licheniformis ATCC 14580; identical to SEQ ID NO: 15133

SEQ ID NO: 41049 - DNA, 1113 bp, Nocardia farcinica IFM 10152; identical to SEQ ID NO: 15134
  CDS (1)..(1113): transl_table=11

SEQ ID NO: 41050 - protein, 370 aa, Nocardia farcinica IFM 10152; identical to SEQ ID NO: 15135

SEQ ID NO: 41051 - DNA, 825 bp, Photobacterium profundum SS9; identical to SEQ ID NO: 15136
  CDS (1)..(825): transl_table=11

SEQ ID NO: 41052 - protein, 274 aa, Photobacterium profundum SS9; identical to SEQ ID NO: 15137

SEQ ID NO: 41053 - DNA, 858 bp, Photobacterium profundum SS9; identical to SEQ ID NO: 15138
  CDS (1)..(858): transl_table=11

SEQ ID NO: 41054 - protein, 285 aa, Photobacterium profundum SS9; identical to SEQ ID NO: 15139

SEQ ID NO: 41055 - DNA, 4956 bp, Acanthamoeba polyphaga mimivirus; identical to SEQ ID NO: 15140
  CDS (1)..(4956)

SEQ ID NO: 41056 - protein, 1651 aa, Acanthamoeba polyphaga mimivirus; identical to SEQ ID NO: 15141

SEQ ID NO: 41057 - DNA, 4974 bp, Acanthamoeba polyphaga mimivirus; identical to SEQ ID NO: 15142
  CDS (1)..(4974)

SEQ ID NO: 41058 - protein, 1657 aa, Acanthamoeba polyphaga mimivirus; identical to SEQ ID NO: 15143

SEQ ID NO: 41059 - DNA, 4875 bp, Acanthamoeba polyphaga mimivirus; identical to SEQ ID NO: 15144
  CDS (1)..(4875)

SEQ ID NO: 41060 - protein, 1624 aa, Acanthamoeba polyphaga mimivirus; identical to SEQ ID NO: 15145

SEQ ID NO: 41061 - DNA, 891 bp, Geobacillus kaustophilus HTA426; identical to SEQ ID NO: 15146
  CDS (1)..(891): transl_table=11

SEQ ID NO: 41062 - protein, 296 aa, Geobacillus kaustophilus HTA426; identical to SEQ ID NO: 15147

SEQ ID NO: 41063 - DNA, 1041 bp, Salmonella enterica subsp. enterica serovar Paratyphi A str. ATCC; identical to SEQ ID NO: 15148
  CDS (1)..(1041): transl_table=11

SEQ ID NO: 41064 - protein, 346 aa, Salmonella enterica subsp. enterica serovar Paratyphi A str. ATCC; identical to SEQ ID NO: 15149

SEQ ID NO: 41065 - DNA, 1041 bp, Zymomonas mobilis subsp. mobilis ZM4; identical to SEQ ID NO: 15150
  CDS (1)..(1041): transl_table=11

SEQ ID NO: 41066 - protein, 346 aa, Zymomonas mobilis subsp. mobilis ZM4; identical to SEQ ID NO: 15151

SEQ ID NO: 41067 - DNA, 921 bp, Bacillus clausii KSM-K16; identical to SEQ ID NO: 15152
  CDS (1)..(921): transl_table=11

SEQ ID NO: 41068 - protein, 306 aa, Bacillus clausii KSM-K16; identical to SEQ ID NO: 15153

SEQ ID NO: 41069 - DNA, 1152 bp, Thermococcus kodakarensis KOD1; identical to SEQ ID NO: 15154
  CDS (1)..(1152): transl_table=11

SEQ ID NO: 41070 - protein, 383 aa, Thermococcus kodakarensis KOD1; identical to SEQ ID NO: 15155

SEQ ID NO: 41071 - DNA, 984 bp, Staphylococcus aureus subsp. aureus COL; identical to SEQ ID NO: 15156
  CDS (1)..(984): transl_table=11

SEQ ID NO: 41072 - protein, 327 aa, Staphylococcus aureus subsp. aureus COL; identical to SEQ ID NO: 15157

SEQ ID NO: 41073 - DNA, 978 bp, Staphylococcus epidermidis RP62A; identical to SEQ ID NO: 15158
  CDS (1)..(978): transl_table=11

SEQ ID NO: 41074 - protein, 325 aa, Staphylococcus epidermidis RP62A; identical to SEQ ID NO: 15159

SEQ ID NO: 41075 - DNA, 990 bp, Gluconobacter oxydans 621H; identical to SEQ ID NO: 15160
  CDS (1)..(990): transl_table=11

SEQ ID NO: 41076 - protein, 329 aa, Gluconobacter oxydans 621H; identical to SEQ ID NO: 15161

SEQ ID NO: 41077 - DNA, 1029 bp, Gluconobacter oxydans 621H; identical to SEQ ID NO: 15162
  CDS (1)..(1029): transl_table=11

SEQ ID NO: 41078 - protein, 342 aa, Gluconobacter oxydans 621H; identical to SEQ ID NO: 15163

SEQ ID NO: 41079 - DNA, 1119 bp, Xanthomonas oryzae pv. oryzae KACC10331; identical to SEQ ID NO: 15164
  CDS (1)..(1119): transl_table=11

SEQ ID NO: 41080 - protein, 372 aa, Xanthomonas oryzae pv. oryzae KACC10331; identical to SEQ ID NO: 15165

SEQ ID NO: 41081 - DNA, 1137 bp, Xanthomonas oryzae pv. oryzae KACC10331; identical to SEQ ID NO: 15166
  CDS (1)..(1137): transl_table=11

SEQ ID NO: 41082 - protein, 378 aa, Xanthomonas oryzae pv. oryzae KACC10331; identical to SEQ ID NO: 15167

SEQ ID NO: 41083 - DNA, 813 bp, Vibrio fischeri ES114; identical to SEQ ID NO: 15168
  CDS (1)..(813): transl_table=11

SEQ ID NO: 41084 - protein, 270 aa, Vibrio fischeri ES114; identical to SEQ ID NO: 15169

SEQ ID NO: 41085 - DNA, 852 bp, Bacteroides fragilis NCTC 9343; identical to SEQ ID NO: 15170
  CDS (1)..(852): transl_table=11

SEQ ID NO: 41086 - protein, 283 aa, Bacteroides fragilis NCTC 9343; identical to SEQ ID NO: 15171

SEQ ID NO: 41087 - DNA, 966 bp, Cyanophage P-SSM4; identical to SEQ ID NO: 15172
  CDS (1)..(966): transl_table=11

SEQ ID NO: 41088 - protein, 321 aa, Cyanophage P-SSM4; identical to SEQ ID NO: 15173

SEQ ID NO: 41089 - DNA, 1041 bp, Salmonella enterica subsp. enterica serovar Choleraesuis str; identical to SEQ ID NO: 15174
  CDS (1)..(1041): transl_table=11

SEQ ID NO: 41090 - protein, 346 aa, Salmonella enterica subsp. enterica serovar Choleraesuis str; identical to SEQ ID NO: 15175

SEQ ID NO: 41091 - DNA, 747 bp, Leptospirillum ferrooxidans; identical to SEQ ID NO: 15176
  CDS (1)..(747): transl_table=11

SEQ ID NO: 41092 - protein, 248 aa, Leptospirillum ferrooxidans; identical to SEQ ID NO: 15177

SEQ ID NO: 41093 - DNA, 1104 bp, Corynebacterium jeikeium K411; identical to SEQ ID NO: 15178
  CDS (1)..(1104): transl_table=11

SEQ ID NO: 41094 - protein, 367 aa, Corynebacterium jeikeium K411; identical to SEQ ID NO: 15179

SEQ ID NO: 41095 - DNA, 1095 bp, Xylella fastidiosa Ann-1; identical to SEQ ID NO: 15180
  CDS (1)..(1095)

SEQ ID NO: 41096 - protein, 364 aa, Xylella fastidiosa Ann-1; identical to SEQ ID NO: 15181

SEQ ID NO: 41097 - DNA, 1044 bp, Nostoc punctiforme PCC 73102; identical to SEQ ID NO: 15182
  CDS (1)..(1044)

SEQ ID NO: 41098 - protein, 347 aa, Nostoc punctiforme PCC 73102; identical to SEQ ID NO: 15183

SEQ ID NO: 41099 - DNA, 801 bp, Bifidobacterium longum DJO10A; identical to SEQ ID NO: 15184
  CDS (1)..(801): n means a or g or c or t/u, s means g or c

SEQ ID NO: 41100 - protein, 266 aa, Bifidobacterium longum DJO10A; identical to SEQ ID NO: 15185
  Xaa in positions 229-245 is unknown

SEQ ID NO: 41101 - DNA, 996 bp, Pseudomonas syringae pv. syringae B728a; identical to SEQ ID NO: 15186
  CDS (1)..(996)

SEQ ID NO: 41102 - protein, 331 aa, Pseudomonas syringae pv. syringae B728a; identical to SEQ ID NO: 15187

SEQ ID NO: 41103 - DNA, 810 bp, Desulfovibrio desulfuricans G20; identical to SEQ ID NO: 15188
  CDS (1)..(810)

SEQ ID NO: 41104 - protein, 269 aa, Desulfovibrio desulfuricans G20; identical to SEQ ID NO: 15189

SEQ ID NO: 41105 - DNA, 1044 bp, Actinobacillus pleuropneumoniae serovar 1 str. 4074; identical to SEQ ID NO: 15190
  CDS (1)..(1044)

SEQ ID NO: 41106 - protein, 347 aa, Actinobacillus pleuropneumoniae serovar 1 str. 4074; identical to SEQ ID NO: 15191

SEQ ID NO: 41107 - DNA, 1179 bp, Pseudomonas aeruginosa UCBPP-PA14; identical to SEQ ID NO: 15192
  CDS (1)..(1179)

SEQ ID NO: 41108 - protein, 392 aa, Pseudomonas aeruginosa UCBPP-PA14; identical to SEQ ID NO: 15193

SEQ ID NO: 41109 - DNA, 1155 bp, Psychrobacter sp. 273-4; identical to SEQ ID NO: 15194
  CDS (1)..(1155)

SEQ ID NO: 41110 - protein, 384 aa, Psychrobacter sp. 273-4; identical to SEQ ID NO: 15195

SEQ ID NO: 41111 - DNA, 975 bp, Dechloromonas aromatica RCB; identical to SEQ ID NO: 15196
  CDS (1)..(975)

SEQ ID NO: 41112 - protein, 324 aa, Dechloromonas aromatica RCB; identical to SEQ ID NO: 15197

SEQ ID NO: 41113 - DNA, 1014 bp, Haemophilus influenzae R2846; identical to SEQ ID NO: 15198
  CDS (1)..(1014)

SEQ ID NO: 41114 - protein, 337 aa, Haemophilus influenzae R2846; identical to SEQ ID NO: 15199

SEQ ID NO: 41115 - DNA, 1182 bp, Anabaena variabilis ATCC 29413; identical to SEQ ID NO: 15200
  CDS (1)..(1182)

SEQ ID NO: 41116 - protein, 393 aa, Anabaena variabilis ATCC 29413; identical to SEQ ID NO: 15201

SEQ ID NO: 41117 - DNA, 1044 bp, Anabaena variabilis ATCC 29413; identical to SEQ ID NO: 15202
  CDS (1)..(1044)

SEQ ID NO: 41118 - protein, 347 aa, Anabaena variabilis ATCC 29413; identical to SEQ ID NO: 15203

SEQ ID NO: 41119 - DNA, 1032 bp, Ralstonia eutropha JMP134; identical to SEQ ID NO: 15204
  CDS (1)..(1032)

SEQ ID NO: 41120 - protein, 343 aa, Ralstonia eutropha JMP134; identical to SEQ ID NO: 15205

SEQ ID NO: 41121 - DNA, 1026 bp, Burkholderia cepacia R18194; identical to SEQ ID NO: 15206
  CDS (1)..(1026)

SEQ ID NO: 41122 - protein, 341 aa, Burkholderia cepacia R18194; identical to SEQ ID NO: 15207

SEQ ID NO: 41123 - DNA, 915 bp, Burkholderia cepacia R18194; identical to SEQ ID NO: 15208
  CDS (1)..(915)

SEQ ID NO: 41124 - protein, 304 aa, Burkholderia cepacia R18194; identical to SEQ ID NO: 15209

SEQ ID NO: 41125 - DNA, 1041 bp, Rubrivivax gelatinosus PM1; identical to SEQ ID NO: 15210
  CDS (1)..(1041)

SEQ ID NO: 41126 - protein, 346 aa, Rubrivivax gelatinosus PM1; identical to SEQ ID NO: 15211

SEQ ID NO: 41127 - DNA, 1110 bp, Pseudomonas fluorescens PfO-1; identical to SEQ ID NO: 15212
  CDS (1)..(1110)

SEQ ID NO: 41128 - protein, 369 aa, Pseudomonas fluorescens PfO-1; identical to SEQ ID NO: 15213

SEQ ID NO: 41129 - DNA, 1014 bp, Burkholderia fungorum LB400; identical to SEQ ID NO: 15214
  CDS (1)..(1014)

SEQ ID NO: 41130 - protein, 337 aa, Burkholderia fungorum LB400; identical to SEQ ID NO: 15215

SEQ ID NO: 41131 - DNA, 1026 bp, Burkholderia fungorum LB400; identical to SEQ ID NO: 15216
  CDS (1)..(1026)

SEQ ID NO: 41132 - protein, 341 aa, Burkholderia fungorum LB400; identical to SEQ ID NO: 15217

SEQ ID NO: 41133 - DNA, 1032 bp, Burkholderia fungorum LB400; identical to SEQ ID NO: 15218
  CDS (1)..(1032)

SEQ ID NO: 41134 - protein, 343 aa, Burkholderia fungorum LB400; identical to SEQ ID NO: 15219

SEQ ID NO: 41135 - DNA, 1119 bp, Thermobifida fusca; identical to SEQ ID NO: 15220
  CDS (1)..(1119)

SEQ ID NO: 41136 - protein, 372 aa, Thermobifida fusca; identical to SEQ ID NO: 15221

SEQ ID NO: 41137 - DNA, 1056 bp, Thermobifida fusca; identical to SEQ ID NO: 15222
  CDS (1)..(1056)

SEQ ID NO: 41138 - protein, 351 aa, Thermobifida fusca; identical to SEQ ID NO: 15223

SEQ ID NO: 41139 - DNA, 867 bp, Oenococcus oeni PSU-1; identical to SEQ ID NO: 15224
  CDS (1)..(867)

SEQ ID NO: 41140 - protein, 288 aa, Oenococcus oeni PSU-1; identical to SEQ ID NO: 15225

SEQ ID NO: 41141 - DNA, 1077 bp, Trichodesmium erythraeum IMS101; identical to SEQ ID NO: 15226
  CDS (1)..(1077)

SEQ ID NO: 41142 - protein, 358 aa, Trichodesmium erythraeum IMS101; identical to SEQ ID NO: 15227

SEQ ID NO: 41143 - DNA, 1086 bp, Trichodesmium erythraeum IMS101; identical to SEQ ID NO: 15228
  CDS (1)..(1086)

SEQ ID NO: 41144 - protein, 361 aa, Trichodesmium erythraeum IMS101; identical to SEQ ID NO: 15229

SEQ ID NO: 41145 - DNA, 870 bp, Streptococcus suis 89/1591; identical to SEQ ID NO: 15230
  CDS (1)..(870)

SEQ ID NO: 41146 - protein, 289 aa, Streptococcus suis 89/1591; identical to SEQ ID NO: 15231

SEQ ID NO: 41147 - DNA, 1026 bp, Thiobacillus denitrificans ATCC 25259; identical to SEQ ID NO: 15232
  CDS (1)..(1026)

SEQ ID NO: 41148 - protein, 341 aa, Thiobacillus denitrificans ATCC 25259; identical to SEQ ID NO: 15233

SEQ ID NO: 41149 - DNA, 1131 bp, Brevibacterium linens BL2; identical to SEQ ID NO: 15234
  CDS (1)..(1131)

SEQ ID NO: 41150 - protein, 376 aa, Brevibacterium linens BL2; identical to SEQ ID NO: 15235

SEQ ID NO: 41151 - DNA, 1023 bp, Deinococcus geothermalis DSM 11300; identical to SEQ ID NO: 15236
  CDS (1)..(1023): transl_table=11

SEQ ID NO: 41152 - protein, 340 aa, Deinococcus geothermalis DSM 11300; identical to SEQ ID NO: 15237

SEQ ID NO: 41153 - DNA, 819 bp, Anaeromyxobacter dehalogenans 2CP-C; identical to SEQ ID NO: 15238
  CDS (1)..(819): transl_table=11

SEQ ID NO: 41154 - protein, 272 aa, Anaeromyxobacter dehalogenans 2CP-C; identical to SEQ ID NO: 15239

SEQ ID NO: 41155 - DNA, 1122 bp, Arthrobacter sp. FB24; identical to SEQ ID NO: 15240
  CDS (1)..(1122): transl_table=11

SEQ ID NO: 41156 - protein, 373 aa, Arthrobacter sp. FB24; identical to SEQ ID NO: 15241

SEQ ID NO: 41157 - DNA, 1026 bp, Burkholderia vietnamiensis G4; identical to SEQ ID NO: 15242
  CDS (1)..(1026): transl_table=11

SEQ ID NO: 41158 - protein, 341 aa, Burkholderia vietnamiensis G4; identical to SEQ ID NO: 15243

SEQ ID NO: 41159 - DNA, 1335 bp, Burkholderia vietnamiensis G4; identical to SEQ ID NO: 15244
  CDS (1)..(1335): transl_table=11

SEQ ID NO: 41160 - protein, 444 aa, Burkholderia vietnamiensis G4; identical to SEQ ID NO: 15245

SEQ ID NO: 41161 - DNA, 1026 bp, Burkholderia cenocepacia AU 1054; identical to SEQ ID NO: 15246
  CDS (1)..(1026): transl_table=11

SEQ ID NO: 41162 - protein, 341 aa, Burkholderia cenocepacia AU 1054; identical to SEQ ID NO: 15247

SEQ ID NO: 41163 - DNA, 1044 bp, Polaromonas sp. JS666; identical to SEQ ID NO: 15248
  CDS (1)..(1044): transl_table=11

SEQ ID NO: 41164 - protein, 347 aa, Polaromonas sp. JS666; identical to SEQ ID NO: 15249

SEQ ID NO: 41165 - DNA, 1080 bp, Polaromonas sp. JS666; identical to SEQ ID NO: 15250
  CDS (1)..(1080): transl_table=11

SEQ ID NO: 41166 - protein, 359 aa, Polaromonas sp. JS666; identical to SEQ ID NO: 15251

SEQ ID NO: 41167 - DNA, 1149 bp, Crocosphaera watsonii WH 8501; identical to SEQ ID NO: 15252
  CDS (1)..(1149): transl_table=11

SEQ ID NO: 41168 - protein, 382 aa, Crocosphaera watsonii WH 8501; identical to SEQ ID NO: 15253

SEQ ID NO: 41169 - DNA, 1029 bp, Geobacter metallireducens GS-15; identical to SEQ ID NO: 15254
  CDS (1)..(1029): transl_table=11

SEQ ID NO: 41170 - protein, 342 aa, Geobacter metallireducens GS-15; identical to SEQ ID NO: 15255

SEQ ID NO: 41171 - DNA, 930 bp, Moorella thermoacetica ATCC 39073; identical to SEQ ID NO: 15256
  CDS (1)..(930): transl_table=11

SEQ ID NO: 41172 - protein, 309 aa, Moorella thermoacetica ATCC 39073; identical to SEQ ID NO: 15257

SEQ ID NO: 41173 - DNA, 873 bp, Pelodictyon phaeoclathratiforme BU-1; identical to SEQ ID NO: 15258
  CDS (1)..(873): transl_table=11

SEQ ID NO: 41174 - protein, 290 aa, Pelodictyon phaeoclathratiforme BU-1; identical to SEQ ID NO: 15259

SEQ ID NO: 41175 - DNA, 819 bp, Prosthecochloris aestuarii DSM 271; identical to SEQ ID NO: 15260
  CDS (1)..(819): transl_table=11

SEQ ID NO: 41176 - protein, 272 aa, Prosthecochloris aestuarii DSM 271; identical to SEQ ID NO: 15261

SEQ ID NO: 41177 - DNA, 1002 bp, Ralstonia metallidurans CH34; identical to SEQ ID NO: 15262
  CDS (1)..(1002): transl_table=11

SEQ ID NO: 41178 - protein, 333 aa, Ralstonia metallidurans CH34; identical to SEQ ID NO: 15263

SEQ ID NO: 41179 - DNA, 1032 bp, Ralstonia metallidurans CH34; identical to SEQ ID NO: 15264
  CDS (1)..(1032): transl_table=11

SEQ ID NO: 41180 - protein, 343 aa, Ralstonia metallidurans CH34; identical to SEQ ID NO: 15265

SEQ ID NO: 41181 - DNA, 1113 bp, Rubrobacter xylanophilus DSM 9941; identical to SEQ ID NO: 15266
  CDS (1)..(1113): transl_table=11

SEQ ID NO: 41182 - protein, 370 aa, Rubrobacter xylanophilus DSM 9941; identical to SEQ ID NO: 15267

SEQ ID NO: 41183 - DNA, 891 bp, Enterococcus faecium DO; identical to SEQ ID NO: 15268
  CDS (1)..(891): transl_table=11

SEQ ID NO: 41184 - protein, 296 aa, Enterococcus faecium DO; identical to SEQ ID NO: 15269

SEQ ID NO: 41185 - DNA, 1113 bp, Kineococcus radiotolerans SRS30216; identical to SEQ ID NO: 15270
  CDS (1)..(1113): transl_table=11

SEQ ID NO: 41186 - protein, 370 aa, Kineococcus radiotolerans SRS30216; identical to SEQ ID NO: 15271

SEQ ID NO: 41187 - DNA, 1026 bp, Nitrobacter hamburgensis X14; identical to SEQ ID NO: 15272
  CDS (1)..(1026): transl_table=11

SEQ ID NO: 41188 - protein, 341 aa, Nitrobacter hamburgensis X14; identical to SEQ ID NO: 15273

SEQ ID NO: 41189 - DNA, 873 bp, Burkholderia mallei FMH; identical to SEQ ID NO: 15274
  CDS (1)..(873)

SEQ ID NO: 41190 - protein, 290 aa, Burkholderia mallei FMH; identical to SEQ ID NO: 15275

SEQ ID NO: 41191 - DNA, 879 bp, Burkholderia mallei JHU; identical to SEQ ID NO: 15276
  CDS (1)..(879)

SEQ ID NO: 41192 - protein, 292 aa, Burkholderia mallei JHU; identical to SEQ ID NO: 15277

SEQ ID NO: 41193 - DNA, 1041 bp, Enterobacter cloacae; identical to SEQ ID NO: 15278
  CDS (1)..(1041): transl_table=11

SEQ ID NO: 41194 - protein, 346 aa, Enterobacter cloacae; identical to SEQ ID NO: 15279

SEQ ID NO: 41195 - DNA, 540 bp, Pectobacterium carotovorum; identical to SEQ ID NO: 15280
  CDS (1)..(540): transl_table=11

SEQ ID NO: 41196 - protein, 179 aa, Pectobacterium carotovorum; identical to SEQ ID NO: 15281

SEQ ID NO: 41197 - DNA, 996 bp, Prochlorococcus marinus; identical to SEQ ID NO: 15282
  CDS (1)..(996): transl_table=11

SEQ ID NO: 41198 - protein, 331 aa, Prochlorococcus marinus; identical to SEQ ID NO: 15283

SEQ ID NO: 41199 - DNA, 981 bp, Synechococcus sp; identical to SEQ ID NO: 15284
  CDS (1)..(981): transl_table=11

SEQ ID NO: 41200 - protein, 326 aa, Synechococcus sp; identical to SEQ ID NO: 15285

SEQ ID NO: 41201 - DNA, 1125 bp, Mycobacterium intracellulare; identical to SEQ ID NO: 15286
  CDS (1)..(1125): transl_table=11

SEQ ID NO: 41202 - protein, 374 aa, Mycobacterium intracellulare; identical to SEQ ID NO: 15287

SEQ ID NO: 41203 - DNA, 873 bp, Lactobacillus reuteri; identical to SEQ ID NO: 15288
  CDS (1)..(873): transl_table=11

SEQ ID NO: 41204 - protein, 290 aa, Lactobacillus reuteri; identical to SEQ ID NO: 15289

SEQ ID NO: 41205 - DNA, 1041 bp, Erwinia amylovora; identical to SEQ ID NO: 15290
  CDS (1)..(1041): transl_table=11

SEQ ID NO: 41206 - protein, 346 aa, Erwinia amylovora; identical to SEQ ID NO: 15291

SEQ ID NO: 41207 - DNA, 987 bp, Mycobacterium leprae; identical to SEQ ID NO: 15292
  CDS (1)..(987): transl_table=11

SEQ ID NO: 41208 - protein, 328 aa, Mycobacterium leprae; identical to SEQ ID NO: 15293

SEQ ID NO: 41209 - DNA, 765 bp, Escherichia coli; identical to SEQ ID NO: 15294
  CDS (1)..(765): transl_table=11

SEQ ID NO: 41210 - protein, 254 aa, Escherichia coli; identical to SEQ ID NO: 15295

SEQ ID NO: 41211 - DNA, 1020 bp, Xanthomonas oryzae; identical to SEQ ID NO: 15296
  CDS (1)..(1020): transl_table=11

SEQ ID NO: 41212 - protein, 339 aa, Xanthomonas oryzae; identical to SEQ ID NO: 15297

SEQ ID NO: 41213 - DNA, 1122 bp, Mycobacterium smegmatis; identical to SEQ ID NO: 15298
  CDS (1)..(1122): transl_table=11

SEQ ID NO: 41214 - protein, 373 aa, Mycobacterium smegmatis; identical to SEQ ID NO: 15299

SEQ ID NO: 41215 - DNA, 1113 bp, Mycobacterium tuberculosis; identical to SEQ ID NO: 15300
  CDS (1)..(1113): transl_table=11

SEQ ID NO: 41216 - protein, 370 aa, Mycobacterium tuberculosis; identical to SEQ ID NO: 15301

SEQ ID NO: 41217 - DNA, 1041 bp, Edwardsiella tarda; identical to SEQ ID NO: 15302
  CDS (1)..(1041): transl_table=11

SEQ ID NO: 41218 - protein, 346 aa, Edwardsiella tarda; identical to SEQ ID NO: 15303

SEQ ID NO: 41219 - DNA, 636 bp, Edwardsiella tarda; identical to SEQ ID NO: 15304
  CDS (1)..(636): transl_table=11

SEQ ID NO: 41220 - protein, 211 aa, Edwardsiella tarda; identical to SEQ ID NO: 15305

SEQ ID NO: 41221 - DNA, 945 bp, Edwardsiella tarda; identical to SEQ ID NO: 15306
  CDS (1)..(945): transl_table=11

SEQ ID NO: 41222 - protein, 314 aa, Edwardsiella tarda; identical to SEQ ID NO: 15307

SEQ ID NO: 41223 - DNA, 1137 bp, Streptomyces griseus subsp; identical to SEQ ID NO: 15308
  CDS (1)..(1137): transl_table=11

SEQ ID NO: 41224 - protein, 378 aa, Streptomyces griseus subsp; identical to SEQ ID NO: 15309

SEQ ID NO: 41225 - DNA, 1017 bp, Burkholderia sp; identical to SEQ ID NO: 15310
  CDS (1)..(1017): transl_table=11

SEQ ID NO: 41226 - protein, 338 aa, Burkholderia sp; identical to SEQ ID NO: 15311

SEQ ID NO: 41227 - DNA, 1107 bp, Pseudomonas aeruginosa; identical to SEQ ID NO: 15312
  CDS (1)..(1107): transl_table=11

SEQ ID NO: 41228 - protein, 368 aa, Pseudomonas aeruginosa; identical to SEQ ID NO: 15313

SEQ ID NO: 41229 - DNA, 1125 bp, Mycobacterium tuberculosis; identical to SEQ ID NO: 15314
  CDS (1)..(1125): transl_table=11

SEQ ID NO: 41230 - protein, 374 aa, Mycobacterium tuberculosis; identical to SEQ ID NO: 15315

SEQ ID NO: 41231 - DNA, 1113 bp, Mycobacterium tuberculosis; identical to SEQ ID NO: 15316
  CDS (1)..(1113): transl_table=11

SEQ ID NO: 41232 - protein, 370 aa, Mycobacterium tuberculosis; identical to SEQ ID NO: 15317

SEQ ID NO: 41233 - DNA, 1110 bp, Mycobacterium avium; identical to SEQ ID NO: 15318
  CDS (1)..(1110): transl_table=11

SEQ ID NO: 41234 - protein, 369 aa, Mycobacterium avium; identical to SEQ ID NO: 15319

SEQ ID NO: 41235 - DNA, 1113 bp, Mycobacterium bovis; identical to SEQ ID NO: 15320
  CDS (1)..(1113): transl_table=11

SEQ ID NO: 41236 - protein, 370 aa, Mycobacterium bovis; identical to SEQ ID NO: 15321

SEQ ID NO: 41237 - DNA, 1110 bp, Mycobacterium leprae; identical to SEQ ID NO: 15322
  CDS (1)..(1110): transl_table=11

SEQ ID NO: 41238 - protein, 369 aa, Mycobacterium leprae; identical to SEQ ID NO: 15323

SEQ ID NO: 41239 - DNA, 1170 bp, Methanococcus jannaschii; identical to SEQ ID NO: 15324
  CDS (1)..(1170): transl_table=11

SEQ ID NO: 41240 - protein, 389 aa, Methanococcus jannaschii; identical to SEQ ID NO: 15325

SEQ ID NO: 41241 - DNA, 1035 bp, Pasteurella multocida; identical to SEQ ID NO: 15326
  CDS (1)..(1035)

SEQ ID NO: 41242 - protein, 344 aa, Pasteurella multocida; identical to SEQ ID NO: 15327

SEQ ID NO: 41243 - DNA, 1056 bp, Rhizobium loti; identical to SEQ ID NO: 15328
  CDS (1)..(1056): transl_table=11

SEQ ID NO: 41244 - protein, 351 aa, Rhizobium loti; identical to SEQ ID NO: 15329

SEQ ID NO: 41245 - DNA, 1095 bp, Xylella fastidiosa; identical to SEQ ID NO: 15330
  CDS (1)..(1095): transl_table=11

SEQ ID NO: 41246 - protein, 364 aa, Xylella fastidiosa; identical to SEQ ID NO: 15331

SEQ ID NO: 41247 - DNA, 1095 bp, Xylella fastidiosa; identical to SEQ ID NO: 15332
  CDS (1)..(1095): transl_table=11

SEQ ID NO: 41248 - protein, 364 aa, Xylella fastidiosa; identical to SEQ ID NO: 15333

SEQ ID NO: 41249 - DNA, 903 bp, Bacillus subtilis; identical to SEQ ID NO: 15334
  CDS (1)..(903): transl_table=11

SEQ ID NO: 41250 - protein, 300 aa, Bacillus subtilis; identical to SEQ ID NO: 15335

SEQ ID NO: 41251 - DNA, 24 bp, Artificial sequence
  (1)..(24): primer
atgaaagttatgcgtaccaccgtc

SEQ ID NO: 41252 - DNA, 23 bp, Artificial sequence
  (1)..(23): primer
ttagtacagcggcttaccgctac

SEQ ID NO: 41253 - protein, 548 aa, Artificial sequence; identical to SEQ ID NO: 15338
  Variant (2)..(4): xaa in position 2 to 4 is any amino acid
  Variant (18)..(18): xaa in position 18 is any amino acid
  Variant (25)..(25): xaa in position 25 is any amino acid
  Variant (28)..(28): xaa in position 28 is any amino acid
  Variant (34)..(34): xaa in position 34 is any amino acid
  Variant (38)..(38): xaa in position 38 is any amino acid
  Variant (58)..(58): xaa in position 58 is any amino acid
  Variant (78)..(78): xaa in position 78 is any amino acid
  Variant (80)..(80): xaa in position 80 is any amino acid
  Variant (90)..(90): xaa in position 90 is any or no amino acid
  Variant (92)..(137): xaa in position 92 to 137 is any or no amino acid
  Variant (153)..(153): xaa in position 153 is any amino acid
  Variant (158)..(161): xaa in position 158 to 161 is any amino acid
  Variant (162)..(163): xaa in position 162 to 163 is any or no amino acid
  Variant (165)..(173): xaa in position 165 to 173 is any or no amino acid
  Variant (176)..(176): xaa in position 176 is any amino acid
  Variant (191)..(192): xaa in position 191 to 192 is any amino acid
  Variant (197)..(197): xaa in position 197 is any amino acid
  Variant (201)..(207): xaa in position 201 to 207 is any or no amino acid
  Variant (210)..(213): xaa in position 210 to 213 is any amino acid
  Variant (222)..(222): xaa in position 222 is any amino acid
  Variant (226)..(227): xaa in position 226 to 227 is any amino acid
  Variant (229)..(229): xaa in position 229 is any amino acid
  Variant (231)..(231): xaa in position 231 is any amino acid
  Variant (238)..(238): xaa in position 238 is any amino acid
  Variant (245)..(245): xaa in position 245 is any amino acid
  Variant (260)..(260): xaa in position 260 is any amino acid
  Variant (262)..(262): xaa in position 262 is any amino acid
  Variant (288)..(288): xaa in position 288 is any amino acid
  Variant (291)..(291): xaa in position 291 is any amino acid
  Variant (294)..(294): xaa in position 294 is any amino acid
  Variant (299)..(299): xaa in position 299 is any amino acid
  Variant (334)..(351): xaa in position 334 to 351 is any or no amino acid
  Variant (355)..(357): xaa in position 355 to 357 is any or no amino acid
  Variant (359)..(361): xaa in position 359 to 361 is any amino acid
  Variant (364)..(364): xaa in position 364 is any amino acid
  Variant (368)..(368): xaa in position 368 is any amino acid
  Variant (386)..(386): xaa in position 386 is any amino acid
  Variant (390)..(391): xaa in position 390 to 391 is any amino acid
  Variant (395)..(395): xaa in position 395 is any amino acid
  Variant (399)..(399): xaa in position 399 is any amino acid
  Variant (402)..(402): xaa in position 402 is any amino acid
  Variant (407)..(407): xaa in position 407 is any amino acid
  Variant (409)..(409): xaa in position 409 is any amino acid
  Variant (415)..(415): xaa in position 415 is any or no amino acid
  Variant (418)..(418): xaa in position 418 is any amino acid
  Variant (420)..(420): xaa in position 420 is any or no amino acid
  Variant (430)..(430): xaa in position 430 is any amino acid
  Variant (435)..(443): xaa in position 435 to 443 is any or no amino acid
  Variant (447)..(447): xaa in position 447 is any amino acid
  Variant (457)..(457): xaa in position 457 is any amino acid
  Variant (480)..(480): xaa in position 480 is any or no amino acid
  Variant (485)..(489): xaa in position 485 to 489 is any or no amino acid
  Variant (504)..(504): xaa in position 504 is any amino acid
  Variant (508)..(508): xaa in position 508 is any amino acid
  Variant (515)..(515): xaa in position 515 is any amino acid
  Variant (517)..(519): xaa in position 517 to 519 is any amino acid
  Variant (522)..(522): xaa in position 522 is any amino acid
  Variant (525)..(525): xaa in position 525 is any or no amino acid
  Variant (528)..(528): xaa in position 528 is any amino acid
  Variant (530)..(530): xaa in position 530 is any amino acid
  Variant (534)..(534): xaa in position 534 is any amino acid
  Variant (535)..(536): xaa in position 535 to 536 is any or no amino acid
  Variant (547)..(547): xaa in position 547 is any amino acid

SEQ ID NO: 41254 - protein, 51 aa, Artificial sequence; identical to SEQ ID NO: 15339
  Variant (2)..(30): xaa in position 2 to 30 is any amino acid
  Variant (31)..(31): xaa in position 31 is any or no amino acid
  Variant (34)..(35): xaa in position 34 to 35 is any or no amino acid
  Variant (37)..(38): xaa in position 37 to 38 is any amino acid
  Variant (39)..(39): xaa in position 39 is Ala, Glu, Asn, Gln or Ser
  Variant (40)..(46): xaa in position 40 to 46 is any amino acid
  Variant (47)..(47): xaa in position 47 is Phe, Ile, Leu or Val
  Variant (48)..(48): xaa in position 48 is Ala or Gly
  Variant (49)..(49): xaa in position 49 is any amino acid
  Variant (50)..(50): xaa in position 50 is Ala, Ser or Thr
  Variant (51)..(51): xaa in position 51 is Asp, Glu, Gly or Ser

SEQ ID NO: 41255 - protein, 28 aa, Artificial sequence
  Variant (2)..(10): xaa in position 2 to 10 is any amino acid
  Variant (11)..(12): xaa in position 11 to 12 is any or no amino acid
  Variant (14)..(17): xaa in position 14 to 17 is any amino acid
  Variant (19)..(21): xaa in position 19 to 21 is any amino acid
  Variant (24)..(24): xaa in position 24 is Ser or Thr
  Variant (25)..(27): xaa in position 25 to 27 is any amino acid
  Variant (28)..(28): xaa in position 28 is Phe or Trp
NXXXXXXXXXXXIXXXXRXXXSGXXXXX

SEQ ID NO: 41256 - DNA, 1113 bp, Saccharomyces cerevisiae; identical to SEQ ID NO: 1363
  CDS (1)..(1113)

SEQ ID NO: 41257 - protein, 370 aa, Saccharomyces cerevisiae; identical to SEQ ID NO: 1364

SEQ ID NO: 41258 - DNA, 1086 bp, Deinococcus radiodurans; identical to SEQ ID NO: 1327
  CDS (1)..(1086)

SEQ ID NO: 41259 - protein, 361 aa, Deinococcus radiodurans; identical to SEQ ID NO: 1328

SEQ ID NO: 41260 - DNA, 1071 bp, Salmonella enterica subsp. enterica serovar Typhi; identical to SEQ ID NO: 2245
  CDS (1)..(1071)

SEQ ID NO: 41261 - protein, 356 aa, Salmonella enterica subsp. enterica serovar Typhi; identical to SEQ ID NO: 2246

SEQ ID NO: 41262 - DNA, 1071 bp, Yersinia pestis; identical to SEQ ID NO: 2247
  CDS (1)..(1071)

SEQ ID NO: 41263 - protein, 356 aa, Yersinia pestis; identical to SEQ ID NO: 2248

SEQ ID NO: 41264 - DNA, 1047 bp, Yersinia pestis; identical to SEQ ID NO: 1331
  CDS (1)..(1047)

SEQ ID NO: 41265 - protein, 348 aa, Yersinia pestis; identical to SEQ ID NO: 1332

SEQ ID NO: 41266 - DNA, 1053 bp, Escherichia coli; identical to SEQ ID NO: 2251
  CDS (1)..(1053)

SEQ ID NO: 41267 - protein, 350 aa, Escherichia coli; identical to SEQ ID NO: 1580

SEQ ID NO: 41268 - DNA, 1071 bp, Escherichia coli; identical to SEQ ID NO: 1333
  CDS (1)..(1071)

SEQ ID NO: 41269 - protein, 356 aa, Escherichia coli; identical to SEQ ID NO: 1334

SEQ ID NO: 41270 - DNA, 1131 bp, Nostoc sp. PCC 7120; identical to SEQ ID NO: 1335
  CDS (1)..(1131)

SEQ ID NO: 41271 - protein, 376 aa, Nostoc sp. PCC 7120; identical to SEQ ID NO: 1336

SEQ ID NO: 41272 - DNA, 1053 bp, Salmonella enterica subsp. enterica serovar Typhi; identical to SEQ ID NO: 1337
  CDS (1)..(1053)

SEQ ID NO: 41273 - protein, 350 aa, Salmonella enterica subsp. enterica serovar Typhi; identical to SEQ ID NO: 1338

SEQ ID NO: 41274 - DNA, 1077 bp, Pseudomonas aeruginosa; identical to SEQ ID NO: 1339
  CDS (1)..(1077)

SEQ ID NO: 41275 - protein, 358 aa, Pseudomonas aeruginosa; identical to SEQ ID NO: 1340

SEQ ID NO: 41276 - DNA, 1074 bp, Vibrio cholerae; identical to SEQ ID NO: 1343
  CDS (1)..(1074)

SEQ ID NO: 41277 - protein, 357 aa, Vibrio cholerae; identical to SEQ ID NO: 1344

SEQ ID NO: 41278 - DNA, 1038 bp, Lactococcus lactis subsp. lactis; identical to SEQ ID NO: 1345
  CDS (1)..(1038)

SEQ ID NO: 41279 - protein, 345 aa, Lactococcus lactis subsp. lactis; identical to SEQ ID NO: 1346

SEQ ID NO: 41280 - DNA, 1023 bp, Lactococcus lactis subsp. lactis; identical to SEQ ID NO: 1347
  CDS (1)..(1023)

SEQ ID NO: 41281 - protein, 340 aa, Lactococcus lactis subsp. lactis; identical to SEQ ID NO: 1348

SEQ ID NO: 41282 - DNA, 1032 bp, Streptococcus pneumoniae; identical to SEQ ID NO: 1349
  CDS (1)..(1032)

SEQ ID NO: 41283 - protein, 343 aa, Streptococcus pneumoniae; identical to SEQ ID NO: 1350

SEQ ID NO: 41284 - DNA, 1056 bp, Neisseria meningitidis; identical to SEQ ID NO: 2269
  CDS (1)..(1056)

SEQ ID NO: 41285 - protein, 351 aa, Neisseria meningitidis; identical to SEQ ID NO: 2270

SEQ ID NO: 41286 - DNA, 1095 bp, Pseudomonas aeruginosa; identical to SEQ ID NO: 1351
  CDS (1)..(1095)

SEQ ID NO: 41287 - protein, 364 aa, Pseudomonas aeruginosa; identical to SEQ ID NO: 1352

SEQ ID NO: 41288 - DNA, 1032 bp, Streptococcus pneumoniae; identical to SEQ ID NO: 1355
  CDS (1)..(1032)

SEQ ID NO: 41289 - protein, 343 aa, Streptococcus pneumoniae; identical to SEQ ID NO: 1356

SEQ ID NO: 41290 - DNA, 1143 bp, Xylella fastidiosa; identical to SEQ ID NO: 1603
  CDS (1)..(1143)

SEQ ID NO: 41291 - protein, 380 aa, Xylella fastidiosa; identical to SEQ ID NO: 1604

SEQ ID NO: 41292 - DNA, 1047 bp, Buchnera aphidicola; identical to SEQ ID NO: 1357
  CDS (1)..(1047)

SEQ ID NO: 41293 - protein, 348 aa, Buchnera aphidicola; identical to SEQ ID NO: 1358

SEQ ID NO: 41294 - DNA, 1104 bp, Corynebacterium glutamicum; identical to SEQ ID NO: 2279
  CDS (1)..(1104)

SEQ ID NO: 41295 - protein, 367 aa, Corynebacterium glutamicum; identical to SEQ ID NO: 2280

SEQ ID NO: 41296 - DNA, 1089 bp, Haemophilus influenzae; identical to SEQ ID NO: 1359
  CDS (1)..(1089)

SEQ ID NO: 41297 - protein, 362 aa, Haemophilus influenzae; identical to SEQ ID NO: 1360

SEQ ID NO: 41298 - DNA, 1502 bp, Candida albicans; identical to SEQ ID NO: 1361
  CDS (336)..(1442)

SEQ ID NO: 41299 - protein, 368 aa, Candida albicans; identical to SEQ ID NO: 1362

SEQ ID NO: 41300 - DNA, 2048 bp, Saccharomyces cerevisiae; identical to SEQ ID NO: 1365
  CDS (619)..(1731)

SEQ ID NO: 41301 - protein, 370 aa, Saccharomyces cerevisiae; identical to SEQ ID NO: 1366

SEQ ID NO: 41302 - DNA, 1107 bp, Schizosaccharomyces pombe; identical to SEQ ID NO: 1367
  CDS (1)..(1107)

SEQ ID NO: 41303 - protein, 368 aa, Schizosaccharomyces pombe; identical to SEQ ID NO: 1368

SEQ ID NO: 41304 - DNA, 1089 bp, Amycolatopsis orientalis; identical to SEQ ID NO: 1369
  CDS (1)..(1089)

SEQ ID NO: 41305 - protein, 362 aa, Amycolatopsis orientalis; identical to SEQ ID NO: 1370

SEQ ID NO: 41306 - DNA, 1119 bp, Schizosaccharomyces pombe; identical to SEQ ID NO: 1371
  CDS (1)..(1119)

SEQ ID NO: 41307 - protein, 372 aa, Schizosaccharomyces pombe; identical to SEQ ID NO: 1372

SEQ ID NO: 41308 - DNA, 1083 bp, Methylophilus methylotrophus; identical to SEQ ID NO: 1375
  CDS (1)..(1083)

SEQ ID NO: 41309 - protein, 360 aa, Methylophilus methylotrophus; identical to SEQ ID NO: 1376

SEQ ID NO: 41310 - DNA, 1770 bp, Debaryomyces hansenii; identical to SEQ ID NO: 2295
  CDS (1)..(1770)

SEQ ID NO: 41311 - protein, 589 aa, Debaryomyces hansenii; identical to SEQ ID NO: 2296

SEQ ID NO: 41312 - DNA, 1107 bp, Debaryomyces hansenii; identical to SEQ ID NO: 1377
  CDS (1)..(1107)

SEQ ID NO: 41313 - protein, 368 aa, Debaryomyces hansenii; identical to SEQ ID NO: 1378

SEQ ID NO: 41314 - DNA, 1074 bp, Yarrowia lipolytica; identical to SEQ ID NO: 1379
  CDS (1)..(1074)

SEQ ID NO: 41315 - protein, 357 aa, Yarrowia lipolytica; identical to SEQ ID NO: 1380

SEQ ID NO: 41316 - DNA, 1089 bp, Yarrowia lipolytica; identical to SEQ ID NO: 1381
  CDS (1)..(1089)

SEQ ID NO: 41317 - protein, 362 aa, Yarrowia lipolytica; identical to SEQ ID NO: 1382

SEQ ID NO: 41318 - DNA, 1119 bp, Kluyveromyces lactis; identical to SEQ ID NO: 1383
  CDS (1)..(1119)

SEQ ID NO: 41319 - protein, 372 aa, Kluyveromyces lactis; identical to SEQ ID NO: 1384

SEQ ID NO: 41320 - DNA, 1095 bp, Kluyveromyces lactis; identical to SEQ ID NO: 1385
  CDS (1)..(1095)

SEQ ID NO: 41321 - protein, 364 aa, Kluyveromyces lactis; identical to SEQ ID NO: 1386

SEQ ID NO: 41322 - DNA, 1074 bp, Erwinia carotovora subsp; identical to SEQ ID NO: 1387
  CDS (1)..(1074)

SEQ ID NO: 41323 - protein, 357 aa, Erwinia carotovora subsp; identical to SEQ ID NO: 1388

SEQ ID NO: 41324 - DNA, 1047 bp, Erwinia carotovora subsp; identical to SEQ ID NO: 1389
  CDS (1)..(1047)

SEQ ID NO: 41325 - protein, 348 aa, Erwinia carotovora subsp; identical to SEQ ID NO: 1390

SEQ ID NO: 41326 - DNA, 1056 bp, Erwinia carotovora subsp; identical to SEQ ID NO: 1391
  CDS (1)..(1056)

SEQ ID NO: 41327 - protein, 351 aa, Erwinia carotovora subsp; identical to SEQ ID NO: 1392

SEQ ID NO: 41328 - DNA, 1113 bp, Acinetobacter sp; identical to SEQ ID NO: 1393
  CDS (1)..(1113)

SEQ ID NO: 41329 - protein, 370 aa, Acinetobacter sp; identical to SEQ ID NO: 1394

SEQ ID NO: 41330 - DNA, 1056 bp, Acinetobacter sp; identical to SEQ ID NO: 1395
  CDS (1)..(1056)

SEQ ID NO: 41331 - protein, 351 aa, Acinetobacter sp; identical to SEQ ID NO: 1396

SEQ ID NO: 41332 - DNA, 1119 bp, Candida glabrata; identical to SEQ ID NO: 1397
  CDS (1)..(1119)

SEQ ID NO: 41333 - protein, 372 aa, Candida glabrata; identical to SEQ ID NO: 1398

SEQ ID NO: 41334 - DNA, 1071 bp, Candida glabrata; identical to SEQ ID NO: 1399
  CDS (1)..(1071)

SEQ ID NO: 41335 - protein, 356 aa, Candida glabrata; identical to SEQ ID NO: 1400

SEQ ID NO: 41336 - DNA, 1083 bp, Photobacterium profundum; identical to SEQ ID NO: 1401
  CDS (1)..(1083)

SEQ ID NO: 41337 - protein, 360 aa, Photobacterium profundum; identical to SEQ ID NO: 1402

SEQ ID NO: 41338 - DNA, 1053 bp, Photobacterium profundum; identical to SEQ ID NO: 1403
  CDS (1)..(1053)

SEQ ID NO: 41339 - protein, 350 aa, Photobacterium profundum; identical to SEQ ID NO: 1404

SEQ ID NO: 41340 - DNA, 1113 bp, Photobacterium profundum; identical to SEQ ID NO: 1405
  CDS (1)..(1113)

SEQ ID NO: 41341 - protein, 370 aa, Photobacterium profundum; identical to SEQ ID NO: 1406

SEQ ID NO: 41342 - DNA, 1056 bp, Photobacterium profundum; identical to SEQ ID NO: 1407
  CDS (1)..(1056)

SEQ ID NO: 41343 - protein, 351 aa, Photobacterium profundum; identical to SEQ ID NO: 1408

SEQ ID NO: 41344 - DNA, 1092 bp, Parachlamydia sp; identical to SEQ ID NO: 1409
  CDS (1)..(1092)

SEQ ID NO: 41345 - protein, 363 aa, Parachlamydia sp; identical to SEQ ID NO: 1410

SEQ ID NO: 41346 - DNA, 1095 bp, Rhodopseudomonas palustris; identical to SEQ ID NO: 1411
  CDS (1)..(1095)

SEQ ID NO: 41347 - protein, 364 aa, Rhodopseudomonas palustris; identical to SEQ ID NO: 1412

SEQ ID NO: 41348 - DNA, 1100 bp, Amycolatopsis methanolica; identical to SEQ ID NO: 1413
  CDS (1)..(1086)

SEQ ID NO: 41349 - protein, 361 aa, Amycolatopsis methanolica; identical to SEQ ID NO: 1414

SEQ ID NO: 41350 - DNA, 1071 bp, Treponema denticola; identical to SEQ ID NO: 1415
  CDS (1)..(1071)

SEQ ID NO: 41351 - protein, 356 aa, Treponema denticola; identical to SEQ ID NO: 1416

SEQ ID NO: 41352 - DNA, 1068 bp, Geobacter sulfurreducens; identical to SEQ ID NO: 1417
  CDS (1)..(1068)

SEQ ID NO: 41353 - protein, 355 aa, Geobacter sulfurreducens; identical to SEQ ID NO: 1418

SEQ ID NO: 41354 - DNA, 1095 bp, Ashbya gossypii; identical to SEQ ID NO: 1419
  CDS (1)..(1095)

SEQ ID NO: 41355 - protein, 364 aa, Ashbya gossypii; identical to SEQ ID NO: 1420

SEQ ID NO: 41356 - DNA, 1122 bp, Ashbya gossypii; identical to SEQ ID NO: 1421
  CDS (1)..(1122)

SEQ ID NO: 41357 - protein, 373 aa, Ashbya gossypii; identical to SEQ ID NO: 1422

SEQ ID NO: 41358 - DNA, 1098 bp, Amycolatopsis balhimycina; identical to SEQ ID NO: 1423
  CDS (1)..(1098)

SEQ ID NO: 41359 - protein, 365 aa, Amycolatopsis balhimycina; identical to SEQ ID NO: 1424

SEQ ID NO: 41360 - DNA, 1053 bp, Vibrio vulnificus; identical to SEQ ID NO: 2345
  CDS (1)..(1053)

SEQ ID NO: 41361 - protein, 350 aa, Vibrio vulnificus; identical to SEQ ID NO: 2346

SEQ ID NO: 41362 - DNA, 1047 bp, Photorhabdus luminescens; identical to SEQ ID NO: 1427
  CDS (1)..(1047)

SEQ ID NO: 41363 - protein, 348 aa, Photorhabdus luminescens; identical to SEQ ID NO: 1428

SEQ ID NO: 41364 - DNA, 1053 bp, Photorhabdus luminescens; identical to SEQ ID NO: 1429
  CDS (1)..(1053)

SEQ ID NO: 41365 - protein, 350 aa, Photorhabdus luminescens; identical to SEQ ID NO: 1430

SEQ ID NO: 41366 - DNA, 1095 bp, Photorhabdus luminescens; identical to SEQ ID NO: 1431
  CDS (1)..(1095)

SEQ ID NO: 41367 - protein, 364 aa, Photorhabdus luminescens; identical to SEQ ID NO: 1432

SEQ ID NO: 41368 - DNA, 1119 bp, Gloeobacter violaceus; identical to SEQ ID NO: 1433
  CDS (1)..(1119)

SEQ ID NO: 41369 - protein, 372 aa, Gloeobacter violaceus; identical to SEQ ID NO: 1434

SEQ ID NO: 41370 - DNA, 1107 bp, Chromobacterium violaceum; identical to SEQ ID NO: 1435
  CDS (1)..(1107)

SEQ ID NO: 41371 - protein, 368 aa, Chromobacterium violaceum; identical to SEQ ID NO: 1436

SEQ ID NO: 41372 - DNA, 1059 bp, Chromobacterium violaceum; identical to SEQ ID NO: 1437
  CDS (1)..(1059)

SEQ ID NO: 41373 - protein, 352 aa, Chromobacterium violaceum; identical to SEQ ID NO: 1438

SEQ ID NO: 41374 - DNA, 1140 bp, Neurospora crassa; identical to SEQ ID NO: 1439
  CDS (1)..(1140)

SEQ ID NO: 41375 - protein, 379 aa, Neurospora crassa; identical to SEQ ID NO: 1440

SEQ ID NO: 41376 - DNA, 1092 bp, Neurospora crassa; identical to SEQ ID NO: 1441
  CDS (1)..(1092)

SEQ ID NO: 41377 - protein, 363 aa, Neurospora crassa; identical to SEQ ID NO: 1442

SEQ ID NO: 41378 - DNA, 1068 bp, Synechococcus sp; identical to SEQ ID NO: 1443
  CDS (1)..(1068)

SEQ ID NO: 41379 - protein, 355 aa, Synechococcus sp; identical to SEQ ID NO: 1444

SEQ ID NO: 41380 - DNA, 1053 bp, Rhodopirellula baltica; identical to SEQ ID NO: 1445
  CDS (1)..(1053)

SEQ ID NO: 41381 - protein, 350 aa, Rhodopirellula baltica; identical to SEQ ID NO: 1446

SEQ ID NO: 41382 - DNA, 1068 bp, Prochlorococcus marinus subsp; identical to SEQ ID NO: 1447
  CDS (1)..(1068)

SEQ ID NO: 41383 - protein, 355 aa, Prochlorococcus marinus subsp; identical to SEQ ID NO: 1448

SEQ ID NO: 41384 - DNA, 1083 bp, Prochlorococcus marinus; identical to SEQ ID NO: 1449
  CDS (1)..(1083)

SEQ ID NO: 41385 - protein, 360 aa, Prochlorococcus marinus; identical to SEQ ID NO: 1450

SEQ ID NO: 41386 - DNA, 1074 bp, Prochlorococcus marinus; identical to SEQ ID NO: 1451
  CDS (1)..(1074)

SEQ ID NO: 41387 - protein, 357 aa, Prochlorococcus marinus; identical to SEQ ID NO: 1452

SEQ ID NO: 41388 - DNA, 1113 bp, Haemophilus ducreyi; identical to SEQ ID NO: 1453
  CDS (1)..(1113)

SEQ ID NO: 41389 - protein, 370 aa, Haemophilus ducreyi; identical to SEQ ID NO: 1454

SEQ ID NO: 41390 - DNA, 1080 bp, Haemophilus ducreyi; identical to SEQ ID NO: 1455
  CDS (1)..(1080)

SEQ ID NO: 41391 - protein, 359 aa, Haemophilus ducreyi; identical to SEQ ID NO: 1456

SEQ ID NO: 41392 - DNA, 1086 bp, Candidatus Blochmannia floridanus; identical to SEQ ID NO: 1457
  CDS (1)..(1086)

SEQ ID NO: 41393 - protein, 361 aa, Candidatus Blochmannia floridanus; identical to SEQ ID NO: 1458

SEQ ID NO: 41394 - DNA, 1074 bp, Bordetella pertussis; identical to SEQ ID NO: 2379
  CDS (1)..(1074)

SEQ ID NO: 41395 - protein, 357 aa, Bordetella pertussis; identical to SEQ ID NO: 1460

SEQ ID NO: 41396 - DNA, 1119 bp, Bordetella bronchiseptica; identical to SEQ ID NO: 1461
  CDS (1)..(1119)

SEQ ID NO: 41397 - protein, 372 aa, Bordetella bronchiseptica; identical to SEQ ID NO: 1462

SEQ ID NO: 41398 - DNA, 1179 bp, Nitrosomonas europaea; identical to SEQ ID NO: 1463
  CDS (1)..(1179)

SEQ ID NO: 41399 - protein, 392 aa, Nitrosomonas europaea; identical to SEQ ID NO: 1464

SEQ ID NO: 41400 - DNA, 1083 bp, Coxiella burnetii; identical to SEQ ID NO: 1465
  CDS (1)..(1083)

SEQ ID NO: 41401 - protein, 360 aa, Coxiella burnetii; identical to SEQ ID NO: 1466

SEQ ID NO: 41402 - DNA, 1053 bp, Vibrio parahaemolyticus; identical to SEQ ID NO: 1471
  CDS (1)..(1053)

SEQ ID NO: 41403 - protein, 350 aa, Vibrio parahaemolyticus; identical to SEQ ID NO: 1472

SEQ ID NO: 41404 - DNA, 1053 bp, Vibrio parahaemolyticus; identical to SEQ ID NO: 1473
  CDS (1)..(1053)

SEQ ID NO: 41405 - protein, 350 aa, Vibrio parahaemolyticus; identical to SEQ ID NO: 1474

SEQ ID NO: 41406 - DNA, 1074 bp, Vibrio parahaemolyticus; identical to SEQ ID NO: 1475
  CDS (1)..(1074)

SEQ ID NO: 41407 - protein, 357 aa, Vibrio parahaemolyticus; identical to SEQ ID NO: 1476

SEQ ID NO: 41408 - DNA, 1083 bp, Pseudomonas syringae; identical to SEQ ID NO: 1477
  CDS (1)..(1083)

SEQ ID NO: 41409 - protein, 360 aa, Pseudomonas syringae; identical to SEQ ID NO: 1478

SEQ ID NO: 41410 - DNA, 1077 bp, Pseudomonas syringae; identical to SEQ ID NO: 1479
  CDS (1)..(1077)

SEQ ID NO: 41411 - protein, 358 aa, Pseudomonas syringae; identical to SEQ ID NO: 1480

SEQ ID NO: 41412 - DNA, 1062 bp, Pseudomonas putida; identical to SEQ ID NO: 1481
  CDS (1)..(1062)

SEQ ID NO: 41413 - protein, 353 aa, Pseudomonas putida; identical to SEQ ID NO: 1482

SEQ ID NO: 41414 - DNA, 1113 bp, Pseudomonas putida; identical to SEQ ID NO: 1483
  CDS (1)..(1113)

SEQ ID NO: 41415 - protein, 370 aa, Pseudomonas putida; identical to SEQ ID NO: 1484

SEQ ID NO: 41416 - DNA, 1086 bp, Bradyrhizobium japonicum; identical to SEQ ID NO: 1485
  CDS (1)..(1086)

SEQ ID NO: 41417 - protein, 361 aa, Bradyrhizobium japonicum; identical to SEQ ID NO: 1486

SEQ ID NO: 41418 - DNA, 1053 bp, Yersinia pestis; identical to SEQ ID NO: 1487
  CDS (1)..(1053)

SEQ ID NO: 41419 - protein, 350 aa, Yersinia pestis; identical to SEQ ID NO: 1488

SEQ ID NO: 41420 - DNA, 1038 bp, Wigglesworthia glossinidia brevipalpis; identical to SEQ ID NO: 1491
  CDS (1)..(1038)

SEQ ID NO: 41421 - protein, 345 aa, Wigglesworthia glossinidia brevipalpis; identical to SEQ ID NO: 1492

SEQ ID NO: 41422 - DNA, 1071 bp, Vibrio vulnificus; identical to SEQ ID NO: 1739
  CDS (1)..(1071)

SEQ ID NO: 41423 - protein, 356 aa, Vibrio vulnificus; identical to SEQ ID NO: 1740

SEQ ID NO: 41424 - DNA, 1053 bp, Vibrio vulnificus; identical to SEQ ID NO: 1493
  CDS (1)..(1053)

SEQ ID NO: 41425 - protein, 350 aa, Vibrio vulnificus; identical to SEQ ID NO: 1494

SEQ ID NO: 41426 - DNA, 1071 bp, Vibrio vulnificus; identical to SEQ ID NO: 1497
  CDS (1)..(1071)

SEQ ID NO: 41427 - protein, 356 aa, Vibrio vulnificus; identical to SEQ ID NO: 1498

SEQ ID NO: 41428 - DNA, 1062 bp, Synechococcus elongatus; identical to SEQ ID NO: 1499
  CDS (1)..(1062)

SEQ ID NO: 41429 - protein, 353 aa, Synechococcus elongatus; identical to SEQ ID NO: 1500

SEQ ID NO: 41430 - DNA, 1032 bp, Streptococcus mutans; identical to SEQ ID NO: 1501
  CDS (1)..(1032)

SEQ ID NO: 41431 - protein, 343 aa, Streptococcus mutans; identical to SEQ ID NO: 1502

SEQ ID NO: 41432 - DNA, 1035 bp, Streptococcus mutans; identical to SEQ ID NO: 1503
  CDS (1)..(1035)

SEQ ID NO: 41433 - protein, 344 aa, Streptococcus mutans; identical to SEQ ID NO: 1504

SEQ ID NO: 41434 - DNA, 1008 bp, Streptococcus agalactiae; identical to SEQ ID NO: 1505
  CDS (1)..(1008)

SEQ ID NO: 41435 - protein, 335 aa, Streptococcus agalactiae; identical to SEQ ID NO: 1506

SEQ ID NO: 41436 - DNA, 1065 bp, Shewanella oneidensis; identical to SEQ ID NO: 1507
  CDS (1)..(1065)

SEQ ID NO: 41437 - protein, 354 aa, Shewanella oneidensis; identical to SEQ ID NO: 1508

SEQ ID NO: 41438 - DNA, 1092 bp, Shewanella oneidensis; identical to SEQ ID NO: 1509
  CDS (1)..(1092)

SEQ ID NO: 41439 - protein, 363 aa, Shewanella oneidensis; identical to SEQ ID NO: 1510

SEQ ID NO: 41440 - DNA, 1059 bp, Shewanella oneidensis; identical to SEQ ID NO: 1511
  CDS (1)..(1059)

SEQ ID NO: 41441 - protein, 352 aa, Shewanella oneidensis; identical to SEQ ID NO: 1512

SEQ ID NO: 41442 - DNA, 1170 bp, Corynebacterium efficiens; identical to SEQ ID NO: 1515
  CDS (1)..(1170)

SEQ ID NO: 41443 - protein, 389 aa, Corynebacterium efficiens; identical to SEQ ID NO: 1516

SEQ ID NO: 41444 - DNA, 1134 bp, Bifidobacterium longum; identical to SEQ ID NO: 1517
  CDS (1)..(1134)

SEQ ID NO: 41445 - protein, 377 aa, Bifidobacterium longum; identical to SEQ ID NO: 1518

SEQ ID NO: 41446 - DNA, 1233 bp, Bifidobacterium longum; identical to SEQ ID NO: 1519
  CDS (1)..(1233)

SEQ ID NO: 41447 - protein, 410 aa, Bifidobacterium longum; identical to SEQ ID NO: 1520

SEQ ID NO: 41448 - DNA, 1221 bp, Phytophthora infestans; identical to SEQ ID NO: 1521
  CDS (20)..(1153)

SEQ ID NO: 41449 - protein, 377 aa, Phytophthora infestans; identical to SEQ ID NO: 1522

SEQ ID NO: 41450 - DNA, 1062 bp, Chlorobium tepidum; identical to SEQ ID NO: 1523
  CDS (1)..(1062)

SEQ ID NO: 41451 - protein, 353 aa, Chlorobium tepidum; identical to SEQ ID NO: 1524

SEQ ID NO: 41452 - DNA, 1074 bp, Xanthomonas campestris; identical to SEQ ID NO: 1525
  CDS (1)..(1074)

SEQ ID NO: 41453 - protein, 357 aa, Xanthomonas campestris; identical to SEQ ID NO: 1526

SEQ ID NO: 41454 - DNA, 1074 bp, Xanthomonas axonopodis; identical to SEQ ID NO: 1527
  CDS (1)..(1074)

SEQ ID NO: 41455 - protein, 357 aa, Xanthomonas axonopodis; identical to SEQ ID NO: 1528

SEQ ID NO: 41456 - DNA, 1080 bp, Ralstonia solanacearum; identical to SEQ ID NO: 1529
  CDS (1)..(1080)

SEQ ID NO: 41457 - protein, 359 aa, Ralstonia solanacearum; identical to SEQ ID NO: 1530

SEQ ID NO: 41458 - DNA, 1179 bp, Ralstonia solanacearum; identical to SEQ ID NO: 1531
  CDS (1)..(1179)

SEQ ID NO: 41459 - protein, 392 aa, Ralstonia solanacearum; identical to SEQ ID NO: 1532

SEQ ID NO: 41460 - DNA, 1065 bp, Synechococcus sp; identical to SEQ ID NO: 1533
  CDS (1)..(1065)

SEQ ID NO: 41461 - protein, 354 aa, Synechococcus sp; identical to SEQ ID NO: 1534

SEQ ID NO: 41462 - DNA, 1035 bp, Escherichia coli; identical to SEQ ID NO: 1535
  CDS (1)..(1035)

SEQ ID NO: 41463 - protein, 344 aa, Escherichia coli; identical to SEQ ID NO: 1536

SEQ ID NO: 41464 - DNA, 1200 bp, Stigmatella aurantiaca; identical to SEQ ID NO: 1537
  CDS (62)..(1147)

SEQ ID NO: 41465 - protein, 361 aa, Stigmatella aurantiaca; identical to SEQ ID NO: 1538

SEQ ID NO: 41466 - DNA, 1083 bp, Amycolatopsis mediterranei; identical to SEQ ID NO: 1541
  CDS (1)..(1083)

SEQ ID NO: 41467 - protein, 360 aa, Amycolatopsis mediterranei; identical to SEQ ID NO: 1542

SEQ ID NO: 41468 - DNA, 1053 bp, Pasteurella multocida; identical to SEQ ID NO: 1543
  CDS (1)..(1053)

SEQ ID NO: 41469 - protein, 350 aa, Pasteurella multocida; identical to SEQ ID NO: 1544

SEQ ID NO: 41470 - DNA, 1086 bp, Pasteurella multocida; identical to SEQ ID NO: 1545
  CDS (1)..(1086)

SEQ ID NO: 41471 - protein, 361 aa, Pasteurella multocida; identical to SEQ ID NO: 1546

SEQ ID NO: 41472 - DNA, 1125 bp, Emericella nidulans; identical to SEQ ID NO: 1547
  CDS (1)..(1125)

SEQ ID NO: 41473 - protein, 374 aa, Emericella nidulans; identical to SEQ ID NO: 1548

SEQ ID NO: 41474 - DNA, 1089 bp, Emericella nidulans; identical to SEQ ID NO: 1549
  CDS (1)..(1089)

SEQ ID NO: 41475 - protein, 362 aa, Emericella nidulans; identical to SEQ ID NO: 1550

SEQ ID NO: 41476 - DNA, 1239 bp, Vibrio cholerae; identical to SEQ ID NO: 1551
  CDS (114)..(1175)

SEQ ID NO: 41477 - protein, 353 aa, Vibrio cholerae; identical to SEQ ID NO: 1552

SEQ ID NO: 41478 - DNA, 2184 bp, Candida albicans; identical to SEQ ID NO: 1553
  CDS (461)..(1573)

SEQ ID NO: 41479 - protein, 370 aa, Candida albicans; identical to SEQ ID NO: 1554

SEQ ID NO: 41480 - DNA, 1047 bp, Buchnera aphidicola; identical to SEQ ID NO: 1555
  CDS (1)..(1047)

SEQ ID NO: 41481 - protein, 348 aa, Buchnera aphidicola; identical to SEQ ID NO: 1556

SEQ ID NO: 41482 - DNA, 1047 bp, Buchnera aphidicola; identical to SEQ ID NO: 1557
  CDS (1)..(1047)

SEQ ID NO: 41483 - protein, 348 aa, Buchnera aphidicola; identical to SEQ ID NO: 1558

SEQ ID NO: 41484 - DNA, 1047 bp, Erwinia herbicola; identical to SEQ ID NO: 1559
  CDS (1)..(1047)

SEQ ID NO: 41485 - protein, 348 aa, Erwinia herbicola; identical to SEQ ID NO: 1560

SEQ ID NO: 41486 - DNA, 1047 bp, Salmonella typhimurium; identical to SEQ ID NO: 1561
  CDS (1)..(1047)

SEQ ID NO: 41487 - protein, 348 aa, Salmonella typhimurium; identical to SEQ ID NO: 1562

SEQ ID NO: 41488 - DNA, 1047 bp, Shigella flexneri; identical to SEQ ID NO: 2473
  CDS (1)..(1047)

SEQ ID NO: 41489 - protein, 348 aa, Shigella flexneri; identical to SEQ ID NO: 2474

SEQ ID NO: 41490 - DNA, 25 bp, Artificial sequence
  (1)..(25): primer
atgttcattaaaaacgatcacgccg

SEQ ID NO: 41491 - DNA, 25 bp, Artificial sequence
  (1)..(25): primer
ctattttttcaaggcctttcttctg

SEQ ID NO: 41492 - protein, 353 aa, Artificial sequence; identical to SEQ ID NO: 24922
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(37): xaa in position 37 is any amino acid
  Variant (39)..(46): xaa in position 39 to 46 is any amino acid
  Variant (51)..(51): xaa in position 51 is any amino acid
  Variant (54)..(56): xaa in position 54 to 56 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(130): xaa in position 121 to 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(152): xaa in position 148 to 152 is any amino acid
  Variant (163)..(163): xaa in position 163 is any amino acid
  Variant (166)..(168): xaa in position 166 to 168 is any amino acid
  Variant (171)..(171): xaa in position 171 is any amino acid
  Variant (174)..(174): xaa in position 174 is any amino acid
  Variant (176)..(176): xaa in position 176 is any amino acid
  Variant (181)..(181): xaa in position 181 is any amino acid
  Variant (183)..(183): xaa in position 183 is any amino acid
  Variant (185)..(188): xaa in position 185 to 188 is any amino acid
  Variant (190)..(191): xaa in position 190 to 191 is any amino acid
  Variant (193)..(195): xaa in position 193 to 195 is any amino acid
  Variant (197)..(199): xaa in position 197 to 199 is any amino acid
  Variant (201)..(201): xaa in position 201 is any amino acid
  Variant (203)..(208): xaa in position 203 to 208 is any amino acid
  Variant (210)..(215): xaa in position 210 to 215 is any amino acid
  Variant (217)..(217): xaa in position 217 is any amino acid
  Variant (220)..(222): xaa in position 220 to 222 is any amino acid
  Variant (224)..(225): xaa in position 224 to 225 is any amino acid
  Variant (230)..(238): xaa in position 230 to 238 is any amino acid
  Variant (241)..(269): xaa in position 241 to 269 is any amino acid
  Variant (271)..(271): xaa in position 271 is any amino acid
  Variant (274)..(274): xaa in position 274 is any amino acid
  Variant (277)..(277): xaa in position 277 is any amino acid
  Variant (279)..(282): xaa in position 279 to 282 is any amino acid
  Variant (284)..(285): xaa in position 284 to 285 is any amino acid
  Variant (287)..(292): xaa in position 287 to 292 is any amino acid
  Variant (294)..(296): xaa in position 294 to 296 is any amino acid
  Variant (298)..(305): xaa in position 298 to 305 is any amino acid
  Variant (307)..(307): xaa in position 307 is any amino acid
  Variant (309)..(309): xaa in position 309 is any amino acid
  Variant (312)..(315): xaa in position 312 to 315 is any amino acid
  Variant (317)..(317): xaa in position 317 is any amino acid
  Variant (319)..(334): xaa in position 319 to 334 is any amino acid
  Variant (337)..(337): xaa in position 337 is any amino acid
  Variant (339)..(339): xaa in position 339 is any amino acid
  Variant (342)..(342): xaa in position 342 is any amino acid
  Variant (344)..(345): xaa in position 344 to 345 is any amino acid
  Variant (347)..(348): xaa in position 347 to 348 is any amino acid
  Variant (350)..(352): xaa in position 350 to 352 is any amino acid

SEQ ID NO: 41493 - protein, 72 aa, Artificial sequence; identical to SEQ ID NO: 2906
  Variant (5)..(5): xaa in position 5 is Ile, Val, Ser or Leu
  Variant (6)..(6): xaa in position 6 is His or Asp
  Variant (7)..(7): xaa in position 7 is Asp or Asn
  Variant (8)..(10): xaa in position 8 to 10 is any amino acid
  Variant (11)..(11): xaa in position 11 is Ala, Val or Gly
  Variant (12)..(12): xaa in position 12 is any amino acid
  Variant (13)..(13): xaa in position 13 is Glu, Asp, Ala or Gln
  Variant (15)..(15): xaa in position 15 is Ala, Gly or Cys
  Variant (16)..(17): xaa in position 16 to 17 is any amino acid
  Variant (18)..(18): xaa in position 18 is Leu, Ile or Phe
  Variant (19)..(28): xaa in position 19 to 28 is any amino acid
  Variant (29)..(30): xaa in position 29 to 30 is any or no amino acid
  Variant (31)..(31): xaa in position 31 is Leu, Ile, Phe or Met
  Variant (32)..(32): xaa in position 32 is any amino acid
  Variant (33)..(33): xaa in position 33 is Ile, Val, Leu or Met
  Variant (34)..(34): xaa in position 34 is Val, Ile or Leu
  Variant (37)..(37): xaa in position 37 is Val, Ala or Thr
  Variant (39)..(39): xaa in position 39 is Phe, Leu, Thr or Val
  Variant (40)..(40): xaa in position 40 is Glu or Ala
  Variant (45)..(46): xaa in position 45 to 46 is any amino acid
  Variant (47)..(47): xaa in position 47 is any or no amino acid
  Variant (49)..(49): xaa in position 49 is Trp or Tyr
  Variant (50)..(50): xaa in position 50 is Lys or Arg
  Variant (52)..(52): xaa in position 52 is Leu, Phe, Met or Tyr
  Variant (53)..(53): xaa in position 53 is Ile, Val, Ala or Leu
  Variant (54)..(54): xaa in position 54 is any amino acid
  Variant (55)..(55): xaa in position 55 is Asp, Glu or Gln
  Variant (57)..(57): xaa in position 57 is any amino acid
  Variant (58)..(58): xaa in position 58 is Leu, Met, Ile, Val, Ala or Thr
  Variant (59)..(59): xaa in position 59 is Asp, Asn or Ser
  Variant (60)..(63): xaa in position 60 to 63 is any amino acid
  Variant (64)..(64): xaa in position 64 is Ile, Val, Leu or Met
  Variant (65)..(66): xaa in position 65 to 66 is any amino acid
  Variant (68)..(68): xaa in position 68 is Leu, Ile, Met or Val
  Variant (69)..(70): xaa in position 69 to 70 is any amino acid
  Variant (71)..(71): xaa in position 71 is Ala, Ser, Gly, Val or Thr

SEQ ID NO: 41494 - protein, 76 aa, Artificial sequence; identical to SEQ ID NO: 2907
  Variant (1)..(1): xaa in position 1 is Ala or Ser
  Variant (2)..(2): xaa in position 2 is Ile or Val
  Variant (6)..(6): xaa in position 6 is Thr, Ser or Asn
  Variant (7)..(7): xaa in position 7 is Thr, Val, Ala, Ser or Ile
  Variant (8)..(8): xaa in position 8 is Glu or Ala
  Variant (9)..(9): xaa in position 9 is Ser, Asp or Asn
  Variant (11)..(11): xaa in position 11 is any amino acid
  Variant (14)..(14): xaa in position 14 is Glu, Gln, Phe or Met
  Variant (15)..(15): xaa in position 15 is Leu, Met, Val, Phe or Ile
  Variant (16)..(16): xaa in position 16 is Ala, Ser, Thr, Cys or Val
  Variant (18)..(18): xaa in position 18 is Gly, Ala or Asn
  Variant (19)..(21): xaa in position 19 to 21 is any amino acid
  Variant (22)..(22): xaa in position 22 is Pro or Ala
  Variant (23)..(23): xaa in position 23 is Val, Ile, Thr or Leu
  Variant (25)..(25): xaa in position 25 is Phe, Met, Tyr or Ile
  Variant (28)..(28): xaa in position 28 is any amino acid
  Variant (29)..(29): xaa in position 29 is Thr, Ser or Arg
  Variant (30)..(30): xaa in position 30 is any amino acid
  Variant (32)..(35): xaa in position 32 to 35 is any amino acid
  Variant (36)..(36): xaa in position 36 is Ala or Met
  Variant (37)..(37): xaa in position 37 is any amino acid
  Variant (38)..(38): xaa in position 38 is Asp, Asn or Glu
  Variant (39)..(39): xaa in position 39 is Ala or Gly
  Variant (40)..(41): xaa in position 40 to 41 is any amino acid
  Variant (42)..(42): xaa in position 42 is Ala or Ser
  Variant (43)..(43): xaa in position 43 is Ala, Ser, Val or Thr
  Variant (44)..(46): xaa in position 44 to 46 is any amino acid
  Variant (47)..(47): xaa in position 47 is His or Gln
  Variant (48)..(48): xaa in position 48 is any amino acid
  Variant (49)..(49): xaa in position 49 is Phe, Tyr, His or Val
  Variant (50)..(51): xaa in position 50 to 51 is any amino acid
  Variant (52)..(55): xaa in position 52 to 55 is any or no amino acid
  Variant (57)..(60): xaa in position 57 to 60 is any amino acid
  Variant (61)..(62): xaa in position 61 to 62 is any or no amino acid
  Variant (63)..(63): xaa in position 63 is Thr or Ser
  Variant (64)..(64): xaa in position 64 is any amino acid
  Variant (67)..(69): xaa in position 67 to 69 is any amino acid
  Variant (70)..(70): xaa in position 70 is His or Phe
  Variant (71)..(71): xaa in position 71 is Val, Ile, Leu or Ala
  Variant (72)..(72): xaa in position 72 is Ile or Val
  Variant (73)..(73): xaa in position 73 is Leu or Met
  Variant (76)..(76): xaa in position 76 is Gly, Ala or Ser

SEQ ID NO: 41495 - protein, 83 aa, Artificial sequence; identical to SEQ ID NO: 2908
  Variant (1)..(1): xaa in position 1 is Leu, Ile or Val
  Variant (2)..(2): xaa in position 2 is Met, Val, Ile or Leu
  Variant (3)..(3): xaa in position 3 is Ile or Val
  Variant (5)..(5): xaa in position 5 is Cys, Phe, Ala, Thr or Tyr
  Variant (6)..(6): xaa in position 6 is Ser, Asn or Ala
  Variant (8)..(8): xaa in position 8 is Gly, Ala or Asp
  Variant (10)..(10): xaa in position 10 is Ser or Cys
  Variant (11)..(11): xaa in position 11 is any amino acid
  Variant (13)..(15): xaa in position 13 to 15 is any amino acid
  Variant (16)..(16): xaa in position 16 is Arg, Asn, Lys, Leu or Glu
  Variant (18)..(19): xaa in position 18 to 19 is any amino acid
  Variant (20)..(20): xaa in position 20 is Val or Ile
  Variant (21)..(26): xaa in position 21 to 26 is any amino acid
  Variant (27)..(27): xaa in position 27 is Gln, Asn or Arg
  Variant (28)..(28): xaa in position 28 is Ile, Leu, Val, Arg or Met
  Variant (29)..(30): xaa in position 29 to 30 is any amino acid
  Variant (31)..(31): xaa in position 31 is Gly, Asn or Asp
  Variant (32)..(32): xaa in position 32 is any amino acid
  Variant (33)..(37): xaa in position 33 to 37 is any or no amino acid
  Variant (38)..(38): xaa in position 38 is Ile, Val or Leu
  Variant (39)..(39): xaa in position 39 is any amino acid
  Variant (41)..(41): xaa in position 41 is any amino acid
  Variant (43)..(43): xaa in position 43 is Ile, Leu, Val, Ala or Met
  Variant (46)..(46): xaa in position 46 is His, Phe, Asn or Tyr
  Variant (47)..(47): xaa in position 47 is Leu or Ile
  Variant (48)..(49): xaa in position 48 to 49 is any amino acid
  Variant (51)..(51): xaa in position 51 is any amino acid
  Variant (53)..(57): xaa in position 53 to 57 is any amino acid
  Variant (58)..(69): xaa in position 58 to 69 is any or no amino acid
  Variant (71)..(71): xaa in position 71 is any amino acid
  Variant (73)..(73): xaa in position 73 is Ile or Val
  Variant (76)..(76): xaa in position 76 is any amino acid
  Variant (78)..(78): xaa in position 78 is Ile, Leu or Val
  Variant (79)..(79): xaa in position 79 is any amino acid
  Variant (80)..(80): xaa in position 80 is Trp, Ile, Leu or Phe
  Variant (81)..(82): xaa in position 81 to 82 is any amino acid
  Variant (83)..(83): xaa in position 83 is Thr or Ser

SEQ ID NO: 41496 - DNA, 621 bp, Saccharomyces cerevisiae
  CDS (1)..(621)
atgaaggagtcagtccaagagatcatccagcaactcatccacagtgtcgatttacagtcttccaagttccagctggccattgtgtgcacgatgttcaatcctatcttttggaacatcgttgcaagaatggaataccacaagcattctctcaccaagatgtgtggtggggccagaaagggctgttacatgttggcggcgaccatattttcgctaggtatcgtcagagacatggtgtacgagtctgcattgcgtgaacagcctacgtgttctctgatcacgggcgagaactggaccaagctgggtgtggctctctttggtttggggcaagtgcttgttttgagttccatgtacaagctgggtatcacagggacgtacttgggtgactatttcggcatcctgatggatgagagagtcaccggcttccccttcaacgtttccaacaaccccatgtaccagggttccactttgtccttcttgggcatagccctttacaaaggaaagcctgcggggctggttgtttctgccgtagtttacttcatgtacaagatcgctcttcgttgggaagaaccttttactgccatgatctacgctaaccgtgataaggccaaaaagaatatgtaa

SEQ ID NO: 41497 - protein, 206 aa, Saccharomyces cerevisiae
MKESVQEIIQQLIHSVDLQSSKFQLAIVCTMFNPIFWNIVARMEYHKHSLTKMCGGARKGCYMLAATIFSLGIVRDMVYESALREQPTCSLITGENWTKLGVALFGLGQVLVLSSMYKLGITGTYLGDYFGILMDERVTGFPFNVSNNPMYQGSTLSFLGIALYKGKPAGLVVSAVVYFMYKIALRWEEPFTAMIYANRDKAKKNM

SEQ ID NO: 41498 - DNA, 600 bp, Rattus norvegicus
  CDS (1)..(600)
atgagctggctgctgggttacgtggaccccacagagcccagctttgtggcggctgtgctcaccattgtgttcaatccactcttctggaatgtggtagcaaggtgggagcagagaactcgcaagctgagcagagccttcgggtccccttacctagcctgctattccctgggcagcatcatcctgcttctgaacatcctccgctcccactgcttcacacaggccatgatgagccagcccaagatggagggcctggatagccacaccatctacttcctgggccttgcactcctgggctggggactcgtgtttgtgctctccagcttctatgcactggggttcactgggacctttctaggtgactactttgggatcctcaaggagtccagagtgaccacatttcccttcagcgtgctggacaaccccatgtactggggaagtacagccaactacctaggctgggcacttatgcacgccagccctacaggcctgctgttgacggtgctggtggcactcgtctacgtggttgctctcctgtttgaagagcccttcactgcggagatctaccggcggaaagccaccaggttgcacaaaaggagctga

SEQ ID NO: 41499 - protein, 199 aa, Rattus norvegicus
MSWLLGYVDPTEPSFVAAVLTIVFNPLFWNVVARWEQRTRKLSRAFGSPYLACYSLGSIILLLNILRSHCFTQAMMSQPKMEGLDSHTIYFLGLALLGWGLVFVLSSFYALGFTGTFLGDYFGILKESRVTTFPFSVLDNPMYWGSTANYLGWALMHASPTGLLLTVLVALVYVVALLFEEPFTAEIYRRKATRLHKRS

SEQ ID NO: 41500 - DNA, 711 bp, Homo sapiens
  CDS (1)..(711)
atgaagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacatagtggctctcctatacgaagagcccttcaccgctgagatctaccggcagaaagcctccgggtcccacaagaggagctga

SEQ ID NO: 41501 - protein, 236 aa, Homo sapiens
MKRSGNPGAEVTNSSVAGPDCCGGLGNIDFRQADFCVMTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIVALLYEEPFTAEIYRQKASGSHKRS

SEQ ID NO: 41502 - DNA, 600 bp, Bos taurus
  CDS (1)..(600)
atgacccggctgcttggctacgtggacctctcggaaccccactttgtggctgctgtccttgccattgtcttcaatccgctcttctggaatgtggttgcgagatgggaacacaagacccgaaagctgagcaaggcctttgggtccccccgcctggcctgttacaccctgggtggggccatcctgctcttgaacgtcctgcgctcccactgcttcacgcaggccatgctgagccagccccggatgcagagcctggacaaccccgcggtctaccacgtgggcctggcactcctgggagtgggtggcgtgttcgtcctttccagtttcctggcgctgggcttcaccgggaccttcctaggcgactacttcgggatcctcaaggaggccagagtgaccatgttcccgttcagcgtcctggacaaccccatgtactggggcagcacagccatctacctgggctgggccattgtgcacgccagccccaccggcctgctgctgaccgcgctggtggcgctcatctacatggtcgccatcgtgtatgaagagcccttcactgccgaaatctatcagcagaaagcctcccaggcctacaagaggagctga

SEQ ID NO: 41503 - protein, 199 aa, Bos taurus
MTRLLGYVDLSEPHFVAAVLAIVFNPLFWNVVARWEHKTRKLSKAFGSPRLACYTLGGAILLLNVLRSHCFTQAMLSQPRMQSLDNPAVYHVGLALLGVGGVFVLSSFLALGFTGTFLGDYFGILKEARVTMFPFSVLDNPMYWGSTAIYLGWAIVHASPTGLLLTALVALIYMVAIVYEEPFTAEIYQQKASQAYKRS

SEQ ID NO: 41504 - DNA, 690 bp, Danio rerio
  CDS (1)..(690)
atgagcggagagtcgctgctggacagaaaacccgcaccggactgttgtggaggattcaataacctggagttcagtcagatggacgtgtctgtgctttgggagctgtggagcctcgttgacctgacggagcccaggttttgtgtggccgttattgccattatcttcaatccgttcttctggaatgtggttgcccgatgggagcacaggactcgtggtctgacccgtctgtttggtgggccatatgtggcctgttattcgctggccgtcctaatcctgctgctcaatgtttaccggagccacagcgtgacggtggccatgaagggtcaatctcgctgggatctgctggaaaacctgcaggtttattatgccggagcggctctgatggccgtcggttctctgttggtcatcagcagttttctggccctcggcgtcacaggaacatttctgggggattatttcggcattctgatggatcagaaggtgactggtttcccttttaatgtgatggacaatcccatgtactggggcagcactgcaaactacctgggcctggcattaatgaacgccagtcctatcgggatcgtcctgactgcagtggtggctttgtcttacaaagtagcgatcgcatatgagggaccgttcacacaggagatctacaggcagaggagtcaacgctgcaaacacaaatga

SEQ ID NO: 41505 - protein, 229 aa, Danio rerio
MSGESLLDRKPAPDCCGGFNNLEFSQMDVSVLWELWSLVDLTEPRFCVAVIAIIFNPFFWNVVARWEHRTRGLTRLFGGPYVACYSLAVLILLLNVYRSHSVTVAMKGQSRWDLLENLQVYYAGAALMAVGSLLVISSFLALGVTGTFLGDYFGILMDQKVTGFPFNVMDNPMYWGSTANYLGLALMNASPIGIVLTAVVALSYKVAIAYEGPFTQEIYRQRSQRCKHK

SEQ ID NO: 41506 - DNA, 636 bp, Eremothecium gossypii
  CDS (1)..(636)
atgggtatcaaggatctcaagctcaatgacatgctgctggacgcagtcgcggacatcaatggcgacgatcgcgacttccgcatggcggtgttcttcattgtgttcaacccgttgttctggaacatcgtggcgcaggtcgagtacaagacgcacttcttgacgcggctggccggcggcgcgcggcgcgggtgctacgcgctggcgtttgtgatcttctcgctcgggctggtacgcgactactacttcagtcgcgcgctgaaaaaccaggtcaccacggcgtggctcgaccaggacgcagtgcgctacgcgggcgcggggctgttcgtgttcgggcaggtgctggtcctgtcgtccatgtggcggctgggcgtgacgggcacgtacctgggcgactacttcgggatcttgatggaggaccgcgtgacgtcgttccccttcaatgtctccgacaaccccatgtaccagggctccacgctgacgtttctcgggacgtcgctgtactacggaaaggccgccggcgtgtttgccgcgctgctggtcaacctgatgtataccatggccctgaagctggaggaaccgttcacggccatgatttacgccaagcgcgacgaggagcgcgcccagaaggccaaatag

SEQ ID NO: 41507 - protein, 211 aa, Eremothecium gossypii
MGIKDLKLNDMLLDAVADINGDDRDFRMAVFFIVFNPLFWNIVAQVEYKTHFLTRLAGGARRGCYALAFVIFSLGLVRDYYFSRALKNQVTTAWLDQDAVRYAGAGLFVFGQVLVLSSMWRLGVTGTYLGDYFGILMEDRVTSFPFNVSDNPMYQGSTLTFLGTSLYYGKAAGVFAALLVNLMYTMALKLEEPFTAMIYAKRDEERAQKAK

SEQ ID NO: 41508 - DNA, 600 bp, Sus scrofa
  CDS (1)..(600)
atgaccaggttgctgggctacgtggacccctctgatgcccgcttcgtggctgcggttctcaccatcgctttcaatccactcttctggaatgtggtcgccagatgggaacacaagacccgcaagctgagcagggccttcgggtcaccccgcctggcctgctacaccctgggcggcgccatcctgctcctcaacttactgcgctcccactgcttcacgcaggccatgctgagccagccccagatggagagcctgggcggccccacgggctaccgcctgggcctggcgctcctgggcgtgggcagcgtcttcgtactttccagtttcctggcgctgggcttcaccgggaccttcctaggcgactacttcgggatcctcatggaggcgagagtgacccggttcccgttcagcgtcctggacaaccccatgtactggggcagcacggccgtctacctgggctgggccctcatgcacgccagccccaccggcctgctgctgacgctggtggtggctgccatctacaagctcgccatcctgttcgaggagcccttcaccgccgagatctaccggcagagaggctcccaggcccgcaagagaagctga

SEQ ID NO: 41509 - protein, 199 aa, Sus scrofa
MTRLLGYVDPSDARFVAAVLTIAFNPLFWNVVARWEHKTRKLSRAFGSPRLACYTLGGAILLLNLLRSHCFTQAMLSQPQMESLGGPTGYRLGLALLGVGSVFVLSSFLALGFTGTFLGDYFGILMEARVTRFPFSVLDNPMYWGSTAVYLGWALMHASPTGLLLTLVVAAIYKLAILFEEPFTAEIYRQRGSQARKRS

SEQ ID NO: 41510 - DNA, 645 bp, Neurospora crassa
  CDS (1)..(645)
atgcctctcgtcgccctaggtgtcgccgacctgttcaactttgttgactacagcaagacaagcctcgccatctctgctgctgccattgccttcaaccctaccttctggaacatcgttgcccgcagagaataccgcaccaagttcctcacgcgcgctttcggcggcaatgcccaggtagcctgctacttcctggccgtcaccatcttcggcctcggtcttgtccgcgacttcctctacgaacgcgctctccgtgaccagccctcccacccgctcctcgagggcacctatgtcaaatacgccgcctatgccctccttgccctcggcaaccttctcgtcatcacctctacaatgcgtctgggtatcacgggaaccttccttggtgactactttggcattctgatggatggcattgtcaccggcttccccttcaacgttaccagcgctcccatgtactacggctccaccatgagcttcctcggcaccgctcttctctacggcaagcccgctggtctccttttgactgcctgggttctctttgtgtacataatcgctatccaattcgagaaccccttcactgccgaaatctatgccaagcgcgaccgcgagagggccaaggctgccggtaccagcaagaaggagctttaa

SEQ ID NO: 41511 - protein, 214 aa, Neurospora crassa
MPLVALGVADLFNFVDYSKTSLAISAAAIAFNPTFWNIVARREYRTKFLTRAFGGNAQVACYFLAVTIFGLGLVRDFLYERALRDQPSHPLLEGTYVKYAAYALLALGNLLVITSTMRLGITGTFLGDYFGILMDGIVTGFPFNVTSAPMYYGSTMSFLGTALLYGKPAGLLLTAWVLFVYIIAIQFENPFTAEIYAKRDRERAKAAGTSKKEL

SEQ ID NO: 41512 - DNA, 672 bp, Gibberella zeae PH-1
  CDS (1)..(672)
atgggtatcatggctcttggtccacaagatttcctcgactatgtcaactatgacaagcagagcttgtacatctcagctgcatccattgcctttaacccgctgttctggaatatcgtcgctcgtcaagaataccacaataagcttctgacaaagctctttggtggaaactcccaagttgcctgctatgccctcgccttcaccatcttttctctgggtatggttcgcgacttagttttcaagaatgccatctctgaacaacctacgcatcccgcccttgtcaacgactacatgcgggctgctgctgccactctctttgctgtcggcaatatcttggtcgtctcctcgacttggcgacttggcattactggtacattcctcggtgactactttggctttcttatggatgagatggtgactggctttcccttcaacgtgactggctctcccatgtacactggctctacctgcagtttccttgctacctctctgtggtatggcaagcctgctggtgttctgctcaccatctgggtcgacattgtctacaagctcgccctgagatacgaggatcccttcacttctgagatctacgctaagcgtgagcgtgagcgtgctgcgggctggcacgggaaagctacgcctttcaacaggccgggtgcctctcaacaggcttaa

SEQ ID NO: 41513 - protein, 223 aa, Gibberella zeae PH-1
MGIMALGPQDFLDYVNYDKQSLYISAASIAFNPLFWNIVARQEYHNKLLTKLFGGNSQVACYALAFTIFSLGMVRDLVFKNAISEQPTHPALVNDYMRAAAATLFAVGNILVVSSTWRLGITGTFLGDYFGFLMDEMVTGFPFNVTGSPMYTGSTCSFLATSLWYGKPAGVLLTIWVDIVYKLALRYEDPFTSEIYAKRERERAAGWHGKATPFNRPGASQQA

SEQ ID NO: 41514 - DNA, 714 bp, Ustilago maydis 521
  CDS (1)..(714)
atgtcggccctttttcacaagtcgagcgcatatgtggtgtccaacgtggttgatctgacgcaaccttcgttgtggatcgctgttggaagcatctgctttaacccgctctactggaacattgtggcacagaacgagtaccacaacaagacgatcaccaagttgctcggcggacgacgctacctcggatgctacctgctcgccgtctccattttttcgcttggcattctgcgtgaccatctgtacaacctcgcactcaaggatcagccgacgcatgccttgttgcaacaggcgtgggtcaagcctgtcgctgctctgctctttgcttcgggtaacatctttgtgctttcgtccatgtgggcgctcggtgtcacgggcacctacttgggtgactactttggtatccttatggacagcatcgtcacgggctttcctttcaacgtgatggccaaccccatgtactggggtagctcgatgagcttcaccgcggttgcgctgtggtttggcaaacctgctggactgctgctcagtgtcctggtggtgatcgtctatgcgctcgctctgcgcttcgaggaaccgtttaccgccaacatctacaagcaggccgagaagaagaggagggctgaagccgaaaagcaagcgttgatcgagagtcaaggtcctgcctctggcacgcgcaaccgaagcaaaaggacgccatccaagcccaacgcctaa

SEQ ID NO: 41515 - protein, 237 aa, Ustilago maydis 521
MSALFHKSSAYVVSNVVDLTQPSLWIAVGSICFNPLYWNIVAQNEYHNKTITKLLGGRRYLGCYLLAVSIFSLGILRDHLYNLALKDQPTHALLQQAWVKPVAALLFASGNIFVLSSMWALGVTGTYLGDYFGILMDSIVTGFPFNVMANPMYWGSSMSFTAVALWFGKPAGLLLSVLVVIVYALALRFEEPFTANIYKQAEKKRRAEAEKQALIESQGPASGTRNRSKRTPSKPNA

SEQ ID NO: 41516 - DNA, 654 bp, Candida glabrata CBS138
  CDS (1)..(654)
atgtttggtgctgactttgtagaggataaagttatccagtttgagaatttcgttgaagggctaatgtactctgtggattacgatgctccatacttctactctgcgttacttttcattatatttaacccattgttttggaatatagtggcaaggctggaataccacacacatttcctaaccaagattgctggttcgccaaagagaggctgttatttccttgcagccaccatattttctctaggtattgctagagatttgacatttgaaaaggcattgagacatcaagaagtctccccattgttagacaccccaaaaatcacaaatatcgggtacgcgtttttaattgtgggccaaatactagtgatttcctcaatgtaccagttgggtatcacgggtacttacttgggtgactatttcggtattttaatgaatgacagagtaacagcttttccatttaatgtttccaataacccaatgtaccaaggttctacattttctttcatcggtacttcgctaattgctggtaaaccagcaggattgattttggcattctttgtacatgccatgtactacatggctctaaagtttgaggaaccatttacagctgaaatctatgcaaagcgtgatgaggagaaaaagtctaagaaacaataa

SEQ ID NO: 41517 - protein, 217 aa, Candida glabrata CBS138
MFGADFVEDKVIQFENFVEGLMYSVDYDAPYFYSALLFIIFNPLFWNIVARLEYHTHFLTKIAGSPKRGCYFLAATIFSLGIARDLTFEKALRHQEVSPLLDTPKITNIGYAFLIVGQILVISSMYQLGITGTYLGDYFGILMNDRVTAFPFNVSNNPMYQGSTFSFIGTSLIAGKPAGLILAFFVHAMYYMALKFEEPFTAEIYAKRDEEKKSKKQ

SEQ ID NO: 41518 - DNA, 657 bp, Kluyveromyces lactis NRRL Y-1140
  CDS (1)..(657)
atggatatcgaaacttatattaccaatcagttttctcttttcaagagattctgtgatgaaatcgtcacactaaccaatttcgaatctagagagtatacaatcgctctaggtttgattgcgttcaacccaatcttctggaacgtcgttgccagattggaacacagcacccatttcttgactaagatcgctggttccgctaagagaggatgttatttcctagcagctacaattttctccttgggtatcatcagagactatttctatgaatctgcattgcgccaacaaccagtcagtgccatgatgactggtgacaaatttacctatgtcggtatcgcatatatcgcatttggtcaattgctggttttaagctctatgtaccagttggggatcaccggtacttatctaggtgattatttcggtattctaatggaccaccgtgtgaccagcttcccattcaactatttcgataatccaatgtaccaaggttctactttcactttccttggttacgcattgtacaacggtaaacctgctggtttgattgccactttggttgttcacgtgatgtacaacatcgcattaagattcgaagagccattcactgccaagatttatgccaagcgtgcagctgaagatgctaacaagaagggcaattga

SEQ ID NO: 41519 - protein, 218 aa, Kluyveromyces lactis NRRL Y-1140
MDIETYITNQFSLFKRFCDEIVTLTNFESREYTIALGLIAFNPIFWNVVARLEHSTHFLTKIAGSAKRGCYFLAATIFSLGIIRDYFYESALRQQPVSAMMTGDKFTYVGIAYIAFGQLLVLSSMYQLGITGTYLGDYFGILMDHRVTSFPFNYFDNPMYQGSTFTFLGYALYNGKPAGLIATLVVHVMYNIALRFEEPFTAKIYAKRAAEDANKKGN

SEQ ID NO: 41520 - DNA, 627 bp, Debaryomyces hansenii CBS767
  CDS (1)..(627)
atgaattttagtgacgtacaacacttagttggaaattttagtgattacattgtggtcaattgtgaaattaagtacgcaattgcatgcattgcctttaatcctattttctggaacattgttgcaagaaccgaatataaaacacatttccttaccaaaataactggatctgctaaagtcggatgctatttgttggcattgaccattttcagtttagggatttacagggataatgtataccatcaagcattgctcaatcaaccaacttacggccctctcttgaagtccaaccttgtcaaggccttagccataggtactttcggctttggaaatgtcttggtcttatcatctatgtatgtgttgggtgttacaggtacataccttggggattactttgggatcttgatggacgatcgtgttacaggattcccatttaacattaacgacaatcctatgtacaatggatccacattatgtttcttgggtactgctttatggtacggtaaaccaaccggtattgctattgctggatttgtatatgtcatgtacaaaatagccttattttttgaagagccatttactgcaaagatttacgccaacagagacaagcaatccaagaaagtacaatag

SEQ ID NO: 41521 - protein, 208 aa, Debaryomyces hansenii CBS767
MNFSDVQHLVGNFSDYIVVNCEIKYAIACIAFNPIFWNIVARTEYKTHFLTKITGSAKVGCYLLALTIFSLGIYRDNVYHQALLNQPTYGPLLKSNLVKALAIGTFGFGNVLVLSSMYVLGVTGTYLGDYFGILMDDRVTGFPFNINDNPMYNGSTLCFLGTALWYGKPTGIAIAGFVYVMYKIALFFEEPFTAKIYANRDKQSKKVQ

SEQ ID NO: 41522 - DNA, 630 bp, Yarrowia lipolytica CLIB99
  CDS (1)..(630)
tcccctagccaccgatctagcaccccacgccagggccacaaccctcccttaaacataactaacacagtcgtcctgggctccatcgccttcaaccccatcttttggaacattgttgctcgagccgagtacaacacccactttctgactaagctggctggaggagccaagaccggatgctatctgctggccatcaccattttctcgctcggtatcttccgagactacctttaccaccaggctcttgagcagcagcccacctccattctgctgtcggtcacttacgttgacattgtcaagcctctggccattgtgctgtttgctgttggcaacgtgctggtccttacctccatgtacgccctgggcgtcaccggaacctacctcggcgactactttggcattctcatgaacgagcgagtcaccggcttccccttcaatgtgtccaacaaccccatgtaccacggctccactctgtgtttcctggcttccgctctgtggtacgccaagcccgcaggcctgctcatcaccgcctttgtgtcgctcatgtactccattgctctcaagttcgaggaacccttcaccggtgagatctacgctaagcgagaccgggagctcgctgccaagcagaagtaa

SEQ ID NO: 41523 - protein, 209 aa, Yarrowia lipolytica CLIB99
SPSHRSSTPRQGHNPPLNITNTVVLGSIAFNPIFWNIVARAEYNTHFLTKLAGGAKTGCYLLAITIFSLGIFRDYLYHQALEQQPTSILLSVTYVDIVKPLAIVLFAVGNVLVLTSMYALGVTGTYLGDYFGILMNERVTGFPFNVSNNPMYHGSTLCFLASALWYAKPAGLLITAFVSLMYSIALKFEEPFTGEIYAKRDRELAAKQK

SEQ ID NO: 41524 - DNA, 732 bp, Gallus gallus
  CDS (1)..(732)
atggcggggaggcccaggccgggaggcgagcgggggcaggcaggaggccggcggggagcggggttgcggtggtggccgcgggattgctgcagcgggctgggcggcctggattacagcgaggtggatgtgacagccatggcgcggctcttcagctatgtggatatgactgattctggcttcattgcagccgtcctctctatcgccttcaacccattcttctggaatgtggtagcaagatgggagcacaaaacgcgggcactcagccgaggcttcggctctccacacaccgcctgctactgcctgggcgctgttatcctgctgctcaactgcgtgtgcagccactgcttcacagaagccatgaagagccagccgaagctggagggcttggacagccactgggcctattactcaggcttggccatcatggctgtagggaccttgtttgtcatctccagcttcttagcactgggattcaccgggaccttcctaggggattactttggcatcctgatggaggcgaaagtgacctgtttccccttcagcatcctggataaccccatgtactggggcagcacggccgtctacctgggctggtccctcatgcatgcgagcccagctggccttttgctgacagctgtagtggcaatttcctacacaattgcagtgctgtacgaggggcctttcacagaggaaatctaccgtcagaaacagaagggagcaaagagcaattag

SEQ ID NO: 41525 - protein, 243 aa, Gallus gallus
MAGRPRPGGERGQAGGRRGAGLRWWPRDCCSGLGGLDYSEVDVTAMARLFSYVDMTDSGFIAAVLSIAFNPFFWNVVARWEHKTRALSRGFGSPHTACYCLGAVILLLNCVCSHCFTEAMKSQPKLEGLDSHWAYYSGLAIMAVGTLFVISSFLALGFTGTFLGDYFGILMEAKVTCFPFSILDNPMYWGSTAVYLGWSLMHASPAGLLLTAVVAISYTIAVLYEGPFTEEIYRQKQKGAKSN

SEQ ID NO: 41526 - DNA, 612 bp, Xenopus laevis
  CDS (1)..(612)
atggcagacgtgctgcagtacgtggtgctgacggacttccattttcttgttgctttgctctgtatagtcttcaatcctttgttctggaatgtggttgcaagatgggagtaccggactcacaccatcactaggctgtttgggtctccgtacattgggtgctacagtttgggtgtagtcattattttccttgccgtcctacggagtcactgttttacagaagccatgaagaatcagtcccatctaggggcgctggagaacactggcgtttattacctgagctggatgttgattggcgcaggcggagtgctggtggtttccagtttcctggcactgggttttgtcggaacctatttgggagactactttgggattttaatggaaaagaaggtgaccggcttcccttttaacatcatggaaaatccgatgtactggggcagcactgccaactacctgggactggccctcttgaactccagtcccgccggcctcgtcctcacagcggtggtggctctgtgctacaaggtggccattttgtatgaggggccttttacagtggaaatctaccgcaagaaagattctgcaaagaagaaaaaaccagggaaactgcaatga

SEQ ID NO: 41527 - protein, 203 aa, Xenopus laevis
MADVLQYVVLTDFHFLVALLCIVFNPLFWNVVARWEYRTHTITRLFGSPYIGCYSLGVVIIFLAVLRSHCFTEAMKNQSHLGALENTGVYYLSWMLIGAGGVLVVSSFLALGFVGTYLGDYFGILMEKKVTGFPFNIMENPMYWGSTANYLGLALLNSSPAGLVLTAVVALCYKVAILYEGPFTVEIYRKKDSAKKKKPGKLQ

SEQ ID NO: 41528 - DNA, 597 bp, Xenopus tropicalis
  CDS (1)..(597)
atggcagaactgttggagtacgtggtgctgacggacacccgttttctcattgctttactctgtatagtcttcaatcctttgttctggaatttggttgccagatgggagtatcggacccacaccatcactaggctatttggctctccgtacattgggtgctacagtctgggcgtagtcattatttccttagccgtcctacggagtcactgttttacagaagccatgaagactcagccccacataggggcgctggagagcactggtgtctattacctgagctggatgttgattggtgctggaggggtgttggtggtttccagttttctggcgctgggttttgttggaacctatttgggagactattttggaattttaatggaaaagaaggtgaccggcttcccatttaacgtcatggagaatccgatgtactggggcagcactgcaaactacctgggattggccctcttgaacgccagtcctgccggcctcctcctcacagccctggtggctctgtgttacaaggtggccattttgtatgagggaccttttaccgaggaaatctaccgcaagaaagagacagcaaagaagcgaaaatga

SEQ ID NO: 41529 - protein, 198 aa, Xenopus tropicalis
MAELLEYVVLTDTRFLIALLCIVFNPLFWNLVARWEYRTHTITRLFGSPYIGCYSLGVVIISLAVLRSHCFTEAMKTQPHIGALESTGVYYLSWMLIGAGGVLVVSSFLALGFVGTYLGDYFGILMEKKVTGFPFNVMENPMYWGSTANYLGLALLNASPAGLLLTALVALCYKVAILYEGPFTEEIYRKKETAKKRK

SEQ ID NO: 41530 - DNA, 600 bp, Homo sapiens
  CDS (1)..(600)
atgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcgtcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccacgcccacgggcctgctcctgacggtgctgatggccctcacctacatagtggctctcctatacgaagagcccttcaccgctgagatctaccggcagaaagcctccgggtcccacaagaggagctga

SEQ ID NO: 41531 - protein, 199 aa, Homo sapiens [sequence omitted]

SEQ ID NO: 41532 - DNA, 612 bp, Mus musculus
  CDS (1)..(612)
atgagctggctgctgggttacatggaccccacagagcccagctttgtggcggctgtgatcaccattgtgttcaacccactcttctggaatgtggtagcgagatgggagcagagaactcggaagctgagcagagccttcggctccccccacctagcctgctattccctgggcatctgcatcctgcttttgaacatcctccgctcccactgcttcacacaggctatgatgagccagcccaagatggagggcctggacaaccacaccacctacttcctgggccttgcattcctaggttggggattcgtgtttgtgctgtccagcttctatgcactggggttcactgggacctttctaggtgactactttgggatcctcaaggagtccagagtgaccacatttcccttcagcgtgctggataaccccatgtactggggcagtacagccaactacctaggctgggcactcatgcatgctagtcccacaggcctgctgttgacggtgctggtggcaattgtctacgtggttgctctcctatatgaagagcccttcactgctgagatctaccgacagaaagctaccaggtttgcacaaaagaagctgacagggccatga

SEQ ID NO: 41533 - protein, 203 aa, Mus musculus
MSWLLGYMDPTEPSFVAAVITIVFNPLFWNVVARWEQRTRKLSRAFGSPHLACYSLGICILLLNILRSHCFTQAMMSQPKMEGLDNHTTYFLGLAFLGWGFVFVLSSFYALGFTGTFLGDYFGILKESRVTTFPFSVLDNPMYWGSTANYLGWALMHASPTGLLLTVLVAIVYVVALLYEEPFTAEIYRQKATRFAQKKLTGP

SEQ ID NO: 41534 - DNA, 711 bp, Homo sapiens
  CDS (1)..(711)
atgaagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcatcaccatcctgctcctgaacttcctgcgctcgcactgcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacataatggctctcctatacgaagagcccttcaccgctgagatctaccggcagaaagcctccgggtcccacaagaggagctga

SEQ ID NO: 41535 - protein, 236 aa, Homo sapiens [sequence omitted]

SEQ ID NO: 41536 - DNA, 666 bp, Schizosaccharomyces pombe
  CDS (1)..(666)
atgagcttgattctttaccccaaaccaacttcgtatttatatcaaccttttataaaagcatatttttcgctaaacatggccatttttgaaatcaataattcttttttaatttgtgctgtatctattgctttgaaccctctgctatggaatattgctgcacgttcagaatacaatcataagactttgaccaaattggcaaatggcgactctaagaaggcctgttacatgctagcagcttgtatttttgttgccggaatagttcgtgacttaatttatcagaatgctttaaaacaacaacctacgctaggtatcttcatgaaccctcttgtgcagggtatagctaagctcattttttgttttggcagcgtccttgtcttatcgagtatgtataagctaggacttgttggtacatatcttggtgattactttggatttctgcttccagagcgtgtttctggtttcccatttaatgtcaacgataacccaatgtacaacggttctactctttgtttcctttctacagctctgcgttatggaaaagttgctggcctccttttaactttggaagtctttttcgtttatagaatagctttgaaatttgaagaaccttttactgctaaaatttacgctgctcgtgatagcaagcaagctaaaaaatccgagtga

SEQ ID NO: 41537 - protein, 221 aa, Schizosaccharomyces pombe
MSLILYPKPTSYLYQPFIKAYFSLNMAIFEINNSFLICAVSIALNPLLWNIAARSEYNHKTLTKLANGDSKKACYMLAACIFVAGIVRDLIYQNALKQQPTLGIFMNPLVQGIAKLIFCFGSVLVLSSMYKLGLVGTYLGDYFGFLLPERVSGFPFNVNDNPMYNGSTLCFLSTALRYGKVAGLLLTLEVFFVYRIALKFEEPFTAKIYAARDSKQAKKSE

SEQ ID NO: 41538 - DNA, 24 bp, Artificial sequence
  (1)..(24): primer
atgaaggagtcagtccaagagatc

SEQ ID NO: 41539 - DNA, 26 bp, Artificial sequence
  (1)..(26): primer
ttacatattctttttggccttatcac

SEQ ID NO: 41540 - protein, 192 aa, Artificial sequence
  Variant (2)..(4): xaa in position 2 to 4 is any amino acid
  Variant (6)..(14): xaa in position 6 to 14 is any amino acid
  Variant (17)..(18): xaa in position 17 to 18 is any amino acid
  Variant (20)..(20): xaa in position 20 is any amino acid
  Variant (32)..(32): xaa in position 32 is any amino acid
  Variant (35)..(35): xaa in position 35 is any amino acid
  Variant (37)..(38): xaa in position 37 to 38 is any amino acid
  Variant (42)..(43): xaa in position 42 to 43 is any amino acid
  Variant (45)..(48): xaa in position 45 to 48 is any amino acid
  Variant (49)..(49): xaa in position 49 is any or no amino acid
  Variant (53)..(53): xaa in position 53 is any amino acid
  Variant (56)..(57): xaa in position 56 to 57 is any amino acid
  Variant (59)..(60): xaa in position 59 to 60 is any amino acid
  Variant (62)..(62): xaa in position 62 is any amino acid
  Variant (66)..(68): xaa in position 66 to 68 is any amino acid
  Variant (70)..(71): xaa in position 70 to 71 is any amino acid
  Variant (74)..(75): xaa in position 74 to 75 is any amino acid
  Variant (78)..(81): xaa in position 78 to 81 is any amino acid
  Variant (82)..(84): xaa in position 82 to 84 is any or no amino acid
  Variant (86)..(93): xaa in position 86 to 93 is any amino acid
  Variant (95)..(96): xaa in position 95 to 96 is any amino acid
  Variant (98)..(98): xaa in position 98 is any amino acid
  Variant (100)..(100): xaa in position 100 is any amino acid
  Variant (102)..(102): xaa in position 102 is any amino acid
  Variant (104)..(104): xaa in position 104 is any amino acid
  Variant (109)..(111): xaa in position 109 to 111 is any amino acid
  Variant (114)..(115): xaa in position 114 to 115 is any amino acid
  Variant (127)..(127): xaa in position 127 is any amino acid
  Variant (129)..(129): xaa in position 129 is any amino acid
  Variant (133)..(133): xaa in position 133 is any amino acid
  Variant (137)..(137): xaa in position 137 is any amino acid
  Variant (139)..(140): xaa in position 139 to 140 is any amino acid
  Variant (145)..(145): xaa in position 145 is any amino acid
  Variant (149)..(150): xaa in position 149 to 150 is any amino acid
  Variant (154)..(154): xaa in position 154 is any amino acid
  Variant (157)..(158): xaa in position 157 to 158 is any amino acid
  Variant (160)..(160): xaa in position 160 is any amino acid
  Variant (162)..(162): xaa in position 162 is any amino acid
  Variant (168)..(169): xaa in position 168 to 169 is any amino acid
  Variant (171)..(173): xaa in position 171 to 173 is any amino acid
  Variant (175)..(175): xaa in position 175 is any amino acid
  Variant (179)..(179): xaa in position 179 is any amino acid
  Variant (182)..(182): xaa in position 182 is any amino acid
  Variant (186)..(187): xaa in position 186 to 187 is any amino acid
  Variant (190)..(191): xaa in position 190 to 191 is any amino acid
LXXXVXXXXXXXXXAVXXIXFNPLFWNVVARXEYXTXXLTRXXGXXXXXACYXLAXXIXXLXILRXXXFXXAMXXQPXXXXXXXLXXXXXXXXGXXLXGXGXVXVLSSXXXLGXXGTFLGDYFGILXEXRVTXFPFXVXXNPMYXGSTXXYLGXALXXAXPXGLLLTXXVXXXYXVALXYEXPFTXXIYXXR

SEQ ID NO: 41541 - protein, 21 aa, Artificial sequence
  Variant (2)..(2): xaa in position 2 is any amino acid
  Variant (6)..(6): xaa in position 6 is any amino acid
  Variant (7)..(7): xaa in position 7 is Phe or Tyr
  Variant (10)..(10): xaa in position 10 is Ile, Leu or Val
  Variant (14)..(14): xaa in position 14 is any amino acid
  Variant (16)..(17): xaa in position 16 to 17 is any amino acid
  Variant (18)..(18): xaa in position 18 is Asn or Thr
  Variant (19)..(19): xaa in position 19 is His, Lys or Arg
  Variant (20)..(20): xaa in position 20 is any amino acid
  Variant (21)..(21): xaa in position 21 is Ile or Leu
IXFNPXXWNXVARXEXXXXXX

SEQ ID NO: 41542 - protein, 26 aa, Artificial sequence
  Variant (3)..(3): xaa in position 3 is any amino acid
  Variant (5)..(5): xaa in position 5 is Ala, Gly or Ser
  Variant (6)..(6): xaa in position 6 is any amino acid
  Variant (7)..(7): xaa in position 7 is Ala, Cys, Ser, Thr or Val
  Variant (9)..(9): xaa in position 9 is Phe, Ile or Leu
  Variant (10)..(10): xaa in position 10 is any amino acid
  Variant (12)..(12): xaa in position 12 is Ala, Gly or Asn
  Variant (13)..(13): xaa in position 13 is Phe, Ile, Leu, Met or Val
  Variant (14)..(14): xaa in position 14 is any amino acid
  Variant (16)..(16): xaa in position 16 is Asp or Ser
  Variant (17)..(18): xaa in position 17 to 18 is any amino acid
  Variant (19)..(19): xaa in position 19 is Phe or Tyr
  Variant (20)..(21): xaa in position 20 to 21 is any amino acid
  Variant (23)..(23): xaa in position 23 is Ile, Leu or Met
  Variant (24)..(25): xaa in position 24 to 25 is any amino acid
CYXLXXXIXXLXXXRXXXXXXAXXXQ

SEQ ID NO: 41543 - protein, 47 aa, Artificial sequence
  Variant (2)..(4): xaa in position 2 to 4 is any amino acid
  Variant (6)..(6): xaa in position 6 is Ile, Leu or Val
  Variant (9)..(9): xaa in position 9 is Phe or Met
  Variant (10)..(11): xaa in position 10 to 11 is any amino acid
  Variant (14)..(14): xaa in position 14 is Phe, Ile or Val
  Variant (15)..(15): xaa in position 15 is Ala, Thr or Val
  Variant (18)..(18): xaa in position 18 is Phe or Tyr
  Variant (27)..(27): xaa in position 27 is any amino acid
  Variant (28)..(28): xaa in position 28 is Asp, Glu or Asn
  Variant (29)..(30): xaa in position 29 to 30 is any amino acid
  Variant (33)..(33): xaa in position 33 is any amino acid
  Variant (37)..(37): xaa in position 37 is Asn or Ser
  Variant (38)..(39): xaa in position 38 to 39 is any amino acid
  Variant (40)..(40): xaa in position 40 is Ala, Asp, Glu or Asn
  Variant (45)..(45): xaa in position 45 is any amino acid
GXXXVXSSXXXLGXXGTXLGDYFGILXXXXVTXFPFXXXXNPMYXGS

SEQ ID NO: 41544 - protein, 29 aa, Artificial sequence
  Variant (3)..(5): xaa in position 3 to 5 is any amino acid
  Variant (6)..(7): xaa in position 6 to 7 is any or no amino acid
  Variant (9)..(11): xaa in position 9 to 11 is any amino acid
  Variant (12)..(13): xaa in position 12 to 13 is any or no amino acid
  Variant (15)..(15): xaa in position 15 is any amino acid
  Variant (16)..(16): xaa in position 16 is Ile, Leu, Met or Val
  Variant (18)..(18): xaa in position 18 is Ile, Leu or Val
  Variant (19)..(19): xaa in position 19 is any amino acid
  Variant (20)..(20): xaa in position 20 is Phe, Trp or Tyr
  Variant (22)..(22): xaa in position 22 is Glu, Gly or Asn
  Variant (26)..(27): xaa in position 26 to 27 is any amino acid
GLXXXXXVXXXXXYXXAXXXEXPFTXXIY

SEQ ID NO: 41545 - DNA, 1518 bp, Saccharomyces cerevisiae; identical to SEQ ID NO: 2533
  CDS (1)..(1518)

SEQ ID NO: 41546 - protein, 505 aa, Saccharomyces cerevisiae; identical to SEQ ID NO: 2534

SEQ ID NO: 41547 - DNA, 1548 bp, Mus musculus (house mouse); identical to SEQ ID NO: 2535
  CDS (1)..(1548)

SEQ ID NO: 41548 - protein, 515 aa, Mus musculus (house mouse); identical to SEQ ID NO: 2536

SEQ ID NO: 41549 - DNA, 1593 bp, Fugu rubripes (Japanese pufferfish); identical to SEQ ID NO: 2537
  CDS (1)..(1593)

SEQ ID NO: 41550 - protein, 530 aa, Fugu rubripes (Japanese pufferfish); identical to SEQ ID NO: 2538

SEQ ID NO: 41551 - DNA, 1506 bp, Vibrio cholerae; identical to SEQ ID NO: 2539
  CDS (1)..(1506)

SEQ ID NO: 41552 - protein, 501 aa, Vibrio cholerae; identical to SEQ ID NO: 2540

SEQ ID NO: 41553 - DNA, 1470 bp, Pseudomonas aeruginosa; identical to SEQ ID NO: 2541
  CDS (1)..(1470)

SEQ ID NO: 41554 - protein, 489 aa, Pseudomonas aeruginosa; identical to SEQ ID NO: 2542

SEQ ID NO: 41555 - DNA, 1485 bp, Staphylococcus aureus; identical to SEQ ID NO: 2543
  CDS (1)..(1485)

SEQ ID NO: 41556 - protein, 494 aa, Staphylococcus aureus; identical to SEQ ID NO: 2544

SEQ ID NO: 41557 - DNA, 1488 bp, Streptococcus pneumoniae; identical to SEQ ID NO: 2545
  CDS (1)..(1488)

SEQ ID NO: 41558 - protein, 495 aa, Streptococcus pneumoniae; identical to SEQ ID NO: 2546

SEQ ID NO: 41559 - DNA, 1476 bp, Salmonella enterica subsp. enterica serovar Typhi; identical to SEQ ID NO: 2547
  CDS (1)..(1476)

SEQ ID NO: 41560 - protein, 491 aa, Salmonella enterica subsp. enterica serovar Typhi; identical to SEQ ID NO: 2548

SEQ ID NO: 41561 - DNA, 1476 bp, Agrobacterium tumefaciens; identical to SEQ ID NO: 2549
  CDS (1)..(1476)

SEQ ID NO: 41562 - protein, 491 aa, Agrobacterium tumefaciens; identical to SEQ ID NO: 2550

SEQ ID NO: 41563 - DNA, 1530 bp, Nostoc sp. PCC 7120; identical to SEQ ID NO: 2551
  CDS (1)..(1530)

SEQ ID NO: 41564 - protein, 509 aa, Nostoc sp. PCC 7120; identical to SEQ ID NO: 2552

SEQ ID NO: 41565 - DNA, 1386 bp, Agrobacterium tumefaciens; identical to SEQ ID NO: 2553
  CDS (1)..(1386)

SEQ ID NO: 41566 - protein, 461 aa, Agrobacterium tumefaciens; identical to SEQ ID NO: 2554

SEQ ID NO: 41567 - DNA, 1476 bp, Brucella melitensis; identical to SEQ ID NO: 2555
  CDS (1)..(1476)

SEQ ID NO: 41568 - protein, 491 aa, Brucella melitensis; identical to SEQ ID NO: 2556

SEQ ID NO: 41569 - DNA, 1458 bp, Zymomonas mobilis; identical to SEQ ID NO: 2557
  CDS (1)..(1458)

SEQ ID NO: 41570 - protein, 485 aa, Zymomonas mobilis; identical to SEQ ID NO: 2558

SEQ ID NO: 41571 - DNA, 1470 bp, Bacillus subtilis; identical to SEQ ID NO: 2559
  CDS (1)..(1470)

SEQ ID NO: 41572 - protein, 489 aa, Bacillus subtilis; identical to SEQ ID NO: 2560

SEQ ID NO: 41573 - DNA, 1401 bp, Mycobacterium tuberculosis; identical to SEQ ID NO: 2561
  CDS (1)..(1401)

SEQ ID NO: 41574 - protein, 466 aa, Mycobacterium tuberculosis; identical to SEQ ID NO: 2562

SEQ ID NO: 41575 - DNA, 1545 bp, Mycobacterium tuberculosis; identical to SEQ ID NO: 2563
  CDS (1)..(1545)

SEQ ID NO: 41576 - protein, 514 aa, Mycobacterium tuberculosis; identical to SEQ ID NO: 2564

SEQ ID NO: 41577 - DNA, 1320 bp, Chlamydia trachomatis; identical to SEQ ID NO: 2565
  CDS (1)..(1320)

SEQ ID NO: 41578 - protein, 439 aa, Chlamydia trachomatis; identical to SEQ ID NO: 2566

SEQ ID NO: 41579 - DNA, 1773 bp, Deinococcus radiodurans; identical to SEQ ID NO: 2567
  CDS (1)..(1773)

SEQ ID NO: 41580 - protein, 590 aa, Deinococcus radiodurans; identical to SEQ ID NO: 2568

SEQ ID NO: 41581 - DNA, 1467 bp, Pseudomonas aeruginosa; identical to SEQ ID NO: 2569
  CDS (1)..(1467)

SEQ ID NO: 41582 - protein, 488 aa, Pseudomonas aeruginosa; identical to SEQ ID NO: 2570

SEQ ID NO: 41583 - DNA, 1422 bp, Caulobacter crescentus; identical to SEQ ID NO: 2571
  CDS (1)..(1422)

SEQ ID NO: 41584 - protein, 473 aa, Caulobacter crescentus; identical to SEQ ID NO: 2572

SEQ ID NO: 41585 - DNA, 1437 bp, Borrelia burgdorferi (Lyme disease spirochete); identical to SEQ ID NO: 2573
  CDS (1)..(1437)

SEQ ID NO: 41586 - protein, 478 aa, Borrelia burgdorferi (Lyme disease spirochete); identical to SEQ ID NO: 2574

SEQ ID NO: 41587 - DNA, 1539 bp, Chlamydophila pneumoniae, Chlamydia pneumoniae; identical to SEQ ID NO: 2575
  CDS (1)..(1539)

SEQ ID NO: 41588 - protein, 512 aa, Chlamydophila pneumoniae, Chlamydia pneumoniae; identical to SEQ ID NO: 2576

SEQ ID NO: 41589 - DNA, 1476 bp, Escherichia coli; identical to SEQ ID NO: 2577
  CDS (1)..(1476)

SEQ ID NO: 41590 - protein, 491 aa, Escherichia coli; identical to SEQ ID NO: 2578

SEQ ID NO: 41591 - DNA, 1548 bp, Treponema pallidum subsp. pallidum (syphilis spirochete); identical to SEQ ID NO: 2579
  CDS (1)..(1548)

SEQ ID NO: 41592 - protein, 515 aa, Treponema pallidum subsp. pallidum (syphilis spirochete); identical to SEQ ID NO: 2580

SEQ ID NO: 41593 - DNA, 1476 bp, Buchnera sp; identical to SEQ ID NO: 2581
  CDS (1)..(1476)

SEQ ID NO: 41594 - protein, 491 aa, Buchnera sp; identical to SEQ ID NO: 2582

SEQ ID NO: 41595 - DNA, 1512 bp, Lactococcus lactis subsp. lactis; identical to SEQ ID NO: 2583
  CDS (1)..(1512)

SEQ ID NO: 41596 - protein, 503 aa, Lactococcus lactis subsp. lactis; identical to SEQ ID NO: 2584

SEQ ID NO: 41597 - DNA, 1572 bp, Drosophila melanogaster; identical to SEQ ID NO: 2585
  CDS (1)..(1572)

SEQ ID NO: 41598 - protein, 523 aa, Drosophila melanogaster; identical to SEQ ID NO: 2586

SEQ ID NO: 41599 - DNA, 1575 bp, Synechococcus sp; identical to SEQ ID NO: 2587
  CDS (1)..(1575)

SEQ ID NO: 41600 - protein, 524 aa, Synechococcus sp; identical to SEQ ID NO: 2588

SEQ ID NO: 41601 - DNA, 1485 bp, Haemophilus influenzae; identical to SEQ ID NO: 2589
  CDS (1)..(1485)

SEQ ID NO: 41602 - protein, 494 aa, Haemophilus influenzae; identical to SEQ ID NO: 2590

SEQ ID NO: 41603 - DNA, 1446 bp, Neisseria meningitidis; identical to SEQ ID NO: 2591
  CDS (1)..(1446)

SEQ ID NO: 41604 - protein, 481 aa, Neisseria meningitidis; identical to SEQ ID NO: 2592

SEQ ID NO: 41605 - DNA, 1278 bp, Helicobacter pylori; identical to SEQ ID NO: 2593
  CDS (1)..(1278)

SEQ ID NO: 41606 - protein, 425 aa, Helicobacter pylori; identical to SEQ ID NO: 2594

SEQ ID NO: 41607 - DNA, 1434 bp, Xylella fastidiosa; identical to SEQ ID NO: 2595
  CDS (1)..(1434)

SEQ ID NO: 41608 - protein, 477 aa, Xylella fastidiosa; identical to SEQ ID NO: 2596

SEQ ID NO: 41609 - DNA, 1296 bp, Aquifex aeolicus; identical to SEQ ID NO: 2597
  CDS (1)..(1296)

SEQ ID NO: 41610 - protein, 431 aa, Aquifex aeolicus; identical to SEQ ID NO: 2598

SEQ ID NO: 41611 - DNA, 1491 bp, Thermotoga maritima; identical to SEQ ID NO: 2599
  CDS (1)..(1491)

SEQ ID NO: 41612 - protein, 496 aa, Thermotoga maritima; identical to SEQ ID NO: 2600

SEQ ID NO: 41613 - DNA, 1494 bp, Kluyveromyces marxianus var. lactis, Candida sphaerica; identical to SEQ ID NO: 2601
  CDS (1)..(1494)

SEQ ID NO: 41614 - protein, 497 aa, Kluyveromyces marxianus var. lactis, Candida sphaerica; identical to SEQ ID NO: 2602

SEQ ID NO: 41615 - DNA, 2813 bp, Erwinia chrysanthemi; identical to SEQ ID NO: 2603
  CDS (322)..(1797)

SEQ ID NO: 41616 - protein, 491 aa, Erwinia chrysanthemi; identical to SEQ ID NO: 2604

SEQ ID NO: 41617 - DNA, 3244 bp, Plasmodium falciparum; identical to SEQ ID NO: 2605
  CDS (184)..(2916)

SEQ ID NO: 41618 - protein, 910 aa, Plasmodium falciparum; identical to SEQ ID NO: 2606

SEQ ID NO: 41619 - DNA, 1785 bp, Medicago sativa (alfalfa); identical to SEQ ID NO: 2607
  CDS (38)..(1585)

SEQ ID NO: 41620 - protein, 515 aa, Medicago sativa (alfalfa); identical to SEQ ID NO: 2608

SEQ ID NO: 41621 - DNA, 1689 bp, Solanum tuberosum (potato); identical to SEQ ID NO: 2609
  CDS (46)..(1581)

SEQ ID NO: 41622 - protein, 511 aa, Solanum tuberosum (potato); identical to SEQ ID NO: 2610

SEQ ID NO: 41623 - DNA, 1530 bp, Synechocystis sp; identical to SEQ ID NO: 2611
  CDS (1)..(1530)

SEQ ID NO: 41624 - protein, 509 aa, Synechocystis sp; identical to SEQ ID NO: 2612

SEQ ID NO: 41625 - DNA, 1953 bp, Nicotiana tabacum (common tobacco); identical to SEQ ID NO: 2613
  CDS (43)..(1824)

SEQ ID NO: 41626 - protein, 593 aa, Nicotiana tabacum (common tobacco); identical to SEQ ID NO: 2614

SEQ ID NO: 41627 - DNA, 1869 bp, Nicotiana tabacum (common tobacco); identical to SEQ ID NO: 2615
  CDS (22)..(1788)

SEQ ID NO: 41628 - protein, 588 aa, Nicotiana tabacum (common tobacco); identical to SEQ ID NO: 2616

SEQ ID NO: 41629 - DNA, 2058 bp, Solanum tuberosum (potato); identical to SEQ ID NO: 2617
  CDS (41)..(1774)

SEQ ID NO: 41630 - protein, 577 aa, Solanum tuberosum (potato); identical to SEQ ID NO: 2618

SEQ ID NO: 41631 - DNA, 2049 bp, Spinacia oleracea (spinach); identical to SEQ ID NO: 2619
  CDS (147)..(1871)

SEQ ID NO: 41632 - protein, 574 aa, Spinacia oleracea (spinach); identical to SEQ ID NO: 2620

SEQ ID NO: 41633 - DNA, 2359 bp, Petroselinum crispum (parsley); identical to SEQ ID NO: 2621
  CDS (172)..(1986)

SEQ ID NO: 41634 - protein, 604 aa, Petroselinum crispum (parsley); identical to SEQ ID NO: 2622

SEQ ID NO: 41635 - DNA, 1848 bp, Petroselinum crispum (parsley); identical to SEQ ID NO: 2623
  CDS (41)..(1528)

SEQ ID NO: 41636 - protein, 495 aa, Petroselinum crispum (parsley); identical to SEQ ID NO: 2624

SEQ ID NO: 41637 - DNA, 1957 bp, Petroselinum crispum (parsley); identical to SEQ ID NO: 2625
  CDS (74)..(1678)

SEQ ID NO: 41638 - protein, 534 aa, Petroselinum crispum (parsley); identical to SEQ ID NO: 2626

SEQ ID NO: 41639 - DNA, 1569 bp, Caenorhabditis elegans; identical to SEQ ID NO: 2627
  CDS (1)..(1569)

SEQ ID NO: 41640 - protein, 522 aa, Caenorhabditis elegans; identical to SEQ ID NO: 2628

SEQ ID NO: 41641 - DNA, 1779 bp, Streptomyces coelicolor; identical to SEQ ID NO: 2629
  CDS (1)..(1779)

SEQ ID NO: 41642 - protein, 592 aa, Streptomyces coelicolor; identical to SEQ ID NO: 2630

SEQ ID NO: 41643 - DNA, 1524 bp, Streptomyces coelicolor; identical to SEQ ID NO: 2631
  CDS (1)..(1524)

SEQ ID NO: 41644 - protein, 507 aa, Streptomyces coelicolor; identical to SEQ ID NO: 2632

SEQ ID NO: 41645 - DNA, 1422 bp, Schizosaccharomyces pombe; identical to SEQ ID NO: 2633
  CDS (1)..(1422)

SEQ ID NO: 41646 - protein, 473 aa, Schizosaccharomyces pombe; identical to SEQ ID NO: 2634

SEQ ID NO: 41647 - DNA, 1503 bp, Schizosaccharomyces pombe; identical to SEQ ID NO: 2635
  CDS (1)..(1503)

SEQ ID NO: 41648 - protein, 500 aa, Schizosaccharomyces pombe; identical to SEQ ID NO: 2636

SEQ ID NO: 41649 - DNA, 1428 bp, Schizosaccharomyces pombe; identical to SEQ ID NO: 2637
  CDS (1)..(1428)

SEQ ID NO: 41650 - protein, 475 aa, Schizosaccharomyces pombe; identical to SEQ ID NO: 2638

SEQ ID NO: 41651 - DNA, 1461 bp, Leuconostoc mesenteroides; identical to SEQ ID NO: 2639
  CDS (1)..(1461)

SEQ ID NO: 41652 - protein, 486 aa, Leuconostoc mesenteroides; identical to SEQ ID NO: 2640

SEQ ID NO: 41653 - DNA, 3038 bp, Corynebacterium glutamicum; identical to SEQ ID NO: 2641
  CDS (115)..(1659)

SEQ ID NO: 41654 - protein, 514 aa, Corynebacterium glutamicum; identical to SEQ ID NO: 2642

SEQ ID NO: 41655 - DNA, 1852 bp, Nicotiana tabacum; identical to SEQ ID NO: 2643
  CDS (102)..(1634)

SEQ ID NO: 41656 - protein, 510 aa, Nicotiana tabacum; identical to SEQ ID NO: 2644

SEQ ID NO: 41657 - DNA, 1821 bp, Nicotiana tabacum; identical to SEQ ID NO: 2645
  CDS (88)..(1623)

SEQ ID NO: 41658 - protein, 511 aa, Nicotiana tabacum; identical to SEQ ID NO: 2646

SEQ ID NO: 41659 - DNA, 1808 bp, Chlamydia trachomatis; identical to SEQ ID NO: 2647
  CDS (105)..(1643)

SEQ ID NO: 41660 - protein, 512 aa, Chlamydia trachomatis; identical to SEQ ID NO: 2648

SEQ ID NO: 41661 - DNA, 2750 bp, Plasmodium falciparum; identical to SEQ ID NO: 2649
  CDS (48)..(2258)

SEQ ID NO: 41662 - protein, 736 aa, Plasmodium falciparum; identical to SEQ ID NO: 2650

SEQ ID NO: 41663 - DNA, 1509 bp, Debaryomyces hansenii; identical to SEQ ID NO: 2651
  CDS (1)..(1509)

SEQ ID NO: 41664 - protein, 502 aa, Debaryomyces hansenii; identical to SEQ ID NO: 2652

SEQ ID NO: 41665 - DNA, 1503 bp, Candida glabrata; identical to SEQ ID NO: 2653
  CDS (1)..(1503)

SEQ ID NO: 41666 - protein, 500 aa, Candida glabrata; identical to SEQ ID NO: 2654

SEQ ID NO: 41667 - DNA, 1485 bp, Bacillus thuringiensis serovar konkukian str; identical to SEQ ID NO: 2655
  CDS (1)..(1485)

SEQ ID NO: 41668 - protein, 494 aa, Bacillus thuringiensis serovar konkukian str; identical to SEQ ID NO: 2656

SEQ ID NO: 41669 - DNA, 1554 bp, Oryza sativa; identical to SEQ ID NO: 2657
  CDS (1)..(1554)

SEQ ID NO: 41670 - protein, 517 aa, Oryza sativa; identical to SEQ ID NO: 2658

SEQ ID NO: 41671 - DNA, 1500 bp, Photobacterium profundum; identical to SEQ ID NO: 2659
  CDS (1)..(1500)

SEQ ID NO: 41672 - protein, 499 aa, Photobacterium profundum; identical to SEQ ID NO: 2660

SEQ ID NO: 41673 - DNA, 1551 bp, Parachlamydia sp; identical to SEQ ID NO: 2661
  CDS (1)..(1551)

SEQ ID NO: 41674 - protein, 516 aa, Parachlamydia sp; identical to SEQ ID NO: 2662

SEQ ID NO: 41675 - DNA, 1515 bp, Rhodopseudomonas palustris; identical to SEQ ID NO: 2663
  CDS (1)..(1515)

SEQ ID NO: 41676 - protein, 504 aa, Rhodopseudomonas palustris; identical to SEQ ID NO: 2664

SEQ ID NO: 41677 - DNA, 1650 bp, Corynebacterium diphtheriae; identical to SEQ ID NO: 2665
  CDS (1)..(1650)

SEQ ID NO: 41678 - protein, 549 aa, Corynebacterium diphtheriae; identical to SEQ ID NO: 2666

SEQ ID NO: 41679 - DNA, 1446 bp, uncultured bacterium 581; identical to SEQ ID NO: 2667
  CDS (1)..(1446)

SEQ ID NO: 41680 - protein, 481 aa, uncultured bacterium 581; identical to SEQ ID NO: 2668

SEQ ID NO: 41681 - DNA, 1602 bp, Nonomuraea sp; identical to SEQ ID NO: 2669
  CDS (1)..(1602)

SEQ ID NO: 41682 - protein, 533 aa, Nonomuraea sp; identical to SEQ ID NO: 2670

SEQ ID NO: 41683 - DNA, 1476 bp, Listeria monocytogenes; identical to SEQ ID NO: 2671
  CDS (1)..(1476)

SEQ ID NO: 41684 - protein, 491 aa, Listeria monocytogenes; identical to SEQ ID NO: 2672

SEQ ID NO: 41685 - DNA, 1485 bp, Bacillus cereus; identical to SEQ ID NO: 2673
  CDS (1)..(1485)

SEQ ID NO: 41686 - protein, 494 aa, Bacillus cereus; identical to SEQ ID NO: 2674

SEQ ID NO: 41687 - DNA, 1410 bp, Mycobacterium paratuberculosis; identical to SEQ ID NO: 2675
  CDS (1)..(1410)

SEQ ID NO: 41688 - protein, 469 aa, Mycobacterium paratuberculosis; identical to SEQ ID NO: 2676

SEQ ID NO: 41689 - DNA, 2454 bp, Mycobacterium paratuberculosis; identical to SEQ ID NO: 2677
  CDS (1)..(2454)

SEQ ID NO: 41690 - protein, 817 aa, Mycobacterium paratuberculosis; identical to SEQ ID NO: 2678

SEQ ID NO: 41691 - DNA, 1545 bp, Mycobacterium paratuberculosis; identical to SEQ ID NO: 2679
  CDS (1)..(1545)

SEQ ID NO: 41692 - protein, 514 aa, Mycobacterium paratuberculosis; identical to SEQ ID NO: 2680

SEQ ID NO: 41693 - DNA, 1449 bp, Lactobacillus johnsonii; identical to SEQ ID NO: 2681
  CDS (1)..(1449)

SEQ ID NO: 41694 - protein, 482 aa, Lactobacillus johnsonii; identical to SEQ ID NO: 2682

SEQ ID NO: 41695 - DNA, 1539 bp, Ashbya gossypii; identical to SEQ ID NO: 2683
  CDS (1)..(1539)

SEQ ID NO: 41696 - protein, 512 aa, Ashbya gossypii; identical to SEQ ID NO: 2684

SEQ ID NO: 41697 - DNA, 1734 bp, Oryza sativa; identical to SEQ ID NO: 2685
  CDS (1)..(1734)

SEQ ID NO: 41698 - protein, 577 aa, Oryza sativa; identical to SEQ ID NO: 2686

SEQ ID NO: 41699 - DNA, 1467 bp, Gluconobacter oxydans; identical to SEQ ID NO: 2687
  CDS (1)..(1467)

SEQ ID NO: 41700 - protein, 488 aa, Gluconobacter oxydans; identical to SEQ ID NO: 2688

SEQ ID NO: 41701 - DNA, 1581 bp, Vibrio vulnificus; identical to SEQ ID NO: 2689
  CDS (1)..(1581)

SEQ ID NO: 41702 - protein, 526 aa, Vibrio vulnificus; identical to SEQ ID NO: 2690

SEQ ID NO: 41703 - DNA, 1476 bp, Photorhabdus luminescens; identical to SEQ ID NO: 2691
  CDS (1)..(1476)

SEQ ID NO: 41704 - protein, 491 aa, Photorhabdus luminescens; identical to SEQ ID NO: 2692

SEQ ID NO: 41705 - DNA, 1539 bp, Gloeobacter violaceus; identical to SEQ ID NO: 2693
  CDS (1)..(1539)

SEQ ID NO: 41706 - protein, 512 aa, Gloeobacter violaceus; identical to SEQ ID NO: 2694

SEQ ID NO: 41707 - DNA, 1539 bp, Gloeobacter violaceus; identical to SEQ ID NO: 2695
  CDS (1)..(1539)

SEQ ID NO: 41708 - protein, 512 aa, Gloeobacter violaceus; identical to SEQ ID NO: 2696

SEQ ID NO: 41709 - DNA, 1479 bp, Chromobacterium violaceum; identical to SEQ ID NO: 2697
  CDS (1)..(1479)

SEQ ID NO: 41710 - protein, 492 aa, Chromobacterium violaceum; identical to SEQ ID NO: 2698

SEQ ID NO: 41711 - DNA, 2229 bp, Giardia lamblia ATCC 50803; identical to SEQ ID NO: 2699
  CDS (1)..(2229)

SEQ ID NO: 41712 - protein, 742 aa, Giardia lamblia ATCC 50803; identical to SEQ ID NO: 2700

SEQ ID NO: 41713 - DNA, 2850 bp, Plasmodium yoelii yoelii; identical to SEQ ID NO: 2701
  CDS (1)..(2850)

SEQ ID NO: 41714 - protein, 949 aa, Plasmodium yoelii yoelii; identical to SEQ ID NO: 2702

SEQ ID NO: 41715 - DNA, 1476 bp, Neurospora crassa; identical to SEQ ID NO: 2703
  CDS (1)..(1476)

SEQ ID NO: 41716 - protein, 491 aa, Neurospora crassa; identical to SEQ ID NO: 2704

SEQ ID NO: 41717 - DNA, 1524 bp, Synechococcus sp; identical to SEQ ID NO: 2705
  CDS (1)..(1524)

SEQ ID NO: 41718 - protein, 507 aa, Synechococcus sp; identical to SEQ ID NO: 2706

SEQ ID NO: 41719 - DNA, 1455 bp, Rhodopirellula baltica; identical to SEQ ID NO: 2707
  CDS (1)..(1455)

SEQ ID NO: 41720 - protein, 484 aa, Rhodopirellula baltica; identical to SEQ ID NO: 2708

SEQ ID NO: 41721 - DNA, 1524 bp, Prochlorococcus marinus subsp; identical to SEQ ID NO: 2709
  CDS (1)..(1524)

SEQ ID NO: 41722 - protein, 507 aa, Prochlorococcus marinus subsp; identical to SEQ ID NO: 2710

SEQ ID NO: 41723 - DNA, 1524 bp, Prochlorococcus marinus; identical to SEQ ID NO: 2711
  CDS (1)..(1524)

SEQ ID NO: 41724 - protein, 507 aa, Prochlorococcus marinus; identical to SEQ ID NO: 2712

SEQ ID NO: 41725 - DNA, 1521 bp, Prochlorococcus marinus; identical to SEQ ID NO: 2713
  CDS (1)..(1521)

SEQ ID NO: 41726 - protein, 506 aa, Prochlorococcus marinus; identical to SEQ ID NO: 2714

SEQ ID NO: 41727 - DNA, 1488 bp, Haemophilus ducreyi; identical to SEQ ID NO: 2715
  CDS (1)..(1488)

SEQ ID NO: 41728 - protein, 495 aa, Haemophilus ducreyi; identical to SEQ ID NO: 2716

SEQ ID NO: 41729 - DNA, 1497 bp, Candidatus Blochmannia floridanus; identical to SEQ ID NO: 2717
  CDS (1)..(1497)

SEQ ID NO: 41730 - protein, 498 aa, Candidatus Blochmannia floridanus; identical to SEQ ID NO: 2718

SEQ ID NO: 41731 - DNA, 1768 bp, Oryza sativa; identical to SEQ ID NO: 2719
  CDS (2)..(1768)

SEQ ID NO: 41732 - protein, 588 aa, Oryza sativa; identical to SEQ ID NO: 2720

SEQ ID NO: 41733 - DNA, 1548 bp, Bos indicus; identical to SEQ ID NO: 2721
  CDS (1)..(1548)

SEQ ID NO: 41734 - protein, 515 aa, Bos indicus; identical to SEQ ID NO: 2722

SEQ ID NO: 41735 - DNA, 1536 bp, Chlamydophila caviae; identical to SEQ ID NO: 2723
  CDS (1)..(1536)

SEQ ID NO: 41736 - protein, 511 aa, Chlamydophila caviae; identical to SEQ ID NO: 2724

SEQ ID NO: 41737 - DNA, 1524 bp, Streptomyces avermitilis; identical to SEQ ID NO: 2725
  CDS (1)..(1524)

SEQ ID NO: 41738 - protein, 507 aa, Streptomyces avermitilis; identical to SEQ ID NO: 2726

SEQ ID NO: 41739 - DNA, 1647 bp, Streptomyces avermitilis; identical to SEQ ID NO: 2727
  CDS (1)..(1647)

SEQ ID NO: 41740 - protein, 548 aa, Streptomyces avermitilis; identical to SEQ ID NO: 2728

SEQ ID NO: 41741 - DNA, 1491 bp, Nitrosomonas europaea; identical to SEQ ID NO: 2729
  CDS (1)..(1491)

SEQ ID NO: 41742 - protein, 496 aa, Nitrosomonas europaea; identical to SEQ ID NO: 2730

SEQ ID NO: 41743 - DNA, 1524 bp, Enterococcus faecalis; identical to SEQ ID NO: 2731
  CDS (1)..(1524)

SEQ ID NO: 41744 - protein, 507 aa, Enterococcus faecalis; identical to SEQ ID NO: 2732

SEQ ID NO: 41745 - DNA, 1464 bp, Tropheryma whipplei; identical to SEQ ID NO: 2733
  CDS (1)..(1464)

SEQ ID NO: 41746 - protein, 487 aa, Tropheryma whipplei; identical to SEQ ID NO: 2734

SEQ ID NO: 41747 - DNA, 2145 bp, Leishmania mexicana; identical to SEQ ID NO: 2735
  CDS (298)..(1986)

SEQ ID NO: 41748 - protein, 562 aa, Leishmania mexicana; identical to SEQ ID NO: 2736

SEQ ID NO: 41749 - DNA, 1494 bp, Dictyostelium discoideum; identical to SEQ ID NO: 2737
  CDS (1)..(1494)

SEQ ID NO: 41750 - protein, 497 aa, Dictyostelium discoideum; identical to SEQ ID NO: 2738

SEQ ID NO: 41751 - DNA, 1503 bp, Xylella fastidiosa; identical to SEQ ID NO: 2739
  CDS (1)..(1503)

SEQ ID NO: 41752 - protein, 500 aa, Xylella fastidiosa; identical to SEQ ID NO: 2740

SEQ ID NO: 41753 - DNA, 1506 bp, Vibrio parahaemolyticus; identical to SEQ ID NO: 2741
  CDS (1)..(1506)

SEQ ID NO: 41754 - protein, 501 aa, Vibrio parahaemolyticus; identical to SEQ ID NO: 2742

SEQ ID NO: 41755 - DNA, 1533 bp, Pseudomonas syringae; identical to SEQ ID NO: 2743
  CDS (1)..(1533)

SEQ ID NO: 41756 - protein, 510 aa, Pseudomonas syringae; identical to SEQ ID NO: 2744

SEQ ID NO: 41757 - DNA, 1470 bp, Pseudomonas syringae; identical to SEQ ID NO: 2745
  CDS (1)..(1470)

SEQ ID NO: 41758 - protein, 489 aa, Pseudomonas syringae; identical to SEQ ID NO: 2746

SEQ ID NO: 41759 - DNA, 1458 bp, Pseudomonas putida; identical to SEQ ID NO: 2747
  CDS (1)..(1458)

SEQ ID NO: 41760 - protein, 485 aa, Pseudomonas putida; identical to SEQ ID NO: 2748

SEQ ID NO: 41761 - DNA, 1506 bp, Pseudomonas putida; identical to SEQ ID NO: 2749
  CDS (1)..(1506)

SEQ ID NO: 41762 - protein, 501 aa, Pseudomonas putida; identical to SEQ ID NO: 2750

SEQ ID NO: 41763 - DNA, 1470 bp, Pseudomonas putida; identical to SEQ ID NO: 2751
  CDS (1)..(1470)

SEQ ID NO: 41764 - protein, 489 aa, Pseudomonas putida; identical to SEQ ID NO: 2752

SEQ ID NO: 41765 - DNA, 1485 bp, Lactobacillus plantarum; identical to SEQ ID NO: 2753
  CDS (1)..(1485)

SEQ ID NO: 41766 - protein, 494 aa, Lactobacillus plantarum; identical to SEQ ID NO: 2754

SEQ ID NO: 41767 - DNA, 1440 bp, Clostridium tetani; identical to SEQ ID NO: 2755
  CDS (1)..(1440)

SEQ ID NO: 41768 - protein, 479 aa, Clostridium tetani; identical to SEQ ID NO: 2756

SEQ ID NO: 41769 - DNA, 1512 bp, Bradyrhizobium japonicum; identical to SEQ ID NO: 2757
  CDS (1)..(1512)

SEQ ID NO: 41770 - protein, 503 aa, Bradyrhizobium japonicum; identical to SEQ ID NO: 2758

SEQ ID NO: 41771 - DNA, 1497 bp, Bacteroides thetaiotaomicron; identical to SEQ ID NO: 2759
  CDS (1)..(1497)

SEQ ID NO: 41772 - protein, 498 aa, Bacteroides thetaiotaomicron; identical to SEQ ID NO: 2760

SEQ ID NO: 41773 - DNA, 4583 bp, Mus musculus; identical to SEQ ID NO: 2761
  CDS (119)..(2488)

SEQ ID NO: 41774 - protein, 789 aa, Mus musculus; identical to SEQ ID NO: 2762

SEQ ID NO: 41775 - DNA, 1485 bp, Staphylococcus epidermidis; identical to SEQ ID NO: 2763
  CDS (1)..(1485)

SEQ ID NO: 41776 - protein, 494 aa, Staphylococcus epidermidis; identical to SEQ ID NO: 2764

SEQ ID NO: 41777 - DNA, 1590 bp, Yersinia pestis; identical to SEQ ID NO: 2765
  CDS (1)..(1590)

SEQ ID NO: 41778 - protein, 529 aa, Yersinia pestis; identical to SEQ ID NO: 2766

SEQ ID NO: 41779 - DNA, 1530 bp, Synechococcus elongatus; identical to SEQ ID NO: 2767
  CDS (1)..(1530)

SEQ ID NO: 41780 - protein, 509 aa, Synechococcus elongatus; identical to SEQ ID NO: 2768

SEQ ID NO: 41781 - DNA, 1473 bp, Shewanella oneidensis; identical to SEQ ID NO: 2769
  CDS (1)..(1473)

SEQ ID NO: 41782 - protein, 490 aa, Shewanella oneidensis; identical to SEQ ID NO: 2770

SEQ ID NO: 41783 - DNA, 1476 bp, Oceanobacillus iheyensis; identical to SEQ ID NO: 2771
  CDS (1)..(1476)

SEQ ID NO: 41784 - protein, 491 aa, Oceanobacillus iheyensis; identical to SEQ ID NO: 2772

SEQ ID NO: 41785 - DNA, 1344 bp, Corynebacterium efficiens; identical to SEQ ID NO: 2773
  CDS (1)..(1344)

SEQ ID NO: 41786 - protein, 447 aa, Corynebacterium efficiens; identical to SEQ ID NO: 2774

SEQ ID NO: 41787 - DNA, 1545 bp, Corynebacterium efficiens; identical to SEQ ID NO: 2775
  CDS (1)..(1545)

SEQ ID NO: 41788 - protein, 514 aa, Corynebacterium efficiens; identical to SEQ ID NO: 2776

SEQ ID NO: 41789 - DNA, 1668 bp, Bifidobacterium longum; identical to SEQ ID NO: 2777
  CDS (1)..(1668)

SEQ ID NO: 41790 - protein, 555 aa, Bifidobacterium longum; identical to SEQ ID NO: 2778

SEQ ID NO: 41791 - DNA, 1284 bp, Rhodococcus opacus; identical to SEQ ID NO: 2779
  CDS (1)..(1284)

SEQ ID NO: 41792 - protein, 427 aa, Rhodococcus opacus; identical to SEQ ID NO: 2780

SEQ ID NO: 41793 - DNA, 2879 bp, Leishmania guyanensis; identical to SEQ ID NO: 2781
  CDS (205)..(1893): n means a or g or c or t/u, s means g or c

SEQ ID NO: 41794 - protein, 562 aa, Leishmania guyanensis; identical to SEQ ID NO: 2782

SEQ ID NO: 41795 - DNA, 1689 bp, Leishmania mexicana; identical to SEQ ID NO: 2783
  CDS (1)..(1689): n means a or g or c or t/u, s means g or c

SEQ ID NO: 41796 - protein, 562 aa, Leishmania mexicana; identical to SEQ ID NO: 2784
  Xaa in the positions 76-18, 187, 197, 224, 243, 250, and 492-510 is unknown

SEQ ID NO: 41797 - DNA, 2916 bp, Leishmania amazonensis; identical to SEQ ID NO: 2785
  CDS (207)..(1895): n means a or g or c or t/u, s means g or c

SEQ ID NO: 41798 - protein, 562 aa, Leishmania amazonensis; identical to SEQ ID NO: 2786
  Xaa in the positions 463 and 481 is unknown

SEQ ID NO: 41799 - DNA, 1440 bp, Chlorobium tepidum; identical to SEQ ID NO: 2787
  CDS (1)..(1440)

SEQ ID NO: 41800 - protein, 479 aa, Chlorobium tepidum; identical to SEQ ID NO: 2788

SEQ ID NO: 41801 - DNA, 2187 bp, Methylobacterium extorquens; identical to SEQ ID NO: 2789
  CDS (640)..(2187)

SEQ ID NO: 41802 - protein, 515 aa, Methylobacterium extorquens; identical to SEQ ID NO: 2790

SEQ ID NO: 41803 - DNA, 1476 bp, Bartonella henselae; identical to SEQ ID NO: 2791
  CDS (1)..(1476)

SEQ ID NO: 41804 - protein, 491 aa, Bartonella henselae; identical to SEQ ID NO: 2792

SEQ ID NO: 41805 - DNA, 2266 bp, Toxoplasma gondii; identical to SEQ ID NO: 2793
  CDS (169)..(1851)

SEQ ID NO: 41806 - protein, 560 aa, Toxoplasma gondii; identical to SEQ ID NO: 2794

SEQ ID NO: 41807 - DNA, 1923 bp, Xanthomonas campestris; identical to SEQ ID NO: 2795
  CDS (1)..(1923)

SEQ ID NO: 41808 - protein, 640 aa, Xanthomonas campestris; identical to SEQ ID NO: 2796

SEQ ID NO: 41809 - DNA, 1431 bp, Xanthomonas campestris; identical to SEQ ID NO: 2797
  CDS (1)..(1431)

SEQ ID NO: 41810 - protein, 476 aa, Xanthomonas campestris; identical to SEQ ID NO: 2798

SEQ ID NO: 41811 - DNA, 1839 bp, Xanthomonas axonopodis; identical to SEQ ID NO: 2799
  CDS (1)..(1839)

SEQ ID NO: 41812 - protein, 612 aa, Xanthomonas axonopodis; identical to SEQ ID NO: 2800

SEQ ID NO: 41813 - DNA, 1431 bp, Xanthomonas axonopodis; identical to SEQ ID NO: 2801
  CDS (1)..(1431)

SEQ ID NO: 41814 - protein, 476 aa, Xanthomonas axonopodis; identical to SEQ ID NO: 2802

SEQ ID NO: 41815 - DNA, 1458 bp, Thermoanaerobacter tengcongensis; identical to SEQ ID NO: 2803
  CDS (1)..(1458)

SEQ ID NO: 41816 - protein, 485 aa, Thermoanaerobacter tengcongensis; identical to SEQ ID NO: 2804

SEQ ID NO: 41817 - DNA, 1762 bp, Oryza sativa; identical to SEQ ID NO: 2805
  CDS (41)..(1558)

SEQ ID NO: 41818 - protein, 505 aa, Oryza sativa; identical to SEQ ID NO: 2806

SEQ ID NO: 41819 - DNA, 1305 bp, Encephalitozoon cuniculi; identical to SEQ ID NO: 2807
  CDS (1)..(1305)

SEQ ID NO: 41820 - protein, 434 aa, Encephalitozoon cuniculi; identical to SEQ ID NO: 2808

SEQ ID NO: 41821 - DNA, 2125 bp, Drosophila melanogaster; identical to SEQ ID NO: 2809
  CDS (158)..(1738)

SEQ ID NO: 41822 - protein, 526 aa, Drosophila melanogaster; identical to SEQ ID NO: 2810

SEQ ID NO: 41823 - DNA, 1470 bp, Ralstonia solanacearum; identical to SEQ ID NO: 2811
  CDS (1)..(1470)

SEQ ID NO: 41824 - protein, 489 aa, Ralstonia solanacearum; identical to SEQ ID NO: 2812

SEQ ID NO: 41825 - DNA, 1521 bp, Enterococcus mundtii; identical to SEQ ID NO: 2813
  CDS (1)..(1521)

SEQ ID NO: 41826 - protein, 506 aa, Enterococcus mundtii; identical to SEQ ID NO: 2814

SEQ ID NO: 41827 - DNA, 2230 bp, Homo sapiens; identical to SEQ ID NO: 2815
  CDS (54)..(1601)

SEQ ID NO: 41828 - protein, 515 aa, Homo sapiens [sequence omitted]

SEQ ID NO: 41829 - DNA, 1470 bp, Rhizobium loti; identical to SEQ ID NO: 2817
  CDS (1)..(1470)

SEQ ID NO: 41830 - protein, 489 aa, Rhizobium loti; identical to SEQ ID NO: 2818

SEQ ID NO: 41831 - DNA, 1428 bp, Rhizobium loti; identical to SEQ ID NO: 2819
  CDS (1)..(1428)

SEQ ID NO: 41832 - protein, 475 aa, Rhizobium loti; identical to SEQ ID NO: 2820

SEQ ID NO: 41833 - DNA, 3584 bp, Plasmodium berghei; identical to SEQ ID NO: 2821
  CDS (370)..(3222)

SEQ ID NO: 41834 - protein, 950 aa, Plasmodium berghei; identical to SEQ ID NO: 2822

SEQ ID NO: 41835 - DNA, 1491 bp, Pasteurella multocida; identical to SEQ ID NO: 2823
  CDS (1)..(1491)

SEQ ID NO: 41836 - protein, 496 aa, Pasteurella multocida; identical to SEQ ID NO: 2824

SEQ ID NO: 41837 - DNA, 1470 bp, Pseudomonas putida; identical to SEQ ID NO: 2825
  CDS (1)..(1470)

SEQ ID NO: 41838 - protein, 489 aa, Pseudomonas putida; identical to SEQ ID NO: 2826

SEQ ID NO: 41839 - DNA, 1566 bp, Trypanosoma brucei; identical to SEQ ID NO: 2827
  CDS (1)..(1566)

SEQ ID NO: 41840 - protein, 521 aa, Trypanosoma brucei; identical to SEQ ID NO: 2828

SEQ ID NO: 41841 - DNA, 1904 bp, Triticum aestivum; identical to SEQ ID NO: 2829
  CDS (153)..(1682)

SEQ ID NO: 41842 - protein, 509 aa, Triticum aestivum; identical to SEQ ID NO: 2830

SEQ ID NO: 41843 - DNA, 2098 bp, Solanum tuberosum; identical to SEQ ID NO: 2831
  CDS (27)..(1775)

SEQ ID NO: 41844 - protein, 582 aa, Solanum tuberosum; identical to SEQ ID NO: 2832

SEQ ID NO: 41845 - DNA, 1924 bp, Dunaliella bioculata; identical to SEQ ID NO: 2833
  CDS (68)..(1840)

SEQ ID NO: 41846 - protein, 590 aa, Dunaliella bioculata; identical to SEQ ID NO: 2834

SEQ ID NO: 41847 - DNA, 1976 bp, Cyanidium caldarium; identical to SEQ ID NO: 2835
  CDS (46)..(1848)

SEQ ID NO: 41848 - protein, 600 aa, Cyanidium caldarium; identical to SEQ ID NO: 2836

SEQ ID NO: 41849 - DNA, 2106 bp, Drosophila melanogaster; identical to SEQ ID NO: 2837
  CDS (28)..(1746)

SEQ ID NO: 41850 - protein, 572 aa, Drosophila melanogaster; identical to SEQ ID NO: 2838

SEQ ID NO: 41851 - DNA, 1777 bp, Mesembryanthemum crystallinum; identical to SEQ ID NO: 2839
  CDS (39)..(1589)

SEQ ID NO: 41852 - protein, 516 aa, Mesembryanthemum crystallinum; identical to SEQ ID NO: 2840

SEQ ID NO: 41853 - DNA, 1542 bp, Mus musculus; identical to SEQ ID NO: 2841
  CDS (1)..(1542)

SEQ ID NO: 41854 - protein, 513 aa, Mus musculus; identical to SEQ ID NO: 2842

SEQ ID NO: 41855 - DNA, 1485 bp, Actinobacillus actinomycetemcomitans; identical to SEQ ID NO: 2843
  CDS (1)..(1485)

SEQ ID NO: 41856 - protein, 494 aa, Actinobacillus actinomycetemcomitans; identical to SEQ ID NO: 2844

SEQ ID NO: 41857 - DNA, 1473 bp, Buchnera aphidicola; identical to SEQ ID NO: 2845
  CDS (1)..(1473)

SEQ ID NO: 41858 - protein, 490 aa, Buchnera aphidicola; identical to SEQ ID NO: 2846

SEQ ID NO: 41859 - DNA, 1473 bp, Buchnera aphidicola; identical to SEQ ID NO: 2847
  CDS (1)..(1473)

SEQ ID NO: 41860 - protein, 490 aa, Buchnera aphidicola; identical to SEQ ID NO: 2848

SEQ ID NO: 41861 - DNA, 2049 bp, Ceratitis capitata; identical to SEQ ID NO: 2849
  CDS (60)..(1640)

SEQ ID NO: 41862 - protein, 526 aa, Ceratitis capitata; identical to SEQ ID NO: 2850

SEQ ID NO: 41863 - DNA, 1524 bp, Chlamydia muridarum; identical to SEQ ID NO: 2851
  CDS (1)..(1524)

SEQ ID NO: 41864 - protein, 507 aa, Chlamydia muridarum; identical to SEQ ID NO: 2852

SEQ ID NO: 41865 - DNA, 2062 bp, Drosophila melanogaster; identical to SEQ ID NO: 2853
  CDS (303)..(1877)

SEQ ID NO: 41866 - protein, 524 aa, Drosophila melanogaster; identical to SEQ ID NO: 2854

SEQ ID NO: 41867 - DNA, 1536 bp, Emericella nidulans; identical to SEQ ID NO: 2855
  CDS (1)..(1536)

SEQ ID NO: 41868 - protein, 511 aa, Emericella nidulans; identical to SEQ ID NO: 2856

SEQ ID NO: 41869 - DNA, 1957 bp, Leuconostoc mesenteroides; identical to SEQ ID NO: 2857
  CDS (206)..(1666)

SEQ ID NO: 41870 - protein, 486 aa, Leuconostoc mesenteroides; identical to SEQ ID NO: 2858

SEQ ID NO: 41871 - DNA, 2055 bp, Macropus robustus; identical to SEQ ID NO: 2859
  CDS (94)..(1641)

SEQ ID NO: 41872 - protein, 515 aa, Macropus robustus; identical to SEQ ID NO: 2860

SEQ ID NO: 41873 - DNA, 1530 bp, Nostoc punctiforme; identical to SEQ ID NO: 2861
  CDS (1)..(1530)

SEQ ID NO: 41874 - protein, 509 aa, Nostoc punctiforme; identical to SEQ ID NO: 2862

SEQ ID NO: 41875 - DNA, 1476 bp, Rhizobium meliloti; identical to SEQ ID NO: 2863
  CDS (1)..(1476)

SEQ ID NO: 41876 - protein, 491 aa, Rhizobium meliloti; identical to SEQ ID NO: 2864

SEQ ID NO: 41877 - DNA, 2853 bp, Homo sapiens; identical to SEQ ID NO: 2865
  CDS (273)..(2648)

SEQ ID NO: 41878 - protein, 791 aa, Homo sapiens; identical to SEQ ID NO: 2866

SEQ ID NO: 41879 - DNA, 1970 bp, Arabidopsis thaliana; identical to SEQ ID NO: 2867
  CDS (60)..(1790)

SEQ ID NO: 41880 - protein, 576 aa, Arabidopsis thaliana; identical to SEQ ID NO: 2868

SEQ ID NO: 41881 - DNA, 2112 bp, Arabidopsis thaliana; identical to SEQ ID NO: 2869
  CDS (142)..(1932)

SEQ ID NO: 41882 - protein, 596 aa, Arabidopsis thaliana; identical to SEQ ID NO: 2870

SEQ ID NO: 41883 - DNA, 2161 bp, Arabidopsis thaliana; identical to SEQ ID NO: 2871
  CDS (90)..(1967)

SEQ ID NO: 41884 - protein, 625 aa, Arabidopsis thaliana; identical to SEQ ID NO: 2872

SEQ ID NO: 41885 - DNA, 1936 bp, Arabidopsis thaliana; identical to SEQ ID NO: 2873
  CDS (136)..(1686)

SEQ ID NO: 41886 - protein, 516 aa, Arabidopsis thaliana; identical to SEQ ID NO: 2874

SEQ ID NO: 41887 - DNA, 1959 bp, Arabidopsis thaliana; identical to SEQ ID NO: 2875
  CDS (194)..(1741)

SEQ ID NO: 41888 - protein, 515 aa, Arabidopsis thaliana [sequence omitted]

SEQ ID NO: 41889 - DNA, 1503 bp, Xenopus laevis; identical to SEQ ID NO: 2877
  CDS (1)..(1503)

SEQ ID NO: 41890 - protein, 500 aa, Xenopus laevis; identical to SEQ ID NO: 2878

SEQ ID NO: 41891 - DNA, 2004 bp, Arabidopsis thaliana; identical to SEQ ID NO: 2879
  CDS (51)..(1850)

SEQ ID NO: 41892 - protein, 599 aa, Arabidopsis thaliana; identical to SEQ ID NO: 2880

SEQ ID NO: 41893 - DNA, 23 bp, Artificial sequence
  (1)..(23): primer
atgagtgaaggccccgtcaaatt

SEQ ID NO: 41894 - DNA, 25 bp, Artificial sequence
  (1)..(25): primer
ctaattatccttcgtatcttctggc

SEQ ID NO: 41895 - protein, 806 aa, Artificial sequence; identical to SEQ ID NO: 18604
  Variant (2)..(3): xaa in position 2 to 3 is any amino acid
  Variant (7)..(9): xaa in position 7 to 9 is any amino acid
  Variant (11)..(12): xaa in position 11 to 12 is any amino acid
  Variant (14)..(17): xaa in position 14 to 17 is any amino acid
  Variant (19)..(23): xaa in position 19 to 23 is any amino acid
  Variant (25)..(32): xaa in position 25 to 32 is any amino acid
  Variant (34)..(35): xaa in position 34 to 35 is any amino acid
  Variant (37)..(81): xaa in position 37 to 81 is any amino acid
  Variant (83)..(95): xaa in position 83 to 95 is any amino acid
  Variant (97)..(225): xaa in position 97 to 225 is any amino acid
  Variant (227)..(230): xaa in position 227 to 230 is any amino acid
  Variant (232)..(258): xaa in position 232 to 258 is any amino acid
  Variant (260)..(262): xaa in position 260 to 262 is any amino acid
  Variant (266)..(266): xaa in position 266 is any amino acid
  Variant (268)..(268): xaa in position 268 is any amino acid
  Variant (270)..(271): xaa in position 270 to 271 is any amino acid
  Variant (273)..(275): xaa in position 273 to 275 is any amino acid
  Variant (277)..(285): xaa in position 277 to 285 is any amino acid
  Variant (287)..(290): xaa in position 287 to 290 is any amino acid
  Variant (300)..(300): xaa in position 300 is any amino acid
  Variant (302)..(302): xaa in position 302 is any amino acid
  Variant (304)..(307): xaa in position 304 to 307 is any amino acid
  Variant (310)..(310): xaa in position 310 is any amino acid
  Variant (312)..(318): xaa in position 312 to 318 is any amino acid
  Variant (321)..(323): xaa in position 321 to 323 is any amino acid
  Variant (325)..(328): xaa in position 325 to 328 is any amino acid
  Variant (330)..(332): xaa in position 330 to 332 is any amino acid
  Variant (334)..(335): xaa in position 334 to 335 is any amino acid
  Variant (337)..(339): xaa in position 337 to 339 is any amino acid
  Variant (341)..(342): xaa in position 341 to 342 is any amino acid
  Variant (344)..(347): xaa in position 344 to 347 is any amino acid
  Variant (349)..(351): xaa in position 349 to 351 is any amino acid
  Variant (354)..(355): xaa in position 354 to 355 is any amino acid
  Variant (359)..(360): xaa in position 359 to 360 is any amino acid
  Variant (362)..(366): xaa in position 362 to 366 is any amino acid
  Variant (370)..(370): xaa in position 370 is any amino acid
  Variant (372)..(382): xaa in position 372 to 382 is any amino acid
  Variant (385)..(385): xaa in position 385 is any amino acid
  Variant (387)..(387): xaa in position 387 is any amino acid
  Variant (389)..(405): xaa in position 389 to 405 is any amino acid
  Variant (409)..(438): xaa in position 409 to 438 is any amino acid
  Variant (440)..(451): xaa in position 440 to 451 is any amino acid
  Variant (453)..(455): xaa in position 453 to 455 is any amino acid
  Variant (457)..(465): xaa in position 457 to 465 is any amino acid
  Variant (467)..(467): xaa in position 467 is any amino acid
  Variant (470)..(470): xaa in position 470 is any amino acid
  Variant (475)..(478): xaa in position 475 to 478 is any amino acid
  Variant (481)..(493): xaa in position 481 to 493 is any amino acid
  Variant (495)..(524): xaa in position 495 to 524 is any amino acid
  Variant (526)..(531): xaa in position 526 to 531 is any amino acid
  Variant (534)..(534): xaa in position 534 is any amino acid
  Variant (536)..(543): xaa in position 536 to 543 is any amino acid
  Variant (545)..(545): xaa in position 545 is any amino acid
  Variant (548)..(588): xaa in position 548 to 588 is any amino acid
  Variant (592)..(592): xaa in position 592 is any amino acid
  Variant (594)..(595): xaa in position 594 to 595 is any amino acid
  Variant (597)..(599): xaa in position 597 to 599 is any amino acid
  Variant (601)..(604): xaa in position 601 to 604 is any amino acid
  Variant (606)..(609): xaa in position 606 to 609 is any amino acid
  Variant (611)..(614): xaa in position 611 to 614 is any amino acid
  Variant (616)..(797): xaa in position 616 to 797 is any amino acid
  Variant (799)..(800): xaa in position 799 to 800 is any amino acid
  Variant (802)..(805): xaa in position 802 to 805 is any amino acid

SEQ ID NO: 41896 - protein, 150 aa, Artificial sequence; identical to SEQ ID NO: 2917
  Variant (1)..(1): xaa in position 1 is Arg or Lys
  Variant (2)..(2): xaa in position 2 is Val, Ile, Leu or Ala
  Variant (3)..(3): xaa in position 3 is Ile, Val, Met or Ala
  Variant (4)..(4): xaa in position 4 is Ile, Val, Leu, Met or Ala
  Variant (8)..(8): xaa in position 8 is Phe, Ile, Leu or Tyr
  Variant (9)..(9): xaa in position 9 is Gly or Ala
  Variant (10)..(10): xaa in position 10 is any amino acid
  Variant (11)..(11): xaa in position 11 is Asp, Ser or Asn
  Variant (12)..(13): xaa in position 12 to 13 is any amino acid
  Variant (14)..(14): xaa in position 14 is Ser, Thr or Asn
  Variant (15)..(15): xaa in position 15 is Ala, Ser, Phe or Tyr
  Variant (16)..(17): xaa in position 16 to 17 is any amino acid
  Variant (18)..(18): xaa in position 18 is Leu, Ile, Val or Phe
  Variant (19)..(21): xaa in position 19 to 21 is any amino acid
  Variant (22)..(22): xaa in position 22 is Leu, Ile or Val
  Variant (23)..(27): xaa in position 23 to 27 is any amino acid
  Variant (28)..(28): xaa in position 28 is Glu, Asp, Pro or Ser
  Variant (29)..(30): xaa in position 29 to 30 is any amino acid
  Variant (31)..(31): xaa in position 31 is Ile, Val, Leu, Thr or Met
  Variant (32)..(32): xaa in position 32 is Tyr, Phe or Leu
  Variant (33)..(33): xaa in position 33 is Arg, His or Leu
  Variant (34)..(34): xaa in position 34 is Ile, Val, Met or Leu
  Variant (37)..(37): xaa in position 37 is Tyr or Phe
  Variant (39)..(39): xaa in position 39 is Gly, Ser or Ala
  Variant (40)..(40): xaa in position 40 is Lys, Arg or Glu
  Variant (41)..(42): xaa in position 41 to 42 is any amino acid
  Variant (43)..(43): xaa in position 43 is Val, Ile, Leu, Ala or Met
  Variant (44)..(44): xaa in position 44 is any amino acid
  Variant (45)..(45): xaa in position 45 is Asn, Gly, Gln or Ala
  Variant (46)..(46): xaa in position 46 is Leu, Ile, Met, Phe or Val
  Variant (47)..(49): xaa in position 47 to 49 is any amino acid
  Variant (50)..(50): xaa in position 50 is Arg, Lys or Glu
  Variant (51)..(51): xaa in position 51 is Phe or Tyr
  Variant (52)..(52): xaa in position 52 is any amino acid
  Variant (54)..(59): xaa in position 54 to 59 is any amino acid
  Variant (60)..(60): xaa in position 60 is any or no amino acid
  Variant (61)..(61): xaa in position 61 is Trp, Met, Asn or Leu
  Variant (62)..(63): xaa in position 62 to 63 is any amino acid
  Variant (64)..(65): xaa in position 64 to 65 is any or no amino acid
  Variant (66)..(66): xaa in position 66 is Ile, Val or Ala
  Variant (67)..(68): xaa in position 67 to 68 is any amino acid
  Variant (69)..(69): xaa in position 69 is Val, Ile, Met or Leu
  Variant (70)..(70): xaa in position 70 is any amino acid
  Variant (71)..(71): xaa in position 71 is Ile, Leu, Val, Phe or Ser
  Variant (72)..(74): xaa in position 72 to 74 is any amino acid
  Variant (76)..(77): xaa in position 76 to 77 is any amino acid
  Variant (78)..(78): xaa in position 78 is Gly, Asp, Val or Ala
  Variant (79)..(81): xaa in position 79 to 81 is any amino acid
  Variant (82)..(82): xaa in position 82 is Arg or Lys
  Variant (83)..(84): xaa in position 83 to 84 is any or no amino acid
  Variant (85)..(85): xaa in position 85 is Tyr or Phe
  Variant (86)..(86): xaa in position 86 is Tyr, Phe or Trp
  Variant (87)..(87): xaa in position 87 is Asp, Glu, Ala or Asn
  Variant (88)..(89): xaa in position 88 to 89 is any amino acid
  Variant (91)..(91): xaa in position 91 is any amino acid
  Variant (92)..(92): xaa in position 92 is any or no amino acid
  Variant (93)..(93): xaa in position 93 is Leu, Ile, Val, Met or Ala
  Variant (94)..(94): xaa in position 94 is Arg, Lys or Leu
  Variant (96)..(96): xaa in position 96 is Met, Val, Ile or Leu
  Variant (97)..(97): xaa in position 97 is Val, Met, Ile, Leu or Phe
  Variant (98)..(98): xaa in position 98 is Gln, Pro or Thr
  Variant (99)..(99): xaa in position 99 is Asn or Ser
  Variant (100)..(100): xaa in position 100 is His, Gln or Pro
  Variant (101)..(102): xaa in position 101 to 102 is any amino acid
  Variant (103)..(103): xaa in position 103 is Gln, Glu, Asn or Leu
  Variant (104)..(104): xaa in position 104 is Leu, Ile, Val, Met or Thr
  Variant (105)..(105): xaa in position 105 is Leu, Met, Val, Ile, Phe or Tyr
  Variant (106)..(106): xaa in position 106 is any amino acid
  Variant (107)..(107): xaa in position 107 is Leu, Met, Ile, Val, Trp or Phe
  Variant (108)..(109): xaa in position 108 to 109 is any amino acid
  Variant (111)..(111): xaa in position 111 is Glu, Asp, Ser or Asn
  Variant (112)..(112): xaa in position 112 is any amino acid
  Variant (114)..(118): xaa in position 114 to 118 is any amino acid
  Variant (119)..(121): xaa in position 119 to 121 is any or no amino acid
  Variant (122)..(122): xaa in position 122 is Ile, Val, Leu, Phe or Met
  Variant (123)..(124): xaa in position 123 to 124 is any amino acid
  Variant (125)..(125): xaa in position 125 is Glu, Lys, Ala, Arg or His
  Variant (126)..(126): xaa in position 126 is Lys or Val
  Variant (127)..(128): xaa in position 127 to 128 is any amino acid
  Variant (129)..(129): xaa in position 129 is Val, Ile, Ala, Leu or Phe
  Variant (130)..(130): xaa in position 130 is Leu, Ile, Val, Phe or Met
  Variant (131)..(140): xaa in position 131 to 140 is any amino acid
  Variant (141)..(145): xaa in position 141 to 145 is any or no amino acid
  Variant (146)..(146): xaa in position 146 is Val, Leu, Ile, Ala or Ser
  Variant (147)..(147): xaa in position 147 is any amino acid
  Variant (148)..(148): xaa in position 148 is Gly or Ala
  Variant (149)..(149): xaa in position 149 is Gln or Arg
  Variant (150)..(150): xaa in position 150 is Tyr or Phe

SEQ ID NO: 41897 - protein, 44 aa, Artificial sequence; identical to SEQ ID NO: 2918
  Variant (1)..(1): xaa in position 1 is Tyr or Leu
  Variant (2)..(2): xaa in position 2 is any amino acid
  Variant (3)..(13): xaa in position 3 to 13 is any or no amino acid
  Variant (15)..(17): xaa in position 15 to 17 is any amino acid
  Variant (19)..(19): xaa in position 19 is Phe or Tyr
  Variant (20)..(25): xaa in position 20 to 25 is any amino acid
  Variant (26)..(26): xaa in position 26 is Ile, Val, Leu or Phe
  Variant (27)..(29): xaa in position 27 to 29 is any amino acid
  Variant (30)..(30): xaa in position 30 is Arg, Asn, Phe or Gln
  Variant (31)..(31): xaa in position 31 is Trp or Phe
  Variant (32)..(32): xaa in position 32 is any amino acid
  Variant (33)..(33): xaa in position 33 is Gly or Asp
  Variant (34)..(34): xaa in position 34 is Val or Thr
  Variant (36)..(36): xaa in position 36 is Phe or Ile
  Variant (37)..(37): xaa in position 37 is any amino acid
  Variant (38)..(38): xaa in position 38 is Leu, Met, Ile, Val or Phe
  Variant (39)..(40): xaa in position 39 to 40 is any amino acid
  Variant (41)..(41): xaa in position 41 is Gly or Ala
  Variant (43)..(43): xaa in position 43 is any amino acid
  Variant (44)..(44): xaa in position 44 is Leu, Met or Val

SEQ ID NO: 41898 - protein, 97 aa, Artificial sequence; identical to SEQ ID NO: 2919
  Variant (1)..(1): xaa in position 1 is Asn, Asp, Gln, Arg or Lys
  Variant (2)..(4): xaa in position 2 to 4 is any amino acid
  Variant (5)..(5): xaa in position 5 is Ile, Leu, Met, Phe or Val
  Variant (6)..(6): xaa in position 6 is any amino acid
  Variant (7)..(7): xaa in position 7 is Ile, Leu, Val, Ala or Ser
  Variant (8)..(8): xaa in position 8 is any amino acid
  Variant (9)..(9): xaa in position 9 is Pro or His
  Variant (10)..(12): xaa in position 10 to 12 is any amino acid
  Variant (13)..(13): xaa in position 13 is Ile, Val, Met, Leu, Phe or Ala
  Variant (14)..(19): xaa in position 14 to 19 is any amino acid
  Variant (20)..(20): xaa in position 20 is Lys, Ser or Arg
  Variant (21)..(29): xaa in position 21 to 29 is any amino acid
  Variant (30)..(35): xaa in position 30 to 35 is any or no amino acid
  Variant (36)..(36): xaa in position 36 is Leu, Ile, Met or Val
  Variant (37)..(44): xaa in position 37 to 44 is any amino acid
  Variant (45)..(64): xaa in position 45 to 64 is any or no amino acid
  Variant (65)..(65): xaa in position 65 is Ala, Gly, Pro or Ser
  Variant (66)..(66): xaa in position 66 is Tyr or Leu
  Variant (67)..(68): xaa in position 67 to 68 is any amino acid
  Variant (69)..(69): xaa in position 69 is Leu, Met or Tyr
  Variant (70)..(70): xaa in position 70 is Leu, Ile, Phe or Met
  Variant (71)..(71): xaa in position 71 is any amino acid
  Variant (72)..(72): xaa in position 72 is Asp, Glu, Ala, Asn or His
  Variant (73)..(75): xaa in position 73 to 75 is any amino acid
  Variant (76)..(76): xaa in position 76 is Gly, Ser or Asp
  Variant (77)..(80): xaa in position 77 to 80 is any amino acid
  Variant (81)..(81): xaa in position 81 is Phe or Tyr
  Variant (82)..(85): xaa in position 82 to 85 is any amino acid
  Variant (86)..(86): xaa in position 86 is any or no amino acid
  Variant (87)..(87): xaa in position 87 is Val, Ile, Leu, Ala or Gln
  Variant (88)..(90): xaa in position 88 to 90 is any amino acid
  Variant (92)..(96): xaa in position 92 to 96 is any amino acid
  Variant (97)..(97): xaa in position 97 is Ile, Val, Leu, Phe or Ala

SEQ ID NO: 41899 - DNA, 1203 bp, Escherichia coli; identical to SEQ ID NO: 13945
  CDS (1)..(1203)

SEQ ID NO: 41900 - protein, 400 aa, Escherichia coli; identical to SEQ ID NO: 13946

SEQ ID NO: 41901 - DNA, 1281 bp, Aquifex aeolicus VF5; identical to SEQ ID NO: 13947
  CDS (1)..(1281): transl_table=11

SEQ ID NO: 41902 - protein, 426 aa, Aquifex aeolicus VF5; identical to SEQ ID NO: 13948

SEQ ID NO: 41903 - DNA, 1260 bp, Neisseria meningitidis Z2491; identical to SEQ ID NO: 13949
  CDS (1)..(1260): transl_table=11

SEQ ID NO: 41904 - protein, 419 aa, Neisseria meningitidis Z2491; identical to SEQ ID NO: 13950

SEQ ID NO: 41905 - DNA, 1425 bp, Deinococcus radiodurans R1; identical to SEQ ID NO: 13951
  CDS (1)..(1425): transl_table=11

SEQ ID NO: 41906 - protein, 474 aa, Deinococcus radiodurans R1; identical to SEQ ID NO: 13952

SEQ ID NO: 41907 - DNA, 1392 bp, Mycobacterium tuberculosis CDC1551; identical to SEQ ID NO: 13953
  CDS (1)..(1392): transl_table=11

SEQ ID NO: 41908 - protein, 463 aa, Mycobacterium tuberculosis CDC1551; identical to SEQ ID NO: 13954

SEQ ID NO: 41909 - DNA, 1203 bp, Salmonella typhimurium LT2; identical to SEQ ID NO: 13955
  CDS (1)..(1203): transl_table=11

SEQ ID NO: 41910 - protein, 400 aa, Salmonella typhimurium LT2; identical to SEQ ID NO: 13956

SEQ ID NO: 41911 - DNA, 1320 bp, Agrobacterium tumefaciens str. C58; identical to SEQ ID NO: 13957
  CDS (1)..(1320): transl_table=11

SEQ ID NO: 41912 - protein, 439 aa, Agrobacterium tumefaciens str. C58; identical to SEQ ID NO: 13958

SEQ ID NO: 41913 - DNA, 1251 bp, Yersinia pestis KIM; identical to SEQ ID NO: 13959
  CDS (1)..(1251): transl_table=11

SEQ ID NO: 41914 - protein, 416 aa, Yersinia pestis KIM; identical to SEQ ID NO: 13960

SEQ ID NO: 41915 - DNA, 1314 bp, Thermosynechococcus elongatus BP-1; identical to SEQ ID NO: 13961
  CDS (1)..(1314): transl_table=11

SEQ ID NO: 41916 - protein, 437 aa, Thermosynechococcus elongatus BP-1; identical to SEQ ID NO: 13962

SEQ ID NO: 41917 - DNA, 1464 bp, Oceanobacillus iheyensis HTE831; identical to SEQ ID NO: 13963
  CDS (1)..(1464): transl_table=11

SEQ ID NO: 41918 - protein, 487 aa, Oceanobacillus iheyensis HTE831; identical to SEQ ID NO: 13964

SEQ ID NO: 41919 - DNA, 1209 bp, Pseudomonas putida KT2440; identical to SEQ ID NO: 13965
  CDS (1)..(1209): transl_table=11

SEQ ID NO: 41920 - protein, 402 aa, Pseudomonas putida KT2440; identical to SEQ ID NO: 13966

SEQ ID NO: 41921 - DNA, 1305 bp, Bradyrhizobium japonicum USDA 110; identical to SEQ ID NO: 13967
  CDS (1)..(1305)

SEQ ID NO: 41922 - protein, 434 aa, Bradyrhizobium japonicum USDA 110; identical to SEQ ID NO: 13968

SEQ ID NO: 41923 - DNA, 1434 bp, Lactobacillus plantarum WCFS1; identical to SEQ ID NO: 13969
  CDS (1)..(1434): transl_table=11

SEQ ID NO: 41924 - protein, 477 aa, Lactobacillus plantarum WCFS1; identical to SEQ ID NO: 13970

SEQ ID NO: 41925 - DNA, 1203 bp, Salmonella enterica subsp. enterica serovar Typhi Ty2; identical to SEQ ID NO: 13971
  CDS (1)..(1203): transl_table=11

SEQ ID NO: 41926 - protein, 400 aa, Salmonella enterica subsp. enterica serovar Typhi Ty2; identical to SEQ ID NO: 13972

SEQ ID NO: 41927 - DNA, 1170 bp, Bacteroides thetaiotaomicron VPI-5482; identical to SEQ ID NO: 13973
  CDS (1)..(1170): transl_table=11

SEQ ID NO: 41928 - protein, 389 aa, Bacteroides thetaiotaomicron VPI-5482; identical to SEQ ID NO: 13974

SEQ ID NO: 41929 - DNA, 1407 bp, Coxiella burnetii RSA 493; identical to SEQ ID NO: 13975
  CDS (1)..(1407): transl_table=11

SEQ ID NO: 41930 - protein, 468 aa, Coxiella burnetii RSA 493; identical to SEQ ID NO: 13976

SEQ ID NO: 41931 - DNA, 1185 bp, Porphyromonas gingivalis W83; identical to SEQ ID NO: 13977
  CDS (1)..(1185): transl_table=11

SEQ ID NO: 41932 - protein, 394 aa, Porphyromonas gingivalis W83; identical to SEQ ID NO: 13978

SEQ ID NO: 41933 - DNA, 1608 bp, Oryza sativa (japonica cultivar-group); identical to SEQ ID NO: 13979
  CDS (1)..(1608)

SEQ ID NO: 41934 - protein, 535 aa, Oryza sativa (japonica cultivar-group); identical to SEQ ID NO: 13980

SEQ ID NO: 41935 - DNA, 1446 bp, Geobacter sulfurreducens PCA; identical to SEQ ID NO: 13981
  CDS (1)..(1446): transl_table=11

SEQ ID NO: 41936 - protein, 481 aa, Geobacter sulfurreducens PCA; identical to SEQ ID NO: 13982

SEQ ID NO: 41937 - DNA, 1437 bp, Treponema denticola ATCC 35405; identical to SEQ ID NO: 13983
  CDS (1)..(1437): transl_table=11

SEQ ID NO: 41938 - protein, 478 aa, Treponema denticola ATCC 35405; identical to SEQ ID NO: 13984

SEQ ID NO: 41939 - DNA, 1293 bp, Eremothecium gossypii; identical to SEQ ID NO: 13985
  CDS (1)..(1293)

SEQ ID NO: 41940 - protein, 430 aa, Eremothecium gossypii; identical to SEQ ID NO: 13986

SEQ ID NO: 41941 - DNA, 1434 bp, Neurospora crassa; identical to SEQ ID NO: 13987
  CDS (1)..(1434)

SEQ ID NO: 41942 - protein, 477 aa, Neurospora crassa; identical to SEQ ID NO: 13988

SEQ ID NO: 41943 - DNA, 5916 bp, Magnaporthe grisea 70-15; identical to SEQ ID NO: 13989
  CDS (1)..(5916)

SEQ ID NO: 41944 - protein, 1971 aa, Magnaporthe grisea 70-15; identical to SEQ ID NO: 13990

SEQ ID NO: 41945 - DNA, 1380 bp, Gibberella zeae PH-1; identical to SEQ ID NO: 13991
  CDS (1)..(1380)

SEQ ID NO: 41946 - protein, 459 aa, Gibberella zeae PH-1; identical to SEQ ID NO: 13992

SEQ ID NO: 41947 - DNA, 1839 bp, Ustilago maydis 521; identical to SEQ ID NO: 13993
  CDS (1)..(1839)

SEQ ID NO: 41948 - protein, 612 aa, Ustilago maydis 521; identical to SEQ ID NO: 13994

SEQ ID NO: 41949 - DNA, 1464 bp, Aspergillus nidulans FGSC A4; identical to SEQ ID NO: 13995
  CDS (1)..(1464)

SEQ ID NO: 41950 - protein, 487 aa, Aspergillus nidulans FGSC A4; identical to SEQ ID NO: 13996

SEQ ID NO: 41951 - DNA, 1296 bp, Candida glabrata CBS138; identical to SEQ ID NO: 13997
  CDS (1)..(1296)

SEQ ID NO: 41952 - protein, 431 aa, Candida glabrata CBS138; identical to SEQ ID NO: 13998

SEQ ID NO: 41953 - DNA, 1284 bp, Kluyveromyces lactis NRRL Y-1140; identical to SEQ ID NO: 13999
  CDS (1)..(1284)

SEQ ID NO: 41954 - protein, 427 aa, Kluyveromyces lactis NRRL Y-1140; identical to SEQ ID NO: 14000

SEQ ID NO: 41955 - DNA, 1269 bp, Debaryomyces hansenii CBS767; identical to SEQ ID NO: 14001
  CDS (1)..(1269)

SEQ ID NO: 41956 - protein, 422 aa, Debaryomyces hansenii CBS767; identical to SEQ ID NO: 14002

SEQ ID NO: 41957 - DNA, 1245 bp, Yarrowia lipolytica CLIB99; identical to SEQ ID NO: 14003
  CDS (1)..(1245)

SEQ ID NO: 41958 - protein, 414 aa, Yarrowia lipolytica CLIB99; identical to SEQ ID NO: 14004

SEQ ID NO: 41959 - DNA, 1362 bp, Cryptococcus neoformans var. neoformans JEC21; identical to SEQ ID NO: 14005
  CDS (1)..(1362)

SEQ ID NO: 41960 - protein, 453 aa, Cryptococcus neoformans var. neoformans JEC21; identical to SEQ ID NO: 14006

SEQ ID NO: 41961 - DNA, 1173 bp, Entamoeba histolytica HM-1:IMSS; identical to SEQ ID NO: 14007
  CDS (1)..(1173)

SEQ ID NO: 41962 - protein, 390 aa, Entamoeba histolytica HM-1:IMSS; identical to SEQ ID NO: 14008

SEQ ID NO: 41963 - DNA, 1266 bp, Candida albicans SC5314; identical to SEQ ID NO: 14009
  CDS (1)..(1266): transl_table=12

SEQ ID NO: 41964 - protein, 421 aa, Candida albicans SC5314; identical to SEQ ID NO: 14010

SEQ ID NO: 41965 - DNA, 1305 bp, Bartonella quintana str. Toulouse; identical to SEQ ID NO: 14011
  CDS (1)..(1305): transl_table=11

SEQ ID NO: 41966 - protein, 434 aa, Bartonella quintana str. Toulouse; identical to SEQ ID NO: 14012

SEQ ID NO: 41967 - DNA, 1305 bp, Bartonella henselae str. Houston-1; identical to SEQ ID NO: 14013
  CDS (1)..(1305): transl_table=11

SEQ ID NO: 41968 - protein, 434 aa, Bartonella henselae str. Houston-1; identical to SEQ ID NO: 14014

SEQ ID NO: 41969 - DNA, 1470 bp, Bacillus licheniformis ATCC 14580; identical to SEQ ID NO: 14015
  CDS (1)..(1470): transl_table=11

SEQ ID NO: 41970 - protein, 489 aa, Bacillus licheniformis ATCC 14580; identical to SEQ ID NO: 14016

SEQ ID NO: 41971 - DNA, 1167 bp, Bacteroides fragilis YCH46; identical to SEQ ID NO: 14017
  CDS (1)..(1167): transl_table=11

SEQ ID NO: 41972 - protein, 388 aa, Bacteroides fragilis YCH46; identical to SEQ ID NO: 14018

SEQ ID NO: 41973 - DNA, 1350 bp, Methylococcus capsulatus str. Bath; identical to SEQ ID NO: 14019
  CDS (1)..(1350): transl_table=11

SEQ ID NO: 41974 - protein, 449 aa, Methylococcus capsulatus str. Bath; identical to SEQ ID NO: 14020

SEQ ID NO: 41975 - DNA, 1317 bp, Nocardia farcinica IFM 10152; identical to SEQ ID NO: 14021
  CDS (1)..(1317): transl_table=11

SEQ ID NO: 41976 - protein, 438 aa, Nocardia farcinica IFM 10152; identical to SEQ ID NO: 14022

SEQ ID NO: 41977 - DNA, 1404 bp, Legionella pneumophila str. Paris; identical to SEQ ID NO: 14023
  CDS (1)..(1404): transl_table=11

SEQ ID NO: 41978 - protein, 467 aa, Legionella pneumophila str. Paris; identical to SEQ ID NO: 14024

SEQ ID NO: 41979 - DNA, 1404 bp, Legionella pneumophila str. Lens; identical to SEQ ID NO: 14025
  CDS (1)..(1404): transl_table=11

SEQ ID NO: 41980 - protein, 467 aa, Legionella pneumophila str. Lens; identical to SEQ ID NO: 14026

SEQ ID NO: 41981 - DNA, 1473 bp, Geobacillus kaustophilus HTA426; identical to SEQ ID NO: 14027
  CDS (1)..(1473): transl_table=11

SEQ ID NO: 41982 - protein, 490 aa, Geobacillus kaustophilus HTA426; identical to SEQ ID NO: 14028

SEQ ID NO: 41983 - DNA, 1347 bp, Idiomarina loihiensis L2TR; identical to SEQ ID NO: 14029
  CDS (1)..(1347): transl_table=11

SEQ ID NO: 41984 - protein, 448 aa, Idiomarina loihiensis L2TR; identical to SEQ ID NO: 14030

SEQ ID NO: 41985 - DNA, 1344 bp, Silicibacter pomeroyi DSS-3; identical to SEQ ID NO: 14031
  CDS (1)..(1344): transl_table=11

SEQ ID NO: 41986 - protein, 447 aa, Silicibacter pomeroyi DSS-3; identical to SEQ ID NO: 14032

SEQ ID NO: 41987 - DNA, 1260 bp, Neisseria gonorrhoeae FA 1090; identical to SEQ ID NO: 14033
  CDS (1)..(1260): transl_table=11

SEQ ID NO: 41988 - protein, 419 aa, Neisseria gonorrhoeae FA 1090; identical to SEQ ID NO: 14034

SEQ ID NO: 41989 - DNA, 1167 bp, Bacteroides fragilis NCTC 9343; identical to SEQ ID NO: 14035
  CDS (1)..(1167): transl_table=11

SEQ ID NO: 41990 - protein, 388 aa, Bacteroides fragilis NCTC 9343; identical to SEQ ID NO: 14036

SEQ ID NO: 41991 - DNA, 1251 bp, Salmonella enterica subsp. enterica serovar Choleraesuis str; identical to SEQ ID NO: 14037
  CDS (1)..(1251): transl_table=11

SEQ ID NO: 41992 - protein, 416 aa, Salmonella enterica subsp. enterica serovar Choleraesuis str; identical to SEQ ID NO: 14038

SEQ ID NO: 41993 - DNA, 1224 bp, Pseudomonas syringae pv. syringae B728a; identical to SEQ ID NO: 14039
  CDS (1)..(1224)

SEQ ID NO: 41994 - protein, 407 aa, Pseudomonas syringae pv. syringae B728a; identical to SEQ ID NO: 14040

SEQ ID NO: 41995 - DNA, 1326 bp, Corynebacterium jeikeium K411; identical to SEQ ID NO: 14041
  CDS (1)..(1326): transl_table=11

SEQ ID NO: 41996 - protein, 441 aa, Corynebacterium jeikeium K411; identical to SEQ ID NO: 14042

SEQ ID NO: 41997 - DNA, 1293 bp, Rhodobacter sphaeroides 2.4.1; identical to SEQ ID NO: 14043
  CDS (1)..(1293)

SEQ ID NO: 41998 - protein, 430 aa, Rhodobacter sphaeroides 2.4.1; identical to SEQ ID NO: 14044

SEQ ID NO: 41999 - DNA, 1134 bp, Xylella fastidiosa Ann-1; identical to SEQ ID NO: 14045
  CDS (1)..(1134)

SEQ ID NO: 42000 - protein, 377 aa, Xylella fastidiosa Ann-1; identical to SEQ ID NO: 14046

SEQ ID NO: 42001 - DNA, 1464 bp, Leuconostoc mesenteroides subsp. mesenteroides ATCC 8293; identical to SEQ ID NO: 14047
  CDS (1)..(1464)

SEQ ID NO: 42002 - protein, 487 aa, Leuconostoc mesenteroides subsp. mesenteroides ATCC 8293; identical to SEQ ID NO: 14048

SEQ ID NO: 42003 - DNA, 1242 bp, Psychrobacter sp. 273-4; identical to SEQ ID NO: 14049
  CDS (1)..(1242)

SEQ ID NO: 42004 - protein, 413 aa, Psychrobacter sp. 273-4; identical to SEQ ID NO: 14050

SEQ ID NO: 42005 - DNA, 1179 bp, Ralstonia eutropha JMP134; identical to SEQ ID NO: 14051
  CDS (1)..(1179)

SEQ ID NO: 42006 - protein, 392 aa, Ralstonia eutropha JMP134; identical to SEQ ID NO: 14052

SEQ ID NO: 42007 - DNA, 1200 bp, Burkholderia cepacia R18194; identical to SEQ ID NO: 14053
  CDS (1)..(1200)

SEQ ID NO: 42008 - protein, 399 aa, Burkholderia cepacia R18194; identical to SEQ ID NO: 14054

SEQ ID NO: 42009 - DNA, 1224 bp, Pseudomonas fluorescens PfO-1; identical to SEQ ID NO: 14055
  CDS (1)..(1224)

SEQ ID NO: 42010 - protein, 407 aa, Pseudomonas fluorescens PfO-1; identical to SEQ ID NO: 14056

SEQ ID NO: 42011 - DNA, 1197 bp, Burkholderia fungorum LB400; identical to SEQ ID NO: 14057
  CDS (1)..(1197)

SEQ ID NO: 42012 - protein, 398 aa, Burkholderia fungorum LB400; identical to SEQ ID NO: 14058

SEQ ID NO: 42013 - DNA, 1428 bp, Oenococcus oeni PSU-1; identical to SEQ ID NO: 14059
  CDS (1)..(1428)

SEQ ID NO: 42014 - protein, 475 aa, Oenococcus oeni PSU-1; identical to SEQ ID NO: 14060

SEQ ID NO: 42015 - DNA, 1380 bp, Trichodesmium erythraeum IMS101; identical to SEQ ID NO: 14061
  CDS (1)..(1380)

SEQ ID NO: 42016 - protein, 459 aa, Trichodesmium erythraeum IMS101; identical to SEQ ID NO: 14062

SEQ ID NO: 42017 - DNA, 1434 bp, Campylobacter upsaliensis RM3195; identical to SEQ ID NO: 14063
  CDS (1)..(1434): transl_table=11

SEQ ID NO: 42018 - protein, 477 aa, Campylobacter upsaliensis RM3195; identical to SEQ ID NO: 14064

SEQ ID NO: 42019 - DNA, 1488 bp, Lactococcus lactis subsp. cremoris SK11; identical to SEQ ID NO: 14065
  CDS (1)..(1488)

SEQ ID NO: 42020 - protein, 495 aa, Lactococcus lactis subsp. cremoris SK11; identical to SEQ ID NO: 14066

SEQ ID NO: 42021 - DNA, 1461 bp, Deinococcus geothermalis DSM 11300; identical to SEQ ID NO: 14067
  CDS (1)..(1461): transl_table=11

SEQ ID NO: 42022 - protein, 486 aa, Deinococcus geothermalis DSM 11300; identical to SEQ ID NO: 14068

SEQ ID NO: 42023 - DNA, 1359 bp, Azotobacter vinelandii AvOP; identical to SEQ ID NO: 14069
  CDS (1)..(1359): transl_table=11

SEQ ID NO: 42024 - protein, 452 aa, Azotobacter vinelandii AvOP; identical to SEQ ID NO: 14070

SEQ ID NO: 42025 - DNA, 1356 bp, Burkholderia vietnamiensis G4; identical to SEQ ID NO: 14071
  CDS (1)..(1356): transl_table=11

SEQ ID NO: 42026 - protein, 451 aa, Burkholderia vietnamiensis G4; identical to SEQ ID NO: 14072

SEQ ID NO: 42027 - DNA, 1200 bp, Burkholderia mallei 10229; identical to SEQ ID NO: 14073
  CDS (1)..(1200)

SEQ ID NO: 42028 - protein, 399 aa, Burkholderia mallei 10229; identical to SEQ ID NO: 14074

SEQ ID NO: 42029 - DNA, 1200 bp, Burkholderia cenocepacia AU 1054; identical to SEQ ID NO: 14075
  CDS (1)..(1200): transl_table=11

SEQ ID NO: 42030 - protein, 399 aa, Burkholderia cenocepacia AU 1054; identical to SEQ ID NO: 14076

SEQ ID NO: 42031 - DNA, 1356 bp, Burkholderia pseudomallei 1655; identical to SEQ ID NO: 14077
  CDS (1)..(1356)

SEQ ID NO: 42032 - protein, 451 aa, Burkholderia pseudomallei 1655; identical to SEQ ID NO: 14078

SEQ ID NO: 42033 - DNA, 1173 bp, Chromohalobacter salexigens DSM 3043; identical to SEQ ID NO: 14079
  CDS (1)..(1173): transl_table=11

SEQ ID NO: 42034 - protein, 390 aa, Chromohalobacter salexigens DSM 3043; identical to SEQ ID NO: 14080

SEQ ID NO: 42035 - DNA, 1356 bp, Burkholderia pseudomallei 668; identical to SEQ ID NO: 14081
  CDS (1)..(1356)

SEQ ID NO: 42036 - protein, 451 aa, Burkholderia pseudomallei 668; identical to SEQ ID NO: 14082

SEQ ID NO: 42037 - DNA, 1269 bp, Polaromonas sp. JS666; identical to SEQ ID NO: 14083
  CDS (1)..(1269): transl_table=11

SEQ ID NO: 42038 - protein, 422 aa, Polaromonas sp. JS666; identical to SEQ ID NO: 14084

SEQ ID NO: 42039 - DNA, 1341 bp, Crocosphaera watsonii WH 8501; identical to SEQ ID NO: 14085
  CDS (1)..(1341): transl_table=11

SEQ ID NO: 42040 - protein, 446 aa, Crocosphaera watsonii WH 8501; identical to SEQ ID NO: 14086

SEQ ID NO: 42041 - DNA, 1431 bp, Geobacter metallireducens GS-15; identical to SEQ ID NO: 14087
  CDS (1)..(1431): transl_table=11

SEQ ID NO: 42042 - protein, 476 aa, Geobacter metallireducens GS-15; identical to SEQ ID NO: 14088

SEQ ID NO: 42043 - DNA, 1206 bp, Methanosarcina barkeri str. fusaro; identical to SEQ ID NO: 14089
  CDS (1)..(1206): transl_table=11

SEQ ID NO: 42044 - protein, 401 aa, Methanosarcina barkeri str. fusaro; identical to SEQ ID NO: 14090

SEQ ID NO: 42045 - DNA, 1206 bp, Desulfuromonas acetoxidans DSM 684; identical to SEQ ID NO: 14091
  CDS (1)..(1206): transl_table=11

SEQ ID NO: 42046 - protein, 401 aa, Desulfuromonas acetoxidans DSM 684; identical to SEQ ID NO: 14092

SEQ ID NO: 42047 - DNA, 1293 bp, Jannaschia sp. CCS1; identical to SEQ ID NO: 14093
  CDS (1)..(1293): transl_table=11

SEQ ID NO: 42048 - protein, 430 aa, Jannaschia sp. CCS1; identical to SEQ ID NO: 14094

SEQ ID NO: 42049 - DNA, 1458 bp, Desulfitobacterium hafniense DCB-2; identical to SEQ ID NO: 14095
  CDS (1)..(1458): transl_table=11

SEQ ID NO: 42050 - protein, 485 aa, Desulfitobacterium hafniense DCB-2; identical to SEQ ID NO: 14096

SEQ ID NO: 42051 - DNA, 1218 bp, Methanococcoides burtonii DSM 6242; identical to SEQ ID NO: 14097
  CDS (1)..(1218): transl_table=11

SEQ ID NO: 42052 - protein, 405 aa, Methanococcoides burtonii DSM 6242; identical to SEQ ID NO: 14098

SEQ ID NO: 42053 - DNA, 1575 bp, Frankia sp. EAN1pec; identical to SEQ ID NO: 14099
  CDS (1)..(1575): transl_table=11

SEQ ID NO: 42054 - protein, 524 aa, Frankia sp. EAN1pec; identical to SEQ ID NO: 14100

SEQ ID NO: 42055 - DNA, 1200 bp, Ralstonia metallidurans CH34; identical to SEQ ID NO: 14101
  CDS (1)..(1200): transl_table=11

SEQ ID NO: 42056 - protein, 399 aa, Ralstonia metallidurans CH34; identical to SEQ ID NO: 14102

SEQ ID NO: 42057 - DNA, 1341 bp, Magnetococcus sp. MC-1; identical to SEQ ID NO: 14103
  CDS (1)..(1341): transl_table=11

SEQ ID NO: 42058 - protein, 446 aa, Magnetococcus sp. MC-1; identical to SEQ ID NO: 14104

SEQ ID NO: 42059 - DNA, 1305 bp, Mesorhizobium sp. BNC1; identical to SEQ ID NO: 14105
  CDS (1)..(1305): transl_table=11

SEQ ID NO: 42060 - protein, 434 aa, Mesorhizobium sp. BNC1; identical to SEQ ID NO: 14106

SEQ ID NO: 42061 - DNA, 1290 bp, Silicibacter sp. TM1040; identical to SEQ ID NO: 14107
  CDS (1)..(1290): transl_table=11

SEQ ID NO: 42062 - protein, 429 aa, Silicibacter sp. TM1040; identical to SEQ ID NO: 14108

SEQ ID NO: 42063 - DNA, 1305 bp, Nitrobacter hamburgensis X14; identical to SEQ ID NO: 14109
  CDS (1)..(1305): transl_table=11

SEQ ID NO: 42064 - protein, 434 aa, Nitrobacter hamburgensis X14; identical to SEQ ID NO: 14110

SEQ ID NO: 42065 - DNA, 1308 bp, Paracoccus denitrificans PD1222; identical to SEQ ID NO: 14111
  CDS (1)..(1308): transl_table=11

SEQ ID NO: 42066 - protein, 435 aa, Paracoccus denitrificans PD1222; identical to SEQ ID NO: 14112

SEQ ID NO: 42067 - DNA, 1230 bp, Pseudomonas fluorescens; identical to SEQ ID NO: 14113
  CDS (1)..(1230): transl_table=11

SEQ ID NO: 42068 - protein, 409 aa, Pseudomonas fluorescens; identical to SEQ ID NO: 14114

SEQ ID NO: 42069 - DNA, 1215 bp, Pseudomonas fluorescens; identical to SEQ ID NO: 14115
  CDS (1)..(1215): transl_table=11

SEQ ID NO: 42070 - protein, 404 aa, Pseudomonas fluorescens; identical to SEQ ID NO: 14116

SEQ ID NO: 42071 - DNA, 1443 bp, Staphylococcus haemolyticus; identical to SEQ ID NO: 14117
  CDS (1)..(1443): transl_table=11

SEQ ID NO: 42072 - protein, 480 aa, Staphylococcus haemolyticus; identical to SEQ ID NO: 14118

SEQ ID NO: 42073 - DNA, 1245 bp, Leishmania major; identical to SEQ ID NO: 14119
  CDS (1)..(1245)

SEQ ID NO: 42074 - protein, 414 aa, Leishmania major; identical to SEQ ID NO: 14120

SEQ ID NO: 42075 - DNA, 1380 bp, Gibberella moniliformis; identical to SEQ ID NO: 14121
  CDS (1)..(1380)

SEQ ID NO: 42076 - protein, 459 aa, Gibberella moniliformis; identical to SEQ ID NO: 14122

SEQ ID NO: 42077 - DNA, 1233 bp, Schizosaccharomyces pombe; identical to SEQ ID NO: 14123
  CDS (1)..(1233)

SEQ ID NO: 42078 - protein, 410 aa, Schizosaccharomyces pombe; identical to SEQ ID NO: 14124

SEQ ID NO: 42079 - DNA, 1290 bp, Saccharomyces cerevisiae; identical to SEQ ID NO: 14125
  CDS (1)..(1290)

SEQ ID NO: 42080 - protein, 429 aa, Saccharomyces cerevisiae; identical to SEQ ID NO: 14126

SEQ ID NO: 42081 - DNA, 1200 bp, Pseudomonas aeruginosa; identical to SEQ ID NO: 14127
  CDS (1)..(1200): transl_table=11

SEQ ID NO: 42082 - protein, 399 aa, Pseudomonas aeruginosa; identical to SEQ ID NO: 14128

SEQ ID NO: 42083 - DNA, 1197 bp, Pseudomonas aeruginosa; identical to SEQ ID NO: 14129
  CDS (1)..(1197): transl_table=11

SEQ ID NO: 42084 - protein, 398 aa, Pseudomonas aeruginosa; identical to SEQ ID NO: 14130

SEQ ID NO: 42085 - DNA, 1224 bp, Acinetobacter sp; identical to SEQ ID NO: 14131
  CDS (1)..(1224): transl_table=11

SEQ ID NO: 42086 - protein, 407 aa, Acinetobacter sp; identical to SEQ ID NO: 14132

SEQ ID NO: 42087 - DNA, 1218 bp, Bordetella pertussis; identical to SEQ ID NO: 14133
  CDS (1)..(1218): transl_table=11

SEQ ID NO: 42088 - protein, 405 aa, Bordetella pertussis; identical to SEQ ID NO: 14134

SEQ ID NO: 42089 - DNA, 1305 bp, Brucella melitensis; identical to SEQ ID NO: 14135
  CDS (1)..(1305): transl_table=11

SEQ ID NO: 42090 - protein, 434 aa, Brucella melitensis; identical to SEQ ID NO: 14136

SEQ ID NO: 42091 - DNA, 1305 bp, Brucella suis; identical to SEQ ID NO: 14137
  CDS (1)..(1305)

SEQ ID NO: 42092 - protein, 434 aa, Brucella suis; identical to SEQ ID NO: 14138

SEQ ID NO: 42093 - DNA, 1200 bp, Buchnera aphidicola; identical to SEQ ID NO: 14139
  CDS (1)..(1200): transl_table=11

SEQ ID NO: 42094 - protein, 399 aa, Buchnera aphidicola; identical to SEQ ID NO: 14140

SEQ ID NO: 42095 - DNA, 1197 bp, Buchnera aphidicola; identical to SEQ ID NO: 14141
  CDS (1)..(1197): transl_table=11

SEQ ID NO: 42096 - protein, 398 aa, Buchnera aphidicola; identical to SEQ ID NO: 14142

SEQ ID NO: 42097 - DNA, 1200 bp, Burkholderia mallei; identical to SEQ ID NO: 14143
  CDS (1)..(1200): transl_table=11

SEQ ID NO: 42098 - protein, 399 aa, Burkholderia mallei; identical to SEQ ID NO: 14144

SEQ ID NO: 42099 - DNA, 1209 bp, Chromobacterium violaceum; identical to SEQ ID NO: 14145
  CDS (1)..(1209): transl_table=11

SEQ ID NO: 42100 - protein, 402 aa, Chromobacterium violaceum; identical to SEQ ID NO: 14146

SEQ ID NO: 42101 - DNA, 1206 bp, Erwinia carotovora; identical to SEQ ID NO: 14147
  CDS (1)..(1206): transl_table=11

SEQ ID NO: 42102 - protein, 401 aa, Erwinia carotovora; identical to SEQ ID NO: 14148

SEQ ID NO: 42103 - DNA, 1215 bp, Methanosarcina acetivorans; identical to SEQ ID NO: 14149
  CDS (1)..(1215): transl_table=11

SEQ ID NO: 42104 - protein, 404 aa, Methanosarcina acetivorans; identical to SEQ ID NO: 14150

SEQ ID NO: 42105 - DNA, 1209 bp, Neisseria gonorrhoeae; identical to SEQ ID NO: 14151
  CDS (1)..(1209)

SEQ ID NO: 42106 - protein, 402 aa, Neisseria gonorrhoeae; identical to SEQ ID NO: 14152

SEQ ID NO: 42107 - DNA, 1209 bp, Neisseria meningitidis; identical to SEQ ID NO: 14153
  CDS (1)..(1209)

SEQ ID NO: 42108 - protein, 402 aa, Neisseria meningitidis; identical to SEQ ID NO: 14154

SEQ ID NO: 42109 - DNA, 1209 bp, Neisseria meningitidis; identical to SEQ ID NO: 14155
  CDS (1)..(1209): transl_table=11

SEQ ID NO: 42110 - protein, 402 aa, Neisseria meningitidis; identical to SEQ ID NO: 14156

SEQ ID NO: 42111 - DNA, 1215 bp, Photorhabdus luminescens; identical to SEQ ID NO: 14157
  CDS (1)..(1215): transl_table=11

SEQ ID NO: 42112 - protein, 404 aa, Photorhabdus luminescens; identical to SEQ ID NO: 14158

SEQ ID NO: 42113 - DNA, 1218 bp, Photobacterium profundum; identical to SEQ ID NO: 14159
  CDS (1)..(1218): transl_table=11

SEQ ID NO: 42114 - protein, 405 aa, Photobacterium profundum; identical to SEQ ID NO: 14160

SEQ ID NO: 42115 - DNA, 1170 bp, Ralstonia solanacearum; identical to SEQ ID NO: 14161
  CDS (1)..(1170)

SEQ ID NO: 42116 - protein, 389 aa, Ralstonia solanacearum; identical to SEQ ID NO: 14162

SEQ ID NO: 42117 - DNA, 1305 bp, Rhizobium loti; identical to SEQ ID NO: 14163
  CDS (1)..(1305): transl_table=11

SEQ ID NO: 42118 - protein, 434 aa, Rhizobium loti; identical to SEQ ID NO: 14164

SEQ ID NO: 42119 - DNA, 1305 bp, Rhizobium meliloti; identical to SEQ ID NO: 14165
  CDS (1)..(1305): transl_table=11

SEQ ID NO: 42120 - protein, 434 aa, Rhizobium meliloti; identical to SEQ ID NO: 14166

SEQ ID NO: 42121 - DNA, 1203 bp, Salmonella choleraesuis; identical to SEQ ID NO: 14167
  CDS (1)..(1203)

SEQ ID NO: 42122 - protein, 400 aa, Salmonella choleraesuis; identical to SEQ ID NO: 14168

SEQ ID NO: 42123 - DNA, 1203 bp, Salmonella paratyphi; identical to SEQ ID NO: 14169
  CDS (1)..(1203): transl_table=11

SEQ ID NO: 42124 - protein, 400 aa, Salmonella paratyphi; identical to SEQ ID NO: 14170

SEQ ID NO: 42125 - DNA, 1308 bp, Vibrio cholerae; identical to SEQ ID NO: 14171
  CDS (1)..(1308): transl_table=11

SEQ ID NO: 42126 - protein, 435 aa, Vibrio cholerae; identical to SEQ ID NO: 14172

SEQ ID NO: 42127 - DNA, 1311 bp, Vibrio parahaemolyticus; identical to SEQ ID NO: 14173
  CDS (1)..(1311): transl_table=11

SEQ ID NO: 42128 - protein, 436 aa, Vibrio parahaemolyticus; identical to SEQ ID NO: 14174

SEQ ID NO: 42129 - DNA, 1314 bp, Vibrio vulnificus; identical to SEQ ID NO: 14175
  CDS (1)..(1314): transl_table=11

SEQ ID NO: 42130 - protein, 437 aa, Vibrio vulnificus; identical to SEQ ID NO: 14176

SEQ ID NO: 42131 - DNA, 1314 bp, Vibrio vulnificus; identical to SEQ ID NO: 14177
  CDS (1)..(1314): transl_table=11

SEQ ID NO: 42132 - protein, 437 aa, Vibrio vulnificus; identical to SEQ ID NO: 14178

SEQ ID NO: 42133 - DNA, 1179 bp, Xanthomonas axonopodis; identical to SEQ ID NO: 14179
  CDS (1)..(1179): transl_table=11

SEQ ID NO: 42134 - protein, 392 aa, Xanthomonas axonopodis; identical to SEQ ID NO: 14180

SEQ ID NO: 42135 - DNA, 1197 bp, Xanthomonas campestris; identical to SEQ ID NO: 14181
  CDS (1)..(1197): transl_table=11

SEQ ID NO: 42136 - protein, 398 aa, Xanthomonas campestris; identical to SEQ ID NO: 14182

SEQ ID NO: 42137 - DNA, 1185 bp, Xylella fastidiosa; identical to SEQ ID NO: 14183
  CDS (1)..(1185): transl_table=11

SEQ ID NO: 42138 - protein, 394 aa, Xylella fastidiosa; identical to SEQ ID NO: 14184

SEQ ID NO: 42139 - DNA, 1185 bp, Xylella fastidiosa; identical to SEQ ID NO: 14185
  CDS (1)..(1185): transl_table=11

SEQ ID NO: 42140 - protein, 394 aa, Xylella fastidiosa; identical to SEQ ID NO: 14186

SEQ ID NO: 42141 - DNA, 24 bp, Artificial sequence
  (1)..(24): primer
atgacacaattcgcttctcctgtt

SEQ ID NO: 42142 - DNA, 26 bp, Artificial sequence
  (1)..(26): primer
ttaactggcttttttaatatgcggaa

SEQ ID NO: 42143 - protein, 581 aa, Artificial sequence; identical to SEQ ID NO: 14189
  Variant (3)..(3): xaa in position 3 is any amino acid
  Variant (20)..(22): xaa in position 20 to 22 is any amino acid
  Variant (23)..(24): xaa in position 23 to 24 is any or no amino acid
  Variant (27)..(29): xaa in position 27 to 29 is any amino acid
  Variant (31)..(31): xaa in position 31 is any amino acid
  Variant (33)..(33): xaa in position 33 is any amino acid
  Variant (35)..(36): xaa in position 35 to 36 is any amino acid
  Variant (38)..(42): xaa in position 38 to 42 is any amino acid
  Variant (43)..(53): xaa in position 43 to 53 is any or no amino acid
  Variant (56)..(57): xaa in position 56 to 57 is any amino acid
  Variant (60)..(60): xaa in position 60 is any amino acid
  Variant (62)..(63): xaa in position 62 to 63 is any amino acid
  Variant (68)..(68): xaa in position 68 is any amino acid
  Variant (72)..(72): xaa in position 72 is any amino acid
  Variant (75)..(76): xaa in position 75 to 76 is any amino acid
  Variant (78)..(78): xaa in position 78 is any amino acid
  Variant (80)..(88): xaa in position 80 to 88 is any or no amino acid
  Variant (95)..(96): xaa in position 95 to 96 is any amino acid
  Variant (100)..(103): xaa in position 100 to 103 is any amino acid
  Variant (105)..(105): xaa in position 105 is any amino acid
  Variant (107)..(109): xaa in position 107 to 109 is any amino acid
  Variant (110)..(126): xaa in position 110 to 126 is any or no amino acid
  Variant (128)..(128): xaa in position 128 is any or no amino acid
  Variant (130)..(130): xaa in position 130 is any or no amino acid
  Variant (132)..(132): xaa in position 132 is any or no amino acid
  Variant (134)..(134): xaa in position 134 is any or no amino acid
  Variant (136)..(137): xaa in position 136 to 137 is any amino acid
  Variant (138)..(138): xaa in position 138 is any or no amino acid
  Variant (153)..(154): xaa in position 153 to 154 is any amino acid
  Variant (156)..(156): xaa in position 156 is any amino acid
  Variant (158)..(161): xaa in position 158 to 161 is any amino acid
  Variant (162)..(162): xaa in position 162 is any or no amino acid
  Variant (164)..(172): xaa in position 164 to 172 is any amino acid
  Variant (174)..(176): xaa in position 174 to 176 is any amino acid
  Variant (178)..(183): xaa in position 178 to 183 is any amino acid
  Variant (184)..(198): xaa in position 184 to 198 is any or no amino acid
  Variant (208)..(208): xaa in position 208 is any amino acid
  Variant (210)..(212): xaa in position 210 to 212 is any amino acid
  Variant (214)..(215): xaa in position 214 to 215 is any amino acid
  Variant (218)..(218): xaa in position 218 is any amino acid
  Variant (221)..(222): xaa in position 221 to 222 is any amino acid
  Variant (224)..(224): xaa in position 224 is any amino acid
  Variant (225)..(236): xaa in position 225 to 236 is any or no amino acid
  Variant (238)..(238): xaa in position 238 is any or no amino acid
  Variant (244)..(245): xaa in position 244 to 245 is any amino acid
  Variant (250)..(250): xaa in position 250 is any amino acid
  Variant (252)..(252): xaa in position 252 is any amino acid
  Variant (263)..(263): xaa in position 263 is any amino acid
  Variant (265)..(266): xaa in position 265 to 266 is any amino acid
  Variant (269)..(270): xaa in position 269 to 270 is any amino acid
  Variant (271)..(288): xaa in position 271 to 288 is any or no amino acid
  Variant (290)..(291): xaa in position 290 to 291 is any amino acid
  Variant (294)..(295): xaa in position 294 to 295 is any amino acid
  Variant (298)..(299): xaa in position 298 to 299 is any amino acid
  Variant (302)..(303): xaa in position 302 to 303 is any amino acid
  Variant (305)..(305): xaa in position 305 is any amino acid
  Variant (306)..(316): xaa in position 306 to 316 is any or no amino acid
  Variant (318)..(318): xaa in position 318 is any amino acid
  Variant (326)..(329): xaa in position 326 to 329 is any amino acid
  Variant (334)..(334): xaa in position 334 is any amino acid
  Variant (337)..(337): xaa in position 337 is any amino acid
  Variant (338)..(391): xaa in position 338 to 391 is any or no amino acid
  Variant (394)..(394): xaa in position 394 is any amino acid
  Variant (397)..(397): xaa in position 397 is any amino acid
  Variant (401)..(401): xaa in position 401 is any amino acid
  Variant (407)..(408): xaa in position 407 to 408 is any amino acid
  Variant (416)..(416): xaa in position 416 is any amino acid
  Variant (418)..(418): xaa in position 418 is any amino acid
  Variant (419)..(427): xaa in position 419 to 427 is any or no amino acid
  Variant (430)..(430): xaa in position 430 is any amino acid
  Variant (433)..(442): xaa in position 433 to 442 is any or no amino acid
  Variant (453)..(453): xaa in position 453 is any amino acid
  Variant (455)..(455): xaa in position 455 is any amino acid
  Variant (457)..(457): xaa in position 457 is any amino acid
  Variant (459)..(459): xaa in position 459 is any amino acid
  Variant (461)..(466): xaa in position 461 to 466 is any amino acid
  Variant (468)..(474): xaa in position 468 to 474 is any or no amino acid
  Variant (484)..(484): xaa in position 484 is any amino acid
  Variant (489)..(491): xaa in position 489 to 491 is any amino acid
  Variant (492)..(531): xaa in position 492 to 531 is any or no amino acid
  Variant (541)..(542): xaa in position 541 to 542 is any amino acid
  Variant (545)..(545): xaa in position 545 is any amino acid
  Variant (553)..(553): xaa in position 553 is any amino acid
  Variant (557)..(557): xaa in position 557 is any amino acid
  Variant (559)..(560): xaa in position 559 to 560 is any amino acid
  Variant (561)..(575): xaa in position 561 to 575 is any or no amino acid
  Variant (578)..(579): xaa in position 578 to 579 is any amino acid

SEQ ID NO: 42144 - protein, 10 aa, Artificial sequence
  Variant (2)..(2): xaa in position 2 is any amino acid
  Variant (3)..(3): xaa in position 3 is Asn or Thr
  Variant (5)..(5): xaa in position 5 is any amino acid
  Variant (7)..(7): xaa in position 7 is any amino acid
  Variant (8)..(8): xaa in position 8 is Phe, Ile, Leu or Val
  Variant (9)..(9): xaa in position 9 is any amino acid
LXXDXYXXXM

SEQ ID NO: 42145 - protein, 25 aa, Artificial sequence
  Variant (2)..(4): xaa in position 2 to 4 is any or no amino acid
  Variant (8)..(10): xaa in position 8 to 10 is any amino acid
  Variant (11)..(11): xaa in position 11 is Ala or Gly
  Variant (12)..(14): xaa in position 12 to 14 is any amino acid
  Variant (15)..(15): xaa in position 15 is Ala, Asp, Glu, Gly, Asn, Gln or Ser
  Variant (16)..(19): xaa in position 16 to 19 is any amino acid
  Variant (22)..(22): xaa in position 22 is any amino acid
  Variant (25)..(25): xaa in position 25 is Ala, Glu, Gln or Ser
GXXXTSNXXXXXXXXXXXXGTXAHX

SEQ ID NO: 42146 - DNA, 1482 bp, Escherichia coli; identical to SEQ ID NO: 14192
  CDS (1)..(1482)

SEQ ID NO: 42147 - protein, 493 aa, Escherichia coli; identical to SEQ ID NO: 14193

SEQ ID NO: 42148 - DNA, 1401 bp, Mesorhizobium loti MAFF303099; identical to SEQ ID NO: 14194
  CDS (1)..(1401): transl_table=11

SEQ ID NO: 42149 - protein, 466 aa, Mesorhizobium loti MAFF303099; identical to SEQ ID NO: 14195

SEQ ID NO: 42150 - DNA, 1401 bp, Mesorhizobium loti MAFF303099; identical to SEQ ID NO: 14196
  CDS (1)..(1401): transl_table=11

SEQ ID NO: 42151 - protein, 466 aa, Mesorhizobium loti MAFF303099; identical to SEQ ID NO: 14197

SEQ ID NO: 42152 - DNA, 1197 bp, Bacillus halodurans C-125; identical to SEQ ID NO: 14198
  CDS (1)..(1197): transl_table=11

SEQ ID NO: 42153 - protein, 398 aa, Bacillus halodurans C-125; identical to SEQ ID NO: 14199

SEQ ID NO: 42154 - DNA, 1545 bp, Pasteurella multocida subsp. multocida str. Pm70; identical to SEQ ID NO: 14200
  CDS (1)..(1545): transl_table=11

SEQ ID NO: 42155 - protein, 514 aa, Pasteurella multocida subsp. multocida str. Pm70; identical to SEQ ID NO: 14201

SEQ ID NO: 42156 - DNA, 1206 bp, Pseudomonas aeruginosa PAO1; identical to SEQ ID NO: 14202
  CDS (1)..(1206): transl_table=11

SEQ ID NO: 42157 - protein, 401 aa, Pseudomonas aeruginosa PAO1; identical to SEQ ID NO: 14203

SEQ ID NO: 42158 - DNA, 1080 bp, Pseudomonas aeruginosa PAO1; identical to SEQ ID NO: 14204
  CDS (1)..(1080): transl_table=11

SEQ ID NO: 42159 - protein, 359 aa, Pseudomonas aeruginosa PAO1; identical to SEQ ID NO: 14205

SEQ ID NO: 42160 - DNA, 1590 bp, Pseudomonas aeruginosa PAO1; identical to SEQ ID NO: 14206
  CDS (1)..(1590): transl_table=11

SEQ ID NO: 42161 - protein, 529 aa, Pseudomonas aeruginosa PAO1; identical to SEQ ID NO: 14207

SEQ ID NO: 42162 - DNA, 1446 bp, Lactococcus lactis subsp. lactis Il1403; identical to SEQ ID NO: 14208
  CDS (1)..(1446): transl_table=11

SEQ ID NO: 42163 - protein, 481 aa, Lactococcus lactis subsp. lactis Il1403; identical to SEQ ID NO: 14209

SEQ ID NO: 42164 - DNA, 1464 bp, Lactococcus lactis subsp. lactis Il1403; identical to SEQ ID NO: 14210
  CDS (1)..(1464): transl_table=11

SEQ ID NO: 42165 - protein, 487 aa, Lactococcus lactis subsp. lactis Il1403; identical to SEQ ID NO: 14211

SEQ ID NO: 42166 - DNA, 1527 bp, Neisseria meningitidis MC58; identical to SEQ ID NO: 14212
  CDS (1)..(1527): transl_table=11

SEQ ID NO: 42167 - protein, 508 aa, Neisseria meningitidis MC58; identical to SEQ ID NO: 14213

SEQ ID NO: 42168 - DNA, 1959 bp, Xylella fastidiosa 9a5c; identical to SEQ ID NO: 14214
  CDS (1)..(1959): transl_table=11

SEQ ID NO: 42169 - protein, 652 aa, Xylella fastidiosa 9a5c; identical to SEQ ID NO: 14215

SEQ ID NO: 42170 - DNA, 1404 bp, Xylella fastidiosa 9a5c; identical to SEQ ID NO: 14216
  CDS (1)..(1404): transl_table=11

SEQ ID NO: 42171 - protein, 467 aa, Xylella fastidiosa 9a5c; identical to SEQ ID NO: 14217

SEQ ID NO: 42172 - DNA, 1506 bp, Mycoplasma pulmonis UAB CTIP; identical to SEQ ID NO: 14218
  CDS (1)..(1506): transl_table=4

SEQ ID NO: 42173 - protein, 501 aa, Mycoplasma pulmonis UAB CTIP; identical to SEQ ID NO: 14219

SEQ ID NO: 42174 - DNA, 1533 bp, Clostridium acetobutylicum ATCC 824; identical to SEQ ID NO: 14220
  CDS (1)..(1533): transl_table=11

SEQ ID NO: 42175 - protein, 510 aa, Clostridium acetobutylicum ATCC 824; identical to SEQ ID NO: 14221

SEQ ID NO: 42176 - DNA, 1518 bp, Staphylococcus aureus subsp. aureus Mu50; identical to SEQ ID NO: 14222
  CDS (1)..(1518): transl_table=11

SEQ ID NO: 42177 - protein, 505 aa, Staphylococcus aureus subsp. aureus Mu50; identical to SEQ ID NO: 14223

SEQ ID NO: 42178 - DNA, 1566 bp, Sinorhizobium meliloti 1021; identical to SEQ ID NO: 14224
  CDS (1)..(1566): transl_table=11

SEQ ID NO: 42179 - protein, 521 aa, Sinorhizobium meliloti 1021; identical to SEQ ID NO: 14225

SEQ ID NO: 42180 - DNA, 1464 bp, Sinorhizobium meliloti 1021; identical to SEQ ID NO: 14226
  CDS (1)..(1464): transl_table=11

SEQ ID NO: 42181 - protein, 487 aa, Sinorhizobium meliloti 1021; identical to SEQ ID NO: 14227

SEQ ID NO: 42182 - DNA, 1488 bp, Salmonella typhimurium LT2; identical to SEQ ID NO: 14228
  CDS (1)..(1488): transl_table=11

SEQ ID NO: 42183 - protein, 495 aa, Salmonella typhimurium LT2; identical to SEQ ID NO: 14229

SEQ ID NO: 42184 - DNA, 1515 bp, Listeria monocytogenes EGD-e; identical to SEQ ID NO: 14230
  CDS (1)..(1515): transl_table=11

SEQ ID NO: 42185 - protein, 504 aa, Listeria monocytogenes EGD-e; identical to SEQ ID NO: 14231

SEQ ID NO: 42186 - DNA, 1515 bp, Listeria innocua Clip11262; identical to SEQ ID NO: 14232
  CDS (1)..(1515): transl_table=11

SEQ ID NO: 42187 - protein, 504 aa, Listeria innocua Clip11262; identical to SEQ ID NO: 14233

SEQ ID NO: 42188 - DNA, 1443 bp, Nostoc sp. PCC 7120; identical to SEQ ID NO: 14234
  CDS (1)..(1443): transl_table=11

SEQ ID NO: 42189 - protein, 480 aa, Nostoc sp. PCC 7120; identical to SEQ ID NO: 14235

SEQ ID NO: 42190 - DNA, 1269 bp, Ralstonia solanacearum GMI1000; identical to SEQ ID NO: 14236
  CDS (1)..(1269): transl_table=11

SEQ ID NO: 42191 - protein, 422 aa, Ralstonia solanacearum GMI1000; identical to SEQ ID NO: 14237

SEQ ID NO: 42192 - DNA, 1557 bp, Agrobacterium tumefaciens str. C58; identical to SEQ ID NO: 14238
  CDS (1)..(1557): transl_table=11

SEQ ID NO: 42193 - protein, 518 aa, Agrobacterium tumefaciens str. C58; identical to SEQ ID NO: 14239

SEQ ID NO: 42194 - DNA, 1479 bp, Agrobacterium tumefaciens str. C58; identical to SEQ ID NO: 14240
  CDS (1)..(1479): transl_table=11

SEQ ID NO: 42195 - protein, 492 aa, Agrobacterium tumefaciens str. C58; identical to SEQ ID NO: 14241

SEQ ID NO: 42196 - DNA, 1479 bp, Brucella melitensis 16M; identical to SEQ ID NO: 14242
  CDS (1)..(1479): transl_table=11

SEQ ID NO: 42197 - protein, 492 aa, Brucella melitensis 16M; identical to SEQ ID NO: 14243

SEQ ID NO: 42198 - DNA, 1443 bp, Clostridium perfringens str. 13; identical to SEQ ID NO: 14244
  CDS (1)..(1443): transl_table=11

SEQ ID NO: 42199 - protein, 480 aa, Clostridium perfringens str. 13; identical to SEQ ID NO: 14245

SEQ ID NO: 42200 - DNA, 1536 bp, Clostridium perfringens str. 13; identical to SEQ ID NO: 14246
  CDS (1)..(1536): transl_table=11

SEQ ID NO: 42201 - protein, 511 aa, Clostridium perfringens str. 13; identical to SEQ ID NO: 14247

SEQ ID NO: 42202 - DNA, 1458 bp, Clostridium perfringens str. 13; identical to SEQ ID NO: 14248
  CDS (1)..(1458): transl_table=11

SEQ ID NO: 42203 - protein, 485 aa, Clostridium perfringens str. 13; identical to SEQ ID NO: 14249

SEQ ID NO: 42204 - DNA, 1503 bp, Corynebacterium glutamicum ATCC 13032; identical to SEQ ID NO: 14250
  CDS (1)..(1503): transl_table=11

SEQ ID NO: 42205 - protein, 500 aa, Corynebacterium glutamicum ATCC 13032; identical to SEQ ID NO: 14251

SEQ ID NO: 42206 - DNA, 1440 bp, Fusobacterium nucleatum subsp. nucleatum ATCC 25586; identical to SEQ ID NO: 14252
  CDS (1)..(1440): transl_table=11

SEQ ID NO: 42207 - protein, 479 aa, Fusobacterium nucleatum subsp. nucleatum ATCC 25586; identical to SEQ ID NO: 14253

SEQ ID NO: 42208 - DNA, 1188 bp, Streptomyces coelicolor A3(2); identical to SEQ ID NO: 14254
  CDS (1)..(1188)

SEQ ID NO: 42209 - protein, 395 aa, Streptomyces coelicolor A3(2); identical to SEQ ID NO: 14255

SEQ ID NO: 42210 - DNA, 1461 bp, Xanthomonas campestris pv. campestris str. ATCC 33913; identical to SEQ ID NO: 14256
  CDS (1)..(1461): transl_table=11

SEQ ID NO: 42211 - protein, 486 aa, Xanthomonas campestris pv. campestris str. ATCC 33913; identical to SEQ ID NO: 14257

SEQ ID NO: 42212 - DNA, 1983 bp, Xanthomonas campestris pv. campestris str. ATCC 33913; identical to SEQ ID NO: 14258
  CDS (1)..(1983): transl_table=11

SEQ ID NO: 42213 - protein, 660 aa, Xanthomonas campestris pv. campestris str. ATCC 33913; identical to SEQ ID NO: 14259

SEQ ID NO: 42214 - DNA, 1020 bp, Xanthomonas campestris pv. campestris str. ATCC 33913; identical to SEQ ID NO: 14260
  CDS (1)..(1020): transl_table=11

SEQ ID NO: 42215 - protein, 339 aa, Xanthomonas campestris pv. campestris str. ATCC 33913; identical to SEQ ID NO: 14261

SEQ ID NO: 42216 - DNA, 1563 bp, Xanthomonas campestris pv. campestris str. ATCC 33913; identical to SEQ ID NO: 14262
  CDS (1)..(1563): transl_table=11

SEQ ID NO: 42217 - protein, 520 aa, Xanthomonas campestris pv. campestris str. ATCC 33913; identical to SEQ ID NO: 14263

SEQ ID NO: 42218 - DNA, 1425 bp, Xanthomonas campestris pv. campestris str. ATCC 33913; identical to SEQ ID NO: 14264
  CDS (1)..(1425): transl_table=11

SEQ ID NO: 42219 - protein, 474 aa, Xanthomonas campestris pv. campestris str. ATCC 33913; identical to SEQ ID NO: 14265

SEQ ID NO: 42220 - DNA, 1461 bp, Xanthomonas axonopodis pv. citri str. 306; identical to SEQ ID NO: 14266
  CDS (1)..(1461): transl_table=11

SEQ ID NO: 42221 - protein, 486 aa, Xanthomonas axonopodis pv. citri str. 306; identical to SEQ ID NO: 14267

SEQ ID NO: 42222 - DNA, 2019 bp, Xanthomonas axonopodis pv. citri str. 306; identical to SEQ ID NO: 14268
  CDS (1)..(2019): transl_table=11

SEQ ID NO: 42223 - protein, 672 aa, Xanthomonas axonopodis pv. citri str. 306; identical to SEQ ID NO: 14269

SEQ ID NO: 42224 - DNA, 1563 bp, Xanthomonas axonopodis pv. citri str. 306; identical to SEQ ID NO: 14270
  CDS (1)..(1563): transl_table=11

SEQ ID NO: 42225 - protein, 520 aa, Xanthomonas axonopodis pv. citri str. 306; identical to SEQ ID NO: 14271

SEQ ID NO: 42226 - DNA, 1416 bp, Xanthomonas axonopodis pv. citri str. 306; identical to SEQ ID NO: 14272
  CDS (1)..(1416): transl_table=11

SEQ ID NO: 42227 - protein, 471 aa, Xanthomonas axonopodis pv. citri str. 306; identical to SEQ ID NO: 14273

SEQ ID NO: 42228 - DNA, 1224 bp, Xanthomonas axonopodis pv. citri str. 306; identical to SEQ ID NO: 14274
  CDS (1)..(1224): transl_table=11

SEQ ID NO: 42229 - protein, 407 aa, Xanthomonas axonopodis pv. citri str. 306; identical to SEQ ID NO: 14275

SEQ ID NO: 42230 - DNA, 1518 bp, Staphylococcus aureus subsp. aureus MW2; identical to SEQ ID NO: 14276
  CDS (1)..(1518): transl_table=11

SEQ ID NO: 42231 - protein, 505 aa, Staphylococcus aureus subsp. aureus MW2; identical to SEQ ID NO: 14277

SEQ ID NO: 42232 - DNA, 1482 bp, Yersinia pestis KIM; identical to SEQ ID NO: 14278
  CDS (1)..(1482): transl_table=11

SEQ ID NO: 42233 - protein, 493 aa, Yersinia pestis KIM; identical to SEQ ID NO: 14279

SEQ ID NO: 42234 - DNA, 1461 bp, Brucella suis 1330; identical to SEQ ID NO: 14280
  CDS (1)..(1461): transl_table=11

SEQ ID NO: 42235 - protein, 486 aa, Brucella suis 1330; identical to SEQ ID NO: 14281

SEQ ID NO: 42236 - DNA, 1503 bp, Corynebacterium efficiens YS-314; identical to SEQ ID NO: 14282
  CDS (1)..(1503): transl_table=11

SEQ ID NO: 42237 - protein, 500 aa, Corynebacterium efficiens YS-314; identical to SEQ ID NO: 14283

SEQ ID NO: 42238 - DNA, 1158 bp, Pseudomonas putida KT2440; identical to SEQ ID NO: 14284
  CDS (1)..(1158): transl_table=11

SEQ ID NO: 42239 - protein, 385 aa, Pseudomonas putida KT2440; identical to SEQ ID NO: 14285

SEQ ID NO: 42240 - DNA, 1554 bp, Pseudomonas putida KT2440; identical to SEQ ID NO: 14286
  CDS (1)..(1554): transl_table=11

SEQ ID NO: 42241 - protein, 517 aa, Pseudomonas putida KT2440; identical to SEQ ID NO: 14287

SEQ ID NO: 42242 - DNA, 1575 bp, Vibrio vulnificus CMCP6; identical to SEQ ID NO: 14288
  CDS (1)..(1575): transl_table=11

SEQ ID NO: 42243 - protein, 524 aa, Vibrio vulnificus CMCP6; identical to SEQ ID NO: 14289

SEQ ID NO: 42244 - DNA, 1485 bp, Staphylococcus epidermidis ATCC 12228; identical to SEQ ID NO: 14290
  CDS (1)..(1485): transl_table=11

SEQ ID NO: 42245 - protein, 494 aa, Staphylococcus epidermidis ATCC 12228; identical to SEQ ID NO: 14291

SEQ ID NO: 42246 - DNA, 1959 bp, Xylella fastidiosa Temecula1; identical to SEQ ID NO: 14292
  CDS (1)..(1959): transl_table=11

SEQ ID NO: 42247 - protein, 652 aa, Xylella fastidiosa Temecula1; identical to SEQ ID NO: 14293

SEQ ID NO: 42248 - DNA, 1404 bp, Xylella fastidiosa Temecula1; identical to SEQ ID NO: 14294
  CDS (1)..(1404): transl_table=11

SEQ ID NO: 42249 - protein, 467 aa, Xylella fastidiosa Temecula1; identical to SEQ ID NO: 14295

SEQ ID NO: 42250 - DNA, 1437 bp, Clostridium tetani E88; identical to SEQ ID NO: 14296
  CDS (1)..(1437): transl_table=11

SEQ ID NO: 42251 - protein, 478 aa, Clostridium tetani E88; identical to SEQ ID NO: 14297

SEQ ID NO: 42252 - DNA, 1458 bp, Lactobacillus plantarum WCFS1; identical to SEQ ID NO: 14298
  CDS (1)..(1458): transl_table=11

SEQ ID NO: 42253 - protein, 485 aa, Lactobacillus plantarum WCFS1; identical to SEQ ID NO: 14299

SEQ ID NO: 42254 - DNA, 1497 bp, Tropheryma whipplei str. Twist; identical to SEQ ID NO: 14300
  CDS (1)..(1497): transl_table=11

SEQ ID NO: 42255 - protein, 498 aa, Tropheryma whipplei str. Twist; identical to SEQ ID NO: 14301

SEQ ID NO: 42256 - DNA, 1497 bp, Tropheryma whipplei TW08/27; identical to SEQ ID NO: 14302
  CDS (1)..(1497): transl_table=11

SEQ ID NO: 42257 - protein, 498 aa, Tropheryma whipplei TW08/27; identical to SEQ ID NO: 14303

SEQ ID NO: 42258 - DNA, 1629 bp, Pseudomonas syringae pv. tomato str. DC3000; identical to SEQ ID NO: 14304
  CDS (1)..(1629): transl_table=11

SEQ ID NO: 42259 - protein, 542 aa, Pseudomonas syringae pv. tomato str. DC3000; identical to SEQ ID NO: 14305

SEQ ID NO: 42260 - DNA, 1251 bp, Pseudomonas syringae pv. tomato str. DC3000; identical to SEQ ID NO: 14306
  CDS (1)..(1251): transl_table=11

SEQ ID NO: 42261 - protein, 416 aa, Pseudomonas syringae pv. tomato str. DC3000; identical to SEQ ID NO: 14307

SEQ ID NO: 42262 - DNA, 1158 bp, Pseudomonas syringae pv. tomato str. DC3000; identical to SEQ ID NO: 14308
  CDS (1)..(1158): transl_table=11

SEQ ID NO: 42263 - protein, 385 aa, Pseudomonas syringae pv. tomato str. DC3000; identical to SEQ ID NO: 14309

SEQ ID NO: 42264 - DNA, 1197 bp, Bacteroides thetaiotaomicron VPI-5482; identical to SEQ ID NO: 14310
  CDS (1)..(1197): transl_table=11

SEQ ID NO: 42265 - protein, 398 aa, Bacteroides thetaiotaomicron VPI-5482; identical to SEQ ID NO: 14311

SEQ ID NO: 42266 - DNA, 1425 bp, Bacteroides thetaiotaomicron VPI-5482; identical to SEQ ID NO: 14312
  CDS (1)..(1425): transl_table=11

SEQ ID NO: 42267 - protein, 474 aa, Bacteroides thetaiotaomicron VPI-5482; identical to SEQ ID NO: 14313

SEQ ID NO: 42268 - DNA, 1440 bp, Bacteroides thetaiotaomicron VPI-5482; identical to SEQ ID NO: 14314
  CDS (1)..(1440): transl_table=11

SEQ ID NO: 42269 - protein, 479 aa, Bacteroides thetaiotaomicron VPI-5482; identical to SEQ ID NO: 14315

SEQ ID NO: 42270 - DNA, 1446 bp, Enterococcus faecalis V583; identical to SEQ ID NO: 14316
  CDS (1)..(1446): transl_table=11

SEQ ID NO: 42271 - protein, 481 aa, Enterococcus faecalis V583; identical to SEQ ID NO: 14317

SEQ ID NO: 42272 - DNA, 1461 bp, Enterococcus faecalis V583; identical to SEQ ID NO: 14318
  CDS (1)..(1461): transl_table=11

SEQ ID NO: 42273 - protein, 486 aa, Enterococcus faecalis V583; identical to SEQ ID NO: 14319

SEQ ID NO: 42274 - DNA, 1176 bp, Coxiella burnetii RSA 493; identical to SEQ ID NO: 14320
  CDS (1)..(1176): transl_table=11

SEQ ID NO: 42275 - protein, 391 aa, Coxiella burnetii RSA 493; identical to SEQ ID NO: 14321

SEQ ID NO: 42276 - DNA, 1215 bp, Streptomyces avermitilis MA-4680; identical to SEQ ID NO: 14322
  CDS (1)..(1215)

SEQ ID NO: 42277 - protein, 404 aa, Streptomyces avermitilis MA-4680; identical to SEQ ID NO: 14323

SEQ ID NO: 42278 - DNA, 1098 bp, Bacillus cereus ATCC 14579; identical to SEQ ID NO: 14324
  CDS (1)..(1098): transl_table=11

SEQ ID NO: 42279 - protein, 365 aa, Bacillus cereus ATCC 14579; identical to SEQ ID NO: 14325

SEQ ID NO: 42280 - DNA, 1194 bp, Bacillus cereus ATCC 14579; identical to SEQ ID NO: 14326
  CDS (1)..(1194): transl_table=11

SEQ ID NO: 42281 - protein, 397 aa, Bacillus cereus ATCC 14579; identical to SEQ ID NO: 14327

SEQ ID NO: 42282 - DNA, 1242 bp, Shigella flexneri 2a str. 2457T; identical to SEQ ID NO: 14328
  CDS (1)..(1242): transl_table=11

SEQ ID NO: 42283 - protein, 413 aa, Shigella flexneri 2a str. 2457T; identical to SEQ ID NO: 14329

SEQ ID NO: 42284 - DNA, 1158 bp, Nitrosomonas europaea ATCC 19718; identical to SEQ ID NO: 14330
  CDS (1)..(1158): transl_table=11

SEQ ID NO: 42285 - protein, 385 aa, Nitrosomonas europaea ATCC 19718; identical to SEQ ID NO: 14331

SEQ ID NO: 42286 - DNA, 1218 bp, Bacillus anthracis str. Ames; identical to SEQ ID NO: 14332
  CDS (1)..(1218): transl_table=11

SEQ ID NO: 42287 - protein, 405 aa, Bacillus anthracis str. Ames; identical to SEQ ID NO: 14333

SEQ ID NO: 42288 - DNA, 1104 bp, Bacillus anthracis str. Ames; identical to SEQ ID NO: 14334
  CDS (1)..(1104): transl_table=11

SEQ ID NO: 42289 - protein, 367 aa, Bacillus anthracis str. Ames; identical to SEQ ID NO: 14335

SEQ ID NO: 42290 - DNA, 1194 bp, Bacillus anthracis str. Ames; identical to SEQ ID NO: 14336
  CDS (1)..(1194): transl_table=11

SEQ ID NO: 42291 - protein, 397 aa, Bacillus anthracis str. Ames; identical to SEQ ID NO: 14337

SEQ ID NO: 42292 - DNA, 1563 bp, Helicobacter hepaticus ATCC 51449; identical to SEQ ID NO: 14338
  CDS (1)..(1563): transl_table=11

SEQ ID NO: 42293 - protein, 520 aa, Helicobacter hepaticus ATCC 51449; identical to SEQ ID NO: 14339

SEQ ID NO: 42294 - DNA, 1476 bp, Rhodopirellula baltica SH 1; identical to SEQ ID NO: 14340
  CDS (1)..(1476): transl_table=11

SEQ ID NO: 42295 - protein, 491 aa, Rhodopirellula baltica SH 1; identical to SEQ ID NO: 14341

SEQ ID NO: 42296 - DNA, 1476 bp, Candidatus Blochmannia floridanus; identical to SEQ ID NO: 14342
  CDS (1)..(1476): transl_table=11

SEQ ID NO: 42297 - protein, 491 aa, Candidatus Blochmannia floridanus; identical to SEQ ID NO: 14343

SEQ ID NO: 42298 - DNA, 1206 bp, Bordetella pertussis Tohama I; identical to SEQ ID NO: 14344
  CDS (1)..(1206): transl_table=11

SEQ ID NO: 42299 - protein, 401 aa, Bordetella pertussis Tohama I; identical to SEQ ID NO: 14345

SEQ ID NO: 42300 - DNA, 1458 bp, Bordetella pertussis Tohama I; identical to SEQ ID NO: 14346
  CDS (1)..(1458): transl_table=11

SEQ ID NO: 42301 - protein, 485 aa, Bordetella pertussis Tohama I; identical to SEQ ID NO: 14347

SEQ ID NO: 42302 - DNA, 1575 bp, Bordetella pertussis Tohama I; identical to SEQ ID NO: 14348
  CDS (1)..(1575): transl_table=11

SEQ ID NO: 42303 - protein, 524 aa, Bordetella pertussis Tohama I; identical to SEQ ID NO: 14349

SEQ ID NO: 42304 - DNA, 1263 bp, Bordetella parapertussis 12822; identical to SEQ ID NO: 14350
  CDS (1)..(1263)

SEQ ID NO: 42305 - protein, 420 aa, Bordetella parapertussis 12822; identical to SEQ ID NO: 14351

SEQ ID NO: 42306 - DNA, 1431 bp, Bordetella parapertussis 12822; identical to SEQ ID NO: 14352
  CDS (1)..(1431)

SEQ ID NO: 42307 - protein, 476 aa, Bordetella parapertussis 12822; identical to SEQ ID NO: 14353

SEQ ID NO: 42308 - DNA, 1479 bp, Bordetella bronchiseptica RB50; identical to SEQ ID NO: 14354
  CDS (1)..(1479)

SEQ ID NO: 42309 - protein, 492 aa, Bordetella bronchiseptica RB50; identical to SEQ ID NO: 14355

SEQ ID NO: 42310 - DNA, 1545 bp, Bordetella bronchiseptica RB50; identical to SEQ ID NO: 14356
  CDS (1)..(1545)

SEQ ID NO: 42311 - protein, 514 aa, Bordetella bronchiseptica RB50; identical to SEQ ID NO: 14357

SEQ ID NO: 42312 - DNA, 1518 bp, Chromobacterium violaceum ATCC 12472; identical to SEQ ID NO: 14358
  CDS (1)..(1518): transl_table=11

SEQ ID NO: 42313 - protein, 505 aa, Chromobacterium violaceum ATCC 12472; identical to SEQ ID NO: 14359

SEQ ID NO: 42314 - DNA, 1422 bp, Porphyromonas gingivalis W83; identical to SEQ ID NO: 14360
  CDS (1)..(1422): transl_table=11

SEQ ID NO: 42315 - protein, 473 aa, Porphyromonas gingivalis W83; identical to SEQ ID NO: 14361

SEQ ID NO: 42316 - DNA, 1443 bp, Gloeobacter violaceus PCC 7421; identical to SEQ ID NO: 14362
  CDS (1)..(1443): transl_table=11

SEQ ID NO: 42317 - protein, 480 aa, Gloeobacter violaceus PCC 7421; identical to SEQ ID NO: 14363

SEQ ID NO: 42318 - DNA, 1470 bp, Photorhabdus luminescens subsp. laumondii TTO1; identical to SEQ ID NO: 14364
  CDS (1)..(1470): transl_table=11

SEQ ID NO: 42319 - protein, 489 aa, Photorhabdus luminescens subsp. laumondii TTO1; identical to SEQ ID NO: 14365

SEQ ID NO: 42320 - DNA, 1455 bp, Vibrio vulnificus YJ016; identical to SEQ ID NO: 14366
  CDS (1)..(1455): transl_table=11

SEQ ID NO: 42321 - protein, 484 aa, Vibrio vulnificus YJ016; identical to SEQ ID NO: 14367

SEQ ID NO: 42322 - DNA, 1191 bp, Geobacter sulfurreducens PCA; identical to SEQ ID NO: 14368
  CDS (1)..(1191): transl_table=11

SEQ ID NO: 42323 - protein, 396 aa, Geobacter sulfurreducens PCA; identical to SEQ ID NO: 14369

SEQ ID NO: 42324 - DNA, 1443 bp, Geobacter sulfurreducens PCA; identical to SEQ ID NO: 14370
  CDS (1)..(1443): transl_table=11

SEQ ID NO: 42325 - protein, 480 aa, Geobacter sulfurreducens PCA; identical to SEQ ID NO: 14371

SEQ ID NO: 42326 - DNA, 1578 bp, Geobacter sulfurreducens PCA; identical to SEQ ID NO: 14372
  CDS (1)..(1578): transl_table=11

SEQ ID NO: 42327 - protein, 525 aa, Geobacter sulfurreducens PCA; identical to SEQ ID NO: 14373

SEQ ID NO: 42328 - DNA, 1470 bp, Lactobacillus johnsonii NCC 533; identical to SEQ ID NO: 14374
  CDS (1)..(1470): transl_table=11

SEQ ID NO: 42329 - protein, 489 aa, Lactobacillus johnsonii NCC 533; identical to SEQ ID NO: 14375

SEQ ID NO: 42330 - DNA, 1488 bp, Lactobacillus johnsonii NCC 533; identical to SEQ ID NO: 14376
  CDS (1)..(1488): transl_table=11

SEQ ID NO: 42331 - protein, 495 aa, Lactobacillus johnsonii NCC 533; identical to SEQ ID NO: 14377

SEQ ID NO: 42332 - DNA, 1593 bp, Bdellovibrio bacteriovorus HD100; identical to SEQ ID NO: 14378
  CDS (1)..(1593): transl_table=11

SEQ ID NO: 42333 - protein, 530 aa, Bdellovibrio bacteriovorus HD100; identical to SEQ ID NO: 14379

SEQ ID NO: 42334 - DNA, 1212 bp, Bacillus cereus ATCC 10987; identical to SEQ ID NO: 14380
  CDS (1)..(1212): transl_table=11

SEQ ID NO: 42335 - protein, 403 aa, Bacillus cereus ATCC 10987; identical to SEQ ID NO: 14381

SEQ ID NO: 42336 - DNA, 1446 bp, Desulfovibrio vulgaris subsp. vulgaris str. Hildenborough; identical to SEQ ID NO: 14382
  CDS (1)..(1446): transl_table=11

SEQ ID NO: 42337 - protein, 481 aa, Desulfovibrio vulgaris subsp. vulgaris str. Hildenborough; identical to SEQ ID NO: 14383

SEQ ID NO: 42338 - DNA, 1137 bp, Bacillus anthracis str. Sterne; identical to SEQ ID NO: 14384
  CDS (1)..(1137): transl_table=11

SEQ ID NO: 42339 - protein, 378 aa, Bacillus anthracis str. Sterne; identical to SEQ ID NO: 14385

SEQ ID NO: 42340 - DNA, 1572 bp, Bartonella quintana str. Toulouse; identical to SEQ ID NO: 14386
  CDS (1)..(1572): transl_table=11

SEQ ID NO: 42341 - protein, 523 aa, Bartonella quintana str. Toulouse; identical to SEQ ID NO: 14387

SEQ ID NO: 42342 - DNA, 1572 bp, Bartonella henselae str. Houston-1; identical to SEQ ID NO: 14388
  CDS (1)..(1572): transl_table=11

SEQ ID NO: 42343 - protein, 523 aa, Bartonella henselae str. Houston-1; identical to SEQ ID NO: 14389

SEQ ID NO: 42344 - DNA, 1530 bp, Bacillus thuringiensis serovar konkukian str. 97-27; identical to SEQ ID NO: 14390
  CDS (1)..(1530): transl_table=11

SEQ ID NO: 42345 - protein, 509 aa, Bacillus thuringiensis serovar konkukian str. 97-27; identical to SEQ ID NO: 14391

SEQ ID NO: 42346 - DNA, 1218 bp, Bacillus thuringiensis serovar konkukian str. 97-27; identical to SEQ ID NO: 14392
  CDS (1)..(1218): transl_table=11

SEQ ID NO: 42347 - protein, 405 aa, Bacillus thuringiensis serovar konkukian str. 97-27; identical to SEQ ID NO: 14393

SEQ ID NO: 42348 - DNA, 1134 bp, Bacillus thuringiensis serovar konkukian str. 97-27; identical to SEQ ID NO: 14394
  CDS (1)..(1134): transl_table=11

SEQ ID NO: 42349 - protein, 377 aa, Bacillus thuringiensis serovar konkukian str. 97-27; identical to SEQ ID NO: 14395

SEQ ID NO: 42350 - DNA, 1482 bp, Staphylococcus aureus subsp. aureus MSSA476; identical to SEQ ID NO: 14396
  CDS (1)..(1482): transl_table=11

SEQ ID NO: 42351 - protein, 493 aa, Staphylococcus aureus subsp. aureus MSSA476; identical to SEQ ID NO: 14397

SEQ ID NO: 42352 - DNA, 1563 bp, Acinetobacter sp. ADP1; identical to SEQ ID NO: 14398
  CDS (1)..(1563): transl_table=11

SEQ ID NO: 42353 - protein, 520 aa, Acinetobacter sp. ADP1; identical to SEQ ID NO: 14399

SEQ ID NO: 42354 - DNA, 1560 bp, Acinetobacter sp. ADP1; identical to SEQ ID NO: 14400
  CDS (1)..(1560): transl_table=11

SEQ ID NO: 42355 - protein, 519 aa, Acinetobacter sp. ADP1; identical to SEQ ID NO: 14401

SEQ ID NO: 42356 - DNA, 1461 bp, Erwinia carotovora subsp. atroseptica SCRI1043; identical to SEQ ID NO: 14402
  CDS (1)..(1461)

SEQ ID NO: 42357 - protein, 486 aa, Erwinia carotovora subsp. atroseptica SCRI1043; identical to SEQ ID NO: 14403

SEQ ID NO: 42358 - DNA, 1269 bp, Propionibacterium acnes KPA171202; identical to SEQ ID NO: 14404
  CDS (1)..(1269): transl_table=11

SEQ ID NO: 42359 - protein, 422 aa, Propionibacterium acnes KPA171202; identical to SEQ ID NO: 14405

SEQ ID NO: 42360 - DNA, 1464 bp, Leifsonia xyli subsp. xyli str. CTCB07; identical to SEQ ID NO: 14406
  CDS (1)..(1464): transl_table=11

SEQ ID NO: 42361 - protein, 487 aa, Leifsonia xyli subsp. xyli str. CTCB07; identical to SEQ ID NO: 14407

SEQ ID NO: 42362 - DNA, 1533 bp, Desulfotalea psychrophila LSv54; identical to SEQ ID NO: 14408
  CDS (1)..(1533): transl_table=11

SEQ ID NO: 42363 - protein, 510 aa, Desulfotalea psychrophila LSv54; identical to SEQ ID NO: 14409

SEQ ID NO: 42364 - DNA, 1461 bp, Yersinia pseudotuberculosis IP 32953; identical to SEQ ID NO: 14410
  CDS (1)..(1461): transl_table=11

SEQ ID NO: 42365 - protein, 486 aa, Yersinia pseudotuberculosis IP 32953; identical to SEQ ID NO: 14411

SEQ ID NO: 42366 - DNA, 1545 bp, Bacillus cereus E33L; identical to SEQ ID NO: 14412
  CDS (1)..(1545): transl_table=11

SEQ ID NO: 42367 - protein, 514 aa, Bacillus cereus E33L; identical to SEQ ID NO: 14413

SEQ ID NO: 42368 - DNA, 1212 bp, Bacillus cereus E33L; identical to SEQ ID NO: 14414
  CDS (1)..(1212): transl_table=11

SEQ ID NO: 42369 - protein, 403 aa, Bacillus cereus E33L; identical to SEQ ID NO: 14415

SEQ ID NO: 42370 - DNA, 1104 bp, Bacillus cereus E33L; identical to SEQ ID NO: 14416
  CDS (1)..(1104): transl_table=11

SEQ ID NO: 42371 - protein, 367 aa, Bacillus cereus E33L; identical to SEQ ID NO: 14417

SEQ ID NO: 42372 - DNA, 1536 bp, Mannheimia succiniciproducens MBEL55E; identical to SEQ ID NO: 14418
  CDS (1)..(1536): transl_table=11

SEQ ID NO: 42373 - protein, 511 aa, Mannheimia succiniciproducens MBEL55E; identical to SEQ ID NO: 14419

SEQ ID NO: 42374 - DNA, 1197 bp, Bacteroides fragilis YCH46; identical to SEQ ID NO: 14420
  CDS (1)..(1197): transl_table=11

SEQ ID NO: 42375 - protein, 398 aa, Bacteroides fragilis YCH46; identical to SEQ ID NO: 14421

SEQ ID NO: 42376 - DNA, 1440 bp, Burkholderia mallei ATCC 23344; identical to SEQ ID NO: 14422
  CDS (1)..(1440): transl_table=11

SEQ ID NO: 42377 - protein, 479 aa, Burkholderia mallei ATCC 23344; identical to SEQ ID NO: 14423

SEQ ID NO: 42378 - DNA, 1275 bp, Burkholderia pseudomallei K96243; identical to SEQ ID NO: 14424
  CDS (1)..(1275): transl_table=11

SEQ ID NO: 42379 - protein, 424 aa, Burkholderia pseudomallei K96243; identical to SEQ ID NO: 14425

SEQ ID NO: 42380 - DNA, 1653 bp, Burkholderia pseudomallei K96243; identical to SEQ ID NO: 14426
  CDS (1)..(1653): transl_table=11

SEQ ID NO: 42381 - protein, 550 aa, Burkholderia pseudomallei K96243; identical to SEQ ID NO: 14427

SEQ ID NO: 42382 - DNA, 1458 bp, Photobacterium profundum SS9; identical to SEQ ID NO: 14428
  CDS (1)..(1458): transl_table=11

SEQ ID NO: 42383 - protein, 485 aa, Photobacterium profundum SS9; identical to SEQ ID NO: 14429

SEQ ID NO: 42384 - DNA, 1533 bp, Photobacterium profundum SS9; identical to SEQ ID NO: 14430
  CDS (1)..(1533): transl_table=11

SEQ ID NO: 42385 - protein, 510 aa, Photobacterium profundum SS9; identical to SEQ ID NO: 14431

SEQ ID NO: 42386 - DNA, 1509 bp, Geobacillus kaustophilus HTA426; identical to SEQ ID NO: 14432
  CDS (1)..(1509): transl_table=11

SEQ ID NO: 42387 - protein, 502 aa, Geobacillus kaustophilus HTA426; identical to SEQ ID NO: 14433

SEQ ID NO: 42388 - DNA, 1242 bp, Salmonella enterica subsp. enterica serovar Paratyphi A str. ATCC; identical to SEQ ID NO: 14434
  CDS (1)..(1242): transl_table=11

SEQ ID NO: 42389 - protein, 413 aa, Salmonella enterica subsp. enterica serovar Paratyphi A str. ATCC; identical to SEQ ID NO: 14435

SEQ ID NO: 42390 - DNA, 1395 bp, Idiomarina loihiensis L2TR; identical to SEQ ID NO: 14436
  CDS (1)..(1395): transl_table=11

SEQ ID NO: 42391 - protein, 464 aa, Idiomarina loihiensis L2TR; identical to SEQ ID NO: 14437

SEQ ID NO: 42392 - DNA, 1383 bp, Azoarcus sp. EbN1; identical to SEQ ID NO: 14438
  CDS (1)..(1383): transl_table=11

SEQ ID NO: 42393 - protein, 460 aa, Azoarcus sp. EbN1; identical to SEQ ID NO: 14439

SEQ ID NO: 42394 - DNA, 1458 bp, Azoarcus sp. EbN1; identical to SEQ ID NO: 14440
  CDS (1)..(1458): transl_table=11

SEQ ID NO: 42395 - protein, 485 aa, Azoarcus sp. EbN1; identical to SEQ ID NO: 14441

SEQ ID NO: 42396 - DNA, 1419 bp, Zymomonas mobilis subsp. mobilis ZM4; identical to SEQ ID NO: 14442
  CDS (1)..(1419): transl_table=11

SEQ ID NO: 42397 - protein, 472 aa, Zymomonas mobilis subsp. mobilis ZM4; identical to SEQ ID NO: 14443

SEQ ID NO: 42398 - DNA, 1413 bp, Silicibacter pomeroyi DSS-3; identical to SEQ ID NO: 14444
  CDS (1)..(1413): transl_table=11

SEQ ID NO: 42399 - protein, 470 aa, Silicibacter pomeroyi DSS-3; identical to SEQ ID NO: 14445

SEQ ID NO: 42400 - DNA, 1467 bp, Bacillus clausii KSM-K16; identical to SEQ ID NO: 14446
  CDS (1)..(1467): transl_table=11

SEQ ID NO: 42401 - protein, 488 aa, Bacillus clausii KSM-K16; identical to SEQ ID NO: 14447

SEQ ID NO: 42402 - DNA, 1197 bp, Bacillus clausii KSM-K16; identical to SEQ ID NO: 14448
  CDS (1)..(1197): transl_table=11

SEQ ID NO: 42403 - protein, 398 aa, Bacillus clausii KSM-K16; identical to SEQ ID NO: 14449

SEQ ID NO: 42404 - DNA, 1482 bp, Staphylococcus aureus subsp. aureus COL; identical to SEQ ID NO: 14450
  CDS (1)..(1482): transl_table=11

SEQ ID NO: 42405 - protein, 493 aa, Staphylococcus aureus subsp. aureus COL; identical to SEQ ID NO: 14451

SEQ ID NO: 42406 - DNA, 2016 bp, Xanthomonas oryzae pv. oryzae KACC10331; identical to SEQ ID NO: 14452
  CDS (1)..(2016): transl_table=11

SEQ ID NO: 42407 - protein, 671 aa, Xanthomonas oryzae pv. oryzae KACC10331; identical to SEQ ID NO: 14453

SEQ ID NO: 42408 - DNA, 1419 bp, Xanthomonas oryzae pv. oryzae KACC10331; identical to SEQ ID NO: 14454
  CDS (1)..(1419): transl_table=11

SEQ ID NO: 42409 - protein, 472 aa, Xanthomonas oryzae pv. oryzae KACC10331; identical to SEQ ID NO: 14455

SEQ ID NO: 42410 - DNA, 1548 bp, Vibrio fischeri ES114; identical to SEQ ID NO: 14456
  CDS (1)..(1548): transl_table=11

SEQ ID NO: 42411 - protein, 515 aa, Vibrio fischeri ES114; identical to SEQ ID NO: 14457

SEQ ID NO: 42412 - DNA, 1455 bp, Vibrio fischeri ES114; identical to SEQ ID NO: 14458
  CDS (1)..(1455): transl_table=11

SEQ ID NO: 42413 - protein, 484 aa, Vibrio fischeri ES114; identical to SEQ ID NO: 14459

SEQ ID NO: 42414 - DNA, 1578 bp, Neisseria gonorrhoeae FA 1090; identical to SEQ ID NO: 14460
  CDS (1)..(1578): transl_table=11

SEQ ID NO: 42415 - protein, 525 aa, Neisseria gonorrhoeae FA 1090; identical to SEQ ID NO: 14461

SEQ ID NO: 42416 - DNA, 1440 bp, Bacteroides fragilis NCTC 9343; identical to SEQ ID NO: 14462
  CDS (1)..(1440): transl_table=11

SEQ ID NO: 42417 - protein, 479 aa, Bacteroides fragilis NCTC 9343; identical to SEQ ID NO: 14463

SEQ ID NO: 42418 - DNA, 1275 bp, Bacteroides fragilis NCTC 9343; identical to SEQ ID NO: 14464
  CDS (1)..(1275): transl_table=11

SEQ ID NO: 42419 - protein, 424 aa, Bacteroides fragilis NCTC 9343; identical to SEQ ID NO: 14465

SEQ ID NO: 42420 - DNA, 1242 bp, Salmonella enterica subsp. enterica serovar Choleraesuis str; identical to SEQ ID NO: 14466
  CDS (1)..(1242): transl_table=11

SEQ ID NO: 42421 - protein, 413 aa, Salmonella enterica subsp. enterica serovar Choleraesuis str; identical to SEQ ID NO: 14467

SEQ ID NO: 42422 - DNA, 1587 bp, Salmonella enterica subsp. enterica serovar Choleraesuis str; identical to SEQ ID NO: 14468
  CDS (1)..(1587): transl_table=11

SEQ ID NO: 42423 - protein, 528 aa, Salmonella enterica subsp. enterica serovar Choleraesuis str; identical to SEQ ID NO: 14469

SEQ ID NO: 42424 - DNA, 1581 bp, Pseudomonas syringae pv. syringae B728a; identical to SEQ ID NO: 14470
  CDS (1)..(1581)

SEQ ID NO: 42425 - protein, 526 aa, Pseudomonas syringae pv. syringae B728a; identical to SEQ ID NO: 14471

SEQ ID NO: 42426 - DNA, 1251 bp, Pseudomonas syringae pv. syringae B728a; identical to SEQ ID NO: 14472
  CDS (1)..(1251)

SEQ ID NO: 42427 - protein, 416 aa, Pseudomonas syringae pv. syringae B728a; identical to SEQ ID NO: 14473

SEQ ID NO: 42428 - DNA, 1158 bp, Pseudomonas syringae pv. syringae B728a; identical to SEQ ID NO: 14474
  CDS (1)..(1158)

SEQ ID NO: 42429 - protein, 385 aa, Pseudomonas syringae pv. syringae B728a; identical to SEQ ID NO: 14475

SEQ ID NO: 42430 - DNA, 1440 bp, Pseudomonas syringae pv. syringae B728a; identical to SEQ ID NO: 14476
  CDS (1)..(1440)

SEQ ID NO: 42431 - protein, 479 aa, Pseudomonas syringae pv. syringae B728a; identical to SEQ ID NO: 14477

SEQ ID NO: 42432 - DNA, 1512 bp, Corynebacterium jeikeium K411; identical to SEQ ID NO: 14478
  CDS (1)..(1512): transl_table=11

SEQ ID NO: 42433 - protein, 503 aa, Corynebacterium jeikeium K411; identical to SEQ ID NO: 14479

SEQ ID NO: 42434 - DNA, 1404 bp, Xylella fastidiosa Ann-1; identical to SEQ ID NO: 14480
  CDS (1)..(1404)

SEQ ID NO: 42435 - protein, 467 aa, Xylella fastidiosa Ann-1; identical to SEQ ID NO: 14481

SEQ ID NO: 42436 - DNA, 1488 bp, Lactobacillus gasseri; identical to SEQ ID NO: 14482
  CDS (1)..(1488)

SEQ ID NO: 42437 - protein, 495 aa, Lactobacillus gasseri; identical to SEQ ID NO: 14483

SEQ ID NO: 42438 - DNA, 1416 bp, Leuconostoc mesenteroides subsp. mesenteroides ATCC 8293; identical to SEQ ID NO: 14484
  CDS (1)..(1416)

SEQ ID NO: 42439 - protein, 471 aa, Leuconostoc mesenteroides subsp. mesenteroides ATCC 8293; identical to SEQ ID NO: 14485

SEQ ID NO: 42440 - DNA, 1455 bp, Desulfovibrio desulfuricans G20; identical to SEQ ID NO: 14486
  CDS (1)..(1455)

SEQ ID NO: 42441 - protein, 484 aa, Desulfovibrio desulfuricans G20; identical to SEQ ID NO: 14487

SEQ ID NO: 42442 - DNA, 1434 bp, Pseudomonas aeruginosa UCBPP-PA14; identical to SEQ ID NO: 14488
  CDS (1)..(1434)

SEQ ID NO: 42443 - protein, 477 aa, Pseudomonas aeruginosa UCBPP-PA14; identical to SEQ ID NO: 14489

SEQ ID NO: 42444 - DNA, 1440 bp, Fusobacterium nucleatum subsp. vincentii ATCC 49256; identical to SEQ ID NO: 14490
  CDS (1)..(1440): transl_table=11

SEQ ID NO: 42445 - protein, 479 aa, Fusobacterium nucleatum subsp. vincentii ATCC 49256; identical to SEQ ID NO: 14491

SEQ ID NO: 42446 - DNA, 1713 bp, Psychrobacter sp. 273-4; identical to SEQ ID NO: 14492
  CDS (1)..(1713)

SEQ ID NO: 42447 - protein, 570 aa, Psychrobacter sp. 273-4; identical to SEQ ID NO: 14493

SEQ ID NO: 42448 - DNA, 1644 bp, Psychrobacter sp. 273-4; identical to SEQ ID NO: 14494
  CDS (1)..(1644)

SEQ ID NO: 42449 - protein, 547 aa, Psychrobacter sp. 273-4; identical to SEQ ID NO: 14495

SEQ ID NO: 42450 - DNA, 1470 bp, Ralstonia eutropha JMP134; identical to SEQ ID NO: 14496
  CDS (1)..(1470)

SEQ ID NO: 42451 - protein, 489 aa, Ralstonia eutropha JMP134; identical to SEQ ID NO: 14497

SEQ ID NO: 42452 - DNA, 1617 bp, Ralstonia eutropha JMP134; identical to SEQ ID NO: 14498
  CDS (1)..(1617)

SEQ ID NO: 42453 - protein, 538 aa, Ralstonia eutropha JMP134; identical to SEQ ID NO: 14499

SEQ ID NO: 42454 - DNA, 1809 bp, Ralstonia eutropha JMP134; identical to SEQ ID NO: 14500
  CDS (1)..(1809)

SEQ ID NO: 42455 - protein, 602 aa, Ralstonia eutropha JMP134; identical to SEQ ID NO: 14501

SEQ ID NO: 42456 - DNA, 1329 bp, Ralstonia eutropha JMP134; identical to SEQ ID NO: 14502
  CDS (1)..(1329)

SEQ ID NO: 42457 - protein, 442 aa, Ralstonia eutropha JMP134; identical to SEQ ID NO: 14503

SEQ ID NO: 42458 - DNA, 1254 bp, Ralstonia eutropha JMP134; identical to SEQ ID NO: 14504
  CDS (1)..(1254)

SEQ ID NO: 42459 - protein, 417 aa, Ralstonia eutropha JMP134; identical to SEQ ID NO: 14505

SEQ ID NO: 42460 - DNA, 1551 bp, Burkholderia cepacia R18194; identical to SEQ ID NO: 14506
  CDS (1)..(1551)

SEQ ID NO: 42461 - protein, 516 aa, Burkholderia cepacia R18194; identical to SEQ ID NO: 14507

SEQ ID NO: 42462 - DNA, 1275 bp, Burkholderia cepacia R18194; identical to SEQ ID NO: 14508
  CDS (1)..(1275)

SEQ ID NO: 42463 - protein, 424 aa, Burkholderia cepacia R18194; identical to SEQ ID NO: 14509

SEQ ID NO: 42464 - DNA, 1515 bp, Listeria monocytogenes str. 4b H7858; identical to SEQ ID NO: 14510
  CDS (1)..(1515): transl_table=11

SEQ ID NO: 42465 - protein, 504 aa, Listeria monocytogenes str. 4b H7858; identical to SEQ ID NO: 14511

SEQ ID NO: 42466 - DNA, 1212 bp, Bacillus cereus G9241; identical to SEQ ID NO: 14512
  CDS (1)..(1212): transl_table=11

SEQ ID NO: 42467 - protein, 403 aa, Bacillus cereus G9241; identical to SEQ ID NO: 14513

SEQ ID NO: 42468 - DNA, 1530 bp, Bacillus cereus G9241; identical to SEQ ID NO: 14514
  CDS (1)..(1530): transl_table=11

SEQ ID NO: 42469 - protein, 509 aa, Bacillus cereus G9241; identical to SEQ ID NO: 14515

SEQ ID NO: 42470 - DNA, 1545 bp, Bacillus cereus G9241; identical to SEQ ID NO: 14516
  CDS (1)..(1545): transl_table=11

SEQ ID NO: 42471 - protein, 514 aa, Bacillus cereus G9241; identical to SEQ ID NO: 14517

SEQ ID NO: 42472 - DNA, 1167 bp, Bacillus cereus G9241; identical to SEQ ID NO: 14518
  CDS (1)..(1167): transl_table=11

SEQ ID NO: 42473 - protein, 388 aa, Bacillus cereus G9241; identical to SEQ ID NO: 14519

SEQ ID NO: 42474 - DNA, 1194 bp, Bacillus cereus G9241; identical to SEQ ID NO: 14520
  CDS (1)..(1194): transl_table=11

SEQ ID NO: 42475 - protein, 397 aa, Bacillus cereus G9241; identical to SEQ ID NO: 14521

SEQ ID NO: 42476 - DNA, 1314 bp, Rubrivivax gelatinosus PM1; identical to SEQ ID NO: 14522
  CDS (1)..(1314)

SEQ ID NO: 42477 - protein, 437 aa, Rubrivivax gelatinosus PM1; identical to SEQ ID NO: 14523

SEQ ID NO: 42478 - DNA, 1647 bp, Rubrivivax gelatinosus PM1; identical to SEQ ID NO: 14524
  CDS (1)..(1647)

SEQ ID NO: 42479 - protein, 548 aa, Rubrivivax gelatinosus PM1; identical to SEQ ID NO: 14525

SEQ ID NO: 42480 - DNA, 1287 bp, Pseudomonas fluorescens PfO-1; identical to SEQ ID NO: 14526
  CDS (1)..(1287)

SEQ ID NO: 42481 - protein, 428 aa, Pseudomonas fluorescens PfO-1; identical to SEQ ID NO: 14527

SEQ ID NO: 42482 - DNA, 1158 bp, Pseudomonas fluorescens PfO-1; identical to SEQ ID NO: 14528
  CDS (1)..(1158)

SEQ ID NO: 42483 - protein, 385 aa, Pseudomonas fluorescens PfO-1; identical to SEQ ID NO: 14529

SEQ ID NO: 42484 - DNA, 1263 bp, Burkholderia fungorum LB400; identical to SEQ ID NO: 14530
  CDS (1)..(1263)

SEQ ID NO: 42485 - protein, 420 aa, Burkholderia fungorum LB400; identical to SEQ ID NO: 14531

SEQ ID NO: 42486 - DNA, 1554 bp, Burkholderia fungorum LB400; identical to SEQ ID NO: 14532
  CDS (1)..(1554)

SEQ ID NO: 42487 - protein, 517 aa, Burkholderia fungorum LB400; identical to SEQ ID NO: 14533

SEQ ID NO: 42488 - DNA, 1452 bp, Burkholderia fungorum LB400; identical to SEQ ID NO: 14534
  CDS (1)..(1452)

SEQ ID NO: 42489 - protein, 483 aa, Burkholderia fungorum LB400; identical to SEQ ID NO: 14535

SEQ ID NO: 42490 - DNA, 1503 bp, Cytophaga hutchinsonii; identical to SEQ ID NO: 14536
  CDS (1)..(1503)

SEQ ID NO: 42491 - protein, 500 aa, Cytophaga hutchinsonii; identical to SEQ ID NO: 14537

SEQ ID NO: 42492 - DNA, 1434 bp, Oenococcus oeni PSU-1; identical to SEQ ID NO: 14538
  CDS (1)..(1434)

SEQ ID NO: 42493 - protein, 477 aa, Oenococcus oeni PSU-1; identical to SEQ ID NO: 14539

SEQ ID NO: 42494 - DNA, 1464 bp, Pediococcus pentosaceus ATCC 25745; identical to SEQ ID NO: 14540
  CDS (1)..(1464)

SEQ ID NO: 42495 - protein, 487 aa, Pediococcus pentosaceus ATCC 25745; identical to SEQ ID NO: 14541

SEQ ID NO: 42496 - DNA, 1365 bp, Pediococcus pentosaceus ATCC 25745; identical to SEQ ID NO: 14542
  CDS (1)..(1365)

SEQ ID NO: 42497 - protein, 454 aa, Pediococcus pentosaceus ATCC 25745; identical to SEQ ID NO: 14543

SEQ ID NO: 42498 - DNA, 1191 bp, Thiobacillus denitrificans ATCC 25259; identical to SEQ ID NO: 14544
  CDS (1)..(1191)

SEQ ID NO: 42499 - protein, 396 aa, Thiobacillus denitrificans ATCC 25259; identical to SEQ ID NO: 14545

SEQ ID NO: 42500 - DNA, 1443 bp, Thiobacillus denitrificans ATCC 25259; identical to SEQ ID NO: 14546
  CDS (1)..(1443)

SEQ ID NO: 42501 - protein, 480 aa, Thiobacillus denitrificans ATCC 25259; identical to SEQ ID NO: 14547

SEQ ID NO: 42502 - DNA, 1260 bp, Thiobacillus denitrificans ATCC 25259; identical to SEQ ID NO: 14548
  CDS (1)..(1260)

SEQ ID NO: 42503 - protein, 419 aa, Thiobacillus denitrificans ATCC 25259; identical to SEQ ID NO: 14549

SEQ ID NO: 42504 - DNA, 1959 bp, Xylella fastidiosa Ann-1; identical to SEQ ID NO: 14550
  CDS (1)..(1959)

SEQ ID NO: 42505 - protein, 652 aa, Xylella fastidiosa Ann-1; identical to SEQ ID NO: 14551

SEQ ID NO: 42506 - DNA, 1206 bp, Pseudomonas aeruginosa UCBPP-PA14; identical to SEQ ID NO: 14552
  CDS (1)..(1206)

SEQ ID NO: 42507 - protein, 401 aa, Pseudomonas aeruginosa UCBPP-PA14; identical to SEQ ID NO: 14553

SEQ ID NO: 42508 - DNA, 1203 bp, Erythrobacter litoralis HTCC2594; identical to SEQ ID NO: 14554
  CDS (1)..(1203): transl_table=11

SEQ ID NO: 42509 - protein, 400 aa, Erythrobacter litoralis HTCC2594; identical to SEQ ID NO: 14555

SEQ ID NO: 42510 - DNA, 1497 bp, Brevibacterium linens BL2; identical to SEQ ID NO: 14556
  CDS (1)..(1497)

SEQ ID NO: 42511 - protein, 498 aa, Brevibacterium linens BL2; identical to SEQ ID NO: 14557

SEQ ID NO: 42512 - DNA, 1446 bp, Lactococcus lactis subsp. cremoris SK11; identical to SEQ ID NO: 14558
  CDS (1)..(1446)

SEQ ID NO: 42513 - protein, 481 aa, Lactococcus lactis subsp. cremoris SK11; identical to SEQ ID NO: 14559

SEQ ID NO: 42514 - DNA, 1470 bp, Lactobacillus casei ATCC 334; identical to SEQ ID NO: 14560
  CDS (1)..(1470)

SEQ ID NO: 42515 - protein, 489 aa, Lactobacillus casei ATCC 334; identical to SEQ ID NO: 14561

SEQ ID NO: 42516 - DNA, 1212 bp, Bacillus anthracis str. A2012; identical to SEQ ID NO: 14562
  CDS (1)..(1212)

SEQ ID NO: 42517 - protein, 403 aa, Bacillus anthracis str. A2012; identical to SEQ ID NO: 14563

SEQ ID NO: 42518 - DNA, 2703 bp, Anaeromyxobacter dehalogenans 2CP-C; identical to SEQ ID NO: 14564
  CDS (1)..(2703): transl_table=11

SEQ ID NO: 42519 - protein, 900 aa, Anaeromyxobacter dehalogenans 2CP-C; identical to SEQ ID NO: 14565

SEQ ID NO: 42520 - DNA, 1461 bp, Anaeromyxobacter dehalogenans 2CP-C; identical to SEQ ID NO: 14566
  CDS (1)..(1461): transl_table=11

SEQ ID NO: 42521 - protein, 486 aa, Anaeromyxobacter dehalogenans 2CP-C; identical to SEQ ID NO: 14567

SEQ ID NO: 42522 - DNA, 1509 bp, Anaeromyxobacter dehalogenans 2CP-C; identical to SEQ ID NO: 14568
  CDS (1)..(1509): transl_table=11

SEQ ID NO: 42523 - protein, 502 aa, Anaeromyxobacter dehalogenans 2CP-C; identical to SEQ ID NO: 14569

SEQ ID NO: 42524 - DNA, 1533 bp, Arthrobacter sp. FB24; identical to SEQ ID NO: 14570
  CDS (1)..(1533): transl_table=11

SEQ ID NO: 42525 - protein, 510 aa, Arthrobacter sp. FB24; identical to SEQ ID NO: 14571

SEQ ID NO: 42526 - DNA, 1161 bp, Azotobacter vinelandii AvOP; identical to SEQ ID NO: 14572
  CDS (1)..(1161): transl_table=11

SEQ ID NO: 42527 - protein, 386 aa, Azotobacter vinelandii AvOP; identical to SEQ ID NO: 14573

SEQ ID NO: 42528 - DNA, 1446 bp, Azotobacter vinelandii AvOP; identical to SEQ ID NO: 14574
  CDS (1)..(1446): transl_table=11

SEQ ID NO: 42529 - protein, 481 aa, Azotobacter vinelandii AvOP; identical to SEQ ID NO: 14575

SEQ ID NO: 42530 - DNA, 1623 bp, Burkholderia vietnamiensis G4; identical to SEQ ID NO: 14576
  CDS (1)..(1623): transl_table=11

SEQ ID NO: 42531 - protein, 540 aa, Burkholderia vietnamiensis G4; identical to SEQ ID NO: 14577

SEQ ID NO: 42532 - DNA, 1452 bp, Burkholderia vietnamiensis G4; identical to SEQ ID NO: 14578
  CDS (1)..(1452): transl_table=11

SEQ ID NO: 42533 - protein, 483 aa, Burkholderia vietnamiensis G4; identical to SEQ ID NO: 14579

SEQ ID NO: 42534 - DNA, 1275 bp, Burkholderia mallei 10229; identical to SEQ ID NO: 14580
  CDS (1)..(1275)

SEQ ID NO: 42535 - protein, 424 aa, Burkholderia mallei 10229; identical to SEQ ID NO: 14581

SEQ ID NO: 42536 - DNA, 1275 bp, Burkholderia mallei 10399; identical to SEQ ID NO: 14582
  CDS (1)..(1275)

SEQ ID NO: 42537 - protein, 424 aa, Burkholderia mallei 10399; identical to SEQ ID NO: 14583

SEQ ID NO: 42538 - DNA, 1275 bp, Burkholderia cenocepacia AU 1054; identical to SEQ ID NO: 14621
  CDS (1)..(1275): transl_table=11

SEQ ID NO: 42539 - protein, 424 aa, Burkholderia cenocepacia AU 1054; identical to SEQ ID NO: 14622

SEQ ID NO: 42540 - DNA, 1623 bp, Burkholderia cenocepacia AU 1054; identical to SEQ ID NO: 14623
  CDS (1)..(1623): transl_table=11

SEQ ID NO: 42541 - protein, 540 aa, Burkholderia cenocepacia AU 1054; identical to SEQ ID NO: 14624

SEQ ID NO: 42542 - DNA, 1440 bp, Burkholderia cenocepacia AU 1054; identical to SEQ ID NO: 14625
  CDS (1)..(1440): transl_table=11

SEQ ID NO: 42543 - protein, 479 aa, Burkholderia cenocepacia AU 1054; identical to SEQ ID NO: 14626

SEQ ID NO: 42544 - DNA, 1077 bp, Burkholderia cenocepacia HI2424; identical to SEQ ID NO: 14627
  CDS (1)..(1077): transl_table=11

SEQ ID NO: 42545 - protein, 358 aa, Burkholderia cenocepacia HI2424; identical to SEQ ID NO: 14628

SEQ ID NO: 42546 - DNA, 1551 bp, Burkholderia cenocepacia HI2424; identical to SEQ ID NO: 14629
  CDS (1)..(1551): transl_table=11

SEQ ID NO: 42547 - protein, 516 aa, Burkholderia cenocepacia HI2424; identical to SEQ ID NO: 14630

SEQ ID NO: 42548 - DNA, 1425 bp, Chromohalobacter salexigens DSM 3043; identical to SEQ ID NO: 14631
  CDS (1)..(1425): transl_table=11

SEQ ID NO: 42549 - protein, 474 aa, Chromohalobacter salexigens DSM 3043; identical to SEQ ID NO: 14632

SEQ ID NO: 42550 - DNA, 1440 bp, Burkholderia pseudomallei 668; identical to SEQ ID NO: 14633
  CDS (1)..(1440)

SEQ ID NO: 42551 - protein, 479 aa, Burkholderia pseudomallei 668; identical to SEQ ID NO: 14634

SEQ ID NO: 42552 - DNA, 1719 bp, Polaromonas sp. JS666; identical to SEQ ID NO: 14635
  CDS (1)..(1719): transl_table=11

SEQ ID NO: 42553 - protein, 572 aa, Polaromonas sp. JS666; identical to SEQ ID NO: 14636

SEQ ID NO: 42554 - DNA, 1284 bp, Solibacter usitatus Ellin6076; identical to SEQ ID NO: 14637
  CDS (1)..(1284): transl_table=11

SEQ ID NO: 42555 - protein, 427 aa, Solibacter usitatus Ellin6076; identical to SEQ ID NO: 14638

SEQ ID NO: 42556 - DNA, 1191 bp, Geobacter metallireducens GS-15; identical to SEQ ID NO: 14639
  CDS (1)..(1191): transl_table=11

SEQ ID NO: 42557 - protein, 396 aa, Geobacter metallireducens GS-15; identical to SEQ ID NO: 14640

SEQ ID NO: 42558 - DNA, 1509 bp, Geobacter metallireducens GS-15; identical to SEQ ID NO: 14641
  CDS (1)..(1509): transl_table=11

SEQ ID NO: 42559 - protein, 502 aa, Geobacter metallireducens GS-15; identical to SEQ ID NO: 14642

SEQ ID NO: 42560 - DNA, 1524 bp, Exiguobacterium sp. 255-15; identical to SEQ ID NO: 14643
  CDS (1)..(1524): transl_table=11

SEQ ID NO: 42561 - protein, 507 aa, Exiguobacterium sp. 255-15; identical to SEQ ID NO: 14644

SEQ ID NO: 42562 - DNA, 1440 bp, Exiguobacterium sp. 255-15; identical to SEQ ID NO: 14645
  CDS (1)..(1440): transl_table=11

SEQ ID NO: 42563 - protein, 479 aa, Exiguobacterium sp. 255-15; identical to SEQ ID NO: 14646

SEQ ID NO: 42564 - DNA, 1512 bp, Exiguobacterium sp. 255-15; identical to SEQ ID NO: 14647
  CDS (1)..(1512): transl_table=11

SEQ ID NO: 42565 - protein, 503 aa, Exiguobacterium sp. 255-15; identical to SEQ ID NO: 14648

SEQ ID NO: 42566 - DNA, 1467 bp, Desulfuromonas acetoxidans DSM 684; identical to SEQ ID NO: 14649
  CDS (1)..(1467): transl_table=11

SEQ ID NO: 42567 - protein, 488 aa, Desulfuromonas acetoxidans DSM 684; identical to SEQ ID NO: 14650

SEQ ID NO: 42568 - DNA, 1443 bp, Desulfuromonas acetoxidans DSM 684; identical to SEQ ID NO: 14651
  CDS (1)..(1443): transl_table=11

SEQ ID NO: 42569 - protein, 480 aa, Desulfuromonas acetoxidans DSM 684; identical to SEQ ID NO: 14652

SEQ ID NO: 42570 - DNA, 1437 bp, Desulfitobacterium hafniense DCB-2; identical to SEQ ID NO: 14653
  CDS (1)..(1437): transl_table=11

SEQ ID NO: 42571 - protein, 478 aa, Desulfitobacterium hafniense DCB-2; identical to SEQ ID NO: 14654

SEQ ID NO: 42572 - DNA, 1608 bp, Methylobacillus flagellatus KT; identical to SEQ ID NO: 14655
  CDS (1)..(1608): transl_table=11

SEQ ID NO: 42573 - protein, 535 aa, Methylobacillus flagellatus KT; identical to SEQ ID NO: 14656

SEQ ID NO: 42574 - DNA, 1152 bp, Methylobacillus flagellatus KT; identical to SEQ ID NO: 14657
  CDS (1)..(1152): transl_table=11

SEQ ID NO: 42575 - protein, 383 aa, Methylobacillus flagellatus KT; identical to SEQ ID NO: 14658

SEQ ID NO: 42576 - DNA, 1173 bp, Sphingopyxis alaskensis RB2256; identical to SEQ ID NO: 14659
  CDS (1)..(1173): transl_table=11

SEQ ID NO: 42577 - protein, 390 aa, Sphingopyxis alaskensis RB2256; identical to SEQ ID NO: 14660

SEQ ID NO: 42578 - DNA, 1140 bp, Sphingopyxis alaskensis RB2256; identical to SEQ ID NO: 14661
  CDS (1)..(1140): transl_table=11

SEQ ID NO: 42579 - protein, 379 aa, Sphingopyxis alaskensis RB2256; identical to SEQ ID NO: 14662

SEQ ID NO: 42580 - DNA, 1527 bp, Shewanella amazonensis SB2B; identical to SEQ ID NO: 14663
  CDS (1)..(1527): transl_table=11

SEQ ID NO: 42581 - protein, 508 aa, Shewanella amazonensis SB2B; identical to SEQ ID NO: 14664

SEQ ID NO: 42582 - DNA, 1518 bp, Ralstonia metallidurans CH34; identical to SEQ ID NO: 14665
  CDS (1)..(1518): transl_table=11

SEQ ID NO: 42583 - protein, 505 aa, Ralstonia metallidurans CH34; identical to SEQ ID NO: 14666

SEQ ID NO: 42584 - DNA, 1605 bp, Ralstonia metallidurans CH34; identical to SEQ ID NO: 14667
  CDS (1)..(1605): transl_table=11

SEQ ID NO: 42585 - protein, 534 aa, Ralstonia metallidurans CH34; identical to SEQ ID NO: 14668

SEQ ID NO: 42586 - DNA, 1599 bp, Ralstonia metallidurans CH34; identical to SEQ ID NO: 14669
  CDS (1)..(1599): transl_table=11

SEQ ID NO: 42587 - protein, 532 aa, Ralstonia metallidurans CH34; identical to SEQ ID NO: 14670

SEQ ID NO: 42588 - DNA, 1281 bp, Rubrobacter xylanophilus DSM 9941; identical to SEQ ID NO: 14671
  CDS (1)..(1281): transl_table=11

SEQ ID NO: 42589 - protein, 426 aa, Rubrobacter xylanophilus DSM 9941; identical to SEQ ID NO: 14672

SEQ ID NO: 42590 - DNA, 1437 bp, Mesorhizobium sp. BNC1; identical to SEQ ID NO: 14673
  CDS (1)..(1437): transl_table=11

SEQ ID NO: 42591 - protein, 478 aa, Mesorhizobium sp. BNC1; identical to SEQ ID NO: 14674

SEQ ID NO: 42592 - DNA, 1404 bp, Kineococcus radiotolerans SRS30216; identical to SEQ ID NO: 14675
  CDS (1)..(1404): transl_table=11

SEQ ID NO: 42593 - protein, 467 aa, Kineococcus radiotolerans SRS30216; identical to SEQ ID NO: 14676

SEQ ID NO: 42594 - DNA, 1476 bp, Kineococcus radiotolerans SRS30216; identical to SEQ ID NO: 14677
  CDS (1)..(1476): transl_table=11

SEQ ID NO: 42595 - protein, 491 aa, Kineococcus radiotolerans SRS30216; identical to SEQ ID NO: 14678

SEQ ID NO: 42596 - DNA, 1551 bp, Silicibacter sp. TM1040; identical to SEQ ID NO: 14679
  CDS (1)..(1551): transl_table=11

SEQ ID NO: 42597 - protein, 516 aa, Silicibacter sp. TM1040; identical to SEQ ID NO: 14680

SEQ ID NO: 42598 - DNA, 1554 bp, Nitrobacter hamburgensis X14; identical to SEQ ID NO: 14681
  CDS (1)..(1554): transl_table=11

SEQ ID NO: 42599 - protein, 517 aa, Nitrobacter hamburgensis X14; identical to SEQ ID NO: 14682

SEQ ID NO: 42600 - DNA, 1428 bp, Paracoccus denitrificans PD1222; identical to SEQ ID NO: 14683
  CDS (1)..(1428): transl_table=11

SEQ ID NO: 42601 - protein, 475 aa, Paracoccus denitrificans PD1222; identical to SEQ ID NO: 14684

SEQ ID NO: 42602 - DNA, 1569 bp, Pseudomonas fluorescens; identical to SEQ ID NO: 14685
  CDS (1)..(1569): transl_table=11

SEQ ID NO: 42603 - protein, 522 aa, Pseudomonas fluorescens; identical to SEQ ID NO: 14686

SEQ ID NO: 42604 - DNA, 1158 bp, Pseudomonas fluorescens; identical to SEQ ID NO: 14687
  CDS (1)..(1158): transl_table=11

SEQ ID NO: 42605 - protein, 385 aa, Pseudomonas fluorescens; identical to SEQ ID NO: 14688

SEQ ID NO: 42606 - DNA, 1485 bp, Staphylococcus haemolyticus; identical to SEQ ID NO: 14689
  CDS (1)..(1485): transl_table=11

SEQ ID NO: 42607 - protein, 494 aa, Staphylococcus haemolyticus; identical to SEQ ID NO: 14690

SEQ ID NO: 42608 - DNA, 1515 bp, Listeria monocytogenes; identical to SEQ ID NO: 14691
  CDS (1)..(1515): transl_table=11

SEQ ID NO: 42609 - protein, 504 aa, Listeria monocytogenes; identical to SEQ ID NO: 14692

SEQ ID NO: 42610 - DNA, 1485 bp, Salmonella typhimurium; identical to SEQ ID NO: 14693
  CDS (1)..(1485): transl_table=11

SEQ ID NO: 42611 - protein, 494 aa, Salmonella typhimurium; identical to SEQ ID NO: 14694

SEQ ID NO: 42612 - DNA, 1530 bp, Bacillus anthracis; identical to SEQ ID NO: 14695
  CDS (1)..(1530): transl_table=11

SEQ ID NO: 42613 - protein, 509 aa, Bacillus anthracis; identical to SEQ ID NO: 14696

SEQ ID NO: 42614 - DNA, 1530 bp, Bacillus cereus; identical to SEQ ID NO: 14697
  CDS (1)..(1530): transl_table=11

SEQ ID NO: 42615 - protein, 509 aa, Bacillus cereus; identical to SEQ ID NO: 14698

SEQ ID NO: 42616 - DNA, 1503 bp, Bacillus subtilis; identical to SEQ ID NO: 14699
  CDS (1)..(1503): transl_table=11

SEQ ID NO: 42617 - protein, 500 aa, Bacillus subtilis; identical to SEQ ID NO: 14700

SEQ ID NO: 42618 - DNA, 1482 bp, Staphylococcus aureus; identical to SEQ ID NO: 14701
  CDS (1)..(1482): transl_table=11

SEQ ID NO: 42619 - protein, 493 aa, Staphylococcus aureus; identical to SEQ ID NO: 14702

SEQ ID NO: 42620 - DNA, 1473 bp, Staphylococcus epidermidis; identical to SEQ ID NO: 14703
  CDS (1)..(1473): transl_table=11

SEQ ID NO: 42621 - protein, 490 aa, Staphylococcus epidermidis; identical to SEQ ID NO: 14704

SEQ ID NO: 42622 - DNA, 1473 bp, Staphylococcus epidermidis; identical to SEQ ID NO: 14705
  CDS (1)..(1473): transl_table=11

SEQ ID NO: 42623 - protein, 490 aa, Staphylococcus epidermidis; identical to SEQ ID NO: 14706

SEQ ID NO: 42624 - DNA, 1545 bp, Bacillus cereus; identical to SEQ ID NO: 14707
  CDS (1)..(1545): transl_table=11

SEQ ID NO: 42625 - protein, 514 aa, Bacillus cereus; identical to SEQ ID NO: 14708

SEQ ID NO: 42626 - DNA, 1449 bp, Bacillus subtilis; identical to SEQ ID NO: 14709
  CDS (1)..(1449): transl_table=11

SEQ ID NO: 42627 - protein, 482 aa, Bacillus subtilis; identical to SEQ ID NO: 14710

SEQ ID NO: 42628 - DNA, 1485 bp, Staphylococcus aureus; identical to SEQ ID NO: 14711
  CDS (1)..(1485): transl_table=11

SEQ ID NO: 42629 - protein, 494 aa, Staphylococcus aureus; identical to SEQ ID NO: 14712

SEQ ID NO: 42630 - DNA, 1467 bp, Staphylococcus epidermidis; identical to SEQ ID NO: 14713
  CDS (1)..(1467)

SEQ ID NO: 42631 - protein, 488 aa, Staphylococcus epidermidis; identical to SEQ ID NO: 14714

SEQ ID NO: 42632 - DNA, 1512 bp, Bacillus halodurans; identical to SEQ ID NO: 14715
  CDS (1)..(1512): transl_table=11

SEQ ID NO: 42633 - protein, 503 aa, Bacillus halodurans; identical to SEQ ID NO: 14716

SEQ ID NO: 42634 - DNA, 1512 bp, Bacillus pseudofirmus; identical to SEQ ID NO: 14717
  CDS (1)..(1512): transl_table=11

SEQ ID NO: 42635 - protein, 503 aa, Bacillus pseudofirmus; identical to SEQ ID NO: 14718

SEQ ID NO: 42636 - DNA, 1473 bp, Buchnera aphidicola; identical to SEQ ID NO: 14719
  CDS (1)..(1473): transl_table=11

SEQ ID NO: 42637 - protein, 490 aa, Buchnera aphidicola; identical to SEQ ID NO: 14720

SEQ ID NO: 42638 - DNA, 1431 bp, Clostridium perfringens; identical to SEQ ID NO: 14721
  CDS (1)..(1431): transl_table=11

SEQ ID NO: 42639 - protein, 476 aa, Clostridium perfringens; identical to SEQ ID NO: 14722

SEQ ID NO: 42640 - DNA, 1461 bp, Escherichia coli O157; identical to SEQ ID NO: 14723
  CDS (1)..(1461): transl_table=11

SEQ ID NO: 42641 - protein, 486 aa, Escherichia coli O157; identical to SEQ ID NO: 14724

SEQ ID NO: 42642 - DNA, 1449 bp, Listeria monocytogenes; identical to SEQ ID NO: 14725
  CDS (1)..(1449): transl_table=11

SEQ ID NO: 42643 - protein, 482 aa, Listeria monocytogenes; identical to SEQ ID NO: 14726

SEQ ID NO: 42644 - DNA, 1473 bp, Pseudomonas aeruginosa; identical to SEQ ID NO: 14727
  CDS (1)..(1473): transl_table=11

SEQ ID NO: 42645 - protein, 490 aa, Pseudomonas aeruginosa; identical to SEQ ID NO: 14728

SEQ ID NO: 42646 - DNA, 1446 bp, Pseudomonas putida; identical to SEQ ID NO: 14729
  CDS (1)..(1446): transl_table=11

SEQ ID NO: 42647 - protein, 481 aa, Pseudomonas putida; identical to SEQ ID NO: 14730

SEQ ID NO: 42648 - DNA, 1446 bp, Pseudomonas putida; identical to SEQ ID NO: 14731
  CDS (1)..(1446): transl_table=11

SEQ ID NO: 42649 - protein, 481 aa, Pseudomonas putida; identical to SEQ ID NO: 14732

SEQ ID NO: 42650 - DNA, 1440 bp, Pseudomonas syringae; identical to SEQ ID NO: 14733
  CDS (1)..(1440): transl_table=11

SEQ ID NO: 42651 - protein, 479 aa, Pseudomonas syringae; identical to SEQ ID NO: 14734

SEQ ID NO: 42652 - DNA, 1461 bp, Salmonella typhi; identical to SEQ ID NO: 14735
  CDS (1)..(1461): transl_table=11

SEQ ID NO: 42653 - protein, 486 aa, Salmonella typhi; identical to SEQ ID NO: 14736

SEQ ID NO: 42654 - DNA, 1461 bp, Shigella flexneri; identical to SEQ ID NO: 14737
  CDS (1)..(1461): transl_table=11

SEQ ID NO: 42655 - protein, 486 aa, Shigella flexneri; identical to SEQ ID NO: 14738

SEQ ID NO: 42656 - DNA, 1485 bp, Staphylococcus aureus; identical to SEQ ID NO: 14739
  CDS (1)..(1485): transl_table=11

SEQ ID NO: 42657 - protein, 494 aa, Staphylococcus aureus; identical to SEQ ID NO: 14740

SEQ ID NO: 42658 - DNA, 1461 bp, Yersinia pestis; identical to SEQ ID NO: 14741
  CDS (1)..(1461): transl_table=11

SEQ ID NO: 42659 - protein, 486 aa, Yersinia pestis; identical to SEQ ID NO: 14742

SEQ ID NO: 42660 - DNA, 1509 bp, Helicobacter pylori J99; identical to SEQ ID NO: 14743
  CDS (1)..(1509): transl_table=11

SEQ ID NO: 42661 - protein, 502 aa, Helicobacter pylori J99; identical to SEQ ID NO: 14744

SEQ ID NO: 42662 - DNA, 1509 bp, Helicobacter pylori; identical to SEQ ID NO: 14745
  CDS (1)..(1509): transl_table=11

SEQ ID NO: 42663 - protein, 502 aa, Helicobacter pylori; identical to SEQ ID NO: 14746

SEQ ID NO: 42664 - DNA, 1242 bp, Escherichia coli; identical to SEQ ID NO: 14747
  CDS (1)..(1242): transl_table=11

SEQ ID NO: 42665 - protein, 413 aa, Escherichia coli; identical to SEQ ID NO: 14748

SEQ ID NO: 42666 - DNA, 1242 bp, Salmonella typhimurium; identical to SEQ ID NO: 14749
  CDS (1)..(1242): transl_table=11

SEQ ID NO: 42667 - protein, 413 aa, Salmonella typhimurium; identical to SEQ ID NO: 14750

SEQ ID NO: 42668 - DNA, 1242 bp, Shigella flexneri; identical to SEQ ID NO: 14751
  CDS (1)..(1242): transl_table=11

SEQ ID NO: 42669 - protein, 413 aa, Shigella flexneri; identical to SEQ ID NO: 14752

SEQ ID NO: 42670 - DNA, 23 bp, Artificial sequence
  (1)..(23): primer
atgatgaagaaaacgcccacctc

SEQ ID NO: 42671 - DNA, 24 bp, Artificial sequence
  (1)..(24): primer
ttacaataaccattccacgggcaa

SEQ ID NO: 42672 - protein, 736 aa, Artificial sequence; identical to SEQ ID NO: 14755
  Variant (3)..(4): xaa in position 3 to 4 is any amino acid
  Variant (6)..(7): xaa in position 6 to 7 is any amino acid
  Variant (9)..(10): xaa in position 9 to 10 is any amino acid
  Variant (12)..(16): xaa in position 12 to 16 is any amino acid
  Variant (18)..(19): xaa in position 18 to 19 is any or no amino acid
  Variant (21)..(21): xaa in position 21 is any amino acid
  Variant (22)..(93): xaa in position 22 to 93 is any or no amino acid
  Variant (95)..(105): xaa in position 95 to 105 is any amino acid
  Variant (106)..(109): xaa in position 106 to 109 is any or no amino acid
  Variant (111)..(111): xaa in position 111 is any amino acid
  Variant (113)..(113): xaa in position 113 is any amino acid
  Variant (116)..(117): xaa in position 116 to 117 is any amino acid
  Variant (119)..(119): xaa in position 119 is any or no amino acid
  Variant (121)..(121): xaa in position 121 is any amino acid
  Variant (123)..(123): xaa in position 123 is any amino acid
  Variant (127)..(128): xaa in position 127 to 128 is any amino acid
  Variant (130)..(131): xaa in position 130 to 131 is any amino acid
  Variant (133)..(135): xaa in position 133 to 135 is any amino acid
  Variant (137)..(137): xaa in position 137 is any amino acid
  Variant (139)..(139): xaa in position 139 is any amino acid
  Variant (144)..(145): xaa in position 144 to 145 is any amino acid
  Variant (147)..(147): xaa in position 147 is any amino acid
  Variant (150)..(151): xaa in position 150 to 151 is any amino acid
  Variant (153)..(154): xaa in position 153 to 154 is any amino acid
  Variant (158)..(158): xaa in position 158 is any amino acid
  Variant (161)..(161): xaa in position 161 is any amino acid
  Variant (165)..(165): xaa in position 165 is any amino acid
  Variant (172)..(172): xaa in position 172 is any amino acid
  Variant (176)..(183): xaa in position 176 to 183 is any amino acid
  Variant (184)..(190): xaa in position 184 to 190 is any or no amino acid
  Variant (192)..(194): xaa in position 192 to 194 is any amino acid
  Variant (197)..(197): xaa in position 197 is any amino acid
  Variant (199)..(200): xaa in position 199 to 200 is any amino acid
  Variant (202)..(202): xaa in position 202 is any amino acid
  Variant (204)..(209): xaa in position 204 to 209 is any amino acid
  Variant (210)..(229): xaa in position 210 to 229 is any or no amino acid
  Variant (233)..(233): xaa in position 233 is any amino acid
  Variant (235)..(235): xaa in position 235 is any amino acid
  Variant (245)..(245): xaa in position 245 is any amino acid
  Variant (252)..(252): xaa in position 252 is any amino acid
  Variant (259)..(261): xaa in position 259 to 261 is any amino acid
  Variant (262)..(286): xaa in position 262 to 286 is any or no amino acid
  Variant (288)..(288): xaa in position 288 is any or no amino acid
  Variant (290)..(291): xaa in position 290 to 291 is any amino acid
  Variant (295)..(295): xaa in position 295 is any amino acid
  Variant (298)..(298): xaa in position 298 is any amino acid
  Variant (300)..(301): xaa in position 300 to 301 is any amino acid
  Variant (303)..(305): xaa in position 303 to 305 is any amino acid
  Variant (307)..(308): xaa in position 307 to 308 is any amino acid
  Variant (311)..(313): xaa in position 311 to 313 is any amino acid
  Variant (315)..(327): xaa in position 315 to 327 is any amino acid
  Variant (328)..(382): xaa in position 328 to 382 is any or no amino acid
  Variant (384)..(384): xaa in position 384 is any or no amino acid
  Variant (388)..(388): xaa in position 388 is any amino acid
  Variant (391)..(396): xaa in position 391 to 396 is any amino acid
  Variant (398)..(400): xaa in position 398 to 400 is any amino acid
  Variant (401)..(413): xaa in position 401 to 413 is any or no amino acid
  Variant (415)..(415): xaa in position 415 is any or no amino acid
  Variant (418)..(419): xaa in position 418 to 419 is any amino acid
  Variant (423)..(423): xaa in position 423 is any or no amino acid
  Variant (425)..(425): xaa in position 425 is any or no amino acid
  Variant (427)..(427): xaa in position 427 is any or no amino acid
  Variant (434)..(436): xaa in position 434 to 436 is any amino acid
  Variant (439)..(439): xaa in position 439 is any amino acid
  Variant (442)..(443): xaa in position 442 to 443 is any amino acid
  Variant (446)..(446): xaa in position 446 is any amino acid
  Variant (450)..(454): xaa in position 450 to 454 is any or no amino acid
  Variant (456)..(456): xaa in position 456 is any amino acid
  Variant (461)..(463): xaa in position 461 to 463 is any amino acid
  Variant (465)..(466): xaa in position 465 to 466 is any amino acid
  Variant (469)..(470): xaa in position 469 to 470 is any amino acid
  Variant (472)..(474): xaa in position 472 to 474 is any amino acid
  Variant (476)..(477): xaa in position 476 to 477 is any amino acid
  Variant (478)..(488): xaa in position 478 to 488 is any or no amino acid
  Variant (491)..(491): xaa in position 491 is any amino acid
  Variant (498)..(498): xaa in position 498 is any amino acid
  Variant (500)..(503): xaa in position 500 to 503 is any amino acid
  Variant (504)..(608): xaa in position 504 to 608 is any or no amino acid
  Variant (613)..(613): xaa in position 613 is any amino acid
  Variant (618)..(618): xaa in position 618 is any amino acid
  Variant (619)..(626): xaa in position 619 to 626 is any or no amino acid
  Variant (629)..(629): xaa in position 629 is any amino acid
  Variant (637)..(637): xaa in position 637 is any amino acid
  Variant (640)..(641): xaa in position 640 to 641 is any amino acid
  Variant (644)..(644): xaa in position 644 is any amino acid
  Variant (647)..(647): xaa in position 647 is any amino acid
  Variant (651)..(651): xaa in position 651 is any amino acid
  Variant (653)..(653): xaa in position 653 is any amino acid
  Variant (654)..(655): xaa in position 654 to 655 is any or no amino acid
  Variant (658)..(659): xaa in position 658 to 659 is any amino acid
  Variant (661)..(666): xaa in position 661 to 666 is any amino acid
  Variant (669)..(669): xaa in position 669 is any amino acid
  Variant (670)..(670): xaa in position 670 is any or no amino acid
  Variant (672)..(672): xaa in position 672 is any amino acid
  Variant (673)..(673): xaa in position 673 is any or no amino acid
  Variant (675)..(678): xaa in position 675 to 678 is any amino acid
  Variant (680)..(681): xaa in position 680 to 681 is any amino acid
  Variant (683)..(684): xaa in position 683 to 684 is any amino acid
  Variant (685)..(722): xaa in position 685 to 722 is any or no amino acid
  Variant (725)..(727): xaa in position 725 to 727 is any amino acid
  Variant (729)..(729): xaa in position 729 is any amino acid
  Variant (734)..(734): xaa in position 734 is any amino acid

SEQ ID NO: 42673 - protein, 17 aa, Artificial sequence
  Variant (2)..(3): xaa in position 2 to 3 is any amino acid
  Variant (4)..(4): xaa in position 4 is any or no amino acid
  Variant (6)..(7): xaa in position 6 to 7 is any amino acid
  Variant (8)..(8): xaa in position 8 is any or no amino acid
  Variant (10)..(10): xaa in position 10 is Ile or Val
  Variant (11)..(11): xaa in position 11 is any amino acid
  Variant (12)..(12): xaa in position 12 is Ala, Cys, Thr or Val
  Variant (13)..(16): xaa in position 13 to 16 is any amino acid
LXXXAXXXGXXXXXXXD

SEQ ID NO: 42674 - protein, 20 aa, Artificial sequence
  Variant (2)..(2): xaa in position 2 is any amino acid
  Variant (4)..(4): xaa in position 4 is Asn or Arg
  Variant (6)..(8): xaa in position 6 to 8 is any amino acid
  Variant (9)..(9): xaa in position 9 is Ala, Ile or Val
  Variant (11)..(13): xaa in position 11 to 13 is any amino acid
  Variant (14)..(14): xaa in position 14 is Ala, Gly, Ser, Thr or Val
  Variant (15)..(16): xaa in position 15 to 16 is any amino acid
  Variant (18)..(18): xaa in position 18 is Gly or Ser
  Variant (19)..(19): xaa in position 19 is any amino acid
RXHXKXXXXDXXXXXXGXXN

SEQ ID NO: 42675 - protein, 22 aa, Artificial sequence
  Variant (2)..(2): xaa in position 2 is Phe or Leu
  Variant (3)..(3): xaa in position 3 is Phe, Ile, Leu or Val
  Variant (5)..(11): xaa in position 5 to 11 is any amino acid
  Variant (12)..(12): xaa in position 12 is Phe, Ile, Leu, Met or Val
  Variant (13)..(18): xaa in position 13 to 18 is any amino acid
  Variant (20)..(21): xaa in position 20 to 21 is any or no amino acid
YXXPXXXXXXXXXXXXXXGXXV

SEQ ID NO: 42676 - protein, 29 aa, Artificial sequence
  Variant (2)..(2): xaa in position 2 is Ala, Gly, Gln, Ser or Thr
  Variant (4)..(7): xaa in position 4 to 7 is any amino acid
  Variant (9)..(13): xaa in position 9 to 13 is any amino acid
  Variant (14)..(14): xaa in position 14 is any or no amino acid
  Variant (16)..(16): xaa in position 16 is Ser or Thr
  Variant (17)..(17): xaa in position 17 is any amino acid
  Variant (19)..(19): xaa in position 19 is any amino acid
  Variant (20)..(20): xaa in position 20 is Asp, Asn or Thr
  Variant (21)..(21): xaa in position 21 is any amino acid
  Variant (24)..(28): xaa in position 24 to 28 is any amino acid
HXKXXXXDXXXXXXGXXNXXXRSXXXXXE

SEQ ID NO: 42677 - DNA, 291 bp, Escherichia coli K12; identical to SEQ ID NO: 18608
  CDS (1)..(291): transl_table=11

SEQ ID NO: 42678 - protein, 96 aa, Escherichia coli K12; identical to SEQ ID NO: 18609

SEQ ID NO: 42679 - DNA, 216 bp, Bacteriophage 933W; identical to SEQ ID NO: 18610
  CDS (1)..(216): transl_table=11

SEQ ID NO: 42680 - protein, 71 aa, Bacteriophage 933W; identical to SEQ ID NO: 18611

SEQ ID NO: 42681 - DNA, 291 bp, Bacteriophage VT2-Sa; identical to SEQ ID NO: 18612
  CDS (1)..(291): transl_table=11

SEQ ID NO: 42682 - protein, 96 aa, Bacteriophage VT2-Sa; identical to SEQ ID NO: 18613

SEQ ID NO: 42683 - DNA, 315 bp, Escherichia coli O157:H7 EDL933; identical to SEQ ID NO: 18614
  CDS (1)..(315): transl_table=11

SEQ ID NO: 42684 - protein, 104 aa, Escherichia coli O157:H7 EDL933; identical to SEQ ID NO: 18615

SEQ ID NO: 42685 - DNA, 315 bp, Escherichia coli O157:H7 EDL933; identical to SEQ ID NO: 18616
  CDS (1)..(315): transl_table=11

SEQ ID NO: 42686 - protein, 104 aa, Escherichia coli O157:H7 EDL933; identical to SEQ ID NO: 18617

SEQ ID NO: 42687 - DNA, 273 bp, Escherichia coli O157:H7 EDL933; identical to SEQ ID NO: 18618
  CDS (1)..(273): transl_table=11

SEQ ID NO: 42688 - protein, 90 aa, Escherichia coli O157:H7 EDL933; identical to SEQ ID NO: 18619

SEQ ID NO: 42689 - DNA, 216 bp, Escherichia coli O157:H7; identical to SEQ ID NO: 18620
  CDS (1)..(216): transl_table=11

SEQ ID NO: 42690 - protein, 71 aa, Escherichia coli O157:H7; identical to SEQ ID NO: 18621

SEQ ID NO: 42691 - DNA, 207 bp, Escherichia coli O157:H7; identical to SEQ ID NO: 18622
  CDS (1)..(207): transl_table=11

SEQ ID NO: 42692 - protein, 68 aa, Escherichia coli O157:H7; identical to SEQ ID NO: 18623

SEQ ID NO: 42693 - DNA, 216 bp, Escherichia coli O157:H7; identical to SEQ ID NO: 18624
  CDS (1)..(216): transl_table=11

SEQ ID NO: 42694 - protein, 71 aa, Escherichia coli O157:H7; identical to SEQ ID NO: 18625

SEQ ID NO: 42695 - DNA, 216 bp, Escherichia coli O157:H7; identical to SEQ ID NO: 18626
  CDS (1)..(216): transl_table=11

SEQ ID NO: 42696 - protein, 71 aa, Escherichia coli O157:H7; identical to SEQ ID NO: 18627

SEQ ID NO: 42697 - DNA, 216 bp, Escherichia coli O157:H7; identical to SEQ ID NO: 18628
  CDS (1)..(216): transl_table=11

SEQ ID NO: 42698 - protein, 71 aa, Escherichia coli O157:H7; identical to SEQ ID NO: 18629

SEQ ID NO: 42699 - DNA, 207 bp, Escherichia coli O157:H7; identical to SEQ ID NO: 18630
  CDS (1)..(207): transl_table=11

SEQ ID NO: 42700 - protein, 68 aa, Escherichia coli O157:H7; identical to SEQ ID NO: 18631

SEQ ID NO: 42701 - DNA, 207 bp, Escherichia coli O157:H7; identical to SEQ ID NO: 18632
  CDS (1)..(207): transl_table=11

SEQ ID NO: 42702 - protein, 68 aa, Escherichia coli O157:H7; identical to SEQ ID NO: 18633

SEQ ID NO: 42703 - DNA, 216 bp, Shigella flexneri 2a str. 301; identical to SEQ ID NO: 18634
  CDS (1)..(216): transl_table=11

SEQ ID NO: 42704 - protein, 71 aa, Shigella flexneri 2a str. 301; identical to SEQ ID NO: 18635

SEQ ID NO: 42705 - DNA, 216 bp, Shigella flexneri 2a str. 301; identical to SEQ ID NO: 18636
  CDS (1)..(216): transl_table=11

SEQ ID NO: 42706 - protein, 71 aa, Shigella flexneri 2a str. 301; identical to SEQ ID NO: 18637

SEQ ID NO: 42707 - DNA, 321 bp, Escherichia coli CFT073; identical to SEQ ID NO: 18638
  CDS (1)..(321): transl_table=11

SEQ ID NO: 42708 - protein, 106 aa, Escherichia coli CFT073; identical to SEQ ID NO: 18639

SEQ ID NO: 42709 - DNA, 216 bp, Escherichia coli CFT073; identical to SEQ ID NO: 18640
  CDS (1)..(216): transl_table=11

SEQ ID NO: 42710 - protein, 71 aa, Escherichia coli CFT073; identical to SEQ ID NO: 18641

SEQ ID NO: 42711 - DNA, 216 bp, Shigella flexneri 2a str. 2457T; identical to SEQ ID NO: 18642
  CDS (1)..(216): transl_table=11

SEQ ID NO: 42712 - protein, 71 aa, Shigella flexneri 2a str. 2457T; identical to SEQ ID NO: 18643

SEQ ID NO: 42713 - DNA, 180 bp, Shigella flexneri 2a str. 2457T; identical to SEQ ID NO: 18644
  CDS (1)..(180): transl_table=11

SEQ ID NO: 42714 - protein, 59 aa, Shigella flexneri 2a str. 2457T; identical to SEQ ID NO: 18645

SEQ ID NO: 42715 - DNA, 213 bp, Yersinia pseudotuberculosis IP 32953; identical to SEQ ID NO: 18646
  CDS (1)..(213): transl_table=11

SEQ ID NO: 42716 - protein, 70 aa, Yersinia pseudotuberculosis IP 32953; identical to SEQ ID NO: 18647

SEQ ID NO: 42717 - DNA, 216 bp, Shigella sonnei Ss046; identical to SEQ ID NO: 18648
  CDS (1)..(216): transl_table=11

SEQ ID NO: 42718 - protein, 71 aa, Shigella sonnei Ss046; identical to SEQ ID NO: 18649

SEQ ID NO: 42719 - DNA, 216 bp, Shigella sonnei Ss046; identical to SEQ ID NO: 18650
  CDS (1)..(216): transl_table=11

SEQ ID NO: 42720 - protein, 71 aa, Shigella sonnei Ss046; identical to SEQ ID NO: 18651

SEQ ID NO: 42721 - DNA, 207 bp, Bacteriophage H19B; identical to SEQ ID NO: 18652
  CDS (1)..(207): transl_table=11

SEQ ID NO: 42722 - protein, 68 aa, Bacteriophage H19B; identical to SEQ ID NO: 18653

SEQ ID NO: 42723 - DNA, 291 bp, Stx1; identical to SEQ ID NO: 18654
  CDS (1)..(291): transl_table=11

SEQ ID NO: 42724 - protein, 96 aa, Stx1; identical to SEQ ID NO: 18655

SEQ ID NO: 42725 - DNA, 150 bp, Escherichia coli; identical to SEQ ID NO: 18656
  CDS (1)..(150): transl_table=11

SEQ ID NO: 42726 - protein, 49 aa, Escherichia coli; identical to SEQ ID NO: 18657

SEQ ID NO: 42727 - DNA, 216 bp, Escherichia coli; identical to SEQ ID NO: 18658
  CDS (1)..(216): transl_table=11

SEQ ID NO: 42728 - protein, 71 aa, Escherichia coli; identical to SEQ ID NO: 18659

SEQ ID NO: 42729 - DNA, 216 bp, Shigella dysenteriae; identical to SEQ ID NO: 18660
  CDS (1)..(216): transl_table=11

SEQ ID NO: 42730 - protein, 71 aa, Shigella dysenteriae; identical to SEQ ID NO: 18661

SEQ ID NO: 42731 - DNA, 216 bp, Escherichia coli O6; identical to SEQ ID NO: 18662
  CDS (1)..(216): transl_table=11

SEQ ID NO: 42732 - protein, 71 aa, Escherichia coli O6; identical to SEQ ID NO: 18663

SEQ ID NO: 42733 - DNA, 216 bp, Bacteriophage P21; identical to SEQ ID NO: 18664
  CDS (1)..(216): transl_table=11

SEQ ID NO: 42734 - protein, 71 aa, Bacteriophage P21; identical to SEQ ID NO: 18665

SEQ ID NO: 42735 - DNA, 24 bp, Artificial sequence
  (1)..(24): primer
atgctgtcaaaactaccccgtaga

SEQ ID NO: 42736 - DNA, 23 bp, Artificial sequence
  (1)..(23): primer
ttactctcctctcgcagccttac

SEQ ID NO: 42737 - protein, 71 aa, Artificial sequence; identical to SEQ ID NO: 18668
  Variant (2)..(3): xaa in position 2 to 3 is any amino acid
  Variant (14)..(14): xaa in position 14 is any amino acid
  Variant (18)..(20): xaa in position 18 to 20 is any amino acid
  Variant (24)..(24): xaa in position 24 is any amino acid
  Variant (27)..(27): xaa in position 27 is any amino acid
  Variant (30)..(30): xaa in position 30 is any amino acid
  Variant (37)..(37): xaa in position 37 is any amino acid
  Variant (47)..(47): xaa in position 47 is any amino acid
  Variant (49)..(49): xaa in position 49 is any amino acid
  Variant (67)..(67): xaa in position 67 is any amino acid

SEQ ID NO: 42738 - protein, 10 aa, Artificial sequence
  Variant (2)..(2): xaa in position 2 is Asp or Glu
  Variant (5)..(5): xaa in position 5 is Ser or Thr
  Variant (7)..(7): xaa in position 7 is Gly or Ser
  Variant (8)..(8): xaa in position 8 is Ile or Val
  Variant (9)..(9): xaa in position 9 is Ala or Ser
MXKIXTXXXY

SEQ ID NO: 42739 - protein, 6 aa, Artificial sequence
  Variant (2)..(2): xaa in position 2 is Phe or Leu
  Variant (5)..(5): xaa in position 5 is any amino acid
WXLQXL

SEQ ID NO: 42740 - protein, 14 aa, Artificial sequence
  Variant (5)..(5): xaa in position 5 is any or no amino acid
  Variant (7)..(7): xaa in position 7 is any or no amino acid
PSQWXAXIGVLGSL

SEQ ID NO: 42741 - DNA, 2262 bp, Escherichia coli
  CDS (1)..(2262)
atgtcgcaacataacgaaaagaacccacatcagcaccagtcaccactacacgattccagcgaagcgaaaccggggatggactcactggcacctgaggacggctctcatcgtccagcggctgaaccaacaccgccaggtgcacaacctaccgccccagggagcctgaaagcccctgatacgcgtaacgaaaaacttaattctctggaagacgtacgcaaaggcagtgaaaattatgcgctgaccactaatcagggcgtgcgcatcgccgacgatcaaaactcactgcgtgccggtagccgtggtccaacgctgctggaagattttattctgcgcgagaaaatcacccactttgaccatgagcgcattccggaacgtattgttcatgcacgcggatcagccgctcacggttatttccagccatataaaagcttaagcgatattaccaaagcggatttcctctcagatccgaacaaaatcaccccagtatttgtacgtttctctaccgttcagggtggtgctggctctgctgataccgtgcgtgatatccgtggctttgccaccaagttctataccgaagagggtatttttgacctcgttggcaataacacgccaatcttctttatccaggatgcgcataaattccccgattttgttcatgcggtaaaaccagaaccgcactgggcaattccacaagggcaaagtgcccacgatactttctgggattatgtttctctgcaacctgaaactctgcacaacgtgatgtgggcgatgtcggatcgcggcatcccccgcagttaccgcaccatggaaggcttcggtattcacaccttccgcctgattaatgccgaagggaaggcaacgtttgtacgtttccactggaaaccactggcaggtaaagcctcactcgtttgggatgaagcacaaaaactcaccggacgtgacccggacttccaccgccgcgagttgtgggaagccattgaagcaggcgattttccggaatacgaactgggcttccagttgattcctgaagaagatgaattcaagttcgacttcgatcttctcgatccaaccaaacttatcccggaagaactggtgcccgttcagcgtgtcggcaaaatggtgctcaatcgcaacccggataacttctttgctgaaaacgaacaggcggctttccatcctgggcatatcgtgccgggactggacttcaccaacgatccgctgttgcagggacgtttgttctcctataccgatacacaaatcagtcgtcttggtgggccgaatttccatgagattccgattaaccgtccgacctgcccttaccataatttccagcgtgacggcatgcatcgcatggggatcgacactaacccggcgaattacgaaccgaactcgattaacgataactggccgcgcgaaacaccgccggggccgaaacgcggcggttttgaatcataccaggagcgcgtggaaggcaataaagttcgcgagcgcagcccatcgtttggcgaatattattcccatccgcgtctgttctggctaagtcagacgccatttgagcagcgccatattgtcgatggtttcagttttgagttaagcaaagtcgttcgtccgtatattcgtgagcgcgttgttgaccagctggcgcatattgatctcactctggcccaggcggtggcgaaaaatctcggtatcgaactgactgacgaccagctgaatatcaccccacctccggacgtcaacggtctgaaaaaggatccatccttaagtttgtacgccattcctgacggtgatgtgaaaggtcgcgtggtagcgattttacttaatgatgaagtgagatcggcagaccttctggccattctcaaggcgctgaaggccaaaggcgttcatgccaaactgctctactcccgaatgggtgaagtgactgcggatgacggtacggtgttgcctatagccgctacctttgccggtgcaccttcgctgacggtcgatgcggtcattgtcccttgcggcaatatcgcggatatcgctgacaacggcgatgccaactactacctgatggaagcctacaaacaccttaaaccgattgcgctggcgggtgacgcgcgcaagtttaaagcaacaatcaagatcgctgaccagggtgaagaagggattgtggaagctgacagcgctgacggtagttttatggatgaactgctaacgctgatggcagcacaccgcgtgtggtcacgcattcctaagattgacaaaattcctgcctga

SEQ ID NO: 42742 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 42743 - DNA, 1584 bp, Canis familiaris
  CDS (1)..(1584)
atggcggacagccgggacccagccagcgaccagatgaagctctggaaggagcagcgcgccgcgcagaaacctgatgtcctgaccaccgggggcggtaatccaataggagacaaacttaatgtgatgacagcagggcctcgggggccccttcttgttcaggatgtggttttcactgatgaaatggctcactttgaccgggagagaatccctgagagagtcgtgcacgctaaaggagcaggggcttttggctacttcgaggtcacacatgacattaccaaatactccaaagcaaaggtgtttgagcatattggaaagaggacccccattgcagttcgattctccactgttgctggagaatcaggctcggctgacacagttcgtgaccctcgtgggtttgcagtgaaattttacacagaggatggtaattgggatcttgttggaaataacacccccattttcttcatcagagatgccatattgtttccgtcctttatccatagtcaaaagagaaaccctcaaacacacctgaaggatccggacatggtctgggacttctggagcctgcgccctgagtctctgcaccaggtttccttcttgttcagtgatcgagggattccagatggacacaggcacatgaatggatatggatcacatacttttaagctggttaatgcagcgggagaggcggtttattgcaaattccattataagactgaccagggcatcaaaaacctttctgttgaagacgcagcaagactttctcatgaagatcctgactacggcctccgggatcttttcaatgccattgccacaggcaactacccctcctggacattttatatccaagtcatgacttttagtcaggcagaaacttttccattcaatccatttgatcttaccaagatttggcctcaccaagactaccctcttatcccagttggtaaactggtcttaaaccggaatccagttaattacttcgctgaggttgaacagatggcatttgacccaagcaacatgccacctggcattgagcccagccctgacaaaatgcttcagggtcgtctttttgcctatcctgacactcaccgccaccgcctgggacccaactatcttcagatacctgtgaactgtcctttccgggctcgagtggccaactaccaacgggatggccccatgtgcatgctcgacaatcagggtggtgctccaaattactaccccaatagctttagtgctcctgaacaacagcgttgtgtcctagagcatagcagccaatgttcgccagatgtgcagcgcttcaacagtgccaatgaagataatgtcactcaggtgcggaccttctatttgaaggtacttggtgaagaggagaggaaacgcctgtgcgagaacattgctggccatctgaaggacgcacaacttttcatccagaagaaagcggtcaagaacttcagtgatgtccaccctgactacggggcccgcattcaggctcttttggacaaatacaatgctgagaaacctaagaacgcgattcacacctttatgcagcatgggtctcacctggctgccagggaaaaagccaatctgtga

SEQ ID NO: 42744 - protein, 527 aa, Canis familiaris
MADSRDPASDQMKLWKEQRAAQKPDVLTTGGGNPIGDKLNVMTAGPRGPLLVQDVVFTDEMAHFDRERIPERVVHAKGAGAFGYFEVTHDITKYSKAKVFEHIGKRTPIAVRFSTVAGESGSADTVRDPRGFAVKFYTEDGNWDLVGNNTPIFFIRDAILFPSFIHSQKRNPQTHLKDPDMVWDFWSLRPESLHQVSFLFSDRGIPDGHRHMNGYGSHTFKLVNAAGEAVYCKFHYKTDQGIKNLSVEDAARLSHEDPDYGLRDLFNAIATGNYPSWTFYIQVMTFSQAETFPFNPFDLTKIWPHQDYPLIPVGKLVLNRNPVNYFAEVEQMAFDPSNMPPGIEPSPDKMLQGRLFAYPDTHRHRLGPNYLQIPVNCPFRARVANYQRDGPMCMLDNQGGAPNYYPNSFSAPEQQRCVLEHSSQCSPDVQRFNSANEDNVTQVRTFYLKVLGEEERKRLCENIAGHLKDAQLFIQKKAVKNFSDVHPDYGARIQALLDKYNAEKPKNAIHTFMQHGSHLAAREKANL

SEQ ID NO: 42745 - DNA, 2109 bp, Mesorhizobium loti MAFF303099
  CDS (1)..(2109): transl_table=11
atggcgaagcaagcatccaaattggccggaacggccgcgaccatccacgatcagaaactgcagcgcggcgaaggcggcgaactgcaccagaccgcgtccggttcgacagccgtactgaccaccgcacagggcggccctgtctcggacgaccagaactcgctgaggatcggtgcgcgtgggccaaccgtgctcgaggacttccacttccgcgaaaagatcttccatttcgatcacgagcgcattcccgagcgcgtcgtccatgcgcgtggctatggcgcgcacggctatttcgaaacctatgaatcgctggccaaatacacccgcgccgacatcttccagcgcgccggcgaaaagacgccggctttcgtgcgcttctccaccgttgccggcaataagggctccgccgatcttgcccgcgacgtccgtggcttcgccgtaaaactctacacgcaggaaggcaattgggacattgtcggcaacaacatgccggtgttcttcatccaggatgcgatcaagtttcccgacctgatccatgccgcgaaggccgagcccaacagcgatttcccgcaggcacagaccgcgcacgacaatttctgggatttcatctcgctcacgccggaaagcatgcacatgatcatgtgggcgatgtccgaccgcgccatcccgcgctcgctgcgcttcatggaagggttcggcgtccacactttccggctgctcaacgcgaaggatgaatcgaccttcgtcaaattcctctggaagccgaagctcggcctccagtcggtcgcctggaacgaggcggtcaagatcaacggcgccgaccccgacttccatcgccgcgacctctgggacgcgatccacgccgggaatttccccgaatgggaactgcagctgcagctcttcgaccaggccttcgccgacagcttcgacttcgacatcctcgatccgaccaaactcatccccgaggaggtgctgccgccgatcgcggtcggccgactggtcctcgatcgcatgcccgacaatttcttcgccgagaccgagcaggtggcgttcatgacgcagaacgtgccgcccggcgtcgacttctccaacgacccgctgctgcagggccgcaatttttcctatctcgacacgcagatcaaacggctgggcagcaccaacttcacccacctcccgatcaacgcgccgaaatgccccttccacactttccagcaggacgggcacatggcgatgcgcaacccggtgggccgcgccaactaccagcccaattcatgggatgaaggcccgcgcgaatctccgcaaaagggcttccgatcctttgccgaagccgaagccggaccgaaggcccgcctgcgggcggaaagctttgccgatcactacagccaggcacgccaattctacatcagccagcaccccgtggaacaaggccacatcgcctcggcgctgaccttcgaactgagcaaggtgcacaccccggtcatccgcgagcgcatcgtatcccacctcctcaatatcgatgatgcgttggctcgcaaggtggcggatgcgctgggcctgaaggcgatgccgaagcccgccgatgcgggggcgccgacgcgcaccgaccttcccgcgtccgacgcgctcagcatcctcaagaacggccccggccgcttcgagggacgcaagctcggcatcctggtgaccgacggcaccgacgcagctctgctcaatgctctgaagcaggcgctgaccaaggccggcgccaagttcgagatcatcgcgccgaaggtcggcggcgccaaggccagcgacggcagctggatggacgcgcagcagatgatcgccggcgcgccgtctgttctctacgacgccattgcgctgctggcggcaaagcctgcaatggccgggctgctgagggaatcgaccgcccgcgacttcgtcgccgacgcctttgcgcactgcaaattcatcggcttcgtcgaggcggcggcaccactgctggacaaggccggagttgtcgaggacgaggcggtgatcccgcttgcatccgccaaggatgtcgcgggcttcatcaccaggctcggcgacctgcgcctctgggcacgcgagccgaaggtgaagctgggctga

SEQ ID NO: 42746 - protein, 702 aa, Mesorhizobium loti MAFF303099
MAKQASKLAGTAATIHDQKLQRGEGGELHQTASGSTAVLTTAQGGPVSDDQNSLRIGARGPTVLEDFHFREKIFHFDHERIPERVVHARGYGAHGYFETYESLAKYTRADIFQRAGEKTPAFVRFSTVAGNKGSADLARDVRGFAVKLYTQEGNWDIVGNNMPVFFIQDAIKFPDLIHAAKAEPNSDFPQAQTAHDNFWDFISLTPESMHMIMWAMSDRAIPRSLRFMEGFGVHTFRLLNAKDESTFVKFLWKPKLGLQSVAWNEAVKINGADPDFHRRDLWDAIHAGNFPEWELQLQLFDQAFADSFDFDILDPTKLIPEEVLPPIAVGRLVLDRMPDNFFAETEQVAFMTQNVPPGVDFSNDPLLQGRNFSYLDTQIKRLGSTNFTHLPINAPKCPFHTFQQDGHMAMRNPVGRANYQPNSWDEGPRESPQKGFRSFAEAEAGPKARLRAESFADHYSQARQFYISQHPVEQGHIASALTFELSKVHTPVIRERIVSHLLNIDDALARKVADALGLKAMPKPADAGAPTRTDLPASDALSILKNGPGRFEGRKLGILVTDGTDAALLNALKQALTKAGAKFEIIAPKVGGAKASDGSWMDAQQMIAGAPSVLYDAIALLAAKPAMAGLLRESTARDFVADAFAHCKFIGFVEAAAPLLDKAGVVEDEAVIPLASAKDVAGFITRLGDLRLWAREPKVKLG

SEQ ID NO: 42747 - DNA, 1602 bp, Bacillus halodurans C-125
  CDS (1)..(1602): transl_table=11
atgaaagatcaaaatcaagatcccaataagcgatctgacaatgaaacagatgaaacgttaacgaacagacagggtcatcctgtcacgaacaaccagcatgttcgaacagtgggagatcgggggccaactactttagagaattatgattttcttgagaaaattagccattttgaccgagaacgtattccagagcgtgtcgttcatgccagaggggcgggggcacacggttattttgaaagctatggtacatatggggatgaacccatttcgaagtatactcgtgcgaaagtgttcacggaaaaaggcaagcaaacaccggtttttgttcgtttttcctcggtcattcacggtgggcattcaccagagacattacgagaccctaggggatttgcggtgaagttttataccgaagatggtaactgggatttagtagggaacaacttaaaaatcttctttatccgtgatccgttgaaatttcctgatttggttcatgcgttcaagccagatccggttacgaatgtacaagatggagaacggatctttgattttatttcacaaacaccagaggccatgcacatgatcacattcttgttctcaccgtggggcatacctgctaactatcgaatgatgcaaggatctggcgtaaacacctacaaatgggtaaatgaagaggggaatgcggttctcgttaaataccattgggaaccgaagcaaggaatcaaaaatttaacgcagaaggaagcagaggccattcaagcgaaaaactttaaccatgcaactttggatttgtacgaagcgattgaggacggagattatccagagtgggaattgtatgtgcaaattatgagtgatgatgcccatccagagcttgattttgatccgctagatcccacgaaattgtggtataaagatcaattcccatgggtacccgttggcagaatggtgttaaataaaaatcctgaaaactactttgcagaggtggaacaagccgcctttgggacgggtgtactcgtcgatggccttgatttctcagacgataagctattgcagggccgaacgttttcttattctgatacacaacggtatcgggtaggggcaaattatttacagttacctatcaatgccccaaaaaaacgggtagcaacgaatcagcgagatggacaaatggaataccatgtggacataggaccaaagcaaaacccccatgtaaactatgagccatctttattaaatgggctaaaagaagcaaagcaagatggccaggaccataccccgtatgttgaaggtgaactgcaacgggcgagcatcgataggcaaaacgattatggacaggcaggtgaaacctatcgccggttgtcagactgggagcgagatgatcttattttgaatcttgtgaacacactcgcaccttgtcatgaagatattcaaaagcaaatgattgatcactttagccaatgtgaccctgagtatggacgaagggtgaaggaagggttagagaaacaaaagggagcagatactcataggcagccacaaggcggtgcagatggggatgcggcgatgcatgcggcagaagctctgggacatccttcagatccttattaa

SEQ ID NO: 42748 - protein, 533 aa, Bacillus halodurans C-125
MKDQNQDPNKRSDNETDETLTNRQGHPVTNNQHVRTVGDRGPTTLENYDFLEKISHFDRERIPERVVHARGAGAHGYFESYGTYGDEPISKYTRAKVFTEKGKQTPVFVRFSSVIHGGHSPETLRDPRGFAVKFYTEDGNWDLVGNNLKIFFIRDPLKFPDLVHAFKPDPVTNVQDGERIFDFISQTPEAMHMITFLFSPWGIPANYRMMQGSGVNTYKWVNEEGNAVLVKYHWEPKQGIKNLTQKEAEAIQAKNFNHATLDLYEAIEDGDYPEWELYVQIMSDDAHPELDFDPLDPTKLWYKDQFPWVPVGRMVLNKNPENYFAEVEQAAFGTGVLVDGLDFSDDKLLQGRTFSYSDTQRYRVGANYLQLPINAPKKRVATNQRDGQMEYHVDIGPKQNPHVNYEPSLLNGLKEAKQDGQDHTPYVEGELQRASIDRQNDYGQAGETYRRLSDWERDDLILNLVNTLAPCHEDIQKQMIDHFSQCDPEYGRRVKEGLEKQKGADTHRQPQGGADGDAAMHAAEALGHPSDPY

SEQ ID NO: 42749 - DNA, 2136 bp, Bacillus halodurans C-125
  CDS (1)..(2136): transl_table=11
gtggacaaagaccaacaaggaaccgaatcatctgaaaataagaagaatgaacagctagaaccattcaaggtggatcacaaaaacacgaagctcacaacgaatcaaggggtgagggtatctgacacggacgattcccttaaagcaggggatcgaggccctaccttaatggaagacttccattttcgggaaaaaatgactcattttgatcatgaacggattcctgagcgtgtcgttcatgcgcgaggtttcggtgcccacggctactttcaagtgtatgagccaatgaccgaatatacgaaagcatcatttttacaggaccctaatgtaaagacaccggtgtttgtccgtttttctacagtggtcggttcgcgcgggtcagccgatacggttcgtgacgtaaggggatttgcgacgaagttttacacagaggacggaaactatgacctagtagcaaacaacatcccgatcttttttattcaggacgctattaagttcccagatgtggttcacgccttaaaacctgaaccgcacaatgaaatcccgcaagcttctgcagcgcacgacacgttctgggattttgtcgttagcaacacagaaaccgctcatatgattatgtggctcctttcagacagagcaatcccgcgcagctttcgaatgatggaagggtttggcgtcaacacgttccggttcgtgaacgaacaagggaaggcccgattcgtaaaattccattggaagccgaagctcggagttcattcgctcgtttgggatgaagcgcaaaagcttgccgggaaagatcctgacttccatcgtcgcgatttgtgggaagcgattaacatgggagaataccctgaatacgagttaggcgtgcaaatgattgaggaagaagatgagttttcgtttgatttcgatatccttgatccgacgaagttttggccagaggaaatggttccggtaaagcttatcgggaaaatgacattgaatcgaaatcaggacaatttcttcgccgaaaccgaacaagtcgcatttcatgcagggaatgtcgtcccagggattgatttcagcaatgacccgctcttacaaggtcggcttttctcttatcttgacacccaactgcttcgcttaagtggtccgaactttcacgaaatcccgatcaatcgaccaattgcccctgtcaacaacaaccagcgagatggattccatcggatgacgattgacaagggggctgttagctactcgccaaatacgcttcgcaataactcgcctgaaccagcatcggatcaagaacacggatacgttcattatatggaaaaggtcgaaggacaaaaaattcgcaggcgcagtgagagctttaacgatcatttcagccaagccactttgttttggaacagtttgtcgacagcggaaaaacaacacctgatcaaggcgttccattttgaagtcggaagtgtaaaggataaaaacctcaaacaacgtgttgttgagatgtttaatcaagtcgatggaaagttagcggcagagatcgcgaaaggaatcggtgtcaaccctccgaccacacctgggggaacgggagtaacagcgtcatctccagccgtcagtcaagaaaatacgatcaaactggcaagaacgcgaaaagtggccgttctaattgatcatggctttgctttcgacgaggtgtcacaagtggtcactgcgctacaatccgctggtctcggagtagatctcgtgagtaagcagttagggatgatttccagcgctgaaggggagcaactagaagcaaacaaaagcttcgccactaccggtgccatcatgtacgacgcactttacatcggcggtggtgcccaatccattagtagcctcaatttgtacagtgaatcgaaaacctttgttgatgaagcatttaaacatgcgaaaacaatcggagctacaaatgaaggcattgaactactaatagctgcacaagttcaaggaattacattcgcaggtcctgattcgaacgatcatgttgtgaacgacctagggattattacgattcaaacagataaagattttaaggcatttactgatgaaatgatccacgccattgcccagcaccgccattggatgcgggaatttaaggatggcaaattgtccggttaa

SEQ ID NO: 42750 - protein, 711 aa, Bacillus halodurans C-125
MDKDQQGTESSENKKNEQLEPFKVDHKNTKLTTNQGVRVSDTDDSLKAGDRGPTLMEDFHFREKMTHFDHERIPERVVHARGFGAHGYFQVYEPMTEYTKASFLQDPNVKTPVFVRFSTVVGSRGSADTVRDVRGFATKFYTEDGNYDLVANNIPIFFIQDAIKFPDVVHALKPEPHNEIPQASAAHDTFWDFVVSNTETAHMIMWLLSDRAIPRSFRMMEGFGVNTFRFVNEQGKARFVKFHWKPKLGVHSLVWDEAQKLAGKDPDFHRRDLWEAINMGEYPEYELGVQMIEEEDEFSFDFDILDPTKFWPEEMVPVKLIGKMTLNRNQDNFFAETEQVAFHAGNVVPGIDFSNDPLLQGRLFSYLDTQLLRLSGPNFHEIPINRPIAPVNNNQRDGFHRMTIDKGAVSYSPNTLRNNSPEPASDQEHGYVHYMEKVEGQKIRRRSESFNDHFSQATLFWNSLSTAEKQHLIKAFHFEVGSVKDKNLKQRVVEMFNQVDGKLAAEIAKGIGVNPPTTPGGTGVTASSPAVSQENTIKLARTRKVAVLIDHGFAFDEVSQVVTALQSAGLGVDLVSKQLGMISSAEGEQLEANKSFATTGAIMYDALYIGGGAQSISSLNLYSESKTFVDEAFKHAKTIGATNEGIELLIAAQVQGITFAGPDSNDHVVNDLGIITIQTDKDFKAFTDEMIHAIAQHRHWMREFKDGKLSG

SEQ ID NO: 42751 - DNA, 1455 bp, Pasteurella multocida subsp. multocida str. Pm70
  CDS (1)..(1455): transl_table=11
atgtctaaatgcccatttgaccatggttcaaaaaccttaacgaatgcagctggtgcacctattgttgaaaacgacaacaccatgtctgcgggtcctaaaggtccattacttttacaagatgtttggttccaagagaaattagcacactttgcacgtgagcgtattcctgagcgtgttgttcatgcaaaaggttcagcagcgtacggtacattcactgtgacacacgatatcagcaaatacaccaaagcggatttattcaatggtatcggtaaacaaacacaagtcttattacgtttctcaacagtagcgggtgagcgcggtgcggcagacgctgagcgtgatgtgcgtggtttcgcattaaaattctacactgaacaaggtaactgggacttagtgggtaacaacacacccgtattctttatccgtgatccattgaaattcccagatttcattcatactcaaaaacgtaatccacaaactaacttgcgtgatgcaaacgcggcatgggatttctggtcacgtcatcctgaatcattacaccaaatcatgattcttttcagtgatcgtggtattccaactgacttacgtcatatgaacggttacggtagccatacatatagctttattaacgcacaaaatgagcgtttctgggtgaaattccacttcaaaacacaacaaggtcacaaattctatactaatgaagaagcggctaaagtggtgggtgaaaaccgtgagtcaagccaacaagatttatacgaagcgattgagcgtggcgaattcccacgttggaatgttcaagtgcaaatcatgccagaagcagatgcacacaaacataactatgcgtttgacttaactaaagtatggccacacaaagattatccgatgatcgaagtgggtgtattagagttaaaccaaaacccaattaactacttcgcagaagtggaacaagctgcgtttgcaccttctaacatcgtaccgggaattggtttctcaccagaccgtatgttacaaggtcgtcttttctcataccaagacgcgcaacgttatcgtttaggggttaaccatcaccaaatcccagtgaacgcaccaaaatgcccataccacaccactcaccgtgatggcgcaatgcgtgtagataacaatggtggtacacaccctaactatgcaccgaaccgttttgatacttatgtgccgactcaccaacaagagcctgcattagagttagagcgttcagcagcacactttaacttccgtgagtatgatgaagactactacacacaacctgccgcactttacaacttattcgatgtggatcaaaaagcacgtgtggcagccaacttcgcagcgggcttagcaggtgttacagaacctgcgattgttgaaagacaattagcccacttcgacaaagtaagcaaagaattagctgatgcaattcgtgcgaacttagcgaaataa

SEQ ID NO: 42752 - protein, 484 aa, Pasteurella multocida subsp. multocida str. Pm70
MSKCPFDHGSKTLTNAAGAPIVENDNTMSAGPKGPLLLQDVWFQEKLAHFARERIPERVVHAKGSAAYGTFTVTHDISKYTKADLFNGIGKQTQVLLRFSTVAGERGAADAERDVRGFALKFYTEQGNWDLVGNNTPVFFIRDPLKFPDFIHTQKRNPQTNLRDANAAWDFWSRHPESLHQIMILFSDRGIPTDLRHMNGYGSHTYSFINAQNERFWVKFHFKTQQGHKFYTNEEAAKVVGENRESSQQDLYEAIERGEFPRWNVQVQIMPEADAHKHNYAFDLTKVWPHKDYPMIEVGVLELNQNPINYFAEVEQAAFAPSNIVPGIGFSPDRMLQGRLFSYQDAQRYRLGVNHHQIPVNAPKCPYHTTHRDGAMRVDNNGGTHPNYAPNRFDTYVPTHQQEPALELERSAAHFNFREYDEDYYTQPAALYNLFDVDQKARVAANFAAGLAGVTEPAIVERQLAHFDKVSKELADAIRANLAK

SEQ ID NO: 42753 - DNA, 1515 bp, Neisseria meningitidis MC58
  CDS (1)..(1515): transl_table=11
atgactacctccaaatgccctgtaacccatctgaccatgaacaacggcgcgcctgttgccgacaatcaaaacagcctgaccgccggtcctcgcggccctctgctggcgcaggatttgtggctgaatgaaaaactcgccgacttcgtgcgcgaagtcatccccgaacgccgtatgcacgccaaaggttcgggcgcgttcggtacgtttaccgtaacgcacgacatcaccaaatacacccgcgccaaaatcttcagcgaagtcggcaaaaaaaccgagatgttcgcccgtttcaccaccgtggcaggcgaacgcggcgcagccgatgcagaacgcgacatccgcggttttgccttgaaattttataccgaagaaggcaactgggatgtggtcggcaacaacacgcccgtgttcttcctgcgcgacccgcgtaagttccccgacctgaacaaagccgtcaaacgcgacccgcgcaccaatatgcgctctgccacaaacaactgggacttctggacgctgctgcccgaagcactgcaccaagttaccatcgtgatgagcgaccgcggcatccccgccggctaccgccatatgcacggcttcggttcgcatacctacagcttctggaacgaagcaggcgagcgtttttgggtgaaattccatttccgcacccaacaaggcattaaaaacctgaccaacgaagaagccgccaaaatcatcgccgacgaccgcgaaagccatcagcgcgacttatacgaagccatcgaacgcggcgagtttccgaaatggacgatgtacatccaagtcatgcctgaagcagacgcggaaaaagtaccttatcatccgtttgacttgaccaaagtttggccgaaaaaagactatccgctgattgaagtgggcgaattcgagttgaaccgcaatcccgaaaacttcttcgccgatgtggaacaatccgccttcgcaccgagcaacctcgttcccggtgtcggcgccagcccagataaaatgctgcaagcgcgtttgttcaattacgccgacgcacaacgctaccgtttgggcgtaaacttccgccaaattcccgtcaatcgtccgcgttgccctgttcacagcaaccagcgcgacgggcaaggccgcgccgacggcaactacggcagcctgccgcactacgaacccaacagcttcggccaatggcagcaacaacccgacttcgccgaaccgcctttgaaaatcaacggcgacgcggcacactgggactaccgccaagacgatgacgactatttcagccaaccgcgcgccctgttcaacctgatgaacgacgcgcagaaacaggcattgttcggcaacaccgccgccgcaatgggcgacgcgcccgacttcatcaaataccgccatatccgcaactgctaccgttgcgacccggcatacggcgaaggcgtggccaaagcccttggactgactgtcgaagatgcccaagccgcccgcgcgaccgatcccgcactgggtcaggctggtttgctgtaa

SEQ ID NO: 42754 - protein, 504 aa, Neisseria meningitidis MC58
MTTSKCPVTHLTMNNGAPVADNQNSLTAGPRGPLLAQDLWLNEKLADFVREVIPERRMHAKGSGAFGTFTVTHDITKYTRAKIFSEVGKKTEMFARFTTVAGERGAADAERDIRGFALKFYTEEGNWDVVGNNTPVFFLRDPRKFPDLNKAVKRDPRTNMRSATNNWDFWTLLPEALHQVTIVMSDRGIPAGYRHMHGFGSHTYSFWNEAGERFWVKFHFRTQQGIKNLTNEEAAKIIADDRESHQRDLYEAIERGEFPKWTMYIQVMPEADAEKVPYHPFDLTKVWPKKDYPLIEVGEFELNRNPENFFADVEQSAFAPSNLVPGVGASPDKMLQARLFNYADAQRYRLGVNFRQIPVNRPRCPVHSNQRDGQGRADGNYGSLPHYEPNSFGQWQQQPDFAEPPLKINGDAAHWDYRQDDDDYFSQPRALFNLMNDAQKQALFGNTAAAMGDAPDFIKYRHIRNCYRCDPAYGEGVAKALGLTVEDAQAARATDPALGQAGLL

SEQ ID NO: 42755 - DNA, 1425 bp, Campylobacter jejuni subsp. jejuni NCTC 11168
  CDS (1)..(1425): transl_table=11
atgaaaaaattgactaacgattttggaaacattatagctgataaccaaaattcattaagcgcaggcgcaaaaggacctttacttatgcaagattatcttttgcttgaaaaacttgctcatcaaaatagagaaagaattccagaaagaaccgttcatgctaagggaagtggagcttatggcgaaataaaaattacagcagacttaagtgcttataccaaagctaaaatttttcaaaaaggcgaagttactccattatttttacgcttttcaacagtagcaggtgaagcaggtgcagcagatgctgaacgcgatgtgagaggttttgctattaaattttacactaaagaaggaaactgggacttggtaggaaataacactccgacattcttcatccgcgatgcttataaattccctgatttcatccatactcaaaaaagagatccaagaactcatctaagaagtaataatgctgcttgggatttttggagtttatgtcctgaaagtttacatcaagtaaccattcttatgagcgatagaggaattcctgcaagttatcgtcatatgcatggatttggaagccatacttatagttttattaatgataaaaatgaaagattttgggtgaaattccattttaaaacccaacaagggattaaaaatcttaccaaccaagaagctgccgagcttatagcaaaagatagagaaagtcatcaaagagatctctataatgctatagaaaataaagattttccaaaatggaaagttcaagttcaaattcttgctgaaaaagatatagaaaaacttggatttaatccttttgatttaacaaaaatttggcctcatagttttgtacctttgatggatataggcgaaatgattctaaacaaaaatcctcaaaattattttaatgaagttgaacaagctgcctttagtccaagcaatatcgttcctggaattggctttagccctgataaaatgttgcaagctagaattttttcatatcctgatgcacaaagatatagaataggaactaattatcatcttttaccagtaaatcgtgcaaaaagcgaagtgaatacttacaatgtcgctggtgctatgaattttgatagttataaaaatgatgctgcttattatgaaccaaacagctatgataatagcccaaaagaagacaaaagctatcttgaacctgatttagtcttagaaggcgtagcacaaagatatgctccactagataatgacttttatactcaaccaagagctttatttaatcttatgaatgatgatcaaaaaactcaactttttcataatatcgccgcttctatggaaggagttgatgaaaaaattatcactagagctttaaaacattttgaaaaaatttcacctgattatgcaaaaggaattaaaaaagctttagaaaaataa

SEQ ID NO: 42756 - protein, 474 aa, Campylobacter jejuni subsp. jejuni NCTC 11168
MKKLTNDFGNIIADNQNSLSAGAKGPLLMQDYLLLEKLAHQNRERIPERTVHAKGSGAYGEIKITADLSAYTKAKIFQKGEVTPLFLRFSTVAGEAGAADAERDVRGFAIKFYTKEGNWDLVGNNTPTFFIRDAYKFPDFIHTQKRDPRTHLRSNNAAWDFWSLCPESLHQVTILMSDRGIPASYRHMHGFGSHTYSFINDKNERFWVKFHFKTQQGIKNLTNQEAAELIAKDRESHQRDLYNAIENKDFPKWKVQVQILAEKDIEKLGFNPFDLTKIWPHSFVPLMDIGEMILNKNPQNYFNEVEQAAFSPSNIVPGIGFSPDKMLQARIFSYPDAQRYRIGTNYHLLPVNRAKSEVNTYNVAGAMNFDSYKNDAAYYEPNSYDNSPKEDKSYLEPDLVLEGVAQRYAPLDNDFYTQPRALFNLMNDDQKTQLFHNIAASMEGVDEKIITRALKHFEKISPDYAKGIKKALEK

SEQ ID NO: 42757 - DNA, 2319 bp, Deinococcus radiodurans R1
  CDS (1)..(2319): transl_table=11
gtggctgactttcacttcgctcttctcaaaggaaggtggctcatggctcccaaacgtaccctctccaccccgctgtctcttgacgacgcccagaagcaggtcgacgacctgagcaaggcccaggacctcagtgccaacaccaccgaccccggcaccaccctgactgacaacatggggcacgtcgtcagcgacgaccagaactcgctgcgggcgggcgagcgcggcccgaccctgatggaagacttcctcttccgcgagaagatcacccacttcgaccacgagcgcatccccgagcgcgtggtgcacgcccgtggcgccggtgcgcacgggtacttccaactcgacaagagcctggaaaagtacacccatgccaaggtgctgaccgaagtgggcgtcaagaccccggtgttcgcgcgcttttccacggtggccggctcgcgtggctcggcggacacggcgcgtgacgtgcgcggcttcgccgtgaagatgtacaccaaggaaggcaactgggacatcgtgggcaacaacattccggtgttcttcattcaggacgctatcaagttccctgacctgatccactcggtcaagcccgagccgcacaacgagattcctcaggcggcctcggcgcacgacaccttctacgacttcatcgccgagacgcccgaagcgatgcacatgctgatgtggattcactccgaccgcgccattccccgcgcctacaacatgatggaaggcttcggcgtgcacaccttccgtctggtcaacgcccagggcaaggctcacctcgtcaagttccactggaagccggtgctcggcgtcaagagcctggtgtgggacgaagcgcagaagattgccggtaaggacgccgacttccaccgccgcagcatgtgggagaccattgaccagggcggcacgctggaatgggacttcggggtgcaagtgttcaccgaagaagaggcgatgaagtgggacttcgatgtgctcgacgccaccaagatcgtgcccgaagacctcgtgccggtacagcgcgtgggcaagatggtcctcgaccgcaacgtggacaacttcttcgccgaaaccgagcaggtcgccttcatgacccagaacgtagttcctggcattgatttcaccaacgacccgctgctccagggccgcaacttctcatacctagacacccagctttcgcgcctgggcagccccaactggcaggaactgcccatcaaccgccccatcatccgcgtgagcaacaaccagcgcgacggccacatgcgccacaccatcaacaagggccgcgtggcgtacttccccaaccagatggccgccaacaagccggcccaggcgggcgcggcgggcttcgtcacctaccccgacaaggtggaaggcaccaagctgcgcgtgcgcgccgagagcttcagcgaccactacggtcaggcgcgactgttctggaactcgatgagcccggtggaaaaggagcacatcgccaagtcgctgcgcttcgagctgagcaagtgcgaaacccgcgacgtgcgtgtgcggatgctcgggcatctggcaaaaatcaacgaggtgctcgccgcgcaggtcgccaagggcctcggcgagaagttgccctccacgagcgacgccaaacccggcggccagcaggacagcgcctctgaaactgcgctgctcgctgcggccatctcgcccaccaccgcttcgggcgggctgcaaaaggccaagggcctgagccaggaagaaggccagcccaagagtgccaagggccgcaaggtggccgtgctcgtcgccgacggtgtggacgctgccggagtgaaggcgctgcaagacgccctgaagaaggccgatgtcaagtacgacatcgtggcgccccacctcggtgaaatcgcttccggcgtgatggcgacggcgaccctgtccaacaccgaccccgtggtctacgacggcgtggtcgtggcgggcggcgcggcggcggtgcgcgaactcgcgcagcaccccgaaagcttcaacttcgtggtggggtcttaccgccacgccaagcccatcggcagcctcggcgaaggcgccgaaatcgtgaccggctcgggcatcggcaacgtgctgcgccgcgtggccgccgactcccccgccaaggacggcgccacggctccggtgcagaacctctccgaagtcgcgggcgtgcgtctcgcagcgggcgaagggggcgccaagctcgccgccctcggcgtaatcgtgggccaggacaagggggccagcgccgccgccgacagcttcgtgcaggcgctcgccgagcaccgcttctggggccgtccgcagctctaa

SEQ ID NO: 42758 - protein, 772 aa, Deinococcus radiodurans R1
MADFHFALLKGRWLMAPKRTLSTPLSLDDAQKQVDDLSKAQDLSANTTDPGTTLTDNMGHVVSDDQNSLRAGERGPTLMEDFLFREKITHFDHERIPERVVHARGAGAHGYFQLDKSLEKYTHAKVLTEVGVKTPVFARFSTVAGSRGSADTARDVRGFAVKMYTKEGNWDIVGNNIPVFFIQDAIKFPDLIHSVKPEPHNEIPQAASAHDTFYDFIAETPEAMHMLMWIHSDRAIPRAYNMMEGFGVHTFRLVNAQGKAHLVKFHWKPVLGVKSLVWDEAQKIAGKDADFHRRSMWETIDQGGTLEWDFGVQVFTEEEAMKWDFDVLDATKIVPEDLVPVQRVGKMVLDRNVDNFFAETEQVAFMTQNVVPGIDFTNDPLLQGRNFSYLDTQLSRLGSPNWQELPINRPIIRVSNNQRDGHMRHTINKGRVAYFPNQMAANKPAQAGAAGFVTYPDKVEGTKLRVRAESFSDHYGQARLFWNSMSPVEKEHIAKSLRFELSKCETRDVRVRMLGHLAKINEVLAAQVAKGLGEKLPSTSDAKPGGQQDSASETALLAAAISPTTASGGLQKAKGLSQEEGQPKSAKGRKVAVLVADGVDAAGVKALQDALKKADVKYDIVAPHLGEIASGVMATATLSNTDPVVYDGVVVAGGAAAVRELAQHPESFNFVVGSYRHAKPIGSLGEGAEIVTGSGIGNVLRRVAADSPAKDGATAPVQNLSEVAGVRLAAGEGGAKLAALGVIVGQDKGASAAADSFVQALAEHRFWGRPQL

SEQ ID NO: 42759 - DNA, 2253 bp, Salmonella typhimurium LT2
  CDS (1)..(2253): transl_table=11
atgtcgcataatgagaaatccccccatcagtcccccgtgcatgatacccgtgaatcacagcccggcctggactccctggcgccgtcagacggttcacatcgccccacgccagaaacgacgccgccgggcgcgcaaccgacggcccccggcagcttaaaagcgcccgagaccgcgaatgataagctcactgccctcgacgcctttcgtaaaggcagcgaaaattatgcgctgaccaccaatcagggcgtgcgcatcgccgacgatcaaaattctcttcgcgccggcagccgcggccctacgctgttggaagattttatcctgcgcgagaaaattacccactttgaccatgagcgcatcccggagaggatcgttcacgcccgcggatctgcagcgcacggctatttccagccatataaagacctgagcgacatcacgaaagccgcgtttctgtgcgatccacagaaaattaccccggtctttgttcgcttttcgacagtacagggcggcgcggggtctgctgataccgtacgtgatatccgcggttttgcgaccaaattttataccgaagagggaattttcgatctcgtcggtaataacacgccgatcttttttatccaggatgcgcataagtttccggattttgtgcacgccgttaagcccgaaccacattgggctattccgcaagggcagagtgcgcacgacaccttctgggactatgtttccttacagcctgagacgctgcacaacgtcatgtgggcaatgtcggatcgcggtattccacgcagttatcggacgatggaagggttcggcattcacaccttccgtctgatcaatgcacaagggaaagcgacctttgtccgtttccactggaaaccgttggcaggtaaagcctcgctggtatgggatgagtcacaaaaactgaccggtcgcgatccggattttcaccgccgggatctgtgggaggccatcgaagcgggcgatttcccggaatacgagctgggcctacaactcattgccgaagaggatgaatttaaattcgattttgatctgctcgatccgaccaaactgattccggaagagttggtgccagtacaacgcgtcggcaaaatggtgttaaaccgtaatccggataactttttcgctgaaaacgaacaggcggcatttcatccaggacatattgttcccggcattgattttaccaacgatccgctgttacaggggcgtctgttctcttataccgacacgcaaatcagtcgtctgggcgggccaaacttccacgaaattccgattaaccgccctacctgcccctaccataacttccagcgtgacggtatgcaccggatggatatcgacaccaatccggcgaactatgaaccaaactccattaatgacaactggccacgcgaaacgccgccagcgccaaaacgcggcggcttcgaatcataccaggaacgcgtggatggcaataaaatccgcgaacgcagcccctctttcggtgaatattactcgcatcctcgcctgttctggctcagtcagacgccgatagaacagcagcatattattgacgcgttcagctttgaactgggtaaagtcgcccgcgcgtatattcgggagcgggtggtcgatcagttagcgcatattgatgtcacgctggctcagggcgtcgcgcataatctcggttttgcactcacccatgagcaaacgcaaattgccccgcctcctgatgtcaacggtctgaaaaaagatccggcgctcagcctgtatgcggtgccggacggcgatgttaaaggccgagtggtcgctattctgctgaacgacaaagttaacgccgccgaactgttgaccattttgcaggctttaaaagccaaaggcgtccacgcaaaactgctctattcacggatgggtgaagtaacggctgatgatggttcaacattaacgattgcggcaacctttgccggcgcgccgtcgctaacggtcgatgcggtaatagtaccgtgcggcaatattgccgatatcgagagttgcggcgatgcccgttactaccttctggaagcctacaaacatctgaagcccatcgcactggcaggcgacgcccgacggtttaaggcgcttttaaacattgatagccagggggaagaaggacttgttgaggcagataacgttgaccaccactttatggacactctgctgacgctgatggcggcacaccgtgtctggtcgcgtgcggggaaaattaacgcgattcctgcataa

SEQ ID NO: 42760 - protein, 750 aa, Salmonella typhimurium LT2
MSHNEKSPHQSPVHDTRESQPGLDSLAPSDGSHRPTPETTPPGAQPTAPGSLKAPETANDKLTALDAFRKGSENYALTTNQGVRIADDQNSLRAGSRGPTLLEDFILREKITHFDHERIPERIVHARGSAAHGYFQPYKDLSDITKAAFLCDPQKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAQGKATFVRFHWKPLAGKASLVWDESQKLTGRDPDFHRRDLWEAIEAGDFPEYELGLQLIAEEDEFKFDFDLLDPTKLIPEELVPVQRVGKMVLNRNPDNFFAENEQAAFHPGHIVPGIDFTNDPLLQGRLFSYTDTQISRLGGPNFHEIPINRPTCPYHNFQRDGMHRMDIDTNPANYEPNSINDNWPRETPPAPKRGGFESYQERVDGNKIRERSPSFGEYYSHPRLFWLSQTPIEQQHIIDAFSFELGKVARAYIRERVVDQLAHIDVTLAQGVAHNLGFALTHEQTQIAPPPDVNGLKKDPALSLYAVPDGDVKGRVVAILLNDKVNAAELLTILQALKAKGVHAKLLYSRMGEVTADDGSTLTIAATFAGAPSLTVDAVIVPCGNIADIESCGDARYYLLEAYKHLKPIALAGDARRFKALLNIDSQGEEGLVEADNVDHHFMDTLLTLMAAHRVWSRAGKINAIPA

SEQ ID NO: 42761 - DNA, 1503 bp, Caenorhabditis elegans
  CDS (1)..(1503)
atgccaaacgatccatcggataatcaactgaaaacctacaaggagacgtatccaaaaccccaagtgatcacaacttcaaatggagctccgatctactcgaagaccgccgtgctcaccgccgggcggcgtggcccaatgctcatgcaagatgtagtttatatggatgagatggctcatttcgatcgtgaacgtatccccgagcgtgtcgttcatgccaagggagccggagcccatggatacttcgaggtcacccatgacatctccaagtactgtaaggccgatatcttcaacaaggtcgggaagcagaccccactgctaattagattctctacagtcggtggtgagagcggatccgccgacaccgctcgtgatccacgtggatttgcgatcaagttctacaccgaggagggaaactgggatctggttggaaataacactccgatcttcttcatccgtgaccctatccacttcccgaactttatccatacccagaagcgtaatccacagactcacctgaaggatcccaacatgatctttgacttctggcttcatagaccagaggctttgcatcaagtgatgttcctgttttccgatcgaggactcccagatgggtaccgtcatatgaatggatacggatcccatacattcaagatggttaacaaggacggaaaggctatctatgtgaaattccatttcaagccaactcaaggagtgaagaatctcaccgtggagaaggccggtcaacttgcctcttcggacccagactattccatccgtgacctgttcaatgctattgagaagggagactttccagtatggaagatgttcattcaagtgatgacattcgaacaagctgagaaatgggagttcaatccatttgatgtcactaaagtttggccacacggtgattacccactgatcgaggtcggcaagatggtgctgaacagaaatccaaggaactacttcgctgaggttgaacaatccgccttctgcccggcccacatcgtcccaggaatcgagttctcgccagacaagatgctccaaggacgtatcttctcgtacaccgacactcatttccaccgccttggaccaaactacatccagcttccagtcaactgcccgtaccgctcccgtgctcataacacccagcgtgatggtgcaatggcttatgacaatcagcaacatgctccaaacttcttcccgaacagcttcaactatggaaagactcgtccggatgtcaaggataccacattcccagccactggagatgttgatcgttatgaaagtggagatgacaacaactatgatcaaccccgtcaattctgggagaaggtgttggataccggggctcgggagagaatgtgccagaactttgcagggccgctcggggaatgtcatgatttcattattaagggaatgatcgatcacttttcaaaggttcatccagattttggagctcgtgtcaaggcactcatccagaaacaggctcgctctcatatctaa

SEQ ID NO: 42762 - protein, 500 aa, Caenorhabditis elegans [sequence omitted]

SEQ ID NO: 42763 - DNA, 2142 bp, Agrobacterium tumefaciens str. C58
  CDS (1)..(2142): transl_table=11
atggccagaaaaccaaattccacctcgtccattaccgccaccatccatgaccagcagcttatccggggagcaggtggcgagctgcaccagattgccaccggcgacgaacccgttttgacgaccgctcaaggggctccagttgcagacgaccagaattcgcttcggatcggtcctcgcgggccgctcgtggtggatgacttccattttcgcgagaagatcttccatttcgatcacgagagaattcccgagcgcgtcgtccacgcccgcggatatggcgcgcacggctatttcgagacttatgattcccttgccacccataccaaggcggatttgtttcaacgggcaggggaaagaaccccggcctttgtgcggttctcgactgttgccggcaacaagggctcggccgatctcgcacgggatgtccgcggttttgccgtgaagctctataccaaggagggcaactgggatctcgtcggaaacaacatcccggtatttttcattcaggatgcgatcaagtttccggatctcgtccatgcggccaagcaggagcccgatcgcgcctttccacaagctcaaacggcacatgacaccttctgggatttcatcagtctcacgcccgaaagcatgaacatggtgatgtggatcatgtccgaccgcaccattccgcgttccttccgcttcatggaaggcttcggtgtgcacaccttccgcttcatcaatgcgaaggagcaatcaacctttgtgaagtttcactggaagccaaaacttgggttgcagtcggtggcgtggaacgaggcggtcaagatcaatggtgccgatcccgattttcaccggcgtgatctctggaccgcaatccagtcgggaaatttcccggaatgggagttgcaggtccagctcttcgatcaggatttcgccgacagcttcgatttcgacgttcttgatcctaccaagatcattcctgaagagatattggctccgaagcctgtcggccggctcgtgctcgaccgtatgccggacaatttcttcgccgagacggaacaggtggcgttcatgacacaaaacgtcccgccaggcatcgatttcagcaatgacccactgctgcagggtagaaatttttcctatctcgatacgcagttgaagcgtcttggcggtcccaacttcacgcatttgccgatcaatgcgccaaagtgtcctttcgcgcatttccagcaggacggtcacatggcgatgcgaaatccgacaggacgggccaattatcagccgaattcattcggggaaggccagcgggaatcgccgacgcgtggtttccagcatttcgcggctgaggagcagggggtcaaggcaaggttgcggccggaaagttttgccgatcactatagtcaagcacggcagttctacatcagccagacgccacccgaacaacgtcatatcgcatcggccctgactttcgaactcagcaaggtcgaaacggtggagattcgagagaggatggtttcacatcttcttaatatcgacgaaaccctcgctacgacggtggcgcagaagctcggccttcagacaatgccggagccggcgaatacggccattcctacccgtcaggatctggagccgtcgcccgcgctcagcatcgttgaacggggtcccaaacgcttcgaaggccgaaagcttggcattctcatcacggatggcgtggacgcaaaactgctgaaggggctgacccaggcagtaacagccgaaaaagccgtcttcgagttcatcgcgcccaaggtcgggggcgtaacggcgtcgaacggcacccttatcgaggcacatcacatgattgatggaggcccttcggtgcttttcgatgcggttgctctgctgacatcggaggcggccatcgctgagctgaccgaggaggcaactgcccgggatttcgttgcagacgcgttccagcactgcaaattcatcggatacgaccggtcagcgttgccgttgctggaaattgccggaattgccgacgccatggatgaaggcgtgctgcccttgcccggcgaggaagggcttgcggccttcgtggcagaacttgggaaattgcgtgtctgggctcgggaaccctcgctgaaactcggcaaggcatccgttccagtcaacaaggaataa

SEQ ID NO: 42764 - protein, 713 aa, Agrobacterium tumefaciens str. C58
MARKPNSTSSITATIHDQQLIRGAGGELHQIATGDEPVLTTAQGAPVADDQNSLRIGPRGPLVVDDFHFREKIFHFDHERIPERVVHARGYGAHGYFETYDSLATHTKADLFQRAGERTPAFVRFSTVAGNKGSADLARDVRGFAVKLYTKEGNWDLVGNNIPVFFIQDAIKFPDLVHAAKQEPDRAFPQAQTAHDTFWDFISLTPESMNMVMWIMSDRTIPRSFRFMEGFGVHTFRFINAKEQSTFVKFHWKPKLGLQSVAWNEAVKINGADPDFHRRDLWTAIQSGNFPEWELQVQLFDQDFADSFDFDVLDPTKIIPEEILAPKPVGRLVLDRMPDNFFAETEQVAFMTQNVPPGIDFSNDPLLQGRNFSYLDTQLKRLGGPNFTHLPINAPKCPFAHFQQDGHMAMRNPTGRANYQPNSFGEGQRESPTRGFQHFAAEEQGVKARLRPESFADHYSQARQFYISQTPPEQRHIASALTFELSKVETVEIRERMVSHLLNIDETLATTVAQKLGLQTMPEPANTAIPTRQDLEPSPALSIVERGPKRFEGRKLGILITDGVDAKLLKGLTQAVTAEKAVFEFIAPKVGGVTASNGTLIEAHHMIDGGPSVLFDAVALLTSEAAIAELTEEATARDFVADAFQHCKFIGYDRSALPLLEIAGIADAMDEGVLPLPGEEGLAAFVAELGKLRVWAREPSLKLGKASVPVNKE

SEQ ID NO: 42765 - DNA, 1551 bp, Corynebacterium glutamicum ATCC 13032
  CDS (1)..(1551): transl_table=11
atgtctgagaagtcagcagcagaccagatcgtagatcgcggaatgcgtccaaagctttctggaaacactacccgccacaacggagcaccagttccatctgagaacatctccgcaaccgcaggcccacagggtccaaacgttctcaatgacattcacctcattgaaaagctcgcacactttaaccgcgagaacgttccagagcgtatccctcacgcaaagggccacggcgctttcggtgagctgcacatcaccgaggacgtatccgaatacaccaaggcagacctgttccagcctggtaaggtcaccccgctggctgttcgcttctctactgttgctggtgagcagggctccccagatacctggcgcgacgtccacggcttcgctcttcgcttctacaccgaagagggcaactacgacatcgtgggtaacaacaccccaaccttcttccttcgtgacggcatgaagttcccggacttcatccactcacagaagcgtctcaacaagaacggtctgcgcgatgcagacatgcagtgggatttctggacccgcgcacctgaatctgcacaccaggtgacctacctgatgggtgaccgcggtacccctaagacctcccgccaccaggacggcttcggctcccacaccttccagtggattaacgctgaaggtaagccagtttgggttaagtaccacttcaagacccgccagggctgggattgcttcaccgatgcagaagcagcaaaggttgcaggcgagaacgctgactaccagcgcgaagacctctacaacgctattgaaaacggcgacttcccaatctgggacgtcaaggttcagatcatgcctttcgaggatgcagagaactaccgctggaacccattcgacctgaccaagacctggtcccagaaggattacccactgatcccagtcggttacttcatcctgaaccgcaacccacgcaacttcttcgctcagatcgagcagcttgcactggatccaggcaacatcgttcctggcgtcggcctgtccccagaccgcatgctccaggcacgtatcttcgcatacgctgaccagcagcgttaccgcatcggcgctaactaccgcgacctgccagtgaaccgtccaatcaacgaggtcaacacctacagccgcgaaggttccatgcagtacatcttcgacgctgagggcgagccttcctacagccctaaccgctacgacaagggcgcaggctacctggataacggtacggattcctcctccaaccacacctcctacggccaggctgatgacatctacgtcaacccagacccacacggcaccgacctggttcgtgctgcttacgtcaagcaccaggatgatgacgacttcatccagccaggcatcctataccgcgaggtcctggatgagggcgagaaggagcgattggcagacaacatctccaacgcaatgcagggcatctctgaggcaaccgagccacgcgtctacgactactggaacaacgttgatgagaacctcggcgctcgcgtcaaggagctttacctccagaagaaggcttaa

SEQ ID NO: 42766 - protein, 516 aa, Corynebacterium glutamicum ATCC 13032
MSEKSAADQIVDRGMRPKLSGNTTRHNGAPVPSENISATAGPQGPNVLNDIHLIEKLAHFNRENVPERIPHAKGHGAFGELHITEDVSEYTKADLFQPGKVTPLAVRFSTVAGEQGSPDTWRDVHGFALRFYTEEGNYDIVGNNTPTFFLRDGMKFPDFIHSQKRLNKNGLRDADMQWDFWTRAPESAHQVTYLMGDRGTPKTSRHQDGFGSHTFQWINAEGKPVWVKYHFKTRQGWDCFTDAEAAKVAGENADYQREDLYNAIENGDFPIWDVKVQIMPFEDAENYRWNPFDLTKTWSQKDYPLIPVGYFILNRNPRNFFAQIEQLALDPGNIVPGVGLSPDRMLQARIFAYADQQRYRIGANYRDLPVNRPINEVNTYSREGSMQYIFDAEGEPSYSPNRYDKGAGYLDNGTDSSSNHTSYGQADDIYVNPDPHGTDLVRAAYVKHQDDDDFIQPGILYREVLDEGEKERLADNISNAMQGISEATEPRVYDYWNNVDENLGARVKELYLQKKA

SEQ ID NO: 42767 - DNA, 2280 bp, Streptomyces coelicolor A3(2)
  CDS (1)..(2280)
atgagcgaggccaaccccctcaagcgagtagcccgcaaggtgaccgagggcctgcacggcgaggccggcgggccgccggacgggatccccggcaggccaggccccgagtcgccctccgccgccgaacccaccgagccccgcgagccgctgcccccgaagccggaccagaccggtccggacaccgtgtccccgaccggtcagcccacgggcgccgaccaggcccgggtggcgcagtccggcagctacctgacgaacgcccaggggacccggctgtacgacaccgaccactcgctgaaggccgggccgcgcggtcccgtgctgctccaggaccaccacctgcgcgagaaggtcatgcacttcgaccacgagcgcatcccggagcgcgtggtccacgcgcggggcgcgggcgcccacggggtcttccagagctacggcacggcggcctcggtgaccaaggccgggttcctggccgcggacgtggagacgccggtgttcacccggttctccacggtggtcggctcgcgcggttcgtcggacaccgtgcgggacacccgggggttcgcgacgaagttctacaccagtgagggcgtcttcgacctggtcggcaacaacatcccggtcttcttcatccaggacgccatcaagttcccggacgtggtgcacgcggcgaagccgcacccggaccgggagatcccgcaggcgcagagcgcgcacgacaccttctgggacttcgtctcgctgcacaccgaggcgacgaaccacaccatcttcttcatgggcgaccggggtatcccgcgctcgttccggatgatggagggcttcggcgtccacaccttccggctggtgaacgcggagggcgccacgacgctggtgaagttccactggaagccgaagctgggtgtgcactccctggtgtgggacgaggcgcagctgatcaacggcgtcgacccggacttccaccgccgggacctcgcggacgcgatcgaggcgggcgcgtacccgcagtgggagctgggcatccagaccttcccggacaacccggagcagaccttcgagggcatcgacctgctggacccgaccaacttcgtgccggaggagctggcgccggtgcagccggtcgggctgctgaccctgaaccgcaacccgtccaacttcttcgccgagaccgagcaggtcgccttccacgtcggtcacctggtgcccggtatcgacgtcaccgacgacccgctgctcgcggggcggctgttctcgtacctggacacgcagatcacgcggctgggcggtcccaacttcccgcagctgccgatcaaccggccgcaggcgccggtcaacgacatgctgcgtgacggcatgcaccagagcgccgtgcaccggggcgtggcgccgtaccggcccaactccctggacggcggctgcccgttcaccgcgggcgcggacaccagcgcgttcgtcgaggccccggtgcgggtgccggaggggcgcaaggtccgcgaggcctccgagtcgttcgcggaccacttcagccagccgcgccgcttctggctgagcatgagcccggtggagcgcgagcacatcatcggcgcctacaccttcgagctgggcaagtgctacgagcaggcgatccgggagcgcacgctccaggtcctggccaacatcgaccccgagctgtgcgcgggggtcgccgagggcctcggcctgcccgccccggaaccgacggtcccgctggccgaggtcgagcccagcccggcgctgtcccaggtgggcggcgtctggccgctggacggcagggtcgtcggcatcgtgaccggcggggcggacctggagggcgtgggcgcggtacgggaggccgtgctgaacgccgggatggtgccgctggtcgtggcgccgaccggcggcaccctgggctccggcgacgccgcgctgaccgtgcagcgcagctatgtcaccgcgcggtcggtcgagttcgacgcggtgctgatcgcggggacgcccgacatgggcggcgacgcgtacacgccgcgcgactacaaggccgggccggcgcccgcggggccggggacggtcgacccgcgggtgagcctgctgctgtcggaggcgttccggcacggcaaggcgatcggcgtctgggccggtggcacgccggcgctggaggcgtcgggggtgcccgccgacgccccgggtgtgatcgtcgccgactccggcaccgccgccctggaacgggtgacggagctgatgggctcgcaccgggtgtgggaacgcttcaccacgccgcggggctga

SEQ ID NO: 42768 - protein, 759 aa, Streptomyces coelicolor A3(2)
MSEANPLKRVARKVTEGLHGEAGGPPDGIPGRPGPESPSAAEPTEPREPLPPKPDQTGPDTVSPTGQPTGADQARVAQSGSYLTNAQGTRLYDTDHSLKAGPRGPVLLQDHHLREKVMHFDHERIPERVVHARGAGAHGVFQSYGTAASVTKAGFLAADVETPVFTRFSTVVGSRGSSDTVRDTRGFATKFYTSEGVFDLVGNNIPVFFIQDAIKFPDVVHAAKPHPDREIPQAQSAHDTFWDFVSLHTEATNHTIFFMGDRGIPRSFRMMEGFGVHTFRLVNAEGATTLVKFHWKPKLGVHSLVWDEAQLINGVDPDFHRRDLADAIEAGAYPQWELGIQTFPDNPEQTFEGIDLLDPTNFVPEELAPVQPVGLLTLNRNPSNFFAETEQVAFHVGHLVPGIDVTDDPLLAGRLFSYLDTQITRLGGPNFPQLPINRPQAPVNDMLRDGMHQSAVHRGVAPYRPNSLDGGCPFTAGADTSAFVEAPVRVPEGRKVREASESFADHFSQPRRFWLSMSPVEREHIIGAYTFELGKCYEQAIRERTLQVLANIDPELCAGVAEGLGLPAPEPTVPLAEVEPSPALSQVGGVWPLDGRVVGIVTGGADLEGVGAVREAVLNAGMVPLVVAPTGGTLGSGDAALTVQRSYVTARSVEFDAVLIAGTPDMGGDAYTPRDYKAGPAPAGPGTVDPRVSLLLSEAFRHGKAIGVWAGGTPALEASGVPADAPGVIVADSGTAALERVTELMGSHRVWERFTTPRG

SEQ ID NO: 42769 - DNA, 2133 bp, Methanosarcina mazei Go1
  CDS (1)..(2133): transl_table=11
atggataaaaagatgattaacgaaaaaagcaaagaggagcagttggaaaagtttcatgaagatccggaacgtgagtttttaactacaaaccagggagtcagggtaaataatacggacatctcactcaaagcaggagaaagaggacccacccttcttgaggactttcacttcagagaaaaattaactcattttgaccatgaaagaattcctgaaagagtcgttcacgccagaggctcaggtgcacatggtttcttccaggtatatgaacccatgacagaatatacaagtgcgaaattcctgcaggaccctaataaaaaaaccccggtttttgttcgtttttctaccgttgtagggttcaggggctcggcagatactgtcagggatgtccggggttttgctgttaaattctacactgaggacggaaactatgaccttgtcggcaacaacatgcctgtttttttcattcaggatgcaataaagtttcccgacctggttcatgcgatcaagcctgagcaggataaccagattccccaggcttctgcagcgcatgatactttctgggactttgtgtcatgtcaccatgaaaatgcgcatatgatcatgtgggttctttcagaccgtgcacttccaagaagctaccggatgatggagggttttggggttaacaccttccgttttgtcaatgccgaaggtaagggcaggtttataaaattccactggaagcccatgcttggaattcattcccttgtctgggacgaaactcagaaaatagcaggaaaagaccctgattttaaccgtcgtgatctctgggatgccattgagatgggagcctatcctgagtttgagttaggggtgcagatcctggaggaagaggatgaattcaaatttgactttgatattctcgaccctacaaagttatggccggaagaggatgtaccaataaaatggatagggaaaatgaccctggaccgcaaccctgataatttctttgctgagaccgagcaggttgcgttttgccctgcgaatgtggttccgggaattgacttttccaatgaccctctcctgcagggacggcttttctcgtatcttgatacacaactgatccgccttggaggtcctaacttccaggagattccagttaatcgagcgctagcaccggtggctaacaatcagagggaaggatataaccgtatgacaataaacaagggcaaaacgagttatttcccgaatactgtaggagatggcaagccaaggccagcttctgcagaagaaggcggttatgtccattatatggaaaaagtggaaggcaagataatccgttcccgcagcgaaaagttcaaagattttttcagccaggcaaaattattctggaacagcatgtcgcaacctgaaaaagaacatattatagaggctttccatttcgaaataggaaaggtcaaggacaagaaaatcaggcaggcagttgttgatatgttcaataacgtcgatggtgacctggcagtagagattgcaaagggggtcggtgtctctgctccggcacagaaaggaggttctcctgtagctaaagaatcgccaaatttgagccaggaacgcagtgaacgtaatgtgaaaaatactatcaaaaccaggaaaatcgccatcattgtcgcggacggatatgaccacaaagacctgagccaggtaatgcaggctctggaagccggtggagcaagagccgacattatctcaaaattccagggcatgctgaagagctcggacggtcaggaaattgaagttgacaaaaattaccgcactacagaatcggttctgtatgatgctgtatacatccccggaggaaaagaaaatgtggaaaccctgaaaaagcatggggatgctatccacttcgtcaatgaagctttcaggcactgcaagcctctgggtgcaacaggcgaaggagtcgaattatttaaagctgcccatcttccggatataaaactcgcaggaaagagttctgctgataaggtggtttccgataaaggggtggtgaccgccagaaatgaaggggacagaagctcttttaatgagtcttttaccatcgcaattgcacagcaccgccactggaacagggagaaaaaggaacaggttcctgcctga

SEQ ID NO: 42770 - protein, 710 aa, Methanosarcina mazei Go1
MDKKMINEKSKEEQLEKFHEDPEREFLTTNQGVRVNNTDISLKAGERGPTLLEDFHFREKLTHFDHERIPERVVHARGSGAHGFFQVYEPMTEYTSAKFLQDPNKKTPVFVRFSTVVGFRGSADTVRDVRGFAVKFYTEDGNYDLVGNNMPVFFIQDAIKFPDLVHAIKPEQDNQIPQASAAHDTFWDFVSCHHENAHMIMWVLSDRALPRSYRMMEGFGVNTFRFVNAEGKGRFIKFHWKPMLGIHSLVWDETQKIAGKDPDFNRRDLWDAIEMGAYPEFELGVQILEEEDEFKFDFDILDPTKLWPEEDVPIKWIGKMTLDRNPDNFFAETEQVAFCPANVVPGIDFSNDPLLQGRLFSYLDTQLIRLGGPNFQEIPVNRALAPVANNQREGYNRMTINKGKTSYFPNTVGDGKPRPASAEEGGYVHYMEKVEGKIIRSRSEKFKDFFSQAKLFWNSMSQPEKEHIIEAFHFEIGKVKDKKIRQAVVDMFNNVDGDLAVEIAKGVGVSAPAQKGGSPVAKESPNLSQERSERNVKNTIKTRKIAIIVADGYDHKDLSQVMQALEAGGARADIISKFQGMLKSSDGQEIEVDKNYRTTESVLYDAVYIPGGKENVETLKKHGDAIHFVNEAFRHCKPLGATGEGVELFKAAHLPDIKLAGKSSADKVVSDKGVVTARNEGDRSSFNESFTIAIAQHRHWNREKKEQVPA

SEQ ID NO: 42771 - DNA, 1698 bp, Methanosarcina mazei Go1
  CDS (1)..(1698): transl_table=11
atgaaaggcgacaactgtaaaaatcctatggataaaaatcaattaggtgagccgcttccaagcagaaaccagacagtgggagacactcctgaattaactacagtagcaggagctcctgtggaaagcaatcaggatagcatgacaagcggtagacgcggaccccttatgcttcaggatatctggtttctggaaaaactggcacattttgacagagaagtcattcctgagcgcagaatgcatgcaaaaggctcgggagcatttgggacgtttaccgtaactcatgatataaccagttacaccaaagcagccatattttctgaaataggaaaacaaaccaaaatgtttgcacgcttttctactgtagctggtgagcgtggagcggctgatgcagagcgtgatattcgtggttttgctttgaagttttacactgaagaaggcaactgggacatggtagggaataacacgcctgtgttctttttcagagacccgttaaagtttcccgacctgaaccacgctattaaacgtgacccgcgtaccaatatgcgcagcccaaatactaactgggacttctggacatctttaccagaagctctgctacagctgactattattatgggtgaccgcggactaccttcttcattcaggcacatgcatggatttagcagtcatgcttacagtttgataaacaaaaataatgagcgtgtatgggtaaggttccacttcaggtcacagcagggtataagaaacctcacagaccaggaagctgtaatagttgtcggaatggaccgtgaaagccatcaaagagacctctacgaagccattgaaaaaggcatgttcccaaaatggaaaatgtatatccaggttatgacagaggaacaggcaaattctatgaagaataacccctttgacctgaccaaaatgtggcataaaaaggattttccactgatgcctgttggtgaatttgagttaaacaaaaatcctgaaaactactttgcagacgtggaacaggctgctttttcaccggctaacgtagtcccgggaatcagtttctccccggaccgcatgttgcaggggcgtttgttctcttatggggatgcacacaggtatagattaggtgtaaaccaccaccagatacctgtgaattctcctcagggcgttaaaaactatcacagcttccatagagatggacagatgagagttgatggcaatagaggaagccagctgcattatgaacccaatagctatggaaactggaaagaccagcctcaatatgcacttccggttgaaaaaacaggttcaacagacatcctgagatatgatttcagagaagatgacagtgattattatacccagccaggagagttattcagagctatgactcctgatcagcaacaggttctgtttgaaaataccgccagaaatatgggcgattccactctccagatcaagcacaggcatatttacaattgctatcaggcagatcctaaatatggtgaaggtgttgcaaaagcattggagattgatatctcaaccgtagatttaaatttgccagcgcgtacttcaagaaaagccaattatgaagcaaacaataaacaccctgaattaaatcaacctacaatgaaaaaagattcgggcagggaaattgatactaacggcgatccttacattgaacccgaaaacgatccctggcttttgtaa

SEQ ID NO: 42772 - protein, 565 aa, Methanosarcina mazei Go1
MKGDNCKNPMDKNQLGEPLPSRNQTVGDTPELTTVAGAPVESNQDSMTSGRRGPLMLQDIWFLEKLAHFDREVIPERRMHAKGSGAFGTFTVTHDITSYTKAAIFSEIGKQTKMFARFSTVAGERGAADAERDIRGFALKFYTEEGNWDMVGNNTPVFFFRDPLKFPDLNHAIKRDPRTNMRSPNTNWDFWTSLPEALLQLTIIMGDRGLPSSFRHMHGFSSHAYSLINKNNERVWVRFHFRSQQGIRNLTDQEAVIVVGMDRESHQRDLYEAIEKGMFPKWKMYIQVMTEEQANSMKNNPFDLTKMWHKKDFPLMPVGEFELNKNPENYFADVEQAAFSPANVVPGISFSPDRMLQGRLFSYGDAHRYRLGVNHHQIPVNSPQGVKNYHSFHRDGQMRVDGNRGSQLHYEPNSYGNWKDQPQYALPVEKTGSTDILRYDFREDDSDYYTQPGELFRAMTPDQQQVLFENTARNMGDSTLQIKHRHIYNCYQADPKYGEGVAKALEIDISTVDLNLPARTSRKANYEANNKHPELNQPTMKKDSGREIDTNGDPYIEPENDPWLL

SEQ ID NO: 42773 - DNA, 2106 bp, Xanthomonas campestris pv. campestris str. ATCC 33913
  CDS (1)..(2106): transl_table=11
atggccaagtcccccagcaagcccgcacagattccttctgtcggcagttccgcaagcgcgcatgagttgcgcggcaccggcgacgaactgcaccagaaggctggcggctcgcatccgcaactgaccaccaaccagggcattcccgttggcgacaaccagaactcgctccgcgccacaccgcgcggcccgacgttgctggaagatttcatcctgcgcgaaaagatcacgcacttcgaccatgaacgcattcccgagcgcatcgtgcatgcgcgcggcagcgcggcgcacggctacttcgagctgaccaagtcgctgagccagtacaccacggccaagctgctcaccgaagtgggcgaaaaaaccccgctattcacgcgtttttccaccgtggccggcggcgccggttcggtcgatacgccgcgtgacgtacgcggcttcgcggtgaagttctataccaaggaaggcaactgggatctggtcggcaacaacatcccggtgttcttcatccaggatgcaatgaaatttccagacctcatccacgcggtgaagatggaaccggaccgcggctttccgcaggccgccagcgcgcacgacacgttctgggatttcatctcgctcacccccgagtcgatgcacatgatcatgtgggcgatgagcgatcgcaccattccgcgttcgctgcgcatgatcgaaggcttcggcatccacagcttccgcctgctcaacgaaaacggcgacagtacctttgtcaaattccattggcgccccaagctgggcctgcagtccaccatctgggacgaggcagtcaaacttgccggtgccgacccggacttccagcgtcgcgatctgttcgaggcgatccagaagggcgacttccccgagtgggaattgggcgtgcagctgtttaccgaagccgaggccgaagcattcccgttcgaccacctggattcgaccaaggtcattccggaagagctggtgcccttgcagatcgtcgggcgcatggtgctggaccgctggccggacaacttcttcgccgaaaccgagcaggtggcctactgcccggccaacatcgtgccggggatcgacttcagcaacgacccgctgctgcagggccggctgttctcctacctggacacgcagctgagccgcctgggcgggcccaacttccatcagattccgatcaacgcgccgaagtgcccgttcgccaacaatcagcgcgatggtcacatgcagatgggcgtgccgaagggccgcgtggcgtacgaacccagctcgttgcaggccgatgcgccacgcgaagcgctgcgcggtttccccagccatgccacaccggccgaggatggcgccaagggccgcgtgcgtgcggaaagttttgccgaccattacagccaggcacgcatgttcttccgcagccagaccgcgccggagcaagcgcatcttgcatctgcactggtgtttgaactctccaaggtggaaaccgcgcacgtgcgcgaggccatcgtgggacatctgcggcatatcgatgaagcgctggccaagcgcgtggccgatggcatgggcatgaccagcctgccgccggcaccgccggccgccgttgcaccgaccgacatgcagttgtcgcctgcgctgcagttgatcggcaagatgaaggacacgctgcagggccgcaccgtgggcatcctgatccacgacggctccgacgccgcggcaatcaaggctgtgcgcaaggcggccgaagcggccggtgcaacggtcaagatcgtggcccccaagctgggcggcgccaagctcagcgatggcaagcaactggcggccgatggccagctggccggcacgccgtcgatcgtgttcgacgcggtggcggtgttgctgtcttcggaagcggccaaggcgttgacgcgcgaatcggcggcgctggattttgtcagcaatgcctgggcgcatctgaaggcgattgctttcgacgacggcgcgcaactgctgctcaaggccggcaatgtcggcaaggaccccggcgtggtcgatgcggccgacaccaaggccttcattaccgccgccaagacccgccaatgggcacgtgagccgaaggtgcgcatgctggcgtaa

SEQ ID NO: 42774 - protein, 701 aa, Xanthomonas campestris pv. campestris str. ATCC 33913
MAKSPSKPAQIPSVGSSASAHELRGTGDELHQKAGGSHPQLTTNQGIPVGDNQNSLRATPRGPTLLEDFILREKITHFDHERIPERIVHARGSAAHGYFELTKSLSQYTTAKLLTEVGEKTPLFTRFSTVAGGAGSVDTPRDVRGFAVKFYTKEGNWDLVGNNIPVFFIQDAMKFPDLIHAVKMEPDRGFPQAASAHDTFWDFISLTPESMHMIMWAMSDRTIPRSLRMIEGFGIHSFRLLNENGDSTFVKFHWRPKLGLQSTIWDEAVKLAGADPDFQRRDLFEAIQKGDFPEWELGVQLFTEAEAEAFPFDHLDSTKVIPEELVPLQIVGRMVLDRWPDNFFAETEQVAYCPANIVPGIDFSNDPLLQGRLFSYLDTQLSRLGGPNFHQIPINAPKCPFANNQRDGHMQMGVPKGRVAYEPSSLQADAPREALRGFPSHATPAEDGAKGRVRAESFADHYSQARMFFRSQTAPEQAHLASALVFELSKVETAHVREAIVGHLRHIDEALAKRVADGMGMTSLPPAPPAAVAPTDMQLSPALQLIGKMKDTLQGRTVGILIHDGSDAAAIKAVRKAAEAAGATVKIVAPKLGGAKLSDGKQLAADGQLAGTPSIVFDAVAVLLSSEAAKALTRESAALDFVSNAWAHLKAIAFDDGAQLLLKAGNVGKDPGVVDAADTKAFITAAKTRQWAREPKVRMLA

SEQ ID NO: 42775 - DNA, 1524 bp, Xanthomonas campestris pv. campestris str. ATCC 33913
  CDS (1)..(1524): transl_table=11
atgcgccctggatccctcatggtgctagccctgctagcccccacgctgatcgccccgccggtcttcgcccaatccgtcctgacccgcgacaacggcgccaaggtcggcgacaaccagaattcgcagaccgccggtgccaccggcccgacgttgctgcaggacgtgcaactgatccagaagcttcagcgcttcgatcgcgagcgcattcccgagcgcgtggtgcatgcgcgcggcaccggcgtcaaaggcgagttcaccgccactgccgatctgtccaacctgaccaaggccaaggtgttcagcgccggcgaaaagaccccggtgttcgtgcggttctcctcggtggtgcatggcaaccattcgccggaaacgctgcgcgacccgcacggcttcgccaccaagttctacaccagcgaaggcaactgggatctggtcggcaacaacttccccaccttcttcattcgcgatgcgatcaagttccccgacatggtccacgcgttcaagccggatccgcgcaccaacctggacgatgattcgcgtcgtttcgatttcttctcgcacgtgcccgaatccacccgcacgctgaccctgctgtattccaatgaaggcaccccggccggctatcgcttcatggatggcaacggcgtgcacgcctacaagctggtcaacgcgcaaggcgaggtgcattacgtcaagttccactggaagacgctgcagggcatcaagaatctcgaccccaagcaggtcgccgcggtgcaggccaaggactacagccatctgaccaacgatctagtcggtgcgatcaagaagggcgactacccgaagtgggacctgtacgtgcaggtgctcaagccggacgacctggccaagtttgacttcgacccgctcgatgccaccaagatctggccggatgtgccggagcagaaggttggccagatggtgttgaacaagaacgtcgacaacttcttccaggagaccgaacaggtcgcgatggcgccggccaatctggtgccgggtatcgaaccgtcggaagaccgcctgctgcagggccgtatcttttcgtacgccgacacgcagctgtaccgcatcggtaccaatggcctgagcctgccggtcaaccgtccgcgtgtggccgtcaacaatggcaaccaggacggcgaagccaacaccgggcacaccaccagcggcgtgaactacgagccgagccgtcttgaaccgcgtccgcaggacaccgccgcccgttacagcgagctgccgttgtcgggcaccacccagcaggccaagatcaccctcgagcagaacttcaagcaggccggtgagttgtatcggtcctacagcaagaaggatcgcgccgatctggtgcagagttttggcgagtcgctggccaccaccgacaccgagagcaagcacctggtgctgtcgttcctgtacaaggccgaccccgagtacggcgcaggcgtcacccgcgtggccaagggcgatctggcacgcgtgaagcagctcgcgtcgaccctgcaggactga

SEQ ID NO: 42776 - protein, 507 aa, Xanthomonas campestris pv. campestris str. ATCC 33913
MRPGSLMVLALLAPTLIAPPVFAQSVLTRDNGAKVGDNQNSQTAGATGPTLLQDVQLIQKLQRFDRERIPERVVHARGTGVKGEFTATADLSNLTKAKVFSAGEKTPVFVRFSSVVHGNHSPETLRDPHGFATKFYTSEGNWDLVGNNFPTFFIRDAIKFPDMVHAFKPDPRTNLDDDSRRFDFFSHVPESTRTLTLLYSNEGTPAGYRFMDGNGVHAYKLVNAQGEVHYVKFHWKTLQGIKNLDPKQVAAVQAKDYSHLTNDLVGAIKKGDYPKWDLYVQVLKPDDLAKFDFDPLDATKIWPDVPEQKVGQMVLNKNVDNFFQETEQVAMAPANLVPGIEPSEDRLLQGRIFSYADTQLYRIGTNGLSLPVNRPRVAVNNGNQDGEANTGHTTSGVNYEPSRLEPRPQDTAARYSELPLSGTTQQAKITLEQNFKQAGELYRSYSKKDRADLVQSFGESLATTDTESKHLVLSFLYKADPEYGAGVTRVAKGDLARVKQLASTLQD

SEQ ID NO: 42777 - DNA, 1518 bp, Staphylococcus aureus subsp. aureus MW2
  CDS (1)..(1518): transl_table=11
atgtcacaacaagacaaaaagttaactggtgtttttgggcatccagtatcagaccgagaaaatagtatgacagcagggcctaggggacctcttttaatgcaagatatttactttttagagcaaatgtctcaatttgatagagaagtaataccagaacgtcgaatgcatgccaaaggttctggtgcatttgggacatttactgtaactaaagatataacaaaatatacgaatgctaaaatattctctgaaataggtaagcaaaccgaaatgtttgcccgtttctctactgtagcaggagaacgtggtgctgctgatgcggagcgtgacattcgaggatttgcgttaaagttctacactgaagaagggaactgggatttagtagggaataacacaccagtattcttctttagagatccaaagttatttgttagtttaaatcgtgcggtgaaacgagatcctagaacaaatatgagagatgcacaaaataactgggatttctggacgggtcttccagaagcattgcaccaagtaacgatcttaatgtcagatagagggattcctaaagatttacgtcatatgcatgggttcggttctcacacatactctatgtataatgattctggtgaacgtgtttgggttaaattccattttagaacgcaacaaggtattgaaaacttaactgatgaagaagctgctgaaattatagctacagatcgtgattcatctcaacgcgatttattcgaagccattgaaaaaggtgattatccaaaatggacaatgtatattcaagtaatgactgaggaacaagctaaaaaccataaagataatccatttgatttaacaaaagtatggtatcacgatgagtatcctctaattgaagttggagagtttgaattaaatagaaatccagataattactttatggatgttgaacaagctgcgtttgcaccaactaatattattccaggattagatttttctccagacaaaatgctgcaagggcgtttattctcatatggcgatgcgcaaagatatcgattaggagttaatcattggcagattcctgtaaaccaacctaaaggtgttggtattgaaaatatttgtccttttagtagagatggtcaaatgcgcgtagttgacaataatcaaggtggaggaacacattattatccaaataaccatggtaaatttgattctcaacctgaatataaaaagccaccattcccaactgatggatatggctatgaatataatcaacgtcaagatgatgataattattttgaacaaccaggtaaattgtttagattacaatcagaggacgctaaagaaagaatttttacaaatacagcaaatgcaatggaaggcgtaacggatgatgttaaacgacgtcatattcgtcattgttacaaagctgacccagaatatggtaaaggtgttgcaaaagcattaggtattgatataaattctattgatcttgaaactgaaaatgatgaaacatacgaaaactttgaaaaataa

SEQ ID NO: 42778 - protein, 505 aa, Staphylococcus aureus subsp. aureus MW2
MSQQDKKLTGVFGHPVSDRENSMTAGPRGPLLMQDIYFLEQMSQFDREVIPERRMHAKGSGAFGTFTVTKDITKYTNAKIFSEIGKQTEMFARFSTVAGERGAADAERDIRGFALKFYTEEGNWDLVGNNTPVFFFRDPKLFVSLNRAVKRDPRTNMRDAQNNWDFWTGLPEALHQVTILMSDRGIPKDLRHMHGFGSHTYSMYNDSGERVWVKFHFRTQQGIENLTDEEAAEIIATDRDSSQRDLFEAIEKGDYPKWTMYIQVMTEEQAKNHKDNPFDLTKVWYHDEYPLIEVGEFELNRNPDNYFMDVEQAAFAPTNIIPGLDFSPDKMLQGRLFSYGDAQRYRLGVNHWQIPVNQPKGVGIENICPFSRDGQMRVVDNNQGGGTHYYPNNHGKFDSQPEYKKPPFPTDGYGYEYNQRQDDDNYFEQPGKLFRLQSEDAKERIFTNTANAMEGVTDDVKRRHIRHCYKADPEYGKGVAKALGIDINSIDLETENDETYENFEK

SEQ ID NO: 42779 - DNA, 1443 bp, Yersinia pestis KIM
  CDS (1)..(1443): transl_table=11
atgatgagcaagaagaaaggattaaccaccgcggcaggcgctcccgttgtcgataataataatgttattacggctggccgccgtggcccgatgctactgcaagatgtttggttcctggaaaaattagcccattttgaccgtgaagtgatccctgagcgccgcatgcatgctaaaggctccggtgcatacggtacgttcaccgtgactcatgatattacccaatatactcgcgcaaaaattttctcagagatcggtaaaaaaacagacatgtttgtccgcttctccactgtggccggtgaacgcggtgctgcagatgctgaacgtgatatccgtggttttgccatgaagttttataccgaggaaggcaactgggatttggttggtaacgatacaccggtcttctatttacgtgatccactgaagttcccggacctgaaccacgtggtcaaacgcgaccctcgtaccaacctgcgtaacccggtttataaatgggatttcttctctcaactgccagaggcgctgcatcagttaaccatcgatttcagtgaccgtggcttgccaaaatcttaccgtcatatgcacggtttcggtagccatacctttagcctaatcaatgccaataatgaacgtttttgggttaaattccatttccgttgccagcaaggcattgaaaacctgatggacgatgaagccgaaaaactgattggttctgatagagaaagctcgcagcgtgatctgtatgaagcgattgagcgcggtgacttcccgcgttggaaactacagattcaggtaatgccggagcacgaagcatcacaaacaccttataacccatttgatctgactaaagtctggccgcacggtgattacccgctgatcgatgtcggctacttcgaattgaatcgcaacccggaaaactacttcgctgaagtggaacaatcctcattcaatccagctaacgttgtccctgggatcagtttctccccagaccgcatgttacaaggccgcctgttctcatacggtgatgccgcccgctatcgtttaggggttaaccatcatcagatcccggtgaacagtgctaaatgtccgttccataattatcatcgtgacggcgcaatgcgcgttgatggtaacagtggtaatggcgcaacctatgagccaaacagctttggcctgttccaagaacagcctgatttcagcgaaccgccactgacattggaaggggcggcagatcattggaatcaccgcgaagacaccgactatttctctcaaccacgggcgctgtttaacctgctcagtgaagaagagcatcaacgcatgttcacccgtattgcgggtgagttatcgcaagttcctgaagctatccaacgccgccagatagcgttgtttacgcaggttgacccggcttatggcgccggtgtgaaaaaagcacttggcctgaattaa

SEQ ID NO: 42780 - protein, 480 aa, Yersinia pestis KIM
MMSKKKGLTTAAGAPVVDNNNVITAGRRGPMLLQDVWFLEKLAHFDREVIPERRMHAKGSGAYGTFTVTHDITQYTRAKIFSEIGKKTDMFVRFSTVAGERGAADAERDIRGFAMKFYTEEGNWDLVGNDTPVFYLRDPLKFPDLNHVVKRDPRTNLRNPVYKWDFFSQLPEALHQLTIDFSDRGLPKSYRHMHGFGSHTFSLINANNERFWVKFHFRCQQGIENLMDDEAEKLIGSDRESSQRDLYEAIERGDFPRWKLQIQVMPEHEASQTPYNPFDLTKVWPHGDYPLIDVGYFELNRNPENYFAEVEQSSFNPANVVPGISFSPDRMLQGRLFSYGDAARYRLGVNHHQIPVNSAKCPFHNYHRDGAMRVDGNSGNGATYEPNSFGLFQEQPDFSEPPLTLEGAADHWNHREDTDYFSQPRALFNLLSEEEHQRMFTRIAGELSQVPEAIQRRQIALFTQVDPAYGAGVKKALGLN

SEQ ID NO: 42781 - DNA, 1599 bp, Oceanobacillus iheyensis HTE831
  CDS (1)..(1599): transl_table=11
atggcaaaaaaagatgaatccatgaataaaagtaatctagaaaatgatatgtcacttacaaaccgtcaaggtcaccctgtaacaaacaatcaaaacatacgtacagtaagtaaccgtggtcccgctacattagaaaactatgacttcattgagaaaatcagtcattttgaccgtgagaaagtgccagaaagaatcgtacatgcacgcggagctggagcccatggatattttgaaacatacggcactgtcggaaatgatccagtatccaaatatactagagcaaaagtatttcaagataaaggtaaacaaactcctgtatttgtacgtttttcaacagtagtacatggcaatcactctccagaaacagttcgtgacccacgtgggtttgcggtgaaattttatactgaggatggaaactgggatttagtaggaaataacctcaaaatattttttattcgtgatgcaatgaaattcccagatatgattcacgccttccgtcctgatccagtaactaacatccaagattctgaaagattctttgatttttgtgcaaactctcctgaatcctttcatatggtgacctttgtatattcaccttggggaatcccagcaaattaccggatgatgcaaggttctggagtgaatacgtataagtgggttaataaagatggtgaagctgttcttgtaaagtatcactgggaacccaagcaagggattaaaaatttaactaccaaagaagctgaagaaattcaagctaccaacttcaaccatgcaacacaagatttatatgatgcaattgaaaacggagactatccagaatgggaattatttgttcaaattatgagtgatgatgaacatccagaactagactttgatccattagacgatacaaaattatggccagaggatcagttcccatggcatccagtcggtaaaatggtattaaataagaaccctgaaaattactttacagaagtagaacaagccgcatttggtactggtgttttagtggatggattagatttctctgacgataaaatgcttcaaggaagaacgttctcttattctgatactcaacgctatcgtgtaggagcaaactacctgcaagttcctgttaatgaatccaaaaaacgtgtcgcaacgaatcatgaaggtggtcagatgcgtcagaaaaatgataaagcacctagtcaaaacccacatattaactacgagccatctgtacttggcggcttagaagaaaatgaacagaccggtaaagaatacacacctcatatcgagggtaatcttgtacgtgaatccattgatcggaatgataacacgaagcaagctggacatactttccgtgaatttgaagaatgggaaaaagcagaattaatttccaatcttgtcggcgacctttctgtaagtgatcagcgaatccaagataagatgattgctttagcagaagaagctgatgatgaatatggtagacgtttacgagaaggattagaacaggcgaagaagatgggaacaccacataatcctttaggtgcaaaagatgctgaacaagcaccgaaaaaagcaatagataaaggacatgacgcagacccgtattaa

SEQ ID NO: 42782 - protein, 532 aa, Oceanobacillus iheyensis HTE831
MAKKDESMNKSNLENDMSLTNRQGHPVTNNQNIRTVSNRGPATLENYDFIEKISHFDREKVPERIVHARGAGAHGYFETYGTVGNDPVSKYTRAKVFQDKGKQTPVFVRFSTVVHGNHSPETVRDPRGFAVKFYTEDGNWDLVGNNLKIFFIRDAMKFPDMIHAFRPDPVTNIQDSERFFDFCANSPESFHMVTFVYSPWGIPANYRMMQGSGVNTYKWVNKDGEAVLVKYHWEPKQGIKNLTTKEAEEIQATNFNHATQDLYDAIENGDYPEWELFVQIMSDDEHPELDFDPLDDTKLWPEDQFPWHPVGKMVLNKNPENYFTEVEQAAFGTGVLVDGLDFSDDKMLQGRTFSYSDTQRYRVGANYLQVPVNESKKRVATNHEGGQMRQKNDKAPSQNPHINYEPSVLGGLEENEQTGKEYTPHIEGNLVRESIDRNDNTKQAGHTFREFEEWEKAELISNLVGDLSVSDQRIQDKMIALAEEADDEYGRRLREGLEQAKKMGTPHNPLGAKDAEQAPKKAIDKGHDADPY

SEQ ID NO: 42783 - DNA, 2064 bp, Oceanobacillus iheyensis HTE831
  CDS (1)..(2064): transl_table=11
atgtcagatcaagataatcaacaagaaaaacgaaaacaagatgacaataagaaaatcgatcaattaaagaaattctatcgggataatactgacaagataatgactacagatgaaggggtaaagatatccaatgatgagaatacgttaagtgcaggagacagaggtcctcaattattagaagattttatgtatcgtgaaaaactggctcacttcgatcgagaacgtatccctgaacgaaacgttcacgcacggggctatggtgcacatggagtatttgaatgttatgaatctcaatcagatttaacgaaggcacatttcttacaaaaagctgggcaacaaacacctgtatttgtccgattctcacaagtagccggttcaaaaggagccaatgaaacactacgtgacgttcggggttttgctacaaaattttatacgaatgagggaaattttgatttagttggaaataatattcctatatttttcattcaagatggtattaagtttccagacttaattcacgcactgaaacctgaaccgaacaatgaaatccctcaaggacaaacagcgcatgatacattctgggattttatcggtagtaatgaagaatcggcagctatgatgatgtggattatgtcagatcggaccatccctagaagtttccgtactatacaaggattcggagtacatacatttcggcttgttaatgcggaaggtaaatccgtcttttgtaaatttcattggcggcctgttctagggatacattcattaatttggaatgaagcgcaaaaaattggcggtgctgatcctgactttcaccgaagagacctttgggaaaatattgaacaaggattttatccagaatatgagctaggagttcaggtcatcgaggaagggcaagaatttgattttgatttcgatatactagatgcaacaaagctctggccagaagaagaagtaccattacaaatgattggaaaaatgactttaaataaaaacgtagagaatgtttttgctgagactgaacaagtcgcactacacccaggcaacattgtaccaggtattgatttcacgaatgatcctctactacaaggaaggctattctcctatacggatacgcaaatttatcgagttggtactaacttcaaacaacttcctattaatcgtcccgtatgcccttttcacaataatcatcgcgatggatctcaacgttatattattgataagggccaagtagcctaccatcagaattatttagctggtaatactccatacaccgtacctggttctcaaggtggttttgttacgtacccatctttagtagaaggattaaaagtacgaaaaactgcgcctagttttctcgatcacttctcacaagcaagactattttggaacagtatgacagatgttgaacaaagtcatatacttcaagcatttagttttgaattaggtaaagttaatgttccagaggtacgccaacgtgttgtaaatcttatcggtcatataagccgaccgctcgctactgcagtagcagaacaagttggtgtggaaccaccagataagagcataaaacaatcagatgtcactaaatcctcccctactttaagtttaatgaatacaaaattccttcctaatacattaaaagttgctattattgttggtaatggatatggtggcaacgctttagaatcattattagaatctttaaaggaagtcgaacttaaaccatatataataagcgagcgcttaggagaaataactgcagataatggtgataccttaaatgtagatgctaccttcttaacaacttcaccagttctgtacgatgggttacttgttgttggtggagatcatatcaatgatcagtttgcttatgaagctggcaactttattactgagcaatttaaccattataaaccaattggaggcatggaagaaggtgctactttaattcaacagttaggaattgctaatcgaccaggagtgttcataagtcaatcaggcagcagacaattcactagacaatttatagacggaatggcaaaacaacgattttgggatagataa

SEQ ID NO: 42784 - protein, 687 aa, Oceanobacillus iheyensis HTE831
MSDQDNQQEKRKQDDNKKIDQLKKFYRDNTDKIMTTDEGVKISNDENTLSAGDRGPQLLEDFMYREKLAHFDRERIPERNVHARGYGAHGVFECYESQSDLTKAHFLQKAGQQTPVFVRFSQVAGSKGANETLRDVRGFATKFYTNEGNFDLVGNNIPIFFIQDGIKFPDLIHALKPEPNNEIPQGQTAHDTFWDFIGSNEESAAMMMWIMSDRTIPRSFRTIQGFGVHTFRLVNAEGKSVFCKFHWRPVLGIHSLIWNEAQKIGGADPDFHRRDLWENIEQGFYPEYELGVQVIEEGQEFDFDFDILDATKLWPEEEVPLQMIGKMTLNKNVENVFAETEQVALHPGNIVPGIDFTNDPLLQGRLFSYTDTQIYRVGTNFKQLPINRPVCPFHNNHRDGSQRYIIDKGQVAYHQNYLAGNTPYTVPGSQGGFVTYPSLVEGLKVRKTAPSFLDHFSQARLFWNSMTDVEQSHILQAFSFELGKVNVPEVRQRVVNLIGHISRPLATAVAEQVGVEPPDKSIKQSDVTKSSPTLSLMNTKFLPNTLKVAIIVGNGYGGNALESLLESLKEVELKPYIISERLGEITADNGDTLNVDATFLTTSPVLYDGLLVVGGDHINDQFAYEAGNFITEQFNHYKPIGGMEEGATLIQQLGIANRPGVFISQSGSRQFTRQFIDGMAKQRFWDR

SEQ ID NO: 42785 - DNA, 2022 bp, Oceanobacillus iheyensis HTE831
  CDS (1)..(2022): transl_table=11
atgagtaatcaagaacaaaacaaaaagaatcagcagctagatcaattccgagttaatgataaagataaatctcttacaaccaatcaaggattaaaaatgaatgaagatgagttttcactaaaagcaggtgaacgtggcccgtcattattagaagactttcatctgcgagagaagatcacccactttgaccatgaacgcattccggaacgtgttgtccatgcaagaggttttgctgcccatggggaatttgaagtttatgaatcacttgccccatatacaaaagcaaatttcctaggtgaagcaggaaagaagacaccagtatttgtacgtttttctaccgtagcaggttctcgtggatcaggtgatatggcacgtgacgtcagaggttttgcaacaaaattttacacagatgaaggaaactatgacttagttggaaataacattcccgtcttctttatacaagacggcattaaatttcctgacttgatccacgcagttaaacccgaaccacataatgaaataccacaagcacaatctgctcatgatacattttgggattttgttgccaataaccaggaaactgcacatatgattatgtggcatctgtccgaccgggcaattccgcgaagctttcgaatgatggaaggctttggtgtccatacattccgttttgttaatgaggaaggacaagctttctttgtaaaattccactggaaacctgtcttaggtgtacattcggtcatttgggatgaagcattaaaattaaacggtaatgaccctgatttccaacgccgtgacctgtatgacgcgattgaaaatggtcaatatcctgagtacgagttaggattacaaattataaaagaagaagatgaatttaactttgattttgatgttctagacccaaccaagatatggccagaagaagatgtacctgtgaaaattgttggtaaaatgacattgaatcagaatatagataattattttgcagaaaccgaacaagttgcctttcatccaggtcatgtcgtaccagggattgattttacgaatgatccgttgttacaagcacgtctcttttcatatacagacacgcagctcattcgtttaggtggacctaactttcatgaaatcccaattaaccgacctgtctgcccattccataataatcaacgtgatggctatggaagacaaacgattaattctggacaagtaagctaccataaaaactccttggcagataatacaccaacacctgtaagtgaggaaaatggtggctataaacactatcaagagaaggttgaaggcaagaaagtacgagctcgcagtattagttttgaggatcacttcacacaagctgcattattctggaatagtatgagcgatgtcgagaaaaaccacatcattgatgcgtttagctttgaacttggaaagtgtaaggaagtagcgattcgcgaacaagttctcgatatgttctccaatgtcagccatgaccttgtcacaggaattgcggagaacttaggcttagcgataccaaagaaaaaagaaatcgactatacgaaatcgtcaccagccttaagccaagccaacacaaagaaaaaagcggacacgcgtaaagttggcattattgtcgctgatggattcgatgaagaattattctctcatataaaagcattaaatgaagcaaacattaatccggaaatcattagtgatcaccaaggatccatttcaagtaaagaaggaaataaaattccggtacaccatacctttaagacggcagactctgtactctttgattccatactaatcgctagtaaagaggggactaaaccattattcacaaaagaagctccaaacttcgtgaaagaagcttacatgcactataaaccaattagtgcgcttcaagatggcgcttctgtgcttcatgatttaggactaacagatgaaaaaggtgtagttaccaataatgcaagtcaatttgtagaagcagttgccgaagcgagattctggaatcgtgacgggaagtaa

SEQ ID NO: 42786 - protein, 673 aa, Oceanobacillus iheyensis HTE831
MSNQEQNKKNQQLDQFRVNDKDKSLTTNQGLKMNEDEFSLKAGERGPSLLEDFHLREKITHFDHERIPERVVHARGFAAHGEFEVYESLAPYTKANFLGEAGKKTPVFVRFSTVAGSRGSGDMARDVRGFATKFYTDEGNYDLVGNNIPVFFIQDGIKFPDLIHAVKPEPHNEIPQAQSAHDTFWDFVANNQETAHMIMWHLSDRAIPRSFRMMEGFGVHTFRFVNEEGQAFFVKFHWKPVLGVHSVIWDEALKLNGNDPDFQRRDLYDAIENGQYPEYELGLQIIKEEDEFNFDFDVLDPTKIWPEEDVPVKIVGKMTLNQNIDNYFAETEQVAFHPGHVVPGIDFTNDPLLQARLFSYTDTQLIRLGGPNFHEIPINRPVCPFHNNQRDGYGRQTINSGQVSYHKNSLADNTPTPVSEENGGYKHYQEKVEGKKVRARSISFEDHFTQAALFWNSMSDVEKNHIIDAFSFELGKCKEVAIREQVLDMFSNVSHDLVTGIAENLGLAIPKKKEIDYTKSSPALSQANTKKKADTRKVGIIVADGFDEELFSHIKALNEANINPEIISDHQGSISSKEGNKIPVHHTFKTADSVLFDSILIASKEGTKPLFTKEAPNFVKEAYMHYKPISALQDGASVLHDLGLTDEKGVVTNNASQFVEAVAEARFWNRDGK

SEQ ID NO: 42787 - DNA, 1488 bp, Leptospira interrogans serovar Lai str. 56601
  CDS (1)..(1488): transl_table=11
ttggatcttatatatcgttcaatttacaaaaggagaaaaataatgagtagaaaaacccttactacagctggaggtcatccggtttcacaaaatcaacattctttaaccgccggacctcgagggccggttttaattcaggatacacatctgatcgaaaaactagctcacttcaatcgagaaagaattccagagagagtagttcatgcaaaaggtgctggggcttatggaactctgaccattactcaagatcttacaaaatattctagagcttctatcttttccaaaaagggaaaacaaacttctctttttctacgtttttctacagtggcaggggaaaagggttctgcggatacggaaagagatccgagaggttttgcggttaaattttatacggacgaaggaatttgggatcttgtaggaaacaatactcctgtattttttgctagagatcctttgaagtttcctgattttatacattcacaaaaaagagatcctgtcaccggttataaaaacccaattcgtatgtgggactattgggctgggtctcccgaggcatttcatcaaatcaccattctttttggagatagaggaatcccggacggctatcgttttatgaacggttatggaagtcatacttttggactttggaattctaaaggagaacgtttttggactaagtttcactttaaatctatgcaaggaattaggaatctaagtatggaaaaagcatctgcgttagccggaactgatccagattacgcgactagagatttatttgaggcgattgaaagaaaggaatttccaaaatggaagttttgtgttcagatcatgcctgaaaaagaagctacaaaatataaattcaatccatttgatcttactaaggtttggtctcataaagattatcctttgatagaagtaggggttttggaattgaattctaatcctaagaattactttgaagaagtagagcaggccgcattttccccttctaatatgcctcctggaattggtgcttctccagataaaatgttacaaggaagattattcgcatatccggatgctcataggtatcgtttgggaattcaataccagcaacttcctgtaaatagacctaaaaattctgtaaacgtttatcatagagatggtcgtactcgatttcagtgtgacgggaattatgataattatgagccaaacggttttgaaggacctgtgcaggattcttcttatgcggaacctcctttgagtatttctggagatatggatcgttataattctcatataggaaatgacgattattctcaagcgggagatttatatagattgatgagtgttgaggaaagggaaagattgacttctgcgatcgcttctacgatgcataatcttcctaaacctttactagaagccaatctaaaacatttccatctttgtgatccggagtatggagagcaattggctgcaaaagtaggtcttgctctgagtcgagtttaa

SEQ ID NO: 42788 - protein, 495 aa, Leptospira interrogans serovar Lai str. 56601
MDLIYRSIYKRRKIMSRKTLTTAGGHPVSQNQHSLTAGPRGPVLIQDTHLIEKLAHFNRERIPERVVHAKGAGAYGTLTITQDLTKYSRASIFSKKGKQTSLFLRFSTVAGEKGSADTERDPRGFAVKFYTDEGIWDLVGNNTPVFFARDPLKFPDFIHSQKRDPVTGYKNPIRMWDYWAGSPEAFHQITILFGDRGIPDGYRFMNGYGSHTFGLWNSKGERFWTKFHFKSMQGIRNLSMEKASALAGTDPDYATRDLFEAIERKEFPKWKFCVQIMPEKEATKYKFNPFDLTKVWSHKDYPLIEVGVLELNSNPKNYFEEVEQAAFSPSNMPPGIGASPDKMLQGRLFAYPDAHRYRLGIQYQQLPVNRPKNSVNVYHRDGRTRFQCDGNYDNYEPNGFEGPVQDSSYAEPPLSISGDMDRYNSHIGNDDYSQAGDLYRLMSVEERERLTSAIASTMHNLPKPLLEANLKHFHLCDPEYGEQLAAKVGLALSRV

SEQ ID NO: 42789 - DNA, 1461 bp, Shewanella oneidensis MR-1
  CDS (1)..(1461): transl_table=11
atgagtcaacagtatttaaccagccagagcggttccccgattgcggatgatcaaaactcattgtcagcgggtgaacgtggtcctttactcctgcaagattggcatttaattgaaaagcttgctcattttaaccgtgagcgtattccagagcgtgtggtacatgctaaagggactggcgtatacgggactttcactctgaccaaagacttgagtgattacaccattgccgatcacttcaatggtgtgggtaagcaaactgaaacttttgtgcgtttctccaccgtaggcggtgaaatgggctctgccgatgccgagcgtgatccacgtggttttggtctgcgcttttataccgctcgcggtaatcacgacatcgtgggtaataacacgccgacattctttttgcgtgatggcattaagttcccagactttattcatacccaaaagcgtaacccattgactaaccttaaagatccacaagcgatgtgggatttttggtcgctcaaccctgaagctatgcatcaggtgactattctgatgtcagatcgtggtattccggcaaactatcgccaaatgcacggttatggttcgcataccttctctttttggaatgctaaaggtgagcgtttctgggtgaagttccacttcaaatcgcagcaaggcgtagtgaacttaagcaacgaacaagctgacaagttaaaaggcattgatcctgattcttctcagcgcgatatggtggtagctatcactgatggtaacttccctcgttggacggtgaatgtgcagatcatgcctgaggccgatgctaatacttaccatatcaatccgtttgatttaactaaggtttggccacatggcgattatccgttaattgagattggtgtattagaactgaaccgtttaccgcaaaactattttgcggaagtcgagcaagtggccttagcaccgagcaacttagtaccaggtgtgggtgcatcgcctgataagatgttacaagcgcgtttattcgcctatgctgatgcgcagcgttaccgtattggcgcgaattacaaccaattgccagtaaactgtccacatgcggctaaagccaatcatcatcaacgtgcaggcgcaatggcaggaactcaatgtccttaccatggcagtcaaacaggtggtgatgcttctgccaactatggccctaatagcacaataggcgccttggtagaaccggcaaactttgccgagccaccactgcgtttagacggagaaacggcgcgttacagccgttacaatcaggatgattacactcaagcgggtaatttgtaccgtatcttcagtgaagaggaaaaagctcgcttagtggcaaccatctcaggttcgttgcgtcaggcaagcatggatgtacagcaacgtatgctggcacatttccaaaaagctgatgctgattatggtcaacgtatcaaaatggcgctggggttataa

SEQ ID NO: 42790 - protein, 486 aa, Shewanella oneidensis MR-1
MSQQYLTSQSGSPIADDQNSLSAGERGPLLLQDWHLIEKLAHFNRERIPERVVHAKGTGVYGTFTLTKDLSDYTIADHFNGVGKQTETFVRFSTVGGEMGSADAERDPRGFGLRFYTARGNHDIVGNNTPTFFLRDGIKFPDFIHTQKRNPLTNLKDPQAMWDFWSLNPEAMHQVTILMSDRGIPANYRQMHGYGSHTFSFWNAKGERFWVKFHFKSQQGVVNLSNEQADKLKGIDPDSSQRDMVVAITDGNFPRWTVNVQIMPEADANTYHINPFDLTKVWPHGDYPLIEIGVLELNRLPQNYFAEVEQVALAPSNLVPGVGASPDKMLQARLFAYADAQRYRIGANYNQLPVNCPHAAKANHHQRAGAMAGTQCPYHGSQTGGDASANYGPNSTIGALVEPANFAEPPLRLDGETARYSRYNQDDYTQAGNLYRIFSEEEKARLVATISGSLRQASMDVQQRMLAHFQKADADYGQRIKMALGL

SEQ ID NO: 42791 - DNA, 2133 bp, Corynebacterium efficiens YS-314
  CDS (1)..(2133): transl_table=11
atgtcagcgaacccaggaatcccctcctccggaaccccggaggtcaacgagccgaccaccccggtcccgccactgccccgcaagcccgatcaggccacggcggagccctattcccccaccggctgcccgatgcatatcagccccgatgtcaatgcgcagcagggtgaatacctcaccaccgcgcagggcgggcgtctacgtgacaccgaccattcgctgaaagccggtgagcgtggtcccctgctcatgcaggatcaccacttccgcgagaagatcacccacttcgaccacgagcgcatcccggagcgtgtggtccacgcccgcggtgccgcggcccacggtgtgttcaaggccaatggtgccgcctcctccatctgccgcgccggtgtgttcgccgagggtaaggaaaccccggtgttcacccggttctccacggtgctgggcaaccgcggttccgccgacaccgtgcgtgacacccgtggtttcgccgtgaagttctacaccgatgagggcacctgggacctggtgggtaacaacatcccggtgttcttcatccaggacggcatcaagttccccgatgtcatccacgccgccaagccccacccggaccgcgacatcccgcaggcccagagcgcgcatgacaccttctgggattttgtcaccctgcacaccgaggccacccaccacaccatctggaacatgtcggaccgcggcatcccgcggtcctaccgcatgatggagggcttcggtgtcaacaccttccgcatgatcaacgacaagggcgagaccagcctggtgaaattccactggaagccgaaactcggtgtgcattcccaggtgtgggaggaagcccagatcaccggtggtgtggaccccgatttccaccgccgtgatctggcggatgcgattgaaagtggtgccttccccgagtgggatctgggcctgcaggtcttccccgataataaggagcagatgtttgagggcattgacctgctggatcccaccaagatcgtccccgaggaactcgccccggtgcagatcgtgggcaccatgaccctgaacaagaatgtctccaacttccatgaggagaccgagcaggtcgccttccaccccggccacctgcccccgggtatcgatgtcaccgccgatcccctgctgcagggtcgcctgttctcctacctggacacccagatcagccgtttgggtgggccgaacttcgcgcagctgccgatcaaccgtccgcatgcaccggtcaatgacatgttccgtgagggcatgcaccagcagggccagcacatcggcgttgccccctaccagccgaactcgctcgacggcggcaaccccttccccgccgagccgagcaacggggcgcttatcgacgtccccgtccccgtcgaaggcgagatcacccgcagtgcccccgccagcttcgatgaccactactcccaggcccgcctgttctacgtgagcctctcgcccatcgaacagaagcacgtggccgacgcctacactttcgaactgggcaaatgctacgagaaggccatcaaggaacgcgcagtgcacgttctgtccaacgtcgatcacgacctggccagcaccgtggccaagggcctgggtgtgcccgccccggagaagaaggacctgcccgagcccaccccgagcccggcgctgtcccaggtgggcaagacctggcccatcgacggccgccagatcggcatcctggtcaccgatgatctgcccgaggatcaggtcgccgacgtcgcctccctgtccaaggccatcgaggacgccggcatggtacccctggtgacctccacctccggtggcaccatcggcgaacccgaggaagccaccggcgtggcggtctcccgcacctacgtcaccgtgcgttccatcgaattcgatgccgccgtggtcgtggagacccccgagcagcccgaggtgagcatcctgctgtccgagatgatccgccacggcaaggccgtcgccctcgtcggcgatgccaccgcgcaggtacccgatcgcatgggtgatgcacccggcgtggtcaccgtcaacgctgccgccgacgcgctcgatgtgctgaccccgatgctcaagggccaccgcacctgggccgccaacccggcctga

SEQ ID NO: 42792 - protein, 710 aa, Corynebacterium efficiens YS-314
MSANPGIPSSGTPEVNEPTTPVPPLPRKPDQATAEPYSPTGCPMHISPDVNAQQGEYLTTAQGGRLRDTDHSLKAGERGPLLMQDHHFREKITHFDHERIPERVVHARGAAAHGVFKANGAASSICRAGVFAEGKETPVFTRFSTVLGNRGSADTVRDTRGFAVKFYTDEGTWDLVGNNIPVFFIQDGIKFPDVIHAAKPHPDRDIPQAQSAHDTFWDFVTLHTEATHHTIWNMSDRGIPRSYRMMEGFGVNTFRMINDKGETSLVKFHWKPKLGVHSQVWEEAQITGGVDPDFHRRDLADAIESGAFPEWDLGLQVFPDNKEQMFEGIDLLDPTKIVPEELAPVQIVGTMTLNKNVSNFHEETEQVAFHPGHLPPGIDVTADPLLQGRLFSYLDTQISRLGGPNFAQLPINRPHAPVNDMFREGMHQQGQHIGVAPYQPNSLDGGNPFPAEPSNGALIDVPVPVEGEITRSAPASFDDHYSQARLFYVSLSPIEQKHVADAYTFELGKCYEKAIKERAVHVLSNVDHDLASTVAKGLGVPAPEKKDLPEPTPSPALSQVGKTWPIDGRQIGILVTDDLPEDQVADVASLSKAIEDAGMVPLVTSTSGGTIGEPEEATGVAVSRTYVTVRSIEFDAAVVVETPEQPEVSILLSEMIRHGKAVALVGDATAQVPDRMGDAPGVVTVNAAADALDVLTPMLKGHRTWAANPA

SEQ ID NO: 42793 - DNA, 1602 bp, Corynebacterium efficiens YS-314
  CDS (1)..(1602): transl_table=11
atgactgagaactcagcagcagatcagatcatcgaccgtggcatgcgtccgaaggtggccggaaacaccacccgccacaacggtgcaccggttgcctccgagaacatctccgtaaccgccggcccgcagggcccgaacattctcaatgacatccacctcattgagaagctcgcacacttcaaccgtgagaacgttcctgagcgtatcccccacgccaagggtcatggcgccttcggtgagctgcacatcaccgaggatgtgtcccagtacaccaaggctgatctgttccagccgggtaaggtcaccccgatgggtgtccgtttctccaccgttgccggtgagcagggctcccctgacacctggcgcgatgtccacggtttcgcactccgcttctacacccaggagggcaactacgacatcgtcggtaacaataccccgaccttcttcgtccgcgacggcatgaagttccccgacttcatccactcccagaagcgtctgaacaagaacggcctgcgcgacgccgacatgcagtgggatttctggacccgcgcacccgaatccgcacaccaggtgacctacctgatgggtgaccgcggtaccccgaagaccacccgccacatgaacggctatggctcccacaccttccagtgggtgaacaaggacggcgaggcattctgggtcaagtaccacttcatctcccgtcagggcgtggagaacttcaccgacgccgaggcagctgagatggccggcatcaatgccgactaccaccgcgaggacctctacaacgctattgagcgtggcgactacccgatctgggacgtcaaggttcagatcatgccgttcgcagaggcagagaactaccgctggaaccccttcgacctgaccaaggtctggtccaagaaggattacccacgcattgatgtcggttacttcatcctgaaccgcaacccacgcaacttcttcgcgcagatcgagcagatcgccctggacccgggcaacatcgtcccaggtgtcggactgtccccggaccgcatgctccaggcccgtgcattcgcctacgccgaccagcagcgttaccgcatcggaccgaactaccgcgacctgccgatcaaccgtccgatcaacgaggtcaacacctacagccgcgaaggccacatgcagtacgtcttcgatgccgagggtgagccctcctacagcccgaaccgctacaccaagggtgcaggctacctggatgacggcgagacctcctcctccaaccacacctcctacggccaggcttccgacatctacgtcaacccggatccgcacggcaccgacctggtccgcgcagcctacgtcaagcaccaggatgatgacgacttcatgcaggccggcatcctctaccgcgaggtgtacaacgacgaggagaaggcacgtctcgcagacaacatctccaacgcgatgcagggcatctccgaggagaccgagccacgcgtctacgagtactggaccaacgtggacgagaacctcggcgcacgcgtcaaggagctctacctgcagaagaaggcagccggcgcagccgagcacacctcttccaccggtgacgacatcgacaagaagtag

SEQ ID NO: 42794 - protein, 533 aa, Corynebacterium efficiens YS-314
MTENSAADQIIDRGMRPKVAGNTTRHNGAPVASENISVTAGPQGPNILNDIHLIEKLAHFNRENVPERIPHAKGHGAFGELHITEDVSQYTKADLFQPGKVTPMGVRFSTVAGEQGSPDTWRDVHGFALRFYTQEGNYDIVGNNTPTFFVRDGMKFPDFIHSQKRLNKNGLRDADMQWDFWTRAPESAHQVTYLMGDRGTPKTTRHMNGYGSHTFQWVNKDGEAFWVKYHFISRQGVENFTDAEAAEMAGINADYHREDLYNAIERGDYPIWDVKVQIMPFAEAENYRWNPFDLTKVWSKKDYPRIDVGYFILNRNPRNFFAQIEQIALDPGNIVPGVGLSPDRMLQARAFAYADQQRYRIGPNYRDLPINRPINEVNTYSREGHMQYVFDAEGEPSYSPNRYTKGAGYLDDGETSSSNHTSYGQASDIYVNPDPHGTDLVRAAYVKHQDDDDFMQAGILYREVYNDEEKARLADNISNAMQGISEETEPRVYEYWTNVDENLGARVKELYLQKKAAGAAEHTSSTGDDIDKK

SEQ ID NO: 42795 - DNA, 1539 bp, Caenorhabditis elegans
  CDS (1)..(1539)
atgccaatgcttccccacatggtcaatctaacggtcaacgacacaaaacccggaccaatggctgaggatcagctgaaagcttatagagatagaaatcaggaaccccacctgctcaccacatccaatggagctccgatctactcgaagaccgccgtgctcaccgccggacgacgtggtccaatgctaatgcaggacatcgtttatatggacgagatggctcatttcgatcgtgaacgcatcccggagcgtgtcgtccatgccaaaggtggtggtgctcatggatacttcgaggtcacccatgacatcaccaagtactgtaaggccgatatgttcaacaaggtcggaaaacagacaccacttctcgttcgtttttcaacggtcgctggagaatcgggatccgctgatactgtccgcgatccacgtggattctctctcaaattctataccgaggagggtaactgggatctggttggaaataacactccgatcttcttcattcgtgacgcaatccactttccgaatttcattcatgccctgaagcgcaatccacagactcacatgagggatccgaatgcgctcttcgatttctggatgaatcgccctgaatccattcatcaggtgatgttcctctactcggatcgtggaattcctgatggattccgttttatgaatggatacggagcgcatactttcaagatggtcaacaaggagggaaatccgatttattgtaaattccatttcaagcctgctcaaggttccaagaatctcgatccaactgacgctggaaagctcgcctcttcggatccagactatgcgatccgcgacctgttcaatgccattgagtcaagaaatttcccggaatggaagatgttcattcaagtgatgacattcgaacaagctgagaaatgggagttcaatccatttgatgtcactaaagtttggccacacggtgattacccactgatcgaggtcggcaagatggtgctgaacaggaatgtgaagaattatttcgctgaggtcgaacaagccgccttctgcccggcccacatcgtcccaggaatcgagttctcgccagacaagatgctccaagggcgtatcttctcctacacggacacgcattaccatcgccttggaccaaactacattcagcttccagtcaactgcccgtaccgctcccgtgctcataccactcaacgcgatggtgcaatggcttatgaaagccagggagatgcgccgaattacttcccgaacagtttccgcggataccgtactcgtgatgatgtgaaggagtcgacatttcagacgactggagatgttgatcgttatgagactggagacgatcacaactacgagcagccacgtcagttctgggagaaagtgctcaaggaggaggagagagatcggctcgttgggaatttggctagtgatttgggtggctgtttggaggaaattcaaaatggaatggtcaaagagttcacgaaagttcatccggatttcggaaatgctcttcgccatcagctctgccagaagaagcattaa

SEQ ID NO: 42796 - protein, 512 aa, Caenorhabditis elegans
MPMLPHMVNLTVNDTKPGPMAEDQLKAYRDRNQEPHLLTTSNGAPIYSKTAVLTAGRRGPMLMQDIVYMDEMAHFDRERIPERVVHAKGGGAHGYFEVTHDITKYCKADMFNKVGKQTPLLVRFSTVAGESGSADTVRDPRGFSLKFYTEEGNWDLVGNNTPIFFIRDAIHFPNFIHALKRNPQTHMRDPNALFDFWMNRPESIHQVMFLYSDRGIPDGFRFMNGYGAHTFKMVNKEGNPIYCKFHFKPAQGSKNLDPTDAGKLASSDPDYAIRDLFNAIESRNFPEWKMFIQVMTFEQAEKWEFNPFDVTKVWPHGDYPLIEVGKMVLNRNVKNYFAEVEQAAFCPAHIVPGIEFSPDKMLQGRIFSYTDTHYHRLGPNYIQLPVNCPYRSRAHTTQRDGAMAYESQGDAPNYFPNSFRGYRTRDDVKESTFQTTGDVDRYETGDDHNYEQPRQFWEKVLKEEERDRLVGNLASDLGGCLEEIQNGMVKEFTKVHPDFGNALRHQLCQKKH

SEQ ID NO: 42797 - DNA, 1440 bp, Pseudomonas putida KT2440
  CDS (1)..(1440): transl_table=11
atgagcaagattctcaccaccgctagcggtgcacctgtagccgacaaccagaactcccgctccgccggcccgcgcggtccgctgctgctcgacgacttccacctgatcgagaagctcgcccatttcaaccgcgagaacattcctgagcgccgcgtccatgccaaaggctcgggcgcctacggtacctttaccgttactcacgatatcaccggctataccagcgccaagctgttcgaagaggtcggtaaacaaaccgagactttcttacgcttctccaccgttggtggtgagcgcggttcggctgataccgagcgtgacccgcgcggcttcgcggtgaagttctacaccgaggaaggcaactgggacattgtcggtaacaacactccagtattcttcattcgcgacccacttaagttcccggactttatccacacccagaagcgccacccgcagtccaacctgaagaatgctcagatgatgtgggacttctggtcgcactctccagaagcgctgcatcaggtcaccatcctgttttccgatcgtggcattccggacggctaccgtcacatgcatggctttggcagccacacctacagcctgatcaatgcaaagggtgagcgcacttgggtcaagtggcacttcaagacccagcaaggcatcaagaacctcaccccggcagacgctgcacgcctggcaggtaccgacccggactacgctcagcgcgacctcttcgaggccatcgagcgtggcgactacccgcgctggactgtctgcattcaggtgatgagcgaagccgaggctgccagccgcgacgagaacccattcgacgtgaccaagacctggtcgcagaaggattatccactcatcgaggtgggtgtgctggagctcaaccgtaacccgctcaactattttgcggaggtcgagcaggccgcgttcgggccgagcaatatggtgcccggcgtcggtctttcgccggaccgcatgctgcaaggccgtgtattcgcctacgccgacgcgcaccgctatcgcgtggggaccaaccaccagcaattgccagtcaacgcgccacgctgcccggtgaacagctaccagcgtgatggctcgatggccaccggcagttacggtagtgcaccgaactacgagccaaacagctacagcgatgccccgaaacagtcgccacgtcatgctgagccagcattggccatgaatggttcggctgatcgctacgatcaccgcgaggataccgactacttcagccatgccggcgctttgttccgtttgatgaacgatgagcagaaggccctgctgatcagtaacatcgccggtaccatggcgggcgtcagcgaagatgtcattcagcgtcagctacagtacttcttcaaggcggatccggcttacggcgaagggattgcaaaggctttgggcatcaatctcgcctaa

SEQ ID NO: 42798 - protein, 479 aa, Pseudomonas putida KT2440
MSKILTTASGAPVADNQNSRSAGPRGPLLLDDFHLIEKLAHFNRENIPERRVHAKGSGAYGTFTVTHDITGYTSAKLFEEVGKQTETFLRFSTVGGERGSADTERDPRGFAVKFYTEEGNWDIVGNNTPVFFIRDPLKFPDFIHTQKRHPQSNLKNAQMMWDFWSHSPEALHQVTILFSDRGIPDGYRHMHGFGSHTYSLINAKGERTWVKWHFKTQQGIKNLTPADAARLAGTDPDYAQRDLFEAIERGDYPRWTVCIQVMSEAEAASRDENPFDVTKTWSQKDYPLIEVGVLELNRNPLNYFAEVEQAAFGPSNMVPGVGLSPDRMLQGRVFAYADAHRYRVGTNHQQLPVNAPRCPVNSYQRDGSMATGSYGSAPNYEPNSYSDAPKQSPRHAEPALAMNGSADRYDHREDTDYFSHAGALFRLMNDEQKALLISNIAGTMAGVSEDVIQRQLQYFFKADPAYGEGIAKALGINLA

SEQ ID NO: 42799 - DNA, 1455 bp, Lactobacillus plantarum WCFS1
  CDS (1)..(1455): transl_table=11
atgacggaaaaattaacgacggaaaccggccaaccatgggctaacaatgaacattcccaaacggcaggagctcgtggtcccgtattaatgcaagactataatcttttggaaaaactagcccattttgatcgtgaacgaattccagaacgggtcgttcatgctaagggggccggagcaaaaggtttttttgaacttgaaaacgacatgggggaatatactaaggcagacttatttaatggtgtcggtaagaaaactcccgtaatcttaaggttctcacaagttgccggtgaaaaaggttatcctgacaccgttcgagacgtgcgcggttttgccttaaaattttatactcagcaaggcaattatgatctcgttggaaacaacacaccggtcttttttgtaaacgaccctttaaaatttcctgacttcatccattcacaaaaacgggatcctaaaacgaaccgtcgtacgcaaaatatgcaatgggatttttgggctcattctccagaatcattgcaccaggtcacttatttaatgggcgaccgaggacttcctgcgtcctatcgaaccatgaatggttacggttcccatacttttaaatgggttaatcagaatggcgaacagttttgggttaagtatcacttcatctcagaccaaggcgttaaaaatatgactgctcaagcagctgaaaaagcaatgagccaagatttagattatttacaagatgacttatatgatgcaattcaagaaaaaaattacccatcatggacgatgtatgtccaaatcttgccatatgaggaaggtctaaactataaatgggacatttttgatgtcactaaagtcatctcccacaaagactatccactaattaaagtcggcaaactaactttaaatgagaatcccactaataactttaccgatattgaagaggcggccatgtcgccagcaaattttgttcctggtatcgaaccatctcccgacaaattactacaaggtcgcctattctcctataaagatgcacagcgatatcggttaggtgccaactttgaagatttacccgtgaacaagccggttgttccagttcataattatgaacgtgatggttacatgaaaattaataatcaaggtgctgaggtcaactacgagcctaatgcactgcatgggccagaagaggtgccggatgccgcattttcacctgattctgttcgtggtgaaacacgcgcacagccttatcgctatcaagttgattacacaactcaagcaggcgacctatatcgcttaatgtcagaacccgagcaagaacgcttaattaatactatcaaagatgcgttaggccaagttactttgcctggtgtcaaagaactcgaaatcaagcaattttatgaggccgacaaaaactacggtacacgcgtggctaatgctctgggaatgaatattgctgatattatcagtgattaa

SEQ ID NO: 42800 - protein, 484 aa, Lactobacillus plantarum WCFS1
MTEKLTTETGQPWANNEHSQTAGARGPVLMQDYNLLEKLAHFDRERIPERVVHAKGAGAKGFFELENDMGEYTKADLFNGVGKKTPVILRFSQVAGEKGYPDTVRDVRGFALKFYTQQGNYDLVGNNTPVFFVNDPLKFPDFIHSQKRDPKTNRRTQNMQWDFWAHSPESLHQVTYLMGDRGLPASYRTMNGYGSHTFKWVNQNGEQFWVKYHFISDQGVKNMTAQAAEKAMSQDLDYLQDDLYDAIQEKNYPSWTMYVQILPYEEGLNYKWDIFDVTKVISHKDYPLIKVGKLTLNENPTNNFTDIEEAAMSPANFVPGIEPSPDKLLQGRLFSYKDAQRYRLGANFEDLPVNKPVVPVHNYERDGYMKINNQGAEVNYEPNALHGPEEVPDAAFSPDSVRGETRAQPYRYQVDYTTQAGDLYRLMSEPEQERLINTIKDALGQVTLPGVKELEIKQFYEADKNYGTRVANALGMNIADIISD

SEQ ID NO: 42801 - DNA, 1467 bp, Bacteroides thetaiotaomicron VPI-5482
  CDS (1)..(1467): transl_table=11
atggaagaaaaaaaactaactgccgcgaacggtcgtcccattgccgacaatcagaattcgcaaaccgcaggtcaacgcggacctgtcatgttacaagatccatggcttattgaaaaactggctcattttgaccgtgaagtgattccggaaagacgtatgcacgccaaaggttcgggagctttcggtacatttaccgtcactcacgacattacgaagtacacccgtgcagctattttcagcgaagtcggaaagcaaactgagtgtttcgtccgtttctctaccgtagccggagagcgtggggcggcagatgccgaacgtgatatccgcggttttgccatgaaattctacaccgaagagggcaactgggatttagtcggaaacaacactcctgtctttttcttacgtgatccgcttaaatttccggatttgaatcatgccatcaagcgcgacccgaaaacgaacatgcgcagccctaacagcaactgggacttctggacacttctgcccgaagcgcttcatcaggtgacaatcactatgagccctcgcggcattccttactcctatcgccatatgcacggattcggaagccacacctatagttttatcaatgcggacaaccagcgtatctgggtgaaattccacctgcgcaccttgcagggaatcaaaaacctgacagatcaggaagcggaagcgatcatcgccaaagaccgcgaatctcatcaacgcgacctttttgaaagcatcgaaaagggagattacccgaaatggttattccagattcagttaatgacggaagaggaagcagaccattaccgcatcaacccgttcgacctgaccaaagtatggccgcacaaagacttcccgctacaagacgtcggaatccttgaactgaaccgtaatccggaaaactatttcgcagaagtagaacaagctgctttcaacccgatcaataccgtagacggcatcggattctcaccggacaagatgttacagggacgtctgttctcttacggcgatgcacagcgttatcgtctcggagtgaactccgaacagattccggtgaataaaccccgttgcccgttccatgcttaccaccgtgacggagccatgcgtgtagacggcaactacggtgcaaccaaaggctacgaacccaacagctacggagaatggaaagactctcctcacatgaaagaaccgcctctcaaagcatccggcaacggagagatatacaattataatgaacgcgaatacgatgatgattactacagccagccgggcgatctgttccgactgatgccggcagacgagcagcaacttctgtttgaaaacacggcacgtgctatgggagactccgaattattcatcaaacagcgtcacacccgcaactgctacaaagcagaccccgcatacggtgccggagtcgccaaagcattgggcattgatctgcaagaagcattgaaagaataa

SEQ ID NO: 42802 - protein, 488 aa, Bacteroides thetaiotaomicron VPI-5482
MEEKKLTAANGRPIADNQNSQTAGQRGPVMLQDPWLIEKLAHFDREVIPERRMHAKGSGAFGTFTVTHDITKYTRAAIFSEVGKQTECFVRFSTVAGERGAADAERDIRGFAMKFYTEEGNWDLVGNNTPVFFLRDPLKFPDLNHAIKRDPKTNMRSPNSNWDFWTLLPEALHQVTITMSPRGIPYSYRHMHGFGSHTYSFINADNQRIWVKFHLRTLQGIKNLTDQEAEAIIAKDRESHQRDLFESIEKGDYPKWLFQIQLMTEEEADHYRINPFDLTKVWPHKDFPLQDVGILELNRNPENYFAEVEQAAFNPINTVDGIGFSPDKMLQGRLFSYGDAQRYRLGVNSEQIPVNKPRCPFHAYHRDGAMRVDGNYGATKGYEPNSYGEWKDSPHMKEPPLKASGNGEIYNYNEREYDDDYYSQPGDLFRLMPADEQQLLFENTARAMGDSELFIKQRHTRNCYKADPAYGAGVAKALGIDLQEALKE

SEQ ID NO: 42803 - DNA, 1437 bp, Enterococcus faecalis V583
  CDS (1)..(1437): transl_table=11
gtgaaaaatcaacatttaactacgtcacaaggaagtccagttggcgataatcaaaattcgctaactgcaggagaatttggtcctgtcctaatccaagacgttcatttattagaaaaattagctcattttaatcgtgagcgcgtaccagaacgggttgttcatgccaaaggtgctggtgctcatgggattttcaaggtgagccaatcaatggcacaatatactaaagccgattttttatctgaagttggcaaagaaacacctttattcgctcgtttttcaactgtagctggagagttaggttcatcagatacattgcgtgatcctcgcggttttgcgcttaaattctatacagacgaaggaaattacgacttagttggcaataatacgcccatttttttcattcgtgatgcaattaagtttccagattttattcatagccaaaaaagaaatccgcggacgcatttgaaaagtccagaagctgtttgggatttttggtctcattcaccggaaagtcttcatcaagtaacaattttaatgagtgatcgtggcattccgttgtcgttccgtcatatgcatggttttggtagccatacattcaaatgggtcaatgctgctggagaagtattttttgttaaatatcacttcaagacgaatcaaggaatcaaaaatctagagagtcaattagcagaagaaattgctgggaaaaacccagatttccatattgaagatttgcataatgcaattgaaaatcaagaatttccttcttggacattatctgtgcaaattatcccgtatgcagatgcgttaacaatgaaagaaacactttttgatgtaacaaaaacggtttctcaaaaagagtatccgctgattgaagttggcacgatgactttaaatagaaatccagagaattattttgcagaggttgaacaagtaaccttttcaccagggaatttcgttcctggtattgaagcttctccggataaattattgcaaggacgtttgttcgcttatggggacgcacatcgtcatcgcgtgggcgctaatagtcaccaattgccaatcaaccaagcaaaagcgcctgtaaataactaccaaaaagacggcaatatgcgttttaacaatggcaatagcgaaattaattatgaaccaaatagttatactgaaacaccaaaagaagatcctacagcgaaaattagttcctttgaagttgaaggaaatgttggtaattatagctataatcaagatcactttacacaagcaaacgctttgtataatttgctgccaagcgaagaaaaagaaaacttaattaacaatatagcggcatctttaggtcaagtgaaaaatcaagaaatcatcgcgcgtcaaattgatttgttcactagagtaaatccagaatatggagcacgtgtcgcacaagccatcaagcaacaagcataa

SEQ ID NO: 42804 - protein, 478 aa, Enterococcus faecalis V583
MKNQHLTTSQGSPVGDNQNSLTAGEFGPVLIQDVHLLEKLAHFNRERVPERVVHAKGAGAHGIFKVSQSMAQYTKADFLSEVGKETPLFARFSTVAGELGSSDTLRDPRGFALKFYTDEGNYDLVGNNTPIFFIRDAIKFPDFIHSQKRNPRTHLKSPEAVWDFWSHSPESLHQVTILMSDRGIPLSFRHMHGFGSHTFKWVNAAGEVFFVKYHFKTNQGIKNLESQLAEEIAGKNPDFHIEDLHNAIENQEFPSWTLSVQIIPYADALTMKETLFDVTKTVSQKEYPLIEVGTMTLNRNPENYFAEVEQVTFSPGNFVPGIEASPDKLLQGRLFAYGDAHRHRVGANSHQLPINQAKAPVNNYQKDGNMRFNNGNSEINYEPNSYTETPKEDPTAKISSFEVEGNVGNYSYNQDHFTQANALYNLLPSEEKENLINNIAASLGQVKNQEIIARQIDLFTRVNPEYGARVAQAIKQQA

SEQ ID NO: 42805 - DNA, 1986 bp, Bacillus cereus ATCC 14579
  CDS (1)..(1986): transl_table=11
atggagcaattgaagcaccatgttacggataatcaacgcaaacatgctttaacaacaaaccaaggagtaaaaatagccgaggatgaattttctttaaagatgggcttaagaggcccaaccttaatggaggatttccactttcgcgagaaaatgacccactttgatcatgaacgaattcctgaaagaattgttcatgcgcgcggagttggcgtacatggttattttcagctttatgaatcgttagaagcctatacaaaagcagatttccttactaatccttcaaagaaaacacctgtatttgtacggttctcaaccgttcaaggttctaaaggatccaacgacacagtaagagatgtacgcggattcgccacaaaattttatacagatgaaggaaactatgatttagtgggtaataatatgcccgtattctttatccaagatgctattaaatttcctgattttgtccatgcagttaaaccagaaccacataatgatattcctcaaggagctagcgctcatgataccttttgggactttgttgcgcataatcctgagtccactcatatggtcatgtggcaaatgagcgaccgagctattccgcgtagtttacgaatgatggaaggttttggagttcacacatttcgactcattaacacagcaggaaaagcccatttcgtaaagtttcactggaaacctacccttggggttcattcattagtatgggatgaagctcaaaggattgctgggaaaaatcctgattttcatcgtcaagatttatacgaagcaattgaaaaaggggattatcctgaatgggagcttggattacagttaattccagaagaagatgaacataaatttgattttgatattttagatccaacgaaattatggccagaagaagaagttcccgtaaaattagttggtaaaatgacattgaacaaaaatgttgataacttctttgctgaaacagagcaggtagcttttcaccctggtcatgtcgtaccaggtattgatttttcaaatgaccctcttctgcaaggaagattattctcctatacagatacacaattatctcgtttagggggccctaatttccatcaaatccctatcaatcaacccgtatgtccttttcataataatcaacgtgatggtatgcatcaaatgcagattcatcgcggtcagacaagctatcatcctaacggattaaataacaatcaacctgcaaccgtccaagccgaacaaggaggatatgaacattatcaagaaaagattgatgggcataaaattagaggtcgtagtaaaagctttcttaacttttattctcaggctaaacttttctacaatagtatgagccctattgaaaagcagcacataaaagaagctttttgctttgaagttgggaagtgtaaatcagacatggtgaaggcaaatgtaattgctctcctaaaccacgtcgatcgtcaattagcacaagaagtcgctaacattgttggagctcctttacctaaagaaaatcacgaagtaaattcagatgcaaaatcacctgcactaagtatgtccaatactatttttaaatctgattctaaaaatgtcgcaattctattaaatggtgacccaagcgtctcccttctgtccgaatggattcaagcttttgcacagcaccgaatgaactatagcatcatagataataaaatttatcatttcaatgattccattaaagtaactgatacttatacaacaacagactcttcgctttttgatgcagtattagtgtttagtagtgagtctgtcattcacccccctgttttagaatttacagaaactacttttaaacattttaaaccgatagctcatgtccttagtaatcctcatgctttggacaatagtaagattaaactggatggagcaggagtttataacctaacaaacacttcaattgaatcatttatagaaggtattgcccaaggaagattctggaaccgataa

SEQ ID NO: 42806 - protein, 661 aa, Bacillus cereus ATCC 14579
MEQLKHHVTDNQRKHALTTNQGVKIAEDEFSLKMGLRGPTLMEDFHFREKMTHFDHERIPERIVHARGVGVHGYFQLYESLEAYTKADFLTNPSKKTPVFVRFSTVQGSKGSNDTVRDVRGFATKFYTDEGNYDLVGNNMPVFFIQDAIKFPDFVHAVKPEPHNDIPQGASAHDTFWDFVAHNPESTHMVMWQMSDRAIPRSLRMMEGFGVHTFRLINTAGKAHFVKFHWKPTLGVHSLVWDEAQRIAGKNPDFHRQDLYEAIEKGDYPEWELGLQLIPEEDEHKFDFDILDPTKLWPEEEVPVKLVGKMTLNKNVDNFFAETEQVAFHPGHVVPGIDFSNDPLLQGRLFSYTDTQLSRLGGPNFHQIPINQPVCPFHNNQRDGMHQMQIHRGQTSYHPNGLNNNQPATVQAEQGGYEHYQEKIDGHKIRGRSKSFLNFYSQAKLFYNSMSPIEKQHIKEAFCFEVGKCKSDMVKANVIALLNHVDRQLAQEVANIVGAPLPKENHEVNSDAKSPALSMSNTIFKSDSKNVAILLNGDPSVSLLSEWIQAFAQHRMNYSIIDNKIYHFNDSIKVTDTYTTTDSSLFDAVLVFSSESVIHPPVLEFTETTFKHFKPIAHVLSNPHALDNSKIKLDGAGVYNLTNTSIESFIEGIAQGRFWNR

SEQ ID NO: 42807 - DNA, 1458 bp, Nitrosomonas europaea ATCC 19718
  CDS (1)..(1458): transl_table=11
atggatgatgccaaaaagaagctgaccaccagtgccggtgcacccgtagcggataatcagaatgtcatgactgccggtccgcgcggcccgatgttgctacaggatatctggtttctcgagaaacttgctcatttcgatcgtgaagtgatcccggagcggcggatgcacgctaagggatccggtgcctacggtacctttacagtgacgcacgatatcactcgttacacgcgggcaaatattttttctcagatcgggaaaaaaaccgacctgttcgttcgcttttccacggtggcgggagaacggggcgctgccgatgcagagcgtgacattcgcggttttgccatcaagttttatactgaagaaggtaactgggatctggttggcaacaatacgccggtattttttctgcgtgatccgctgaaatttccggatctcaatcatgccgtcaaacgcgatccacgaaccaatttgcgcagtgcgcgcaacaactgggatttctggacgctgcttcctgaagcattgcatcagattaccatcgtcatgagtgaccgcggtctgcctgcaacctatcggcacatgcacggtttcggcagccatactttcagtttcatcaatgcccgacaggaacgttactgggtgaaatttcatttcagaacacagcagggtatcaaaaacctgaccgatgccgaggcggaagcactggtcggcaaggatcgggaaagtcatcagcgtgacctgtacgaaagcattgaaaatggtgaattcccgcgctggacattatttgtgcagatcatgccggaaagcgatgcagccagtcttccctataatccgtttgacctgaccaaagtctggccgcacaaagactatccgctgatcgaagttggtgtgatggaattgaatcgcaatccggagaattactttgctgaggtcgagcaggctgcgttcaatccagccagtgtcgtgccgggaatcagtttttcaccagacaaaatgttgcaggggcgcttgttttcctatggggatgcgcagcgttaccgcctgggtgtcaatcattatcagatcccggttaacgccccccgctgccctttccatcattatcatcgtgacggcgccatgcgggttgatggcaatcagggtagtaccctgggatacgagcccaatagttaccaggaatggcagcagcagcctgaatatgcagaacctccgttaacgctggaaggcgcggctgcacattggaatcaccgagtagacgaggattactatattcagccgggtaatttattccggctcatgaattcctcgcagcaacaagtgctatttgacaataccgctcgttccattggagaggcaccacgggaaattcagattcggcatatcaccaactgtctgaaggcggatcgtgcttatggtgaaggcgttgccagggctttgggaattgcgttgagcgaagtggattaa

SEQ ID NO: 42808 - protein, 485 aa, Nitrosomonas europaea ATCC 19718
MDDAKKKLTTSAGAPVADNQNVMTAGPRGPMLLQDIWFLEKLAHFDREVIPERRMHAKGSGAYGTFTVTHDITRYTRANIFSQIGKKTDLFVRFSTVAGERGAADAERDIRGFAIKFYTEEGNWDLVGNNTPVFFLRDPLKFPDLNHAVKRDPRTNLRSARNNWDFWTLLPEALHQITIVMSDRGLPATYRHMHGFGSHTFSFINARQERYWVKFHFRTQQGIKNLTDAEAEALVGKDRESHQRDLYESIENGEFPRWTLFVQIMPESDAASLPYNPFDLTKVWPHKDYPLIEVGVMELNRNPENYFAEVEQAAFNPASVVPGISFSPDKMLQGRLFSYGDAQRYRLGVNHYQIPVNAPRCPFHHYHRDGAMRVDGNQGSTLGYEPNSYQEWQQQPEYAEPPLTLEGAAAHWNHRVDEDYYIQPGNLFRLMNSSQQQVLFDNTARSIGEAPREIQIRHITNCLKADRAYGEGVARALGIALSEVD

SEQ ID NO: 42809 - DNA, 1437 bp, Helicobacter hepaticus ATCC 51449
  CDS (1)..(1437): transl_table=11
atgtcaaagaaatttacgacagcaacaggcacaccattaggtgataatcaaaactcaattacagcaggcaaaaagggacctacacttttacaagatacttggcttttagaaaaacttgcacattttgatagagagagaatcccagagagagtggtgcacgctaaaggaagtgcagcatatggtgaattaacaattacaaatgatattactcaatacacaaaagcagaactttttaacaaagtgggcaaaaaaacaaaagcatttttgcgtttttctgtggtggcaggtgagcgaggagcagcagatgcagagcgtgatgtgcgtggttttgcactcaagctttatacaaatgaaggaaattgggatattgtaggtaataacacacctgtgttttttattaaagatgcgattaaattccctgattttattcatacacaaaaacgagaccccaaaacaaatatgaaaagccctacggcaatgtgggatttttggagtttgcacccagaatccttacatcaagtaacgattttaatgagcgataggggtattccacgaagttaccgagaaatgcacggatttggtagccacacatatagctttatcaatgccaaaaacgagcgcttttgggtgaaattccattttgtttgtttgcaaggtattcataaccttactaataaagaatcagaggcagttatcgccaaagatagagaatctcatcaaaaagatttgtttgaaaatattgaaaagggtaatttccctaaatggcgattctgtatccaagtaatgagcgaaaaagaggcggaaaactatcgttttaatccttttgatttaacaaaagtatggagtcataaagattatccgcttattgaagtggggattttagaactcaataagaatccagagaattattttgcagaagtagaacaagcagcttttaatcctgcaaatatcgtgcccggagtaggatatagccccgataaagtattgcaagggcggctttttagttatggagatacacaaagataccgcttaggcattaatcacactcaacttcctgtaaatgcacctattgtgcctgtgaataatacgcatcgtgatggttttatgcagcaaggtcagtttggcgatagacgcaattatgagccaagttattttaatgattatgttgaagataaaaacgcacttgaaccaccactttttgtgcaagagggtgatgtaatgtataaatatgaccatcgcgaatatgaagatgattattttgtgcaagcaggagatttgtatcgcttgatgactgcagagcaaaaagaagcattatgtcaaaatattaaagaatcaatggaaggtgtgccagatgaaattaaaaaacgtcagcttgagcactttaaaaaagcagataaagcgtatggcaagagagtggcagagcttttggggttataa

SEQ ID NO: 42810 - protein, 478 aa, Helicobacter hepaticus ATCC 51449
MSKKFTTATGTPLGDNQNSITAGKKGPTLLQDTWLLEKLAHFDRERIPERVVHAKGSAAYGELTITNDITQYTKAELFNKVGKKTKAFLRFSVVAGERGAADAERDVRGFALKLYTNEGNWDIVGNNTPVFFIKDAIKFPDFIHTQKRDPKTNMKSPTAMWDFWSLHPESLHQVTILMSDRGIPRSYREMHGFGSHTYSFINAKNERFWVKFHFVCLQGIHNLTNKESEAVIAKDRESHQKDLFENIEKGNFPKWRFCIQVMSEKEAENYRFNPFDLTKVWSHKDYPLIEVGILELNKNPENYFAEVEQAAFNPANIVPGVGYSPDKVLQGRLFSYGDTQRYRLGINHTQLPVNAPIVPVNNTHRDGFMQQGQFGDRRNYEPSYFNDYVEDKNALEPPLFVQEGDVMYKYDHREYEDDYFVQAGDLYRLMTAEQKEALCQNIKESMEGVPDEIKKRQLEHFKKADKAYGKRVAELLGL

SEQ ID NO: 42811 - DNA, 1482 bp, Rhodopirellula baltica SH 1
  CDS (1)..(1482): transl_table=11
atgtccgaagaatccaagtgcccgtttcaaactcagcaattcggccgggcggtcgatgacaatcagcattcgcaaaccgctggaccacgtggacctgtcttgatgcaggacgttcacctggtcgagaagatggcgcacttcaatcgggaacggattccggaacgggttgttcacgcaaagggctttggagcctttggcacgttcacggtcacgaacgacatcaccaagtactgcatggcggatttgttctcggaagttggcaagaaaacggaaacctttgcccgtttctcgaccgtcggtggcgaaagcggttcggctgacacggcccgtgacccacgtgggttttcgctgaagttttacaccgatcaaggcgtctgggatttggtcggcaacaacacgccgatcttcttcattcgcgatccgttgaagttcagcgacttcattcggactcaaaaacgcgagccgcagaatcacttgcagcctcattggcgtcgttgggacttttggggcgaggtgcccgaggctcttcatcaggtgatgttcctttacagcgatcgtggaacaccaaagagtgcacgcttcatgaacggctacggcagccacacgttcagcatgtacaacaaagacggtgtccggcactgggtgaagttccatctgaagaccgaacaaggttcagagaacttcagtgcggacgaagcgatcaaaatggcgggcgaagcgccagattactcgacgcgtgatttgtttgaagcgattgagaagggcgacttccctcgttggcgaatgcacattcaggtcatgcccgagtctgacgccgcagattacgaatggcatccattcgatttgaccaaggtatggccgcacgatgactatccgttgattgaagtcggcgtgtttgaactcaatcgcaatccgtccaactacttccaagatgtcgagcaagccgcctttgagcctggcaacttggtcgagggcatcgggatctcacccgatcgcatgttgcagaatcgcgtgctgtcttatcccgatgcacaccggtatcggttgggtgtgaactatcaccagatccctgtcaatcaaccgcgttgcccgtatgcgacttatcaccgtgacgggacgatgcgagtggacggaaacggtggtgggacggttgattatgaacccaacaagatgaacggtccgaaggagaccgggcgaacgatggagccgcccatgccagtgcacggcgatggcgatcgctacgacgagttcgcgtgcgatgacaaggactactacggccagcctcagatgttctggaacaaggtgctggacgaaggagctcgcgaacggctttgcacggcgatctccaattcgatggccgacagcccggagaacatccgcgaaaagatgttggctcagttcggcaaagtgcatccggattttgaagagggtgtgcgcagtcgcttggatgctcccaagtcacaaccgatcccgatcgcataa

SEQ ID NO: 42812 - protein, 493 aa, Rhodopirellula baltica SH 1
MSEESKCPFQTQQFGRAVDDNQHSQTAGPRGPVLMQDVHLVEKMAHFNRERIPERVVHAKGFGAFGTFTVTNDITKYCMADLFSEVGKKTETFARFSTVGGESGSADTARDPRGFSLKFYTDQGVWDLVGNNTPIFFIRDPLKFSDFIRTQKREPQNHLQPHWRRWDFWGEVPEALHQVMFLYSDRGTPKSARFMNGYGSHTFSMYNKDGVRHWVKFHLKTEQGSENFSADEAIKMAGEAPDYSTRDLFEAIEKGDFPRWRMHIQVMPESDAADYEWHPFDLTKVWPHDDYPLIEVGVFELNRNPSNYFQDVEQAAFEPGNLVEGIGISPDRMLQNRVLSYPDAHRYRLGVNYHQIPVNQPRCPYATYHRDGTMRVDGNGGGTVDYEPNKMNGPKETGRTMEPPMPVHGDGDRYDEFACDDKDYYGQPQMFWNKVLDEGARERLCTAISNSMADSPENIREKMLAQFGKVHPDFEEGVRSRLDAPKSQPIPIA

SEQ ID NO: 42813 - DNA, 1440 bp, Bordetella bronchiseptica RB50
  CDS (1)..(1440): transl_table=11
atgaccaacaagaccctcactaccgccgccggtgcgccggttgccgacaacaacaacaccatgacggcggggccgcgcggccccgccctgctgcaggacgtctggttcctggagaaactggcccacttcgaccgtgaacgcattcccgagcgcgtggtgcacgccaaaggctcgggcgcctatggcaccttcacggtcacgcatgacatttcccgctacacgcgcgccaggatcttcgccgaagtcggcaagcagacgccgttgttcctgcgcttttcgaccgtggccggcgagcgcggcgcggccgacgccgaacgtgacgtgcgtggcttcgccatcaagttctataccgacgaaggcaactgggacctggtcggcaacaacacgcccgtgttcttcattcgcgatccgctcaagttccccgacttcatccatacccagaagcgcgaccccaagaccaacctgcgcaacgccaccgccgcctgggacttctggtcgctcaacccggaatcgctgcaccaggtcaccatcctgatgagcgatcgcggactgccgcagaactatcgccagcagcacggcttcggctcgcatacctacagcttcgtcaacgacgccggcgagcgtttctacgtcaagttccacttcaagtcgcagcaaggcatcgcctgttatacggacggcgaagccgccgagctggtcggccgcgatcgcgaaagcgcgcagcgcgacctgttccagaacatcgagcagggccagttcccgcgctggacgctcaaggtgcaggtaatgcccgaagccgaggccgccacctatcacatcaacccgttcgacctgaccaaggtgtggccgcatgccgactaccccttgatcgaagtgggcgtgctggaactgaacaagaaccccgagaactatttcgccgaagtcgaacaggccgcgttcacgccggccaatgtggtgccgggcatcggcttttcgcccgacaagatgctgcagggtcgcctgttctcgtacggcgacacccatcgctaccgcctgggcatcaaccaccatcagattcccgtcaatgcgccgcgctgcccgttccacagcttccatcgcgacgggatgggccgggtcgacggcaatggcggcgccacgctgaactacgaacccaacagtttcggcgaatggcgcgaagccaagcacgcagccgaaccgccgctggcgctggacggacaggccgccgaccgctggaaccatcgggtcgacgaggactactactcgcagccgggcgcgctgttccgtctcatgaacgacgaccagaaacagcagctgttcggcaacatcggccgccacatggccggcgtgcccgaggaaatccagcgccgccagctcgagcacttccgccgtgccgacccggcctatgccgcgggcgtggccaaggccctgggcctgaagtaa

SEQ ID NO: 42814 - protein, 479 aa, Bordetella bronchiseptica RB50
MTNKTLTTAAGAPVADNNNTMTAGPRGPALLQDVWFLEKLAHFDRERIPERVVHAKGSGAYGTFTVTHDISRYTRARIFAEVGKQTPLFLRFSTVAGERGAADAERDVRGFAIKFYTDEGNWDLVGNNTPVFFIRDPLKFPDFIHTQKRDPKTNLRNATAAWDFWSLNPESLHQVTILMSDRGLPQNYRQQHGFGSHTYSFVNDAGERFYVKFHFKSQQGIACYTDGEAAELVGRDRESAQRDLFQNIEQGQFPRWTLKVQVMPEAEAATYHINPFDLTKVWPHADYPLIEVGVLELNKNPENYFAEVEQAAFTPANVVPGIGFSPDKMLQGRLFSYGDTHRYRLGINHHQIPVNAPRCPFHSFHRDGMGRVDGNGGATLNYEPNSFGEWREAKHAAEPPLALDGQAADRWNHRVDEDYYSQPGALFRLMNDDQKQQLFGNIGRHMAGVPEEIQRRQLEHFRRADPAYAAGVAKALGLK

SEQ ID NO: 42815 - DNA, 1446 bp, Chromobacterium violaceum ATCC 12472
  CDS (1)..(1446): transl_table=11
atgagaaagcacaccctcaccaccgccgccggcgcgccggtcgtcgacaaccagaacgtgcagaccgccggcccgcgcggcccgatgctgctgcaagatgtctggtatctggaaaagctggcgcatttcgaccgcgaggtgattccggagcgcaggatgcacgccaaaggctccggcgccttcggcaccttcaccgtcacccatgacatcacccgttacacccgcgccgcgctgttctccgacatcggcaaaaagaccgacctgttcctgcgcttctccaccgtcgccggcgagcgcggcgcggccgacgccgagcgcgacatccgcggcttcgccgtcaagttctacaccgaggagggcaactgggacctcgtaggcaacaacacgccggtgttcttcctgcgcgacccgctgaaattccccgacctcaaccgcgccgtgaagcgcaatccgtacaccaatatgcgcgacgccaacgccaactgggacttctggacgctgctgcccgaggcgctgcaccaggtcaccatcgtgatgagcgaccgcggcataccggccagctaccgccacatgcacggtttcggcagccacaccttcagcctgatcaacgccaagggcgagcgccactgggtcaagttccatttccacacccagcagggcatccgcaatctgagcgacgccgaggcggaaaagctggtgggccaagaccgcgaaagcgcgcagcgcgacctgctggagtgcatagaccgcggcgatttcccgcgctggaccctgtacatccaggtgatgacagaagcccaggccgacgcttgtcccttcaaccccttcgacctgaccaaggtgtggtcgcacaaggactacccgctgatcgaggtgggcgtgctggagctgaaccgcaatccgcagaactacttcgcagacgtggagcaggccgcgttcaatccggccaacgtggtgccgggcatcagcttctcgcccgaccgcatgctgcagggccgcttgttcgcctatggcgacgccgagcgctaccgcctgggcgtcaatcaccatctgattccggtgaacgcgccgcgctgccccttccacaacagctaccaccgcgacggcgcgatgcgggtggacagcaacgccggcgccaccatcggctacgagccgaacagccagggcaagtggcagcagcagccggcatacgacgagccgccgctggcgctgcagggcaacgcctatcactacgacttccgcgcggacgacgacgattactacagccagcccggcgcgctgttccggctgatgacgccggcccaacagcaagcgctgttcgacaacaccgcacgcgcgatgggcggcgtcgacgaagcgatcaagcgccgccacatcgccaactgcgccaaggccgatcccgcctatggcgcgggcgtggccaaggcattgggcctgagcgtctga

SEQ ID NO: 42816 - protein, 481 aa, Chromobacterium violaceum ATCC 12472
MRKHTLTTAAGAPVVDNQNVQTAGPRGPMLLQDVWYLEKLAHFDREVIPERRMHAKGSGAFGTFTVTHDITRYTRAALFSDIGKKTDLFLRFSTVAGERGAADAERDIRGFAVKFYTEEGNWDLVGNNTPVFFLRDPLKFPDLNRAVKRNPYTNMRDANANWDFWTLLPEALHQVTIVMSDRGIPASYRHMHGFGSHTFSLINAKGERHWVKFHFHTQQGIRNLSDAEAEKLVGQDRESAQRDLLECIDRGDFPRWTLYIQVMTEAQADACPFNPFDLTKVWSHKDYPLIEVGVLELNRNPQNYFADVEQAAFNPANVVPGISFSPDRMLQGRLFAYGDAERYRLGVNHHLIPVNAPRCPFHNSYHRDGAMRVDSNAGATIGYEPNSQGKWQQQPAYDEPPLALQGNAYHYDFRADDDDYYSQPGALFRLMTPAQQQALFDNTARAMGGVDEAIKRRHIANCAKADPAYGAGVAKALGLSV

SEQ ID NO: 42817 - DNA, 1443 bp, Photorhabdus luminescens subsp. laumondii TTO1
  CDS (1)..(1443): transl_table=11
atgaaaaagagagggcttacaacgaatgctggtacccctgtcgttgacaacaataatgtcatgactgcgggtcaacgtggtcctatgttgttacaagatgtttggttcttagaaaagcttgcccattttgatcgtgaagtgatcccagagcgccgtatgcatgccaaaggttctggagctcatggtgtctttgtggttactcacgatattactaagtacactcgcgctaagattttttctgaaataggcaaaaaaaccgagatgtttgcccgtttctcaactgtcgccggtgaacgcggcgcagcagatgctgaacgtgatattcgtggttttgcgctcaagttctatacggaagaaggaaactgggatttagtcggcaacaataccccgatattctatctccgtgatccactgaagttcccggatcttaaccatgttgttaaacgcgatccccacactaacttacgtaatcctgcctataagtgggattttttctctcatcaacctgaatcactgcaccaattaacgattgatttcagtgaccgtggtgtacctaagtctttccgccatatgcacggttttggtagccatactttcagctttatcaacgcagataatgaacgtttctgggtgaaattccatttccgttgtcagcaaggcattaaaaacctgatggacgaagaagcagaagcgctggtgggtaaagatcgtgaaagttctcaacgtgacttgtttgcagcaattgagcaaggagattatccacgctggaaattaaaagtccaaatcatgccagagaaagaagctaacttgttaccgtacaacccgtttgatttgaccaaagtctggcctcacggcgactacccaatgattgatgtcggttatttcgagctaaaccgtaatcctgataactatttctcagatgttgaacaggctgctttcaaccctgctaatgtcgtgccaggtatcagtttctcccctgataagatgttacaaggccgtctgttctcttatggtgatgctcaacgttaccgtcttggcgttaaccaccatcaaattccggtcaatacacctcgttgtccgttccataattaccaccgtgatggggcaatgcgtgtcgatggtaacagcggaaacaccgtgacttatgaaccaaacaatgcaggattgttccaggaacaacctgaattcaaacacccatcattgtctttagaaggagatgccgatcactggaaccatcgtcaagatgaagattatttcagtcaacctcgtaaactgtttatgctaataaacagtaaagagcatcaacgtatgtttgaccgtattgccagtgaactgtcacaagcacatgaagatactcaacgccgtcaggttgagctatttagaaaagttcatccagaatatggcgctggtgttgaaaatgcgctgaaaaaaatcaaagggtaa

SEQ ID NO: 42818 - protein, 480 aa, Photorhabdus luminescens subsp. laumondii TTO1
MKKRGLTTNAGTPVVDNNNVMTAGQRGPMLLQDVWFLEKLAHFDREVIPERRMHAKGSGAHGVFVVTHDITKYTRAKIFSEIGKKTEMFARFSTVAGERGAADAERDIRGFALKFYTEEGNWDLVGNNTPIFYLRDPLKFPDLNHVVKRDPHTNLRNPAYKWDFFSHQPESLHQLTIDFSDRGVPKSFRHMHGFGSHTFSFINADNERFWVKFHFRCQQGIKNLMDEEAEALVGKDRESSQRDLFAAIEQGDYPRWKLKVQIMPEKEANLLPYNPFDLTKVWPHGDYPMIDVGYFELNRNPDNYFSDVEQAAFNPANVVPGISFSPDKMLQGRLFSYGDAQRYRLGVNHHQIPVNTPRCPFHNYHRDGAMRVDGNSGNTVTYEPNNAGLFQEQPEFKHPSLSLEGDADHWNHRQDEDYFSQPRKLFMLINSKEHQRMFDRIASELSQAHEDTQRRQVELFRKVHPEYGAGVENALKKIKG

SEQ ID NO: 42819 - DNA, 1539 bp, Corynebacterium diphtheriae NCTC 13129
  CDS (1)..(1539): transl_table=11
gtgaccagcccagtcgatccaatcctgaacaagggcgagcgcaccgaagcagctcctcacaccacccgcgccggcgggcagcccgtcgccagcgaaaacatctccatcaccgcaggcccacaaggcgccaacgtactcaacgacctgcacctgatcgaaaaactcgcacactttaaccgcgagcgcgtcccagagcgcaatccacacgccaaaggtcacggcgcattcggcgaactccacatcaccgaagacgtatcccagtacaccaaggccaagctcttccaaaaaggcaccgtcacccccatggccgtgcgcttttctaccgtcgccggtgaaaaaggctccccagacacctggcgcgacgtccacggcttcgcactgcgcttttacacccaagacggcaactacgacatcgtaggaaacaacaccccaaccttcttcctacgcgacgccatgaagttccccgacttcatccactcccagaagcgcctcggctccagcggcctgcgcgatgctgacatgcaatgggacttctggacccgcaccccagaatccgcacaccaagtcacctacctcatgggcgaccgcggcacaccaaaaaccagccgccaccaggacggatttggctctcacacctaccagtggatcaacgaagacggccagccagtgtgggtgaagtaccactttaagacccgccagggctgggaaaccttcaccgacgcagaggcccaagaaatggccggcaagaacgccgactaccagcgcgaagacctctacaatgccatcgagcgcggcgacttccccatctgggacgtcaaagtccagatcatgccattcgacgaggccgaaacctaccgctggaaccccttcgacctgaccaagacctggtcccagaaggactacccgcttatcgacgtcggctacttcgtgctcaaccgcaacccacagaacttcttcgcccagatcgaacagctggccctcgacccagccaacctcgtcccaggcgttggactctccccagaccgcatgctcatggcccgtgccttcgcctacgcagacgcacaacgctaccgcattggcccgaactaccagcagctgcccatcaaccagccagtggtaccggtgaacacctaccagcacgaaggccccatggcctaccacttcaacccagctgacgcgccggtgcacacaccaaaccgctttggcaagggtgccggctacctcgacgacggtcaaacctcgtcctccggtgcgacctacggtcaggcgcaggatctctacgtcaacccagatccacacggcaccgacctgactcgcgcagcctatgtcaagcacgcagacgatgacgacttcatgcaagccggaatcctctaccgcgaggtctatgacgacgcagccaaggaacgcttcgtggacaacgtgaccaatgccatggcaggggtatccccagaaaccgaggagcgcgtctactggtactggacccaagtagacgaaaacctcggtgcgaaaatccgtgaggcattcgccgctaagaagtag

SEQ ID NO: 42820 - protein, 512 aa, Corynebacterium diphtheriae NCTC 13129
MTSPVDPILNKGERTEAAPHTTRAGGQPVASENISITAGPQGANVLNDLHLIEKLAHFNRERVPERNPHAKGHGAFGELHITEDVSQYTKAKLFQKGTVTPMAVRFSTVAGEKGSPDTWRDVHGFALRFYTQDGNYDIVGNNTPTFFLRDAMKFPDFIHSQKRLGSSGLRDADMQWDFWTRTPESAHQVTYLMGDRGTPKTSRHQDGFGSHTYQWINEDGQPVWVKYHFKTRQGWETFTDAEAQEMAGKNADYQREDLYNAIERGDFPIWDVKVQIMPFDEAETYRWNPFDLTKTWSQKDYPLIDVGYFVLNRNPQNFFAQIEQLALDPANLVPGVGLSPDRMLMARAFAYADAQRYRIGPNYQQLPINQPVVPVNTYQHEGPMAYHFNPADAPVHTPNRFGKGAGYLDDGQTSSSGATYGQAQDLYVNPDPHGTDLTRAAYVKHADDDDFMQAGILYREVYDDAAKERFVDNVTNAMAGVSPETEERVYWYWTQVDENLGAKIREAFAAKK

SEQ ID NO: 42821 - DNA, 2118 bp, Rhodopseudomonas palustris CGA009
  CDS (1)..(2118): transl_table=11
atggcaaaatctgcgaaaccgaccaaaaaccggacggcgaccattcacgaccagaagatgtcgcgcggcgaaggcggcgagctgcaccagaccgccgaagatctcggcaccgaggtgatgaccaccgcgcaaggcggcccgatctccgacgaccagaacaccctgaagatcggcccgcgcggaccggcgctgatcgaggacttccacttccgcgaaaagatctttcatttcgaccacgagcggattcccgagcgcgtggtgcatgcccgcggctacggcgcgcacggctttttcgaaacgacccattcgctggcgaagttctcccgcgccgatctgttccagcgcgtcggcgaacgcactccggcgttcgtgcgcttctccactgttgctggcagcaagggctcggtcgatctagcccgcgatgtgcgcggctttgcggtcaagatctacaccaaagagggcaactgggatctggtcggcaacaacattccggtgttcttcattcaggatgcgatcaagtttcccgacctgatccattcggtgaaggaagagcccgaccgggcgtttccgcaggcgcaatcggcccacgacaatttctgggacttcatcagcctgacgcccgaaagcatgcacatggtgatgtgggtgatgtcggaccgcgcaatcccccgctcgttccgtttcatggaaggcttcggcgtccacaccttccgcctcgtcaatgccgacggcgaatccaccttcgtgaagtttcactggaagcccaagctcgggatgcagtcggtgctgtggaacgaggcggtgaagatcaacggcgccgatcctgacttccatcgccgggatctgtggaccgcaatctcgaccggcaatttcccggaatgggagctgcgggtgcagctgttcgatcaggaattcgccgacaagttcgatttcgacatcctcgacgctaccaagatcatcccggaggagatcatcccgccggtgccggtgggtcgcctcgtgcttgaccggatgccggacaacttcttcgccgagaccgagcaggtcgcgttcatgactcagaacgtgccgccggggatcgatttctccaatgatccgctgctgcagggccgcaacttctcctatctcgacactcagctgaaacggctcggcagtccgaatttcgcgcatctgccgatcaacgccccgaaatgtccgttcgcgcacttccagcaggacggccacatggcgatgcacaacccggtcggacgcgccaactatcaaccaaactcgcacggcctcggtccgcgcgaatctccgcagcgcggcttcgtgccgttccccgaggccgaagaaggcgccaaggcgaagtttcgcgccgagagctttgccgatcactatagtcaggcgcggcaattctacctcagccagacccgcaccgagcagcaccacattgtttcggcactgacgttcgaactcagcaaggtcgagatttcggtgatccgcgaacgcgtgctgtcgcatctgctgctcatcgacgagaccttggcgaccaacgtcgccaaccggctgggcatcaaggcaatgccgaagcccgcggacgctgcggtgccgacgcggcaggacctgccgccctcacccgcgctctcgatcatcgagaacggaccggagcggttcggaggccgcaagctcggcatcctgatcaccgacggcaccgacgcggcgctgctgaagagcttgcagaaggctgtcgagaaggcgggcgcgacgttcgaactgatcgccccccgcgtcggcggcgtaatcgcgagcgacggcagcgagatcgccgcgcaccagatgatcgatggcggaccgtctgtcctgtacgacgcggtggcgctgctgccgggagacgatgaaatcgacgacctgctgcaggaatcgaccgcccgcgacttcgtcgccgacgccttcgcgcactgcaagttcatcggctacgtcgccgccgcccggccgctgttcgccaaagccggcatcggcgacgacctcgatgaaggctgcatcgagctcgccgcgcgtaaggatgccggcgccttcgtcgatcagctcggcaagctccgggtgtgggcgcgcgaatccgtcgtcaaaatgcgctga

SEQ ID NO: 42822 - protein, 705 aa, Rhodopseudomonas palustris CGA009
MAKSAKPTKNRTATIHDQKMSRGEGGELHQTAEDLGTEVMTTAQGGPISDDQNTLKIGPRGPALIEDFHFREKIFHFDHERIPERVVHARGYGAHGFFETTHSLAKFSRADLFQRVGERTPAFVRFSTVAGSKGSVDLARDVRGFAVKIYTKEGNWDLVGNNIPVFFIQDAIKFPDLIHSVKEEPDRAFPQAQSAHDNFWDFISLTPESMHMVMWVMSDRAIPRSFRFMEGFGVHTFRLVNADGESTFVKFHWKPKLGMQSVLWNEAVKINGADPDFHRRDLWTAISTGNFPEWELRVQLFDQEFADKFDFDILDATKIIPEEIIPPVPVGRLVLDRMPDNFFAETEQVAFMTQNVPPGIDFSNDPLLQGRNFSYLDTQLKRLGSPNFAHLPINAPKCPFAHFQQDGHMAMHNPVGRANYQPNSHGLGPRESPQRGFVPFPEAEEGAKAKFRAESFADHYSQARQFYLSQTRTEQHHIVSALTFELSKVEISVIRERVLSHLLLIDETLATNVANRLGIKAMPKPADAAVPTRQDLPPSPALSIIENGPERFGGRKLGILITDGTDAALLKSLQKAVEKAGATFELIAPRVGGVIASDGSEIAAHQMIDGGPSVLYDAVALLPGDDEIDDLLQESTARDFVADAFAHCKFIGYVAAARPLFAKAGIGDDLDEGCIELAARKDAGAFVDQLGKLRVWARESVVKMR

SEQ ID NO: 42823 - DNA, 2121 bp, Mycobacterium avium subsp. paratuberculosis str. k10
  CDS (1)..(2121): transl_table=11
atggccaccgaccacacttcgggtgcgcccgatcccaagcagcgcgatctggagtccgcgcggttccgccgcgacaccggatacctgaccacgcagcagggcgtgcgcgtcgaccacaccgacgatgcgctcaccgtcggcgagcggggtccgacgctgctggaggatttccacgcccgggagaagatcacccacttcgaccacgagcgcatcccggagcgtgtggtgcatgcgcgcggggccggcgcctacggctatttcgaaccgtacgacgaccggttggcgcagtacacggcggcgaaatttctgacctcgccgggcaccaggacgccggtgttcgtgcgtttttcgacggtcgccggatcgcgcggttcggccgacaccgtccgcgacgtgcgcgggttcgccaccaagttctataccgaacaaggcaattacgacttggtgggcaacaacttcccggtgttcttcatccaggacggcatcaagttccccgacttcgtgcacgcggtgaaacccgagccgcacaacgagattccgcaggcgcagtcggcgcacgacacgctgtgggacttcgtgtcgctgcagcccgagacgttgcacgccatcatgtggctgatgtcggaccgggcgctgccgcgcagctaccgcatgatgcaggggttcggggtgcacaccttccggctggtgaacgcccgcggcgaggggactttcgtgaagttccactggaagccccgactcggcgtgcactcgctgatctgggacgaatgccagaagatcgccggcaaagaccccgattacaaccgccgcgacctgtgggaggccatcgaatcccgccagtacccggagtgggagctgggcgtgcagctggtcgccgaggacgacgagttcagcttcgacttcgatctgctggacgcgacgaaaatcattccggaagaacaggttccggtattgccggtgggcaagatggtgttgaaccgcaaccccgacaacttcttcgccgagaccgagcaggtcgcttttcacaccgccaacgtggtgccgggcatcgatttcaccaacgacccgttgctgcagttccgcaacttctcctatctggacacgcagctgatccggttgggcggccccaacttcgcgcagctgccggtcaaccgcccggtggcgcaggtgcggaccaaccagcacgacggttacgggcagcacacgattccgcagggccggtccagttacttcaagaacagcatcggcggcggttgtcccgcactggccgacgaggacgtgttccggcactacacccagcgggtggacgggcagacgatgcgcaagcgcgccgaggcgttccagaaccactacggccaggcgcggatgttcttcaagagcatgtcgccggtggaggccgaacacatcgtggccgccttcgccttcgaactcggcaaggtggagatgcccgaaatccgttccgcggtggtggcacaactcgcccgcgtcgatgaccagctggccgcccaggtcgcggcgaaactggggctgcccgagccgccggaggagcaggtggacgagtcggcaccggtttccccggcgctttcgcaggtcaccgacggcggcgacaccatcgcgtcgcgccggatcgcggtgctggccgccgacggcgtcgacgtggtgggcacgcaacgcttcaccgagctgatggagcagcgcggcgcggtggtcgaggtgctggccccggtggccggcggcacgctggcgggtgggtccggcggcgagctgcgggtggaccggtccttcacgacgatggcgtcggtgctctacgacgcggtggtggtggcgtgcggaccgcggtcggtgtcgacgctgtccgacgacggctacgccgtgcacttcgtcaccgaggcctacaaacacctcaagccgatcggcgcctacggggccggtgtcgacctgctccgcaaggccggcatcgacaaccggctcgccgaggacaccgacgtgctcaacgaccaagcggtggtcaccaccaaggccgccgccgacgagctgcccgagcgcttcgccgaggaattcgccgccgcgctcgcgcagcaccggtgctggcagcggcgcaccgacgcggtgccggcctga

SEQ ID NO: 42824 - protein, 706 aa, Mycobacterium avium subsp. paratuberculosis str. k10
MATDHTSGAPDPKQRDLESARFRRDTGYLTTQQGVRVDHTDDALTVGERGPTLLEDFHAREKITHFDHERIPERVVHARGAGAYGYFEPYDDRLAQYTAAKFLTSPGTRTPVFVRFSTVAGSRGSADTVRDVRGFATKFYTEQGNYDLVGNNFPVFFIQDGIKFPDFVHAVKPEPHNEIPQAQSAHDTLWDFVSLQPETLHAIMWLMSDRALPRSYRMMQGFGVHTFRLVNARGEGTFVKFHWKPRLGVHSLIWDECQKIAGKDPDYNRRDLWEAIESRQYPEWELGVQLVAEDDEFSFDFDLLDATKIIPEEQVPVLPVGKMVLNRNPDNFFAETEQVAFHTANVVPGIDFTNDPLLQFRNFSYLDTQLIRLGGPNFAQLPVNRPVAQVRTNQHDGYGQHTIPQGRSSYFKNSIGGGCPALADEDVFRHYTQRVDGQTMRKRAEAFQNHYGQARMFFKSMSPVEAEHIVAAFAFELGKVEMPEIRSAVVAQLARVDDQLAAQVAAKLGLPEPPEEQVDESAPVSPALSQVTDGGDTIASRRIAVLAADGVDVVGTQRFTELMEQRGAVVEVLAPVAGGTLAGGSGGELRVDRSFTTMASVLYDAVVVACGPRSVSTLSDDGYAVHFVTEAYKHLKPIGAYGAGVDLLRKAGIDNRLAEDTDVLNDQAVVTTKAAADELPERFAEEFAAALAQHRCWQRRTDAVPA

SEQ ID NO: 42825 - DNA, 1458 bp, Mycobacterium avium subsp. paratuberculosis str. k10
  CDS (1)..(1458): transl_table=11
atgacggagaatttcacgacgacgaatgcgggcgccccggcgcccagcgacgaactgtcgttgacgctgggtcccgatggcccggtactgctgcaggatttctatctcatcgagcagttggccgcgttcaaccgcgagcgggtccccgagcgccagccgcacgccaaggggaccggcgcgttcggccggttcgaggtcaccaatgacctgagcgcctacaccaaagccgcggtgtttcagccgggcaccaagaccgacgtgttcgtgcggctgtcggggaacgccggcgagcgcggcagcgccgacaccgtgcgggacacgcgcgggttttcggtgaagttctacaccaccgagggcaacttcgacctcgtcggcctcgacttcccggtcttcgtcatccgggacccgatcaagttcccgcagatggtccgctcggccaaacgccgcgcgaacaacgactgccgtgaccacaacatgcagtgggatttttggacgctctccccggagtcggcgcaccaggtggccatgatcatgagcgatcgcggtattcccaagacgtttcgtcacatgcacggcttcggcctgcacaccttcagcttcctcaacgccgccggcgagatctcgtgggtgaagtttcatttcaagtccaatcagggcatcgaatggttgacccaggaagagggcgatcggctggccggcaccgacccggactactgcatccgggatctgtacgaggcgatcgagcgcggggaccatccgagctggtcggtgaaggtgcagatcatgccgttcgaggaggccaagacgtatcggttcaacccgttcgacgtgaccaaggtgtggccgcatgccgactatccgctcatcgatctgggcaccatgacgctggaccgcaacgtcaccgaccaccacaccgaggtcgagcaggtgaccttcgcgccgcatgcgctggtgcccgggatcgggctgagcccggacaagcttttgctggggcgcagtttcgcctacgccgacgcgcaccgctaccgggtcggggccaatcacaaccaaattccggtcaacgccccgcggtgtccggtgcgcagctattccaaggacggacagatgcgcttcgtcaactccaccgacccggtgtatgcgcccaactcctacggcgggccgaaggccgatcccgaccgggcgtccgtggtgaaatgggccgtcgacggcggaatgatggtgcgcgcgccctacacgctgcgaccagacgacgacgactggggccaggccggcgccctggtgcgcgacgtgatggacgacgccgagcgggaacgactggtgcacaacatcgttcaccatgtcaccgacggcgtgaaagaacccgtgctgtcacgcgtcgtcgaatactggtacaacatcgacgccgacatcggcaagagggtggaagacggcatccgagccgccaacctcggccggtga

SEQ ID NO: 42826 - protein, 485 aa, Mycobacterium avium subsp. paratuberculosis str. k10
MTENFTTTNAGAPAPSDELSLTLGPDGPVLLQDFYLIEQLAAFNRERVPERQPHAKGTGAFGRFEVTNDLSAYTKAAVFQPGTKTDVFVRLSGNAGERGSADTVRDTRGFSVKFYTTEGNFDLVGLDFPVFVIRDPIKFPQMVRSAKRRANNDCRDHNMQWDFWTLSPESAHQVAMIMSDRGIPKTFRHMHGFGLHTFSFLNAAGEISWVKFHFKSNQGIEWLTQEEGDRLAGTDPDYCIRDLYEAIERGDHPSWSVKVQIMPFEEAKTYRFNPFDVTKVWPHADYPLIDLGTMTLDRNVTDHHTEVEQVTFAPHALVPGIGLSPDKLLLGRSFAYADAHRYRVGANHNQIPVNAPRCPVRSYSKDGQMRFVNSTDPVYAPNSYGGPKADPDRASVVKWAVDGGMMVRAPYTLRPDDDDWGQAGALVRDVMDDAERERLVHNIVHHVTDGVKEPVLSRVVEYWYNIDADIGKRVEDGIRAANLGR

SEQ ID NO: 42827 - DNA, 1434 bp, Bdellovibrio bacteriovorus HD100
  CDS (1)..(1434): transl_table=11
atgaaaaagacactcacaacatccgcaggcattcccatttctgaaaaccagcacagccttacttccggcccgcgcggcccggtggctttgcaggactatcacctgattgaaaagctcgcgcacttcaaccgcgagcgcattccagagcgcgtggttcatgccaagggctctggcgcctatggcaccttcaccgtcactcatgacatcacgcgcttcaccaaagcggcgatcttttcaaagatcggcaaaaagaccgaagccttcctgcgcttttcaactgtcgcaggagaaaaaggttccgcagataccgagcgcgacccgcgcggctttgccttaaagttctataccgaagaaggcaactgggacatcgtgggcaacaacacgccggtcttctttgaacgagatcccttgaagttcccggacttcatccactcgcagaaacgcgatccgcaaacaggatataaaaacccggtgcgtatgtgggattactggtccaaagctcctgaagctttgcaccagatcacgatcttattcagtgatcgcggaatcccagatggctatcgctttatgaatggctacggtagccacacgttcagctttatcaatgataaaaacgaacgcgtgtgggtgaagttccacttcaaatccatgcaagggatcaaaaatcttcctgtcgccaaagccgtcgaactggcgggaactgatccggattatgccggtcgcgatctattcgaggcgattgaaagaaaggaattcccacgctgggctttgaaggttcaaattatgactgaacgtcaggccgaacaattccggtttgatccgtttgatcttaccaaggtgtggccacacagcgaattcccactgttggatgtcgggattcttgagctgaacagaaatccggaaaactattttgctgaagtcgaacaagccgccttttcaccaagcaacgtcccaccgggcgtgggtttttcaccggataagatgctgcaaggacgactgttcgcctatccggatgcccaacgctatcgcctgggggtaaactatcagtacctgccagtgaatcgcccgcactcggaagtaaacagttatcaccgcgatggcagcatgagattcgacggcaacggaggaagacaggacaactatgaacccaatggttttggcggtccggtacagaacgaaagcttcaaagaccctgccttgaatttgtcaggcactctggatcgtcatgactcccacaaagacaatgacgacttcacgcaggccggaaatttgtatcgaatgctcagcgaagaagaaaaagaccgtttaacatccaacatcgcaggcacgatgaaaaccatttcagaggacctgcaaaccaaaaacatagaacacttcaagagatgcgatccggattatggcggccgcatcgccgccaaattgggattagactaa

SEQ ID NO: 42828 - protein, 477 aa, Bdellovibrio bacteriovorus HD100
MKKTLTTSAGIPISENQHSLTSGPRGPVALQDYHLIEKLAHFNRERIPERVVHAKGSGAYGTFTVTHDITRFTKAAIFSKIGKKTEAFLRFSTVAGEKGSADTERDPRGFALKFYTEEGNWDIVGNNTPVFFERDPLKFPDFIHSQKRDPQTGYKNPVRMWDYWSKAPEALHQITILFSDRGIPDGYRFMNGYGSHTFSFINDKNERVWVKFHFKSMQGIKNLPVAKAVELAGTDPDYAGRDLFEAIERKEFPRWALKVQIMTERQAEQFRFDPFDLTKVWPHSEFPLLDVGILELNRNPENYFAEVEQAAFSPSNVPPGVGFSPDKMLQGRLFAYPDAQRYRLGVNYQYLPVNRPHSEVNSYHRDGSMRFDGNGGRQDNYEPNGFGGPVQNESFKDPALNLSGTLDRHDSHKDNDDFTQAGNLYRMLSEEEKDRLTSNIAGTMKTISEDLQTKNIEHFKRCDPDYGGRIAAKLGLD

SEQ ID NO: 42829 - DNA, 1530 bp, Bdellovibrio bacteriovorus HD100
  CDS (1)..(1530): transl_table=11
atgcttaaggggtcgttcaaaattcaagaaaggatgcatgatatggctcaatcaaagaagggtttgaccaccagtgctggtgcgccggtttcagacaatcagaattcgttgacggtggggcctcgtgggccgttggtacttcaggatgtggcgctgattgaaaagctcgcgcaccaaaaccgcgagcgggtgccggaaagaacagtgcatgccaagggctccggcgcttttggcacgctgacgatcaacggagatatttccaaatacacccgcgcaaagttccttcagccgggaacaaaaacagatctgctgattcgtttttcaacggttgccggcgaaaggggcgctgcagatgctgaacgcgacgtgcggggatttgcgctgaagttttacaccgaagaaggcaactttgatttggtcggcaacaacacgccggtttttttcgtgcgtgatccttataaatttcccgacttcattcacacacaaaaacgcgatccgcgcaccaacttacgaagccccacggcaatgtgggacttctggtcactaagtcccgagtcctgccaccaggtgacaattctattctctgaccgtggtttaccggcgtcatatcggcacatgcacggatttggttcgcacacctattccctgatcaatagcaaggaggaccgtcactgggtgaagttccacttcaaaacccagcaagggatcaaaaatctgaccaatgatgaaggggcagagcttgtggggcgcacgcgcgaaagccatcaggaggatctgtacaattcgatcgaagaaaaaagctttccgaaatggcgcatgtacgtgcagatcatgagcgaagagcaggccaagaaaacctggtacaatccctttgatcttaccaaagtgtggccgcacggagagttcccgatgattgaggtgggcaccatggagctcaaccgcaatccgacaaactattttgctgaaatagagcaggcggctttcaacccgaacaacatggtaccgggtgtttcctggtcgccggacaagatgctgcagtcgcgcacttttgcgtatgctgatgcccatcgctatcgcatcggcactcactacgaaatgcttcctgtgaacaaacccaaagtggaagtgaaccactatcatctggacggggccatgcgcctggatgttcctgaatacaatcatgcctattatgaaccgaactctttcgggggacctgctcagcaggaacagtaccgggaaccgccattgaagctggatgatgccaccatggaccggtttgatcatcatcagggcaatgatgattaccgtcaggcaggggatttgttccggttgatggacgccgataaaaaaaggcagctgctggataatatcgccgaacacatgaagcgcggaaatgtgcctgaagaaatcgtacgccgtcagatcgaggtctttatgaggtgcgatcctgcttacggtagcggcttggccgagcgcatgggtgtaaaggtttattcagacaaatatgaaagtggcagtgcccatcattag

SEQ ID NO: 42830 - protein, 509 aa, Bdellovibrio bacteriovorus HD100
MLKGSFKIQERMHDMAQSKKGLTTSAGAPVSDNQNSLTVGPRGPLVLQDVALIEKLAHQNRERVPERTVHAKGSGAFGTLTINGDISKYTRAKFLQPGTKTDLLIRFSTVAGERGAADAERDVRGFALKFYTEEGNFDLVGNNTPVFFVRDPYKFPDFIHTQKRDPRTNLRSPTAMWDFWSLSPESCHQVTILFSDRGLPASYRHMHGFGSHTYSLINSKEDRHWVKFHFKTQQGIKNLTNDEGAELVGRTRESHQEDLYNSIEEKSFPKWRMYVQIMSEEQAKKTWYNPFDLTKVWPHGEFPMIEVGTMELNRNPTNYFAEIEQAAFNPNNMVPGVSWSPDKMLQSRTFAYADAHRYRIGTHYEMLPVNKPKVEVNHYHLDGAMRLDVPEYNHAYYEPNSFGGPAQQEQYREPPLKLDDATMDRFDHHQGNDDYRQAGDLFRLMDADKKRQLLDNIAEHMKRGNVPEEIVRRQIEVFMRCDPAYGSGLAERMGVKVYSDKYESGSAHH

SEQ ID NO: 42831 - DNA, 1377 bp, Bacillus cereus ATCC 10987
  CDS (1)..(1377): transl_table=11
atggatgaaaactatgataaacagaggcaatctttactagggaaagactttaatgataatgaagaacgtaatgaacaagctatacttcactctcaaacagttggttcacgtggacctgttctagagcaagatagtgtgcttcacgaggcgttacaacaatttattcacgaaaaaattttagaaagacctgttcatgtaaaaggatttggtgcatttggttattttcaaacgatctatccaatgtctgaacatacgaaactaagttttctacaacattctaatgagaaagttcctgttatggtacgattttcactagctgttagtacgaaaggaacacctgatacttctagaaatgtacgcggtttttctacaaaattttatacaaaagaaggtattttcgatctattatgtaatcacattcctgtcttttctgtacgcgatccgatgcgtttccctgaaacaattcaagcgttgtcaccttcacctaaaaataacttaatagaccctaatagattttggagctttgtcgctagagcacctgaatccatacatttcgttgtccgtttgtactctgataatggtacagccaaaagccttcgccacattccaggacatagtgtaaatacatatgtttggagaaatgcagaaggtaatcgaaagtacgtaaagtatcattggtacccatttgaaggtgtacaattcattactagcgaggaagcaaataaactggctgccgaaaaccctgattatagcgggaaagatttatatgatgcaattgcaaacggtaaaccagtggaatatggtttatatgtccagctcatggacccgaaagatgaagcgcatctttcttacgatcctttagatgatacaaaaatatgggatgaaaaagcgtatcctcttataccagtcggcaaaatggtattaaataaaaaccctgaaaattttatggaacaaatagaaaaagtcgctttctccccttctaatttacttgacggtgctgaattatcagatgataaaatgttgcaagggcgagctaacatttatagtgattcccaaagaaaaagaattggtcctgaattccgcaaattaacgattaaccaacagcaaaattggacacctgctaatcaaataacgagcggtgacggaaggtacgttgatggtaaacttgagagaacttctatatcgaaacaagatgactttacgcaggctggcgaattttatgcgacgttaaaaccgatagaaaaagaacatcttgctgaaaacttagctggtgatttgaaagttatatccgatgatattaggaaggtcgttttagagtattttcataacgtgtctgttgatttggtgaagaggattgaaaccgaaataaaaaaataa

SEQ ID NO: 42832 - protein, 458 aa, Bacillus cereus ATCC 10987
MDENYDKQRQSLLGKDFNDNEERNEQAILHSQTVGSRGPVLEQDSVLHEALQQFIHEKILERPVHVKGFGAFGYFQTIYPMSEHTKLSFLQHSNEKVPVMVRFSLAVSTKGTPDTSRNVRGFSTKFYTKEGIFDLLCNHIPVFSVRDPMRFPETIQALSPSPKNNLIDPNRFWSFVARAPESIHFVVRLYSDNGTAKSLRHIPGHSVNTYVWRNAEGNRKYVKYHWYPFEGVQFITSEEANKLAAENPDYSGKDLYDAIANGKPVEYGLYVQLMDPKDEAHLSYDPLDDTKIWDEKAYPLIPVGKMVLNKNPENFMEQIEKVAFSPSNLLDGAELSDDKMLQGRANIYSDSQRKRIGPEFRKLTINQQQNWTPANQITSGDGRYVDGKLERTSISKQDDFTQAGEFYATLKPIEKEHLAENLAGDLKVISDDIRKVVLEYFHNVSVDLVKRIETEIKK

SEQ ID NO: 42833 - DNA, 1524 bp, Eremothecium gossypii
  CDS (1)..(1524)
atggctggcaataacgacaagactaactctgcggaggtgcgggaggaccgggtggtgacgaactcggtgggtaacccgatcaacgagccgttcgcgacgcagcgggtggggcagcacgggccgctgctgctgcaggactacaacctgctggacctgctggcgcacttcaaccgggagcgggtgccggagcgcaacccgcacgcgcacgggtccggggcgttcgggtactttgaggtgacggacgacatcacggacgtgtgcgggtcggcgatgttcggagaggtgggcaagcggacgcgggcgctggtgcggttctcgacggttggcggggagaagggctctgcggacacggtgcgggacccgcgggggtttgcggttaagttctacacggaggaggggaacctggactgggtgtacaacaacacgccggtgttcttcatccgggacccgtcgaagttcccgcacttcatccacacgcagaagcgcaacccgcggacgaacctgaaggacgcgaacatgttctgggacttcctgacgacgccggagaaccaggtggcgatccaccaggtgatgatcctgttctcggaccggggcatccctgcgtcgtaccggcacatgaacgggtactcggggcacacgtacaagtggtcgaacaagcagggcgactggcgctacgtgcaggtgcacattaagacggaccagggcatcaagaacctgaccgcggaggagggcgcgaagctcgcgggcgaggacccggacttctgccagcaggacctggtccaggcgctggagcgcggcgagtacccttcgtggacggtgtacatccagacgatgacggaggagcaggcgcagaagctgcccttctcggtgttcgacctgacgaaggtgtggccgcacaaggactttccgctgcgccgcgtgggccgtctcgtgctcaacgaggtgcccaccaacttcttcgcgcagatcgagcaggccgcgttctcgccggcgacgaccgtgccgtaccaggagcccagcgcggaccccgtgctgcaggcgcggctcttctcctacgcggacgcgcaccgctaccgcatcgggcccaactaccaccaggtgccggtgaactgcccctacgcctcgaagttcttcaaccccgcgatccgcgacgggcccatgaacgtcgacggcaacctcggcagcgagcccaactacctggccaccaacaacaattaccgcttcctcggcgccgaccgcccgatccagcagcaccaggagacgtggcagggccccgcccagcccgtgcactgggccaccaccggcgacatcgacttcgctcaggccaccgcgctctaccacgtgcttggccgcacccccggccagcagcgcaacctggcccacaacgtggccatccacgtcgccagcgcggacccgccgatccaggagcgcgtcttccagatgttctcccgtgtcgacaagggcctcggtgaggccatccgctctgaggccaccgccctcagccagaagaagcccaagttgtaa

SEQ ID NO: 42834 - protein, 507 aa, Eremothecium gossypii
MAGNNDKTNSAEVREDRVVTNSVGNPINEPFATQRVGQHGPLLLQDYNLLDLLAHFNRERVPERNPHAHGSGAFGYFEVTDDITDVCGSAMFGEVGKRTRALVRFSTVGGEKGSADTVRDPRGFAVKFYTEEGNLDWVYNNTPVFFIRDPSKFPHFIHTQKRNPRTNLKDANMFWDFLTTPENQVAIHQVMILFSDRGIPASYRHMNGYSGHTYKWSNKQGDWRYVQVHIKTDQGIKNLTAEEGAKLAGEDPDFCQQDLVQALERGEYPSWTVYIQTMTEEQAQKLPFSVFDLTKVWPHKDFPLRRVGRLVLNEVPTNFFAQIEQAAFSPATTVPYQEPSADPVLQARLFSYADAHRYRIGPNYHQVPVNCPYASKFFNPAIRDGPMNVDGNLGSEPNYLATNNNYRFLGADRPIQQHQETWQGPAQPVHWATTGDIDFAQATALYHVLGRTPGQQRNLAHNVAIHVASADPPIQERVFQMFSRVDKGLGEAIRSEATALSQKKPKL

SEQ ID NO: 42835 - DNA, 1551 bp, Neurospora crassa
  CDS (1)..(1551)
atgtcttcaaacgacgcaccggtttacacacttgccgagggacgccccgtccaggacccttcggctgccacggtcctgatgggctcgaagcctcgtggcggagccctctctctcctcgcagacacccagctgatcgaaaccctcgcccacttcccccgagaacgcatccccgaacgtgtcgtccacgccaaggcagccggtgcctggggagagtttgagtgcacggaagatgtctcggactttacatctgttgactttctcaacaaggtcggaaagaagaccaaggtcctggcccgtatttccacggtggcgggtgagaagggctctgccgatacggttcgtgatatccgcggtttcgccgtcaagttcttcaccgaggaaggcaactgggactttgtcggcaatgacctgcccgtcttcttcatccgcgatcccgtcaagttccccagtctcaaccgctcccacaagcgtcacccccagaccaacgtgcccgactcgaccatgttctgggacttccacaacaacaaccaagaaggcgtccactgcttgatgcagctctttggcggccgtggcatccccgcctctctccgcaatgtcaacgcctttggcaaccacacctacaagttcggcaagcccgaggacggcacgttcaagtacgtcaagatccacttgaagcccgacgccggcatcaagaacctcgagtccgacgaagccctccgcctggctggcgaggaacccgatttccacatcaaggacatgtacaatgccatcgagcgcggcgactaccccacctggaccatgtacttccagatcatggaccccaaggacgccgaaacctaccggtacaacatctttgacattacgcagacctggtcgcatcgggactatcccctgcgtcccatcggtaaactcaggcttaacaagaacccggaaaaccacttccaggatatcgagcaagccgccttctccccctccaccatggtccctggcatcggccctagcgccgaccccatgctccaggctagaatgttctcctaccctgatgccgcccgctaccgtgtcggacccaactaccaacaactcccttgcaaccgcgccttgcacgtctattctccgtaccagcgtgacggtccaatgcgcgtagacggcaactatggtggcgacccggattatgtgcggtcttccttccgtcccatgcgtttcggtccccctgacgtcgctcacgacgagtgggccggtaaggttgccttgttcacctcggaagtgaccgacctcgatttcgagcagccgagggatctgtggaagatctttaaggagaccggagaagacaagcggtttgccaagaacgtggcggcgcatgtgggcaaggcgttgccggaggtgcaaaagaagacaatcgagatgtttagtaaggttgatcaggaggtgggcgaggctatccaaagagagttggatgagcttgagaagaagggcggtgcgggcattgagcatgacaaggcgccggtgaaggggaagggcatgaggtgtaaggattcgaaggatgatgagtga

SEQ ID NO: 42836 - protein, 516 aa, Neurospora crassa
MSSNDAPVYTLAEGRPVQDPSAATVLMGSKPRGGALSLLADTQLIETLAHFPRERIPERVVHAKAAGAWGEFECTEDVSDFTSVDFLNKVGKKTKVLARISTVAGEKGSADTVRDIRGFAVKFFTEEGNWDFVGNDLPVFFIRDPVKFPSLNRSHKRHPQTNVPDSTMFWDFHNNNQEGVHCLMQLFGGRGIPASLRNVNAFGNHTYKFGKPEDGTFKYVKIHLKPDAGIKNLESDEALRLAGEEPDFHIKDMYNAIERGDYPTWTMYFQIMDPKDAETYRYNIFDITQTWSHRDYPLRPIGKLRLNKNPENHFQDIEQAAFSPSTMVPGIGPSADPMLQARMFSYPDAARYRVGPNYQQLPCNRALHVYSPYQRDGPMRVDGNYGGDPDYVRSSFRPMRFGPPDVAHDEWAGKVALFTSEVTDLDFEQPRDLWKIFKETGEDKRFAKNVAAHVGKALPEVQKKTIEMFSKVDQEVGEAIQRELDELEKKGGAGIEHDKAPVKGKGMRCKDSKDDE

SEQ ID NO: 42837 - DNA, 2232 bp, Magnaporthe grisea 70-15
  CDS (1)..(2232)
atggcgtccttaaaagatatcggggacaccctcagcaagggcaagtcatacgtcatgcattcacagggcgacaagatttccgacctcgcgaggaatacagtgaccccggacgagaagggaagacagaccacagacgccggtgtcaggattaccaaccctgatgactggctgcgcgtcaccagcaacgaccaaataggcccctcgctgcttgaggaccagattgctcgcgagaagattcacaggttcgaccatgagcgtattcccgagagagtggtgcacgcccgcggcactgcggcacacggaaagttcactctgcacaagagcatcgagcacttgaccacagctggcgtgcttacagacacatcgcgtgagacacctgttttcttgcgcttttcgaccgttctgggcagccgaggcagcgccgacacagtccgtgacgttcgtggtttcgccgtcaagttttacacgcccgaaggcaactgggatatcgtcggaaacaacattccagtcttcttcatccaggactcgatgaagttccccgatgtcatccacgccggcaagcccgagccagacaacgaggtccctcaggcccaatccgcacacaacaacttctgggacttcatgtaccagcactccgaggccacccacatgttcatgtgggccatgtcggaccgcaccatcccgaggtcgtaccgcatgatgcaaggttttggtgtcaacacctacaccctcatcaacgccaagggagagcgtcactttgtcaagttccacttcaccccggaacttggcgtacacagcttggtctgggacgaggccctcaagcttgccggtcaggaccctgacttccaccgcaaggatctgatggaggccatcgcaaacggtgcattcccacgctggaagtttggtgtccaggttcttcccgagtcgcgcgagcacgagtttgactttgacattctcgacgccaccaaggtttggcccgaggacctcatccccgtcgactacatcggcaccctcgagctcaaccgcaacatcgacgagttcttccccgagacggagcaggttgcctactgcaccagccacgtcgtgcctggtatcggcttttcggacgatccgctcctgcagggtcgcaacttcagctatttcgatacccagatctcacgtcttggcatcaactgggaggagctgcccatcaacaggccagtttgcccggtgctcagcttcaaccgtgacggccagagccgccacaccatcaccaagggcaaggtcaactactggcccaaccgttttggcgtaaatgcgccagccgatggtgtcaaggagggtggatatgtcgagcacgccaccaaggtccagggcatcaaggcgcgcaccaagagcgccaagttcctcgaccacatctcgcaggctcagcttttcttcaacagcatgtctgatgttgaaaagcgccacatgctggccgccttttcgtttgagcttgaccactgcgaagaggaggttgtgtacaacaacctcgtctcgcgtctgactcagattgacatcggcctcgcccagcaggtggccgagatggtcggtgctcaaatcccggacaaggcgaccaaggaaaacaagggtatcaaggccaagggcttgagccagttcgacttcttgcccgagaatcccaccattgcatcacgcaaggtcgccattctgatcgccgacggctacgactcggttcagttccgcgctgtcaaggccgccctctcggctgcccaggctattccgctcgtgatcgcgccccgacgttcgcccatctacgctgctggcgagaccaagggctccagtggtgccggtctcaaacccgaccaccacctcgagggcttccgaagcaccatggtggacgccgtgtacgtgcccggcggcgctgagtcaatcaagacattgtccaagaacggacgtgccttgcattacgttcgcgaggcatttggtcacctgaaggccattggagcgtcgggcgagggtgtggagctcgtcaaactggctgtgacgcttccggaagtcactgtgtcaagcgcagacgtgatggagtcgtacggcgttgtcactgtcaggaatgttcaggctgacagcttgaaggaggttgtcgacctggcaaagggtggaaaggactttttggatcagttcttccacagcattgcaatgcacaggaactgggcacgtgaggcggatggattgaactcccaggtggcgtactaa

SEQ ID NO: 42838 - protein, 743 aa, Magnaporthe grisea 70-15
MASLKDIGDTLSKGKSYVMHSQGDKISDLARNTVTPDEKGRQTTDAGVRITNPDDWLRVTSNDQIGPSLLEDQIAREKIHRFDHERIPERVVHARGTAAHGKFTLHKSIEHLTTAGVLTDTSRETPVFLRFSTVLGSRGSADTVRDVRGFAVKFYTPEGNWDIVGNNIPVFFIQDSMKFPDVIHAGKPEPDNEVPQAQSAHNNFWDFMYQHSEATHMFMWAMSDRTIPRSYRMMQGFGVNTYTLINAKGERHFVKFHFTPELGVHSLVWDEALKLAGQDPDFHRKDLMEAIANGAFPRWKFGVQVLPESREHEFDFDILDATKVWPEDLIPVDYIGTLELNRNIDEFFPETEQVAYCTSHVVPGIGFSDDPLLQGRNFSYFDTQISRLGINWEELPINRPVCPVLSFNRDGQSRHTITKGKVNYWPNRFGVNAPADGVKEGGYVEHATKVQGIKARTKSAKFLDHISQAQLFFNSMSDVEKRHMLAAFSFELDHCEEEVVYNNLVSRLTQIDIGLAQQVAEMVGAQIPDKATKENKGIKAKGLSQFDFLPENPTIASRKVAILIADGYDSVQFRAVKAALSAAQAIPLVIAPRRSPIYAAGETKGSSGAGLKPDHHLEGFRSTMVDAVYVPGGAESIKTLSKNGRALHYVREAFGHLKAIGASGEGVELVKLAVTLPEVTVSSADVMESYGVVTVRNVQADSLKEVVDLAKGGKDFLDQFFHSIAMHRNWAREADGLNSQVAY

SEQ ID NO: 42839 - DNA, 2184 bp, Magnaporthe grisea 70-15
  CDS (1)..(2184)
atgcctcgctcgtctatgttaggactatgggcaagcctagtctggattgcccaggccggctgcccctatgcagacccagcagccttgcgtcctcgagaggagcacacggatgattatctagcacaattctcggttgatgaccaggacaagtttcttacatccgacgttggaggtccaataggggatcaaagaagtctgaaggctggtgcgcgaggctcgacgcttcttgaggactttgtctttcgtcagaaaataacacatttcgatcatgagcgtgttccagaacgcgccgtccatgccaggggcgcaggcgctcacggcaccttcacaagctatggtgactttagcaacatcacctcggcatcgtttctgaactctgctggcaagcggactccggtgtttgtgcgcttctctaccgtggctggctcgagaggtagtgcggatagcgccagggatgtgcacgggtttgccacgagattctataccgacgagggcaattttgatattgttggaaacaatgtacctgttttcttcatacaggacgctatacaatttcctgatttggttcatgccgtcaaacccagcccagacaaggagataccaactgcagcgaccggtaagcgcccagactacaagcctaatcctgatgccactcatgattcggcttgggactttttcagtcaacaatcaagttcattacatgctcttttctgggccatgtcaggctatggaattccacgatcgtatcgtcacatggatgggttcggagtccatacgttccgcatggtcgccgacaatggcgagtcgagattggtcaagtttcacttcaagaccaagcagggcaaagcaagcctgatttgggaagaggcccaagtcctgtccggcaagaaccccgactttcaccggcaagatctttgggatgctatcgaggctggccacggtcccgaatgggagtttggagtccaggttgtcaacgaggaggatgccctgaggtttggcttcgatatgctcgatccgacaaagatcctcccagaggatcttgtgcctgttcatcctctagggcttctcaagcttgatcggaatcccatcaactatttcgccgagacggagcaaatcatgtttcaacctggacacctcgtcaggggtatcgacttcaccgaggatcctcttcttcagggccgggtgttttcataccttgatactcagctcaaccgccacaatggacccaactttgagcaacttcccatcaacagaccaagggtcaccgtccacaacaataatcgcgacggttcagggcagaattttattcacaagaacatccatccttatacacccagtgccctgaatgagttcccgaaacaggccgatgacgaccaaggcagaggcttcatgaccgctcctcggcgcaggacccaggacgcagcgcttgttcgtgagctctccgagacttttgatgaccactggacgcagccgcgtttgttttggaacagcatcacgcccgccgagcagcagattttggtcaacgcgatacgatttgagactagcaacatcgtgaacacgcacgtcaggcagaaagtccttcagcagctcaaccgcattagcgacgaactggcagggcgtgttgctcaagcactcggcatggaggcgcccgctcccgagccagctttctaccacgaaaataccactataggcttgtcaattttcggcatcaagctgcccacgatcaagacgctcagggtgggcgtccttgccagcaccggaaacgtcgcgtcgctctcgcaggcagctgacctcaaggcccgattcatgggcgatggtgtcgcggtcgcggtgctaggcgaaacacaggttgaaggtgtcgacgtcacctactcacaatccgatgctacagtctttgatggcatcatcattgcggccggtgccgagggtcttgtcgccaaggatgcaccggcgtcggcactctttcccataggcaggccacagcaactcgtcgttgacagcttcagatggggcaagcctattggactggccgcagcttcggacgactcggcgaacattttcagcagcctaggaacgactggccctggtgtctttagtggcgatgacctcggtgtgctggtcaccgatttcaaggaggggctgtcgacatataagtttgttgagaggttcccgatggactcgtga

SEQ ID NO: 42840 - protein, 727 aa, Magnaporthe grisea 70-15
MPRSSMLGLWASLVWIAQAGCPYADPAALRPREEHTDDYLAQFSVDDQDKFLTSDVGGPIGDQRSLKAGARGSTLLEDFVFRQKITHFDHERVPERAVHARGAGAHGTFTSYGDFSNITSASFLNSAGKRTPVFVRFSTVAGSRGSADSARDVHGFATRFYTDEGNFDIVGNNVPVFFIQDAIQFPDLVHAVKPSPDKEIPTAATGKRPDYKPNPDATHDSAWDFFSQQSSSLHALFWAMSGYGIPRSYRHMDGFGVHTFRMVADNGESRLVKFHFKTKQGKASLIWEEAQVLSGKNPDFHRQDLWDAIEAGHGPEWEFGVQVVNEEDALRFGFDMLDPTKILPEDLVPVHPLGLLKLDRNPINYFAETEQIMFQPGHLVRGIDFTEDPLLQGRVFSYLDTQLNRHNGPNFEQLPINRPRVTVHNNNRDGSGQNFIHKNIHPYTPSALNEFPKQADDDQGRGFMTAPRRRTQDAALVRELSETFDDHWTQPRLFWNSITPAEQQILVNAIRFETSNIVNTHVRQKVLQQLNRISDELAGRVAQALGMEAPAPEPAFYHENTTIGLSIFGIKLPTIKTLRVGVLASTGNVASLSQAADLKARFMGDGVAVAVLGETQVEGVDVTYSQSDATVFDGIIIAAGAEGLVAKDAPASALFPIGRPQQLVVDSFRWGKPIGLAAASDDSANIFSSLGTTGPGVFSGDDLGVLVTDFKEGLSTYKFVERFPMDS

SEQ ID NO: 42841 - DNA, 2217 bp, Gibberella zeae PH-1
  CDS (1)..(2217)
atgaccgagcaagttacaggagctatcaagcacgcagtcatgggtcacaagaacgacaagattgaccagctcaaggccaacatggtcgagcctaatgagaactcccgaatcacctccgattatggtgtcaagcagaacaacaccgatcaatggctgcgcgtagcgagtgaagaccagactggtccctcgctgttggaagatgctttcggccgagagaagatccaccgatttgaccacgagcgcatccccgagcgtgttgtccatgcccgcggtgctggcgcccacggtacctttagactcttcgagtcagccgccgatgttaccaaggctggcctctttaccgacacatctagggaaacacccgtctttgttcggttctcgactgttcttggaagtcgcggctctgccgacactgtccgcgatgtccgcggtttcgccatcaagttctacacccaagaaggcaacttcgatatccccgggaacaatatccctgtcttctttatccaggatgctatgaagtttcccgatgttattcatgctggaaagccagaaccaaacaacgaggttcctcaagcgcagactgcacacaacaacttctgggatttcatgtttgagcacccagaggcgactcacatgcacacatgggccatgtctgaccgaacaattccccgatcctaccgcatgatgcaaggtttcggtgtcaacacctacactctcgtcaacgagaagggcgagcgccggtttgtcaagttccactggacgcccgagcttggagtccactcacttgtctgggatgaggccctcaagcttgctggtcaagaccctgacttccaccgcaaggaccttcaggaggctatcgagaacggcgcttttcccaagtggaagtttggtatccaggttttggacgagtctcaggagcacgactttgactttgatatcctcgatgccaccaaggtttggcctgaggacctcatccccgtccgatacattggtgagcttgagctgaaccaaacagtcgatgagtacttcacccagaccgagcaggttgctttctgcactagtcaccttgttcctggtattggacactcagacgaccctcttctccagggccgaaacttctcttaccaagatactcagctcagccgactgggaaccaactgggaagagctccccatcaacaagccagtctgtcctgtcatgaactttaaccgtgatggtgccatgcgacacaccatcaccaagggcaaggtcaactactggcccaaccgtttcagtcatcagcctcctgccacagaaagcgagggtgcctacgtcgattacgctgcaaagattgtcggcatgaagcagcgaacactaagcaagaagttcaaggaccacttcacccaagctcagcttttctacaactctctttccgagattgagaagtctcacgtccaagctgcctactcctttgagttggaccactgtgacgaagctatcgtctacgagcgtttgacggaacgcctcggtgaaatcgatggcgatcttgccaacactattgccgagatggttggtggcaagaagcctgccaaccccaagcccaatgccggaaagaaggccaagaacctgagccaacttgactttgtccctgagactcctaccatcaagtctcgacgaattgctatcatcattgctgacggctacgaccctgtcgcctttaacgcgatgtacggtgccatcaaggctcagagcgctctcccctttgtcattgctccccgccgagcacccatcttctctgccgctgaggattcatcttcgtcaaagggcatcttccccgaccatcatctcgagggacagcgttctaccatgttcgacgccatctttgtccccggcggtgccaagtccatcgagactctgtccaagaatggccgtgccctgcactacattcgcgaagcctttggtcacctcaagaccattggcggcactggcgaggccgtcgagtttattaacaaggcgatccagctttctgaggtggctctgtcctctactgacggcagtggtgtcgttgacagctacggtgtcgttactctcaaaaatgcttcgcctgacaccctcaaagagattgccaccgttgcttccgacgccaagggattcctggagaagtttgtctacaatgtcagctgccatcgcaactggcagcgagagctggatggtctcagcaccatggtggcgtactaa

SEQ ID NO: 42842 - protein, 738 aa, Gibberella zeae PH-1
MTEQVTGAIKHAVMGHKNDKIDQLKANMVEPNENSRITSDYGVKQNNTDQWLRVASEDQTGPSLLEDAFGREKIHRFDHERIPERVVHARGAGAHGTFRLFESAADVTKAGLFTDTSRETPVFVRFSTVLGSRGSADTVRDVRGFAIKFYTQEGNFDIPGNNIPVFFIQDAMKFPDVIHAGKPEPNNEVPQAQTAHNNFWDFMFEHPEATHMHTWAMSDRTIPRSYRMMQGFGVNTYTLVNEKGERRFVKFHWTPELGVHSLVWDEALKLAGQDPDFHRKDLQEAIENGAFPKWKFGIQVLDESQEHDFDFDILDATKVWPEDLIPVRYIGELELNQTVDEYFTQTEQVAFCTSHLVPGIGHSDDPLLQGRNFSYQDTQLSRLGTNWEELPINKPVCPVMNFNRDGAMRHTITKGKVNYWPNRFSHQPPATESEGAYVDYAAKIVGMKQRTLSKKFKDHFTQAQLFYNSLSEIEKSHVQAAYSFELDHCDEAIVYERLTERLGEIDGDLANTIAEMVGGKKPANPKPNAGKKAKNLSQLDFVPETPTIKSRRIAIIIADGYDPVAFNAMYGAIKAQSALPFVIAPRRAPIFSAAEDSSSSKGIFPDHHLEGQRSTMFDAIFVPGGAKSIETLSKNGRALHYIREAFGHLKTIGGTGEAVEFINKAIQLSEVALSSTDGSGVVDSYGVVTLKNASPDTLKEIATVASDAKGFLEKFVYNVSCHRNWQRELDGLSTMVAY

SEQ ID NO: 42843 - DNA, 2151 bp, Gibberella zeae PH-1
  CDS (1)..(2151)
atggtgtcttctaagcttcttgttgttcttggacttgccagcctaaccgctgcacaatgtccctacgccgacccggccaaactagcagctagagatgaaggaagttctcgtgaacatctcaaggactatgaagtcgatgatagtaaggggcatatgagttccgatgctggtggcccctttgaggaacaggagagtttaaaggcaggagaacgaggccctactctgctcgaagactttatcttccgccaaaagatcacacatttcgatcacgaacgggtccctgaaagagccgtccacgcccgaggtgctggggctcatggttacttcaagagctacagtgactggagcaacatcacagcagcttctttcctcagctcaaaagacaaaaatactcccgtctttgtgcgcttttcgaccgttgctggttctagaggtagcgccgatactgtgcgagatgtgcacggattcgctacccgattctacacagatgctggcttatttgacattgtgggcaacaatatccctgtattctttattcaagatgcaattcagttcccagacctcatccacgctgttaagccatcccctgacagtgagatcccgcaagccgccacagctcacgactcagcatgggactttttcagtcagcaaactacaaccctacacactctattctgggccatggcaggatatggaattccacgttcgtttcgtcacgtagatgggttcggtgttcacactttccgtctagtgactgatgagggtgacaccaagttcgtcaagtggcactggaagagcaagcagggcaaagcgagcctagtatgggacgaagcacagcacctggccggaaagaacgccgattatcatcgtgctgatctctggaatgccattgagtctggtaacgggcctgaatgggaactcaatgcccagatctttgacgaggaccaggctctggcgtttggatttgatgttctggacgctaccaaaatcattcctgaagagctagctcctctccagcctattggtgttatgaagttggacacaaaccccgtcaactatttcgctgagactgagcaggtcatgttccaacctggccacattgttcgcggtatcgactttaccgaagatcctctgctgcagggacgtatcttttcttaccttgatacccaactcaaccgtcacggtggtcccaactttgagcaactccccatcaaccgtcctctgtctcctatccataacaacaaccgtgatggagccgggcagaactttatccacaagaatactgctgcttctgactctctagacacccctaatactctaaacaagggctaccctgttcaggcaaaccagacacaaggaaaaggcttctttactgcccctggccgcaaggtttctggaaacctggtgcgcgccagagcatccaccttctctgaccactggagccagccacgactcttctacaactctctgaccaaagtagagcagcagtttctcatcaacgccatacgtttcgagacaagtcagctcatgtctgaaactgtccagaagaacgttctctaccagctgaacaaaatcagccacgatattgctgtcagagttggcagggctttgggtctcaaagctcctgaggctgacgacaagtactaccacgacaataccacagccggaatctccatttttggaaccaagttgccaagcattgcaacgctctctgttggtgtcttggtttctatcaactctaataactccatccaacaagccaaggctctcaagaaggcacttggcgaggacaaggtgaccgtgtcgattataggcgaagttcttggagacgatgttgaagttacttacagtgctgcaactgccgctcaatttgatagtgtcgttgttaccagcggtactgagtctcttttcaacggcaccggaaagtcaactctattccctcctggccgtcctacgcagattattgtggacggttatcattggggcaagcctgttggatttattggaggtgcaaaggcggcagctcaggctgcgagagttagtaaaggaaaaggagtgtactttccgaagaacgttaactctttggttgaagatttaaaggatgggttggctactttcaagttcactgaccgattccccctggaccactaa

SEQ ID NO: 42844 - protein, 716 aa, Gibberella zeae PH-1
MVSSKLLVVLGLASLTAAQCPYADPAKLAARDEGSSREHLKDYEVDDSKGHMSSDAGGPFEEQESLKAGERGPTLLEDFIFRQKITHFDHERVPERAVHARGAGAHGYFKSYSDWSNITAASFLSSKDKNTPVFVRFSTVAGSRGSADTVRDVHGFATRFYTDAGLFDIVGNNIPVFFIQDAIQFPDLIHAVKPSPDSEIPQAATAHDSAWDFFSQQTTTLHTLFWAMAGYGIPRSFRHVDGFGVHTFRLVTDEGDTKFVKWHWKSKQGKASLVWDEAQHLAGKNADYHRADLWNAIESGNGPEWELNAQIFDEDQALAFGFDVLDATKIIPEELAPLQPIGVMKLDTNPVNYFAETEQVMFQPGHIVRGIDFTEDPLLQGRIFSYLDTQLNRHGGPNFEQLPINRPLSPIHNNNRDGAGQNFIHKNTAASDSLDTPNTLNKGYPVQANQTQGKGFFTAPGRKVSGNLVRARASTFSDHWSQPRLFYNSLTKVEQQFLINAIRFETSQLMSETVQKNVLYQLNKISHDIAVRVGRALGLKAPEADDKYYHDNTTAGISIFGTKLPSIATLSVGVLVSINSNNSIQQAKALKKALGEDKVTVSIIGEVLGDDVEVTYSAATAAQFDSVVVTSGTESLFNGTGKSTLFPPGRPTQIIVDGYHWGKPVGFIGGAKAAAQAARVSKGKGVYFPKNVNSLVEDLKDGLATFKFTDRFPLDH

SEQ ID NO: 42845 - DNA, 1506 bp, Aspergillus nidulans FGSC A4
  CDS (1)..(1506)
atgggccaaaacgacgaccaaaagacgtaccgctacaatgaaagcccggtttataccacttccaatggctgtcctgtgatggacccgcaagcttcgcagcgagtagggcccaacggacctctcctcctgcaagacttcaaccttatcgaccttctcgcccactttgaccgtgagcgcattcccgagcgagtggtccatgccaagggtgcaggcgcctacggcgagttcgaagtcaccgacgacatcagcgatatcaccgtcatcgacatgctcaagggcgtcggcaagaagactaaaacctttgtccggttctcaaccgttggaggcgaaaagggctcccctgacagtgcccgcgaccctcgaggctttgcctgcaagttctatactgaggagggcaactgggactgggtcttcaacaacacccccgtcttcttcctccgtgaccctagcaaattccccatgttcatccacacccagaagcgtaatccacagacaaacctgaaagacgccaccatgttctgggactacctttccacccaccaggaggccgttcaccaggtcatgcacctcttttcagaccgcggcactccctactcctaccgtcacatgaacggctactccggtcacacctacaaatggatcaagcccgatggcactttcaactatgtccagctgcacctcaaaacagaccagggcaacaagacgttcacggacgccgaggccacgcgcctggccgccgagaaccctgactggcacactcaggacctcttcaatgccattgcccgcggcgaatacccctcatggacctgctatgttcagaccctgtcaccagagcaagccgagaagttccgctggaacattttcgacctgaccaaggtctggccgcaatccgaagttcccctccgccgcttcggccgcttcacccttaacaagaatcccgagaactacttcgccgaagttgagcaagccgccttctctccctcccaccttgtccccggcgtcgagccctccgccgatcccgtcctccaagcccgcctcttctcttacccggacacccaccgtcaccgcctcggcacgtcgaactatcaatccattcccgtcaactgccccctgcgcgcattcacgcccttccaccgcgacggcgcaatgagcgtgaatggcaaccatggcgcgaatcccaactacccatcgaccttccggccgctgcagtacaagcccgttaaggcgtcccaggagcacgagaagtgggctggctcggtagtaaccgagcagctgcctgttactgatgaggactttgttcaggccaatgggctctggaaagtccttggtcgccagccgggacagcaggagaattttgtgggtaatgttgcgggacacctctgcaatgctcaccctagggtccgccaggcgacatatggcatgttccgccgtgtgaatgctgaccttgggaagaggattgaaaaagccactgagaaaaaagctactgaggccagggctcgtttgtag

SEQ ID NO: 42846 - protein, 501 aa, Aspergillus nidulans FGSC A4
MGQNDDQKTYRYNESPVYTTSNGCPVMDPQASQRVGPNGPLLLQDFNLIDLLAHFDRERIPERVVHAKGAGAYGEFEVTDDISDITVIDMLKGVGKKTKTFVRFSTVGGEKGSPDSARDPRGFACKFYTEEGNWDWVFNNTPVFFLRDPSKFPMFIHTQKRNPQTNLKDATMFWDYLSTHQEAVHQVMHLFSDRGTPYSYRHMNGYSGHTYKWIKPDGTFNYVQLHLKTDQGNKTFTDAEATRLAAENPDWHTQDLFNAIARGEYPSWTCYVQTLSPEQAEKFRWNIFDLTKVWPQSEVPLRRFGRFTLNKNPENYFAEVEQAAFSPSHLVPGVEPSADPVLQARLFSYPDTHRHRLGTSNYQSIPVNCPLRAFTPFHRDGAMSVNGNHGANPNYPSTFRPLQYKPVKASQEHEKWAGSVVTEQLPVTDEDFVQANGLWKVLGRQPGQQENFVGNVAGHLCNAHPRVRQATYGMFRRVNADLGKRIEKATEKKATEARARL

SEQ ID NO: 42847 - DNA, 2235 bp, Aspergillus nidulans FGSC A4
  CDS (1)..(2235)
atggctactagtatcaccgccggcctacaaaaggcccagcaagcagtgcaggacactgccaccaagaacaagaagattgtcgatattagccacgacacagtaaatgtccacacagaccaggagcagcgaacagattttggtgtcgcgatcaccgaccctgatcactggctgcgcgtcaccaacgagacgcactcgggcccctcgctgctagaagaccacatcgcgcgagagcgcatccatcgtttcgaccacgagcgcatccctgagcgcgttgttcatgcccgtggaacgggcgcctacggcaatttcaccctcaaggagagcatcgaagatttgacctatgctggagtgttaacggatacttcgcgcaacaccccggtgttcgtgcgtttctctactgtccagggcagccgggggagtgctgataccgttcgcgatgttcgcgggttcgctgtcaagttctacactgacgagggaaattgggatattgtcggcaacaacatccccgtcttcttcattcaggatgccatcaagttccctgactttgtccacgctgtcaagcccgagcctcacaacgaagtgccccaggcccagacggcccataacaatttctgggactttgtgtacttgcaccccgaagccacgcacatgttcatgtgggcgatgtctgaccgcgccatcccgcggtcctaccgtatgatgcagggtttcggtgttaacacgttctcgctggtcaacaaggagggtaagcgccactttgtcaaattccactggatccctcacctcggagtgcactcgctcgtctgggacgaggccctgaagctggcgggacaggatcccgacttccaccgcaaggacctgatggaggccatcgataacaaggcctatcccaagtgggactttgccatccaggccatccccgaggaggaccaggacaagttcgagtttgacatcttcgatgccaccaaggtctggccggaagagcaggtgcccctgcgtgtggtcggcgagctcgaactgaaccgcaacatcgacgagttcttccccgagactgaacaggtcgccttctgcactagccatatcgtgcctggtatcgacttctctgacgacccgcttctccagggccgcaacttctcatatcaggatacacaaattagtcgtctgggtgtgaactgggaagaaatacccatcaaccgacctgtctgcccgttcctcaaccataaccgggacggagctaaacgccaccgcatcaccaagggcacggtgaactattggcccaaccgcttcgaggccaaccctccagctagcgacaagggcttcaagtcgcacccagccccgattacaggccgcaagcgccgcgatctcacacccaagttcaaggaataccacaaccaggcgcagcttttctataactccctctccgaagtcgagaaggtgcacgtcaagaaggccttttccttcgagcttgaccactgtgacgacccgatcgtttacgagcggctcgcaggccagcgcctcgcagagatcgatctccccctggctcaagccgtggccgagatggtcggcgcgcccatccccacgaaggcactgcgtgataaccacggcaagacctccgtccgtctctcccagttcgacttcactcctaaggctcctggcattatcagccgtcgcattgccatcatcatcggtgacggctacgacaagatcgccttcaatggcatgaaggccgctattctcgccgcgcaagcgctccccttcgtcattggcaccaaacgctccgccatctacgcacagggcgaggataagaatagctctaagggtgtgattcccgaccacatgtatgacggcatgcgctccaccatgttcgacgcgaccttcatccccggcggctcgcacattgagactctccaaaagaacggccagattcggtactggattgccgagacattcgggcacctcaaggcgctcggtgccatgggcgaagccgcgcagctggtcaaggaagttctgggcaatgtgatgggcgtccaaattgccggtgcggactctgctgagcccgtcgaatggtatggtgttgttacagctcgtggaccagagagcgccgagagcctcagtgagggcttcaaggtgctcaaggacgccggtgatttcacaagcaagttcttttaccagatcagtcagcaccgcaactggcagcgtgagttggatggattggcttcgacggttgcgttctaa

SEQ ID NO: 42848 - protein, 744 aa, Aspergillus nidulans FGSC A4
MATSITAGLQKAQQAVQDTATKNKKIVDISHDTVNVHTDQEQRTDFGVAITDPDHWLRVTNETHSGPSLLEDHIARERIHRFDHERIPERVVHARGTGAYGNFTLKESIEDLTYAGVLTDTSRNTPVFVRFSTVQGSRGSADTVRDVRGFAVKFYTDEGNWDIVGNNIPVFFIQDAIKFPDFVHAVKPEPHNEVPQAQTAHNNFWDFVYLHPEATHMFMWAMSDRAIPRSYRMMQGFGVNTFSLVNKEGKRHFVKFHWIPHLGVHSLVWDEALKLAGQDPDFHRKDLMEAIDNKAYPKWDFAIQAIPEEDQDKFEFDIFDATKVWPEEQVPLRVVGELELNRNIDEFFPETEQVAFCTSHIVPGIDFSDDPLLQGRNFSYQDTQISRLGVNWEEIPINRPVCPFLNHNRDGAKRHRITKGTVNYWPNRFEANPPASDKGFKSHPAPITGRKRRDLTPKFKEYHNQAQLFYNSLSEVEKVHVKKAFSFELDHCDDPIVYERLAGQRLAEIDLPLAQAVAEMVGAPIPTKALRDNHGKTSVRLSQFDFTPKAPGIISRRIAIIIGDGYDKIAFNGMKAAILAAQALPFVIGTKRSAIYAQGEDKNSSKGVIPDHMYDGMRSTMFDATFIPGGSHIETLQKNGQIRYWIAETFGHLKALGAMGEAAQLVKEVLGNVMGVQIAGADSAEPVEWYGVVTARGPESAESLSEGFKVLKDAGDFTSKFFYQISQHRNWQRELDGLASTVAF

SEQ ID NO: 42849 - DNA, 2169 bp, Aspergillus nidulans FGSC A4
  CDS (1)..(2169)
atgcgagctctcggcctggtcggccttgttggcgtcgccaatgccgtctgtccgtatatgacaggcgagctcggccgtcgcgataccaaccccgatgctaccgaggccactgaggaatttctgtccgagtactaccttgacgacacggactcgtacctgacgactgacgtcggcggcccaattgaggaccagcagagtctcaaggccggtgcgcgcgggtctaccctgctggaagactttatcttccgtcagaagatccagcgattcgaccacgagcgggtccccgagcgtgccgtccatgctcggggtgcaggtgcccacggtgtcttcacctcgtacggcgacttctccaacatcaccgccgcctccttcctctctgctgagggtaaggagacccccgtcttcgtccggttctcgaccgtcgccggcagtcgtggcagttctgacctcgcccgcgatgtccacggtttcgccacccgcttttacactgacgagggcaactttgatatcgtcggtaacaacattcccgtctttttcatccaggatgccatccagttccccgacctgatccacgccgtcaagcccaagggcgatcgtgaaatcccgcaggctgccacggcccatgacgccgcctgggatttcttcagccagcagccctcgactcttcacaccctgctctgggccatggccggtcacggtatcccgcgttcgttccgccacgtcgatgggttcggtgtgcacactttccggctcgtcacggaggatggctccaccaagctcgtcaagttccactggaagaccctgcaaggtttggcaagtatggtctgggaggaagctcagcaaatttctggcaagaaccccgactacatgcgccaggatctgttcgagtcgattgaggctggccggtaccctgagtgggagcttaacgtgcaaatcatggacgaggaggaccagttgcgctttggcttcgaccttttcgaccctaccaagattgtccctgaggaatacgtcccattgaccccgctgggcaagatgaccctcaaccgcaacccccgcaactactttgccgagactgagcaggtcatgttccaacccggccacgtcgtgcgtggtgttgacttcaccgaggatccccttcttcagcagggacgtcttttcagctaccttgacacccagctcaaccgcaatggtggcccgaactttgagcagttgcccatcaaccagccgcgcgttgctattcacaacaacaaccgtgacggtgctggccagatgttcattccgctgaaccccgatgcgtacagccccaacacgctgaagggatcaaccctcaaacaggccaaccagactgcgggtcgcggattctttactgctcctgaccgtactgccaacggcaatcttgtgcgtgccaagagctccaccttcgatgatgcttggtcgcagccccggcttttctggaactctcttcttcccgccgagaagcagttcgtggtcaacgccattcgcttcgaaaacgccaatgtgaagagcgatgtcgtgaagaacaacgtcatcgttcagcttaatcgaatctcgaacgaccttgccacccgcgttgccaaggccatcggtgttgatgctcccgagcccgacaacacttactaccacgacaacacgacctccaacatcggtgcgtttggccaccgactccagagcttggctggcctgaagattgccgtacttgcttctgttgacgcagaggaatccttcagcgcggctactgctctgaaggccgagctctccaacgacaacctggacgtcattgtcgtcgctgaacgcttctccaacggcgtgaaccagacctactctgcctctgacgccattcagtttgacgccgtcgttgttgcccctggagcggagaagctcttcggtgccaagtccgcggccaactccagctcaaccctctaccctgccggccgtcccctcgaaatcctcgttgatgctttccgcttcggtaagccagtcgctgctcttggcagcggctccactgctttcgacaacgctggtatcaacaccgccgtcgagggcgtgtacgttgccgatgccgtggacgagagctttgccaacaacctcgaggagggtctgaccgtgttcaagttcttggatcgctttgccctggactcggatgaatag

SEQ ID NO: 42850 - protein, 722 aa, Aspergillus nidulans FGSC A4
MRALGLVGLVGVANAVCPYMTGELGRRDTNPDATEATEEFLSEYYLDDTDSYLTTDVGGPIEDQQSLKAGARGSTLLEDFIFRQKIQRFDHERVPERAVHARGAGAHGVFTSYGDFSNITAASFLSAEGKETPVFVRFSTVAGSRGSSDLARDVHGFATRFYTDEGNFDIVGNNIPVFFIQDAIQFPDLIHAVKPKGDREIPQAATAHDAAWDFFSQQPSTLHTLLWAMAGHGIPRSFRHVDGFGVHTFRLVTEDGSTKLVKFHWKTLQGLASMVWEEAQQISGKNPDYMRQDLFESIEAGRYPEWELNVQIMDEEDQLRFGFDLFDPTKIVPEEYVPLTPLGKMTLNRNPRNYFAETEQVMFQPGHVVRGVDFTEDPLLQQGRLFSYLDTQLNRNGGPNFEQLPINQPRVAIHNNNRDGAGQMFIPLNPDAYSPNTLKGSTLKQANQTAGRGFFTAPDRTANGNLVRAKSSTFDDAWSQPRLFWNSLLPAEKQFVVNAIRFENANVKSDVVKNNVIVQLNRISNDLATRVAKAIGVDAPEPDNTYYHDNTTSNIGAFGHRLQSLAGLKIAVLASVDAEESFSAATALKAELSNDNLDVIVVAERFSNGVNQTYSASDAIQFDAVVVAPGAEKLFGAKSAANSSSTLYPAGRPLEILVDAFRFGKPVAALGSGSTAFDNAGINTAVEGVYVADAVDESFANNLEEGLTVFKFLDRFALDSDE

SEQ ID NO: 42851 - DNA, 1524 bp, Candida glabrata CBS138
  CDS (1)..(1524)
atgtccgctaatccaactaacacttccgatgttagaggtgacagagttgtcactaactctacaggttacccatacaatgacccatttgctactcaaagagttggtcaacacggcccattgttgatgcaagatgctaacttgatcgactccttggcccacttcaacagagagagaatcccagaaagaaaccctcacgcccacggttctggtgcctttggttactttgaagtcactgatgatattactgacatctgtggttctgccatgttctccgaaattggtaagagaaccagattcttgaccagattctccactgtcggtggtgaaaagggttctgcagacaccgccagagacccaagaggttttgctaccaagttctacactgaagaaggtaacttggactgggtttacaacaacactccaattttcttcatcagagacccatctaagttcccacatttcatccacacccaaaagagaaacccacaaactaacttgaaggacccaaacatgttctgggattacttgaccactccagaaaaccaagttgctgtccaccaattgatgatcctgttctccgacagaggtaccccagcttcttacagacacatgaacggttactccggtcacacttacaagtggtccaacaagaagggtgaatggcactatgtccaagttcacatcttgactgaccaaggtatcaaaaacttgaccaatgatgaagctgttgaaatcgctggtaagaacccagactactgtcaacaagacttgtacgaaaacatcgccaagggtaactacccatcctggactgtttacatccaaactatgaccgaagaacaagccaagaagttgccattctctgtcttcgacttgaccaaggtctggccacacaaggacttcccattgcgtagagtcggtaagatggtcatgaacgaaaacccattgaattactttgcttccatcgaacaagctgctttctccccagccaacactgttccataccaagaaccatctgctgacccagttctacaatctcgtttgtttgcttacgctgatgctcaccgttacagattgggtgctaacttccaccaaatccctgtcaactgcccatacgcctccaagttcttcaacccagttattagagacggtccaatgaacgttgatggtaacttcggtaacgaaccaaactactacgcttccaacaagcaataccaaattccaaaccaagacagaccaatccaacaacaccaagaagtctggaacggtccagctcaaccattccactgggctacttctccaggcgacatcgacttcgtccaagccagagacttgtacaaggtcttgggtaagcaaaaggaccaacaagagcacttggcttacaacatcggtactcacgttgctggtgctgacccagagatccaacaacgtgttatcgacatgttctctcgtgttgatgaaggtctaggtgctaacatcagaaaggagatcgaaaagaacgccagcgccccaactgctaagatctaa

SEQ ID NO: 42852 - protein, 507 aa, Candida glabrata CBS138
MSANPTNTSDVRGDRVVTNSTGYPYNDPFATQRVGQHGPLLMQDANLIDSLAHFNRERIPERNPHAHGSGAFGYFEVTDDITDICGSAMFSEIGKRTRFLTRFSTVGGEKGSADTARDPRGFATKFYTEEGNLDWVYNNTPIFFIRDPSKFPHFIHTQKRNPQTNLKDPNMFWDYLTTPENQVAVHQLMILFSDRGTPASYRHMNGYSGHTYKWSNKKGEWHYVQVHILTDQGIKNLTNDEAVEIAGKNPDYCQQDLYENIAKGNYPSWTVYIQTMTEEQAKKLPFSVFDLTKVWPHKDFPLRRVGKMVMNENPLNYFASIEQAAFSPANTVPYQEPSADPVLQSRLFAYADAHRYRLGANFHQIPVNCPYASKFFNPVIRDGPMNVDGNFGNEPNYYASNKQYQIPNQDRPIQQHQEVWNGPAQPFHWATSPGDIDFVQARDLYKVLGKQKDQQEHLAYNIGTHVAGADPEIQQRVIDMFSRVDEGLGANIRKEIEKNASAPTAKI

SEQ ID NO: 42853 - DNA, 1653 bp, Kluyveromyces lactis NRRL Y-1140
  CDS (1)..(1653)
atgccttctgaatactcttcacctccagtttactccacttcaaatgggtttaaatactctcatcatccatacggtgcacaatactcgcgtccagatggtccacttttactacaggataaccatttgatagaatctctagctagattcgatagggaaagaattcccgaaagagttgtccatgccaaaggtggcggatgtcatatcgaatttgaactcactgattcgttatctgacatcacatatgcagcaccataccaatctcccggttacaagtgtcctggtatcataagatgcagtaccgttggcggtgaatcaggggctccagatacagccagagatccaagaggtttcagtttcaagttttacacgaaatgggggaaccatgactgggtgttcaacaatacaccggtgttcttcatcagagatgcaaacaagttccctcattttattcacactcaaaagagatccccaaggaatcatttgggacaggcttctgatacttccatgtattgggattatttgactcaaaatatcgagtccatccatcaaatcacgtatatgttcggtgatagaggcactccagcttcttggtctgacatgagtgcatattccggtcacacttataagtttatcaatgctgaaggtaagttgacttacgtgcaaattcatgtgttaccagagaatggattcaagactctttcattggaagaagccaataagttagctggtgaaaatcctgattataataaccaattgttgttcgaaaagctagaagccggtgaacgtccaaaatttaattgctatgttcagacgatgacccctgagcaagcagaaaatttcaggtattccattaacgatttgaccaagatttggccacataaggaattcccattgcgcaagttcggtaccattaccctaacccataacgtcgataactatttcgaagaaatcgagcaacttgctttctctccatcaaacacctgtattccaggtatcgagccatccaacgattctgtcttgcaatccagattattctcgtacccagacactcaacgtcacagacttggtaccaactttatgcagttaccagtcaatagacccgtgaatatgggtagagaagcttgtccatttgcaggtgcgaatttccaaagagatgggccaatgtgtatgttcaacttcaaggaccaaccaaactatatcgcttcttccggtaaaaaccttgttcagttcaacacattggatgacaacaatgccaagtcaacgcacgaaagatttactggtgttgtattagaagaggatgttgtcgctgaaataaagagacaagaagaaaaccgtgtagaacatgaacgtgttgttaacggtaagatcaacgaatattatattgtcaatggtgcatctccagtcgatttggaacaaccaagagctctatacgaaaaggtgtacaacgacaaggataagaagacattcgtcaaaaacgttgttgcacatgcttctaagatctccaatccggaaattaagactcgtgtgtctcaatacttcggtcttttgaatgaagatttgggtaaacagatcgctgaaggccttgaaatccaatgggagccagtttctttcgaaacatatgcccggagaatcagtatcgccagtgctttctaa

SEQ ID NO: 42854 - protein, 550 aa, Kluyveromyces lactis NRRL Y-1140
MPSEYSSPPVYSTSNGFKYSHHPYGAQYSRPDGPLLLQDNHLIESLARFDRERIPERVVHAKGGGCHIEFELTDSLSDITYAAPYQSPGYKCPGIIRCSTVGGESGAPDTARDPRGFSFKFYTKWGNHDWVFNNTPVFFIRDANKFPHFIHTQKRSPRNHLGQASDTSMYWDYLTQNIESIHQITYMFGDRGTPASWSDMSAYSGHTYKFINAEGKLTYVQIHVLPENGFKTLSLEEANKLAGENPDYNNQLLFEKLEAGERPKFNCYVQTMTPEQAENFRYSINDLTKIWPHKEFPLRKFGTITLTHNVDNYFEEIEQLAFSPSNTCIPGIEPSNDSVLQSRLFSYPDTQRHRLGTNFMQLPVNRPVNMGREACPFAGANFQRDGPMCMFNFKDQPNYIASSGKNLVQFNTLDDNNAKSTHERFTGVVLEEDVVAEIKRQEENRVEHERVVNGKINEYYIVNGASPVDLEQPRALYEKVYNDKDKKTFVKNVVAHASKISNPEIKTRVSQYFGLLNEDLGKQIAEGLEIQWEPVSFETYARRISIASAF

SEQ ID NO: 42855 - DNA, 1674 bp, Debaryomyces hansenii CBS767
  CDS (1)..(1674)
atggtttctgaatacattcaaaatacgaagaaagatccagcagtgtactcaacctccaatggagttccttatgccaatcatccatatggtgcccaaacggcaggccctggcgggccactattattgcaagattttaatttgatggacgacatttctcacttcgatcatgaaagaatcccagaaagagttgttcacgcaaaaggtggtggtgctcacggatatttcgaattgactgattcattgtctgatttaacttatgcccgtccattacaatccccaggctataaatgtcctgtatcagttagattctctacagttggaggtgaaaggggtacaccggacacaataagagatccaagggggttctcaattaaattgaaaactgacattggtaatatggattgggtttttaacaatacaccaatcttctttattagagacccgattaagttctccaaatttattcacacccaaaagagagatccatctacaaaccttaatcaattaactgatccataccatacttgggactactttattcagaatcctgaatgcttacatcaaataacttacatgtttggtaaaaggggtattccaaagagttgggccgaaatgcacggatattcgggtcatacatttaaactaattaacgataaagatgaaattacttatattcagatccattgtcttgctgatggaggttttgacggctttagtgacaaagaaggtaaagagttggctggttcatcacctgaatacaacactaaggatttatatgaaagaattgctgctggtaattatccatcatattcattttatgttcaaacgatgacacctaaacaagctgaagaatttcgttattctatcaatgatttaacaaaagtatggcctcacaaagaattcccattaagaaagtttggccgcatggttttagataagaatccggtaaattaccacgatgaaattgaacaaattgccttttcacctgctcatttagttcccggaattgagccttcaaatgatcctgttttacaatctaggttatactcttactctgatacacatcgtcatagattaggcgccaattaccaacagttaccggttaacaaaccaaggacatttgatagtaattctggatgtccatttttagcaggtaattttcaaagagaagggattgcatctattgataatcaaggatctagacctaattatttgagttcgttattacctattaattctgtctcgaacgatccaaagtcatacaagaatggattaccacctgttgaagaaaaaaagtatttaggtgttgttccgaaacgatctactgataaatatgaaattttacagaaagaacgtaatttgaaggcacatgaagaaaaaatttggctcaaatcgtatgactatatttctggatttagtgagctagatgttgaacagccaagagccctttataaaaatattattagtaagcaagataaaggggatttcatagaagctattgttggacatgcatcgaaaataagtgttcctcaaataaaagaaagagtacctcagttatggggtttgatagacggggatttaggaagtgaagttgctaaaggtttaggagtaagttacaagcatcttactgttgacgaatatatcgaagatcttggaatagctcctgctaactaa

SEQ ID NO: 42856 - protein, 557 aa, Debaryomyces hansenii CBS767
MVSEYIQNTKKDPAVYSTSNGVPYANHPYGAQTAGPGGPLLLQDFNLMDDISHFDHERIPERVVHAKGGGAHGYFELTDSLSDLTYARPLQSPGYKCPVSVRFSTVGGERGTPDTIRDPRGFSIKLKTDIGNMDWVFNNTPIFFIRDPIKFSKFIHTQKRDPSTNLNQLTDPYHTWDYFIQNPECLHQITYMFGKRGIPKSWAEMHGYSGHTFKLINDKDEITYIQIHCLADGGFDGFSDKEGKELAGSSPEYNTKDLYERIAAGNYPSYSFYVQTMTPKQAEEFRYSINDLTKVWPHKEFPLRKFGRMVLDKNPVNYHDEIEQIAFSPAHLVPGIEPSNDPVLQSRLYSYSDTHRHRLGANYQQLPVNKPRTFDSNSGCPFLAGNFQREGIASIDNQGSRPNYLSSLLPINSVSNDPKSYKNGLPPVEEKKYLGVVPKRSTDKYEILQKERNLKAHEEKIWLKSYDYISGFSELDVEQPRALYKNIISKQDKGDFIEAIVGHASKISVPQIKERVPQLWGLIDGDLGSEVAKGLGVSYKHLTVDEYIEDLGIAPAN

SEQ ID NO: 42857 - DNA, 1458 bp, Debaryomyces hansenii CBS767
  CDS (1)..(1458)
atggctcctgtttacactaactccaacggatgtccaatcccagaaccatttgctactcaaagagttggccaacatggtccattattattgcaagatttcaatcttattgattctttagcacacttcgacagagaaagaatcccagaaagagttgtgcacgccaagggatctggtgcttacggttactttgaagtgactgacgatattagtgatgtttgtagtgctgcatttttggatactattggtaaaaagaccaaggttttaaccagattctccaccgttggtggtgaatctggttctgctgacagtgctagagatccaagaggattttctactaagttgtataccgaggaaggtaacttggatttagtgtacaacaacaccccagttttcttcattagggacccatccaagttccctcacttcatccatacccaaaagagaaacccagaaactcacttgaaggacccaaccatgttctgggactacttgacttctaatcaagaatccatccaccaagttatgactcttttctccgaccgtggtactccagctagttacagagaaatgaacggttactctggtcacacttacaagtggtccaacaagaagggtgaatggtactacgtccaagtccacttcatctccgatcaaggtgtcaaaaccttgaccaacgaagaagcaggcgaattggcaggttccaatccagattttgctcaagaagacttgttcaaagaaattgccaagggtaatgcgccatcctggacttgttacatccaaaccatgactcaagaacaagctaagaaggcaccattctccgtcttcgacttaaccaaggtctggccacataaggattacccaatgagaagattcggtaaattagtcttgaacgaaaacccaaagaactactttgccgaaattgagcaagctgcatttgcacctgctcacaccgttccttacatggaagcttctgctgatccagtcttgcaatcaagattattctcttacgctgatacacacagacacagattaggtaccaattacacccaaattcctgttaactgtccaatcactggtcgtgttttcaatccacatatgagggatggtggtatgaatgttaacggtaacttaggatcacatccaaactatttagccacttccaaaccagttgaattcaagaattttagcatacaagaagaacaagaagtttgggaaggggctgcttgtccattccactggaaatgtactgacaaggattactcccaagctactgctttatacaatgttttagctaagtatccaaaccaacaaaagaacttagctcacaacgttgctgttcatgtttctggcgctgaaactcatatccaagacaaggtctttgatatgttcgcaaaggtccacccagaattatccgccaacattaagaaggaagctttacaactttctccaagaaagtaa

SEQ ID NO: 42858 - protein, 485 aa, Debaryomyces hansenii CBS767
MAPVYTNSNGCPIPEPFATQRVGQHGPLLLQDFNLIDSLAHFDRERIPERVVHAKGSGAYGYFEVTDDISDVCSAAFLDTIGKKTKVLTRFSTVGGESGSADSARDPRGFSTKLYTEEGNLDLVYNNTPVFFIRDPSKFPHFIHTQKRNPETHLKDPTMFWDYLTSNQESIHQVMTLFSDRGTPASYREMNGYSGHTYKWSNKKGEWYYVQVHFISDQGVKTLTNEEAGELAGSNPDFAQEDLFKEIAKGNAPSWTCYIQTMTQEQAKKAPFSVFDLTKVWPHKDYPMRRFGKLVLNENPKNYFAEIEQAAFAPAHTVPYMEASADPVLQSRLFSYADTHRHRLGTNYTQIPVNCPITGRVFNPHMRDGGMNVNGNLGSHPNYLATSKPVEFKNFSIQEEQEVWEGAACPFHWKCTDKDYSQATALYNVLAKYPNQQKNLAHNVAVHVSGAETHIQDKVFDMFAKVHPELSANIKKEALQLSPRK

SEQ ID NO: 42859 - DNA, 1479 bp, Oryza sativa (japonica cultivar-group)
  CDS (1)..(1479)
atggatccttgcaagttccggccgtcgagctcgttcgacacgaagacgacgacgacgaacgcgggagctccggtgtggaacgacaacgaggcgctgacagtggggcccagggggccgatcctcctcgaggactaccacctgatcgagaaggtggcgcacttcgcccgggagcgcatcccggagcgcgtggtccacgcccgcggcgcctccgccaagggcttcttcgagtgcacccacgacgtcaccgacatcacctgcgccgacttcctccggtccccgggcgcccagacccccgtcatcgtccgcttctccaccgtcatccacgagcgcggcagcccggagacgatccgcgacccgcgcgggttcgccgtcaagttctacacccgcgagggcaactgggacctcctcggcaacaacttccccgtcttcttcatccgcgacggcatcaagttccccgacgtcatccacgccttcaagcccaacccgcgctcccatgtccaggagtactggagggtcttcgacttcttgtcccaccaccccgagagcctccacaccttcttcttcctcttcgacgacgtcggcatccccaccgattaccgccacatggacggcttcggcgtcaacacctacaccttcgtcacccgcgacgccaaggccaggtacgtcaagttccactggaagcccacctgcggcgtcagctgcttgatggacgacgaggccacgctcgtcggcggcaagaaccacagccacgccacccaggacctctacgactccatcgccgccggcaacttccccgagtggaagctgttcgtccaggtgatcgacccggaggaggaggagaggttcgacttcgacccgctggatgacaccaagacatggccggaggacgaggtgccgctccggcccgtggggcgcctcgttctcaaccgcaacgtcgacaacttcttcaacgagaacgagcagctggcgttcgggccggggctggtggtgccggggatctactactccgacgacaagatgctgcagtgcagggtgttcgcgtacgccgacacgcagcgctacaggctggggccaaactacctgatgctgccggtgaacgcgcccaagtgcgcccaccacaacaaccactacgacggcgccatgaacttcatgcaccgggacgaggaggtggactactacccatcgcgccacgcgccgctccgccacgcgccgccgacgcccatcacgccgcgccccgtggtggggaggaggcagaaggcgacgatacacaagcagaacgacttcaagcagcccggggagaggtacaggtcgtgggcgccggatagacaggagaggttcatccgccgcttcgccggcgagctcgcgcaccccaaggtctcccctgagctccgcgccatctgggtcaactacctctcccagtgtgatgagtcgttgggggtgaagattgcgaataggctcaacgtgaagccaagcatgtga

SEQ ID NO: 42860 - protein, 492 aa, Oryza sativa (japonica cultivar-group)
MDPCKFRPSSSFDTKTTTTNAGAPVWNDNEALTVGPRGPILLEDYHLIEKVAHFARERIPERVVHARGASAKGFFECTHDVTDITCADFLRSPGAQTPVIVRFSTVIHERGSPETIRDPRGFAVKFYTREGNWDLLGNNFPVFFIRDGIKFPDVIHAFKPNPRSHVQEYWRVFDFLSHHPESLHTFFFLFDDVGIPTDYRHMDGFGVNTYTFVTRDAKARYVKFHWKPTCGVSCLMDDEATLVGGKNHSHATQDLYDSIAAGNFPEWKLFVQVIDPEEEERFDFDPLDDTKTWPEDEVPLRPVGRLVLNRNVDNFFNENEQLAFGPGLVVPGIYYSDDKMLQCRVFAYADTQRYRLGPNYLMLPVNAPKCAHHNNHYDGAMNFMHRDEEVDYYPSRHAPLRHAPPTPITPRPVVGRRQKATIHKQNDFKQPGERYRSWAPDRQERFIRRFAGELAHPKVSPELRAIWVNYLSQCDESLGVKIANRLNVKPSM

SEQ ID NO: 42861 - DNA, 1626 bp, Oryza sativa (japonica cultivar-group)
  CDS (1)..(1626)
atggatccctacaagcaccgcccgtcgagctcgttcaacggcccgctgtggagcaccaactccggcgcccccgtatggaacaacaacaactcgctcaccgtcggctcccgaggcccgatccttctggaggactaccacctggttgagaagctggccaacttcgacagggagcgtatcccggagcgcgtggtgcacgcccgcggcgccagcgccaagggcttcttcgaggtcacccacgacatcacccacctcacctgcgccgacttcctccgcgccccgggcgtccagaccccggtcatcgtccgcttctccaccgtcatccacgagcgcggcagcccggagaccctccgcgacccgcgtggcttcgccatcaagttctacacccgggagggcaactgggacctcgtcggcaacaacttccccgtcttcttcatccgcgacggcatgaagttcccggacatggtgcactcgctcaagcccaaccccaagtcgcacgtccaggagaactggcgcatcctcgacttcttctcccaccacccggagagcctccacatgttcaccttcctcttcgatgacatcggcatccccgccgactaccgccacatggacggctccggcgtcaacacctacacgctcgtcaaccgcgccggcaagtcgcactacgtcaagttccactggaagcccacctgcggcgtcaagtcgctgctcgacgacgaggccgtcaccgtcggcgggaccaaccacagccacgccacgcaggacctctacgactccatcgccgccggcaacttcccggagtggaagctgttcatccagaccatcgaccccgaccacgaggaccgcttcgacttcgacccgctcgacgtcaccaagacgtggcccgaggacatcgtcccgctgcagcccgtggggaggatggtgctcaaccgcaacatcgacaacttcttctcggagaacgagcagctggcgttctgccccgggatcatcgtgccggggatctactactccgacgacaagctgctgcagacgaggatcttctcctactccgacacgcagcgccaccgcctcggaccaaactacctgctgctcccgcccaacgcgcccaagtgcgcccaccacaacaaccactacgacggcttcatgaacttcatgcaccgcgacgaggaggtcgactacttcccatcccgctacgatcctgccaagcacgccccccgctaccccatcccctccgccaccctcaccggccgccgcgagaaggtggtgattgccaaggagaacaacttcaagcagccaggggagaggtaccgttcatgggatccggcaaggcaagaccggttcatcaagagatggatcgacgcactctctgaccctcgcctcacccacgagatcaggagcatctggctctcctactggtctcaggctgacaggtctctgggtcagaaactggcgagccgtctcagcgcgaagccgagcatggcgcaagtgcatgaggacatcacagacgggctcaccgaaggcgacgatgaagtcgtgcgaagccgacgcggggtgcggtggtggatgctgtggcggcgaaggaggcttggaagaaacggcatcgcggtggggaggaaggagataaagtaa

SEQ ID NO: 42862 - protein, 541 aa, Oryza sativa (japonica cultivar-group)
MDPYKHRPSSSFNGPLWSTNSGAPVWNNNNSLTVGSRGPILLEDYHLVEKLANFDRERIPERVVHARGASAKGFFEVTHDITHLTCADFLRAPGVQTPVIVRFSTVIHERGSPETLRDPRGFAIKFYTREGNWDLVGNNFPVFFIRDGMKFPDMVHSLKPNPKSHVQENWRILDFFSHHPESLHMFTFLFDDIGIPADYRHMDGSGVNTYTLVNRAGKSHYVKFHWKPTCGVKSLLDDEAVTVGGTNHSHATQDLYDSIAAGNFPEWKLFIQTIDPDHEDRFDFDPLDVTKTWPEDIVPLQPVGRMVLNRNIDNFFSENEQLAFCPGIIVPGIYYSDDKLLQTRIFSYSDTQRHRLGPNYLLLPPNAPKCAHHNNHYDGFMNFMHRDEEVDYFPSRYDPAKHAPRYPIPSATLTGRREKVVIAKENNFKQPGERYRSWDPARQDRFIKRWIDALSDPRLTHEIRSIWLSYWSQADRSLGQKLASRLSAKPSMAQVHEDITDGLTEGDDEVVRSRRGVRWWMLWRRRRLGRNGIAVGRKEIK

SEQ ID NO: 42863 - DNA, 1599 bp, Yarrowia lipolytica CLIB99
  CDS (1)..(1599)
atgtccaaagaactctacgccaactccaaggacgacgctgtctactcctactcctttggagttccttacccccaccatccctactcatctcagcgggccggccctaccggccctctgctgctccaggacacctatctgattgacgctctggcccatttcgaccgagagcgaatccccgagcgagtcgtccatgccaacggaggaggagcccatggctactttgaggtgaccgatgacatctccgacatcacatacgccgagcccttccagaagattggctacaaatgccccaccaccgtgcgattttctaccgttggtggtgagcgaggctctcccgacactgctcgagacccccgaggtttcgctgtcaagcacaagaccgactggggtaactgggacatggttggtctcaactctcctgttttcttcattcgagatcctgtcaagttcatccatgtcaaccactctcagaagcgagacccccagaccaacctgactgccggagatgatgcctctaactactggaactatctggtccagaaccccgagtctctgcatcaggtggtgtacatgtttggagaccgaggtacccccaatggatggcgacacatgaactgcttctccactcatacttacaagatgatcaacaaggagggcaagctgacctacgtccagttccactacaagtccgaccagggagtcaagaacttcaccggacccgaggctgctgagatggctggaaagagcccggaccacgaccagaaggatctcttctttgccatcgataacggagactacccctcctggaccgtttcccttcagaccatgactcccgagcaggccgaggaatgggaatactccattctggatatgaccaagacctggccctatgacaagttccctctgcgaaaggtcggaaagctggtgctcaacaagaacgccgagaacttctttgaggagattgagcaggccgccttctctccctccaacctgatccacggtatcgaagcctctgatgatcctgttctccaggcccgactcttctcttaccccgatactgctcgacatcgactgggtcccaacttcaaccagctgcctgtcaaccaggcccgaaccttccaaaagggatctggctgcccattcatggccggaaacttccagcgagacggaaacatggccatccacaaccagggcaaccgacccaactacctgtcgacgatccgacccatccagtccgtgtccgtacccaacgaggacttcaagaacactcacgattactgcggagtggtcaccaaggagatggaggacgaatccttcaaggtccaggccgaggctgccaagaagcacaacgagaagatctgggagagctcgtcatacctgtacttgtctggtttccaggagagcgatgcagcccaaccccgagacctgtacgagagagtgtacgacgatgctgccaagcagcgaatgattgacaacgttgttgaccatgcctccaccatcaagcagcacggtctcaaggagcaggtcgccaagtactttggccgaatcagcgacgatcttggcaagaagatcgccgagggtcttggtgttccttactaa

SEQ ID NO: 42864 - protein, 532 aa, Yarrowia lipolytica CLIB99
MSKELYANSKDDAVYSYSFGVPYPHHPYSSQRAGPTGPLLLQDTYLIDALAHFDRERIPERVVHANGGGAHGYFEVTDDISDITYAEPFQKIGYKCPTTVRFSTVGGERGSPDTARDPRGFAVKHKTDWGNWDMVGLNSPVFFIRDPVKFIHVNHSQKRDPQTNLTAGDDASNYWNYLVQNPESLHQVVYMFGDRGTPNGWRHMNCFSTHTYKMINKEGKLTYVQFHYKSDQGVKNFTGPEAAEMAGKSPDHDQKDLFFAIDNGDYPSWTVSLQTMTPEQAEEWEYSILDMTKTWPYDKFPLRKVGKLVLNKNAENFFEEIEQAAFSPSNLIHGIEASDDPVLQARLFSYPDTARHRLGPNFNQLPVNQARTFQKGSGCPFMAGNFQRDGNMAIHNQGNRPNYLSTIRPIQSVSVPNEDFKNTHDYCGVVTKEMEDESFKVQAEAAKKHNEKIWESSSYLYLSGFQESDAAQPRDLYERVYDDAAKQRMIDNVVDHASTIKQHGLKEQVAKYFGRISDDLGKKIAEGLGVPY

SEQ ID NO: 42865 - DNA, 1479 bp, Yarrowia lipolytica CLIB99
  CDS (1)..(1479)
atgtctggaaaacgagtccccacttacaccaccactaacggtaaccccgtcaaggaccccctcgcctcccagcgaatcggcaagcacggacctctcctgctccaggactttgccctgatcgacctgctcgcccacttcgaccgagagcgaatccccgagcgagttgtccacgctaagggatccggtgcttacggagagttcgaggtcactgacgatatcaccgacctcaactgcgccgatttcttgtccaagatcggtaagaagaccaagaccttcactcgattctccaccgttggaggagagaagggatccgccgatgctgctcgagacccccgaggtttcgccaccaagttctacaccgacgagggaaacattgactgggtctacaacaacacccccgtctttttcatcagagacccctccaagttccccgttttcatccacactcagaagcgaaaccccgagaccaacctcaaggacgccactatgatgtgggactacattgccaacaaccaggagtgttgccaccagatcatggtcctcttctccgaccgaggtactcccgctaactaccgacagatgaacggttactccggccacacctacaagtggatcaagaaggatggctctttcaactacgtccagatccacatgaagaccgaccagggcatcaagaacctcaccaatgacgaggctgtcgctctctccggaaccaaccccgaccacgcccaggaagacctcttcaactccatcaagagtggctctttcccctcttggacttgttacgtccaggtctgcacccccgagcaggctgagaagctcaagtggtccgtctttgacctcaccaaggtctggcctcacgaccagttccctctcagacgattcggtaagctcactcttaacaagaacgtccagaactacttcgctgagaccgagcaggctgccttctctccctccaacaccgtccccggctgggagacctcggccgatcccgtcctgcagtctcgactcttctcttatcccgatactcagcgacaccgactcggtaccaacttcgcccagatccccgtcaactgtccctaccatgcccatactccttaccaccgagatggtcagatggctgttaacggcaactccggctctctgcccaactacccctcttctttcgagcccctgcagtaccgacaggacatcaacctgcatgagaagcacgagaagtgggttggtgaggccgtcgcctaccagtgggttgtcggcaccgacggtgttgacttccagcagcccgctgagctctggaaggttcttggaaagaccccagaccagcaggaacaccttgtttacaacatcgctgtctctctgtccggtgctcgacccgaggtccaggacaagacctttggcatgttcgacaaggtcgatgctcacttcggtaagctcgtccgagacgctactcttcagcgatctcctcgatccaagctttaa

SEQ ID NO: 42866 - protein, 492 aa, Yarrowia lipolytica CLIB99
MSGKRVPTYTTTNGNPVKDPLASQRIGKHGPLLLQDFALIDLLAHFDRERIPERVVHAKGSGAYGEFEVTDDITDLNCADFLSKIGKKTKTFTRFSTVGGEKGSADAARDPRGFATKFYTDEGNIDWVYNNTPVFFIRDPSKFPVFIHTQKRNPETNLKDATMMWDYIANNQECCHQIMVLFSDRGTPANYRQMNGYSGHTYKWIKKDGSFNYVQIHMKTDQGIKNLTNDEAVALSGTNPDHAQEDLFNSIKSGSFPSWTCYVQVCTPEQAEKLKWSVFDLTKVWPHDQFPLRRFGKLTLNKNVQNYFAETEQAAFSPSNTVPGWETSADPVLQSRLFSYPDTQRHRLGTNFAQIPVNCPYHAHTPYHRDGQMAVNGNSGSLPNYPSSFEPLQYRQDINLHEKHEKWVGEAVAYQWVVGTDGVDFQQPAELWKVLGKTPDQQEHLVYNIAVSLSGARPEVQDKTFGMFDKVDAHFGKLVRDATLQRSPRSKL

SEQ ID NO: 42867 - DNA, 1458 bp, Desulfovibrio vulgaris subsp. vulgaris str. Hildenborough
  CDS (1)..(1458): transl_table=11
gtggacaagaagcgattgacgaccaacgccggcgctcccgtcgcagacaaccagaacgtcatgacggcggggccgcgcggccctcaactgctgcaagacgtatggttccttgagaaactcgcccacttcgaccgggaggtcatccccgaaaggcggatgcacgccaaggggtcgggggccttcggcacgttcaccgtgacccacgacatcacgcgctacacccgcgccgccatattctctgaagtgggcaagaagacggacctgttcgtgcgcttctcgaccgtggcgggcgaacgcggcgcagccgacgccgaacgcgacatccgtggcttcgccgtcaagttctacaccgaacagggcaactgggacatggtgggcaacaacactcccgtgttcttcctgcgcgacccgctcaaattccccgacctcaaccacgccgtgaagcgcgacccgcgcaccaacctgcgcagcgcacgcaacaactgggacttctggaccagcctgcccgaggccctgcatcaggtcacggtcgtcatgagcgaccggggcattcccgccacctatcgccacatgcacggcttcggcagccacaccttcagcttcatcaacgcaaagggtgaacgcttctggtgcaagttccacttcaagacgcagcagggcatcaagaacctgacggatgccgaagccgaggccatcgtcggcaaatgccgtgaaagccaccagcgcgacctgtacgacagcatcgaacggggcgacttcccccgatggaccatgtatgtccaggtcatgaccgaagagaaggcggcagccctgccctaccaccccttcgacctgaccaaggtctggtaccatgacgacgcgccgctcatcgaagtgggcgttctagaactgaaccgcaaccccgagaactacttcgcagaggtcgaacaggcggccttcaacccggccaacgtggtgccgggcatcggcttctcgcccgacaagatgttgcaggggcggctgttctcgtatggcgacgcccagcgctaccgccttggcgtcaaccaccacctcatccccgtcaacatgccccgctgccccttccacagctaccaccgtgacggcatgatgcgcgtggacggcaaccacggcagcaccctcgcctatgagccgaacagctacggcgaatggcaggaacaacccggcttcgccgaaccgcccctcgaactgagcggcgcggcagcccactggaacgcacgtgaggacgacgccgactacttcacccagccgggcaagctcttcaggctgatgaccccagcgcagcaggaggaactcttcggcaacaccgcccgcgccctcggcgatgcgcccgatgcgatcaagctgcggcacatcggcaactgcctgaaggccgaccccgcctacggaaacggcgtggcgaaggctctcgggctcgaccccgcaaaggcactgggctag

SEQ ID NO: 42868 - protein, 485 aa, Desulfovibrio vulgaris subsp. vulgaris str. Hildenborough
MDKKRLTTNAGAPVADNQNVMTAGPRGPQLLQDVWFLEKLAHFDREVIPERRMHAKGSGAFGTFTVTHDITRYTRAAIFSEVGKKTDLFVRFSTVAGERGAADAERDIRGFAVKFYTEQGNWDMVGNNTPVFFLRDPLKFPDLNHAVKRDPRTNLRSARNNWDFWTSLPEALHQVTVVMSDRGIPATYRHMHGFGSHTFSFINAKGERFWCKFHFKTQQGIKNLTDAEAEAIVGKCRESHQRDLYDSIERGDFPRWTMYVQVMTEEKAAALPYHPFDLTKVWYHDDAPLIEVGVLELNRNPENYFAEVEQAAFNPANVVPGIGFSPDKMLQGRLFSYGDAQRYRLGVNHHLIPVNMPRCPFHSYHRDGMMRVDGNHGSTLAYEPNSYGEWQEQPGFAEPPLELSGAAAHWNAREDDADYFTQPGKLFRLMTPAQQEELFGNTARALGDAPDAIKLRHIGNCLKADPAYGNGVAKALGLDPAKALG

SEQ ID NO: 42869 - DNA, 1521 bp, Acinetobacter sp. ADP1
  CDS (1)..(1521): transl_table=11
atgagtgacgataagttaaagtgtccagtcacccaccttacgactgatgcaggcgcgcctgttgtagacaatcagaacagtatgacggcaggtgcacgtggtccacttctgacccaagatctctggctcaatgagaaaatggctaattttgcacgtgaagttattccagaacgtcgtatgcatgccaaagggtcaggagcatttggtacttttacggtaacccacgatattacacagtattcccgtgccaaaatattcagtgaaattgggaaaaaaactgaaatgtttgcccgcttttcaacggtcgcaggtgaacgtggtgctgccgatgcagaacgtgatattcgcggttttgccctcaagttttataccgaagaaggtaactgggacatggtgggaaacaatacgcctgtgttctttatgcgtgatccacgtaagttcccagatcttaacaaagcagtaaaacgcgacccaaaaactaatttacgtagtgccacctataactgggatttctggacgctactgcctgaagcactgcatcaggtcacaattgtgatgtcagatcgtggtattccagatggatatcgccatatgcatggttttggtagccatacttatagcttcatcaatgccagcaatgagcgcttttgggtaaaattccatttccgcacccagcaaggtattaagaatttaactgatgctgaagctgaagcgattgttgccaaagaccgtgaaagtagccaaagcgatttgttcaatgcgattgaacaaggtaactatccaaaatggaccatgttcgttcaaatcatgccagaaactgatgcggaaaaagtaccctatcatccatttgacctcactaaagtctggccgcatggggattacccactgatcgaagtcggtgaatttgaactaaatcgtaatgctgaaaattattttcaggatgttgagcaagcgacatttgcaccaagtaatctagttccagggattagctactctccagaccgcatgttacaagcacgtttggtgaactatgccgatgcacaccgctatcgtgttggtgtaaatcacactcaaattccagtaaatgcgccgcgttgtccagtgcatagtaaccgccgtgacggacaaggccgtatggatggtaactatggtggtttaccacactacgaaccgaacagtttccatcaatggcaagaacagcctgagtttcgtgaaccgcctttaaaaattacgggcgatgcagatttctgggatttccgtcaagatgacagcgactattttagccagccccgtgctttgtttaatttgatgaatgatgagcaaaaacaggcattatttggtaatacggcacgtgcgatgggtgatgcgctcgacttcattaaatatcgccacatccgtaattgctacgcctgtgatcctgcctatggagaaggtgttgctcaggcactcggcatgacggttgcagatgctcaagcagcccgtgacagtgatcctgctaaaggtcatcctggtttcttataa

SEQ ID NO: 42870 - protein, 506 aa, Acinetobacter sp. ADP1
MSDDKLKCPVTHLTTDAGAPVVDNQNSMTAGARGPLLTQDLWLNEKMANFAREVIPERRMHAKGSGAFGTFTVTHDITQYSRAKIFSEIGKKTEMFARFSTVAGERGAADAERDIRGFALKFYTEEGNWDMVGNNTPVFFMRDPRKFPDLNKAVKRDPKTNLRSATYNWDFWTLLPEALHQVTIVMSDRGIPDGYRHMHGFGSHTYSFINASNERFWVKFHFRTQQGIKNLTDAEAEAIVAKDRESSQSDLFNAIEQGNYPKWTMFVQIMPETDAEKVPYHPFDLTKVWPHGDYPLIEVGEFELNRNAENYFQDVEQATFAPSNLVPGISYSPDRMLQARLVNYADAHRYRVGVNHTQIPVNAPRCPVHSNRRDGQGRMDGNYGGLPHYEPNSFHQWQEQPEFREPPLKITGDADFWDFRQDDSDYFSQPRALFNLMNDEQKQALFGNTARAMGDALDFIKYRHIRNCYACDPAYGEGVAQALGMTVADAQAARDSDPAKGHPGFL

SEQ ID NO: 42871 - DNA, 1452 bp, Propionibacterium acnes KPA171202
  CDS (1)..(1452): transl_table=11
atgcctattgatcccagcaagccgtcaacgaacaccaacgggtcgccagcgcctagcgacgaatactccctgaccgtcggcgctgacggcccggtagtgctccacgacgcacatctcatcgacaccctggcccatttcaaccgggaaaacatccccgaacgcaagcctcacgccaagggatcgggggccttcggacatctcgaggttaccgctgacgtctcggagtacaccaaggcatccttcctgcagaaggggcgcgaaacccccatgctggcccgattctccacagtcgccggtgagctcggcagccctgacacctggcgtgatgtgcgtggattctcgttgaagttctacaccgacgagggcaacttcgacatggtcggcaacaacaccccggtgttcttcatgcgtgacccgatgaagttcccgcatttcatccgctcccagaaacggttaccgaattccggactgcgcagtccgaatatgatgtatgactattggagcctgtcccccgaatcggcccatcaagtggcttacctcatgggaccgcgcggcattccgctcagctatcgcactatgaacggctactcctcgcacacctactcatgggttaacgccgaagggaagatcacctgggtgaaataccacttcatcagtgaccagggtgttcacaacatgactgctgaccgggccaaagcgatcgtcggtgatcacccagacatccaccgcgaggacctcttcaaccacattgccgacggcgactatccgtcctggaccgtcaaggtgcagctcatgccctatgacgaagccaaggattaccggttcaacccgttcgacatcaccaaggtgtggccgcataaggattacccgctgcacaccatcggcaagttcactctggaccgcaacccggagaacttcttcgcccagatcgagcaagcggccttctccccgtcgaacaccgttgagggcactgggttgtccccagaccggatgctgctgggtcgtgtcttcgcctacaacgatgccgcccgcaaccgtctgggggtcaactatgaacaactccctgtgaaccggccaacgacgccgacaaaccagtacaccttcgacggccagatggccttcgaacactccggttcggcacccacctacgccccgaactcctacggtcgcgattttgccaccggataccgaaccggttccgaagctacctgggaggctgacggcgaactcgttcgttccgcccagacccggcacgcggaagatgacgacttcggtcaggcccacgccctggtgcatgacgtcttttccgacgcagagcgtgacgagctcgtcgatactttggtggacttgatgaccaatttcgacatggaagagccggtcatcggcaacgcgctgtcctactggcgcaacatcgacgccggtattgccgaggcaaccgagggcagaatctga

SEQ ID NO: 42872 - protein, 483 aa, Propionibacterium acnes KPA171202
MPIDPSKPSTNTNGSPAPSDEYSLTVGADGPVVLHDAHLIDTLAHFNRENIPERKPHAKGSGAFGHLEVTADVSEYTKASFLQKGRETPMLARFSTVAGELGSPDTWRDVRGFSLKFYTDEGNFDMVGNNTPVFFMRDPMKFPHFIRSQKRLPNSGLRSPNMMYDYWSLSPESAHQVAYLMGPRGIPLSYRTMNGYSSHTYSWVNAEGKITWVKYHFISDQGVHNMTADRAKAIVGDHPDIHREDLFNHIADGDYPSWTVKVQLMPYDEAKDYRFNPFDITKVWPHKDYPLHTIGKFTLDRNPENFFAQIEQAAFSPSNTVEGTGLSPDRMLLGRVFAYNDAARNRLGVNYEQLPVNRPTTPTNQYTFDGQMAFEHSGSAPTYAPNSYGRDFATGYRTGSEATWEADGELVRSAQTRHAEDDDFGQAHALVHDVFSDAERDELVDTLVDLMTNFDMEEPVIGNALSYWRNIDAGIAEATEGRI

SEQ ID NO: 42873 - DNA, 1494 bp, Leifsonia xyli subsp. xyli str. CTCB07
  CDS (1)..(1494): transl_table=11
atgtcggagaaccacacgaccacgcagaccgggacaccggtcgccagcgacgcccactcgctcacggcgggccaggacggcgcgaccgccctgcacgaccgctacctggtggagaagctcgcccagttcaaccgcgaacggatccccgagcggatcgtacacgcgaagggcggcggcgcgttcggcacgttcgctgtcaccggcgacgtaacggcgtacacgaaggcggcggtcttccagccgggcgcgaagacggagaccgtgcagcggttctcctccgtcgcgggcgagcagggctcgcccgacacctggcgcgacgtccgcggcttctcagtgaagttctacacgtccgagggcaactacgacatcgtcggcaacaacaccccggtcttcttcatccgcgacggcatgaagttccccgatttcatccactcgcagaagcgcctcccgggctccggactgcgggatgcggacatgcagtgggatttctggacgctctcccccgagtccgcccaccaggtcacctacctcatgggcgaccgcggcctcccccgctcctggcgcaccatgccgggctacggctcgcacacgtaccagtggatcaacgcggcaggcgagcgcttctgggtcaagtaccacttccacgcgcttcacggcaacgaggagatgcacggggccgaagccgagaagatcgcgggcgaggacgcggactactaccgtcgcgacctgtacgaggcgatcgaacgcggcgacttcccggcgtggaagctctccgtgcaggtcatgccctacgaggacgccaagacctaccggctcaacccgttcgacctcaccaaggtgtggccgcacagcgactacccgctgatcgaggtcggcgtccacacgctgaaccgcaacccggagaacttcttcgcccagatcgagcaggcggcgttctcgccggcgaacacggtccccggcatcgatatctcccccgacaagatgctcacggcccgggtcttctcctacccggacgcccagcgctaccgcgtcggcacgaactacaacgaactgccggtgaatgcgccggtcgcgccggtacacaactactcgcaggacggcgcggcgcgccacggcttcaaggccgcggaggcgccggtctacgcgccgaactcgttcggcggcccggtggccgacccggccctggccggcgaaggctcctgggagtcggacggcgcgctggtccgcgccgccgccactctgcacgccgaggatgacgacttcggccaggccggttccctctaccgcgacgtcttcgacgccaaggccaaagagcgcttcctcgacacgatcgccggggcggtcggcggggtgcagcgcgacgacatccgcgagcgcgccatccagtactggacgagtgtggacgccggcctcggcggcctgctccgtacacggctcgcgtcgggggtcaccgacgccgacgaggcggccgagttcgtgggggtcgcgggctga

SEQ ID NO: 42874 - protein, 497 aa, Leifsonia xyli subsp. xyli str. CTCB07
MSENHTTTQTGTPVASDAHSLTAGQDGATALHDRYLVEKLAQFNRERIPERIVHAKGGGAFGTFAVTGDVTAYTKAAVFQPGAKTETVQRFSSVAGEQGSPDTWRDVRGFSVKFYTSEGNYDIVGNNTPVFFIRDGMKFPDFIHSQKRLPGSGLRDADMQWDFWTLSPESAHQVTYLMGDRGLPRSWRTMPGYGSHTYQWINAAGERFWVKYHFHALHGNEEMHGAEAEKIAGEDADYYRRDLYEAIERGDFPAWKLSVQVMPYEDAKTYRLNPFDLTKVWPHSDYPLIEVGVHTLNRNPENFFAQIEQAAFSPANTVPGIDISPDKMLTARVFSYPDAQRYRVGTNYNELPVNAPVAPVHNYSQDGAARHGFKAAEAPVYAPNSFGGPVADPALAGEGSWESDGALVRAAATLHAEDDDFGQAGSLYRDVFDAKAKERFLDTIAGAVGGVQRDDIRERAIQYWTSVDAGLGGLLRTRLASGVTDADEAAEFVGVAG

SEQ ID NO: 42875 - DNA, 1464 bp, Desulfotalea psychrophila LSv54
  CDS (1)..(1464): transl_table=11
atgaaggatgagaaagataaattaacaggcaacaacggtgcgcctgttgtagacaatcaaaatgttatgacagcaggacctcgtgggcctctgctgctccaggatgtctggtttatggagaaacttgcccattttgaccgggaggtcattcctgaaaggcgaatgcatgccaagggatctggtgcctacggaacctttaccgttaccgatgatatcagggcctataccaaggcaaaaatattcgcagagatagggaagacgactgatctctttgttcgtttttccacggtggcaggagagaggggggcagccgatgccgaacgggatattcggggctttgccatgaagttttataccgaagagggcaactgggatctggtcggtaataatacgccggtcttcttcctgaaagatcctctcaagtttccagacttgaaccacgccgtcaagcgtgatccccgcaccaatatgcgcagtgccgccaataattgggactactggtcatcgctgccggaggcacttcatcaggtcaccataacaatgagtgatcggggtattcccctctcctatcgacatatgaatggatatggcagccatacctatagtcttctcaatgagaacaatgaacgattctgggtcaaattccactttaaaacccagcagggcattaagaccctcagtgatgaggaggcggaaaaactggttggcagggatcgggagagccatcagcgtgatctcttggaggccattgataatcatgaatttcccagttggaagatgcagattcaggtggtgcctgaaaaggaggccgcaaattttccctttaatccctttgatctgaccaaggtatggccgcatgacgattatccactcattgacgtaggcattatggagctgaacaagaatcccgagaactattttgccgaagtagagcaggcggcctttaatccggccaatattgtcccgggcatcggcttttctcccgataagatgttgcagggtaggctcttctcctatggtgatgcccagcgatatcgtcttggggttaaccaccatctcatcccggtaaacagggccagatgtccatttcactcatttcatcgggatggggccatgcgagtcgatgggaattatgggggaacccgtggctatgaacctaatagttatggtgagtggcgggaacagcctgagtttaaagaaccacccctcactcttgaaggggcggctgaccattggaatcatcgagaggatagcgatgactactactctcaacccggcaatctattcaggcttatgactgctgaacaaaaaaaggtgctctttgagaacacggcaagggccttaggcgatgcccctcgggcaatcaagatgcgtcatgcctctaactgccaaaaggccgatagggcctatggcgagggggttgccatggccttgggtctgcccgtgtccgaacttgaggagtag

SEQ ID NO: 42876 - protein, 487 aa, Desulfotalea psychrophila LSv54
MKDEKDKLTGNNGAPVVDNQNVMTAGPRGPLLLQDVWFMEKLAHFDREVIPERRMHAKGSGAYGTFTVTDDIRAYTKAKIFAEIGKTTDLFVRFSTVAGERGAADAERDIRGFAMKFYTEEGNWDLVGNNTPVFFLKDPLKFPDLNHAVKRDPRTNMRSAANNWDYWSSLPEALHQVTITMSDRGIPLSYRHMNGYGSHTYSLLNENNERFWVKFHFKTQQGIKTLSDEEAEKLVGRDRESHQRDLLEAIDNHEFPSWKMQIQVVPEKEAANFPFNPFDLTKVWPHDDYPLIDVGIMELNKNPENYFAEVEQAAFNPANIVPGIGFSPDKMLQGRLFSYGDAQRYRLGVNHHLIPVNRARCPFHSFHRDGAMRVDGNYGGTRGYEPNSYGEWREQPEFKEPPLTLEGAADHWNHREDSDDYYSQPGNLFRLMTAEQKKVLFENTARALGDAPRAIKMRHASNCQKADRAYGEGVAMALGLPVSELEE

SEQ ID NO: 42877 - DNA, 2127 bp, Burkholderia pseudomallei K96243
  CDS (1)..(2127): transl_table=11
atggccgattcagaccgcaacgctccacacgaaacgccgcgcgccgcgcagccggacgacgcgcgcgcggaccgcaaatcgcaggatctcgagccgtatcgctcgaagccgcaaggcgaggcgctgcgcacgaaccagggcgtgcgcatcgcggacgatcagaacacgctgcgcgcgggcgcgcgcggcccgtcgctgctcgaagacttcatcatgcgcgagaagatcacgcatttcgatcacgagcgcattccggagcgcgtcgtgcacgcgcgcggctcggccgcgcacggcgtgttccgcgtctacgaatcgatggccgagtacacgaaggccgcgttcctgcaggacccggcgaaggaaacgcccgtgtacgtgcgcttctcgacggtgcagggcccgcgcggctccgccgacacggtgcgcgacgtgcgcggcttcgccgtgaagttctacaccgacgagggcaactacgatctcgtgggcaacaacatgccggtgttcttcatccaggatgcgatcaagttcccggatttcgtgcacgcggtgaagccggaggcgcccaacgagatgccgacgggcgcgtccgcgcacgatacgttctgggatttcgtgtcgctcgtgccggaatccgcgcacatggtcgcgtggctgatgtcggaccgcgcgattccgcgcagcttccgcacgatggaaggcttcggcgtgcatacgttccggttcgtcaatgcgcagggcgtcgcgcgcttcgtgaagctgcactggcgcccggtgctcggctcgtactcgctgctgtgggacgaggcgcagaagatcgccggccacgatccggatttccaccggcgggatttgtgggaggcgatcgagcgcggcgactatccggagtacgaactcggcgtgcagatcatcgaggcgcgcgaccagcacgcgttcggcttcgatctgctcgatccgaccaagctgattccggaggaaacggtgccggtgaagctgatcggcaagatgacgctcaatcgcaatccggacaatttcttcgcggaaaccgagcaggtggcgtttcatccggggcacctcgtgccgggcatcgacttcaccgacgatccgctgctgcagggccggctcttctcgtacaccgacacgcaactgagccgtctcggcgggccgaacttccacgagctcccgatcaaccggccggtgtgcccgttcgcgaatctgcagcgcgacgcgatgcaccggcagacgatcgacgtcgggcaggcgtcgtacgagccgaattcgctgaacggcggctggccgaaggaaaccgatcccgccgggcgggacggcggcttcgatagctacccggaggcggtcgagggcgcgaaggtgcgcgtgcgcagcggatcgttcgccgatcatttctcgcaggccgcgctgttctatcagagcatgagcgacgtcgagcggcggcacatccgcgatgcataccgcttcgagctcggcaaggtgacgcggcccgagattcgcgcgcgcgtcgtcgacgagatcctcgcgcgcttcgatgcgggcctcgccgcggaagtggccgaggggctcggcctgccgccgccgcccacgagcgcgccggcgatcgtcgcgcagccgctgtcgcccgcgctcagcctgctcacgcgcggcaagcgcagcgtgcgctcgcgcaaggtcgcgctcgtcgcgacgccgggcgcggacacgcgcctcatcgagcgcgtgcggcgcgcgctgaccgatgcgcgcgcggtgccggtgctcgtcgcgccgacgctcgcgcggatcggcgaactcacgcccgaggcgacgctcgccggcatgccgtcggtgatgttcgacgcggtgttcgtctgcggcggcgacggcgacgggcgcgacctcgtgcattcgagcgacgcgcggcatttcctgcaggaggcgttcaagcacctgaaggcgatcgccgccgtgggctccgggcgtcagctgctcggcgccgcgcatctgccggagcagggggacggcgtgtgcgtcgggcacgcggcggatctcgatcaggtggtcgcgaagttcttcgatgcgttgtccgagcaccgcgtctggtcgcgcgagccgctcgcgcagggcgtgcccgcgtag

SEQ ID NO: 42878 - protein, 708 aa, Burkholderia pseudomallei K96243
MADSDRNAPHETPRAAQPDDARADRKSQDLEPYRSKPQGEALRTNQGVRIADDQNTLRAGARGPSLLEDFIMREKITHFDHERIPERVVHARGSAAHGVFRVYESMAEYTKAAFLQDPAKETPVYVRFSTVQGPRGSADTVRDVRGFAVKFYTDEGNYDLVGNNMPVFFIQDAIKFPDFVHAVKPEAPNEMPTGASAHDTFWDFVSLVPESAHMVAWLMSDRAIPRSFRTMEGFGVHTFRFVNAQGVARFVKLHWRPVLGSYSLLWDEAQKIAGHDPDFHRRDLWEAIERGDYPEYELGVQIIEARDQHAFGFDLLDPTKLIPEETVPVKLIGKMTLNRNPDNFFAETEQVAFHPGHLVPGIDFTDDPLLQGRLFSYTDTQLSRLGGPNFHELPINRPVCPFANLQRDAMHRQTIDVGQASYEPNSLNGGWPKETDPAGRDGGFDSYPEAVEGAKVRVRSGSFADHFSQAALFYQSMSDVERRHIRDAYRFELGKVTRPEIRARVVDEILARFDAGLAAEVAEGLGLPPPPTSAPAIVAQPLSPALSLLTRGKRSVRSRKVALVATPGADTRLIERVRRALTDARAVPVLVAPTLARIGELTPEATLAGMPSVMFDAVFVCGGDGDGRDLVHSSDARHFLQEAFKHLKAIAAVGSGRQLLGAAHLPEQGDGVCVGHAADLDQVVAKFFDALSEHRVWSREPLAQGVPA

SEQ ID NO: 42879 - DNA, 2160 bp, Nocardia farcinica IFM 10152
  CDS (1)..(2160): transl_table=11
atgactgggcacacccccgacacccccgacaatgccgccgacgccgaccacgccgccggcggagcggatcgcaagcagcgtcagctcgacgcccaccgggtcgaccgggagcagggccacctcaccacccagcagggcgtgcgagtgcgccacaccgacgacgcgctctcggccggagcccgcggccccacgctgctcgacgacttccatgccagggagaagatcacccacttcgatcacgagcgcattcccgaacgcgtggtgcacgcgcgcggcgccggtgcctacggctacttccagccctacgacgaccggctggccgaatacaccgtcgcgaagttcctgaccgatcccgccgaacgcaccccggtgttcgtgcgcttctccaccgtcgccggttcccgtggttcggccgacaccgtgcgcgacgtgcgcggtttcgcgaccaagttctacacctcgcagggcaactacgacctggtcggcaacaacttcccggtgttcttcatccaggacggcatcaagttccccgacttcgtgcacgcggtgaaacccgagccgcacaacgagataccgcaggccgcctcggcgcacgacaccctgtgggacttcgtgtcgctgcagccggagaccctgcacgcgatcatgtggctgatgtcggaccgggcgctgccgcgcagctaccggatgatgcagggcttcggcgtgcacaccttccggttcctcgacgccgcgggcacgccgaccttcgtgaagttccactggacgcccaagctcggggtgcactcgctggtgtgggacgaatgccagcagatcgccgggcgcgaccccgactacaaccgccgcgatctgtgggactgcatcgaggccgggcactatccggagtgggagctgggcgtgcagctcatcccggtggagaaggagttcgacttcgacttcgacctgctcgacgccaccaagctggtccccgaggaacaggtgcccgtgctgccggtgggccggatggtgctcgaccgcaacccggacaacttcttcgccgagaccgagcaggtcgccttccacaccgccaacctggtaccgggcatcgacttcaccgacgacccgctgctgcaactgcgcaacttctcctatctggacacccagctgatccggctcggcggtcccaacttcgcccagatcccgatcaaccgcccggtcgccgatgtgcgcaaccaccagcaggacggctacggccagcacgccatcccgcgcgggcaggcgagctacaccgtcaacagcatcggcggcggctgccccgtcgtgggcggcgacggctcctacgagcactacccgcggcaggtggacggccgggcgcagcgccggcgcgccgagagcttccgggagtactaccggcagccgcggatgttctggcgcagcatgtccgcaccggaggccgaacacatcgtggaggccttcgccttcgaactcggcaaggtgcagcgggtggagatccgcgagcgcacgctcggccagctggtgcgcatcgaccccgacctggccgtgcgggtggcgggccggctcggtctgcccgcgccgccgccggaccccgaggccggcaccgatgccttcgtctccccggccctctcgcaagcccacaccgccaaggacagcatcgccacccggcaggtcgcggtgctggccgccgacggagtggacgcggcgggggtgcgggcgctgcgctcggcgctcaccgaacgcggcgcgatcgtggaggtgatcgcctcgcacggcggcatggtgcacgccgacggcggcgacggcgacaccctgccggtcgatcgcacactgatgacggtggcctcggtgctctacgacggcgtcgtggtcgccggcgggcagaccggggtggagacgctgacacgcaacggcgaggcggtgcatttcgtcctcgaggcgttcaagcacgccaaaccggtcgcggcgttcggtgcgggtgtctcgctgttgcggatcgcgggcatcctcgacgcggcgcgcgcacacgacgccgacccggctaccggtgtgatcaccaccgaggcgcgcggtgacggcctcgacgaggagttcgtgaccgatctggcgcgggcactggcgaaccatcggacgtggcagcgggcgacctcggcgattccggcataa

SEQ ID NO: 42880 - protein, 719 aa, Nocardia farcinica IFM 10152
MTGHTPDTPDNAADADHAAGGADRKQRQLDAHRVDREQGHLTTQQGVRVRHTDDALSAGARGPTLLDDFHAREKITHFDHERIPERVVHARGAGAYGYFQPYDDRLAEYTVAKFLTDPAERTPVFVRFSTVAGSRGSADTVRDVRGFATKFYTSQGNYDLVGNNFPVFFIQDGIKFPDFVHAVKPEPHNEIPQAASAHDTLWDFVSLQPETLHAIMWLMSDRALPRSYRMMQGFGVHTFRFLDAAGTPTFVKFHWTPKLGVHSLVWDECQQIAGRDPDYNRRDLWDCIEAGHYPEWELGVQLIPVEKEFDFDFDLLDATKLVPEEQVPVLPVGRMVLDRNPDNFFAETEQVAFHTANLVPGIDFTDDPLLQLRNFSYLDTQLIRLGGPNFAQIPINRPVADVRNHQQDGYGQHAIPRGQASYTVNSIGGGCPVVGGDGSYEHYPRQVDGRAQRRRAESFREYYRQPRMFWRSMSAPEAEHIVEAFAFELGKVQRVEIRERTLGQLVRIDPDLAVRVAGRLGLPAPPPDPEAGTDAFVSPALSQAHTAKDSIATRQVAVLAADGVDAAGVRALRSALTERGAIVEVIASHGGMVHADGGDGDTLPVDRTLMTVASVLYDGVVVAGGQTGVETLTRNGEAVHFVLEAFKHAKPVAAFGAGVSLLRIAGILDAARAHDADPATGVITTEARGDGLDEEFVTDLARALANHRTWQRATSAIPA

SEQ ID NO: 42881 - DNA, 2055 bp, Desulfitobacterium hafniense DCB-2
  CDS (1)..(2055)
atggagaatcagcaaacaaaccagaaatccttagatcttgatgccgctcgggtcagtcataacaaggggtatctcactaccaaccagggggtcggggttagcaatacggatgactctctcaaagcaggcaaacggggccctaccctcatggaggattttatctttcgggaaaaggttacccattttgaccatgaacggattcccgagcgggttgttcacgcccggggctcaggtgcccatggttacttccaggtttacgagaacctgtctcatctgaccaaggctcattttctcagcgatcccaatctgattacgccggtcttcgtccgtttttccaccgttgccgggtttcgcggctcttcggatacggtgcgggatgtccgggggtttgcggttaaattctacacacaggaaggcaattatgatatcgtgggcaacaacatgccggtattctttattcaggatgctattaagttccccgatctcatccattccctaaaacctgagcccaacaatgagatgccccaggcggcctcagcccacgacaccttctgggactttgtggtgaatactccggagaccatgcacaatgtcatgtggctgatgtctccccgcgctgttcccaaaagctttcgcatgatggaaggctttggcatcaataccttccgtctggtcaacgccaaaggtgaatttaaatttgtaaaatttcactggaagcctgttctgggtgtccattccctggtctgggatgaagctcagaaggtggccggcaaggatcctgacttcaaccgcagggacctttgggaaactattgagcatggccaggccgtcgaatttgaacttggcattcaggtgctgaagccggaggatgagttcaggtttgatttcgatattctggaccctaccaagctttggcctgaggaattaatccccgttcagaaaatcggcaagatgacactgaaccagaacccggacaatttcttcgccgaaacggaacaggtggctttttgtccggccaatgtagtgcccggtattgatttcagcaatgatcctttgctccagggccggctgttctcctatctggacactcagctctctcgtctgggaggtcccaacttccaccagcttcccattaaccgtcccctgcccaaggtaaacaacaaccaacgggacggcatgcaccgcatgaccattgacgagggacagaccagctactatcccaactccttgaataagggtgagcctcacgccgcccgcgctggggaaagtcacttcgaacactatcaggaaaaagtggatggccatgttatccgggagcgcagcgagagcttccgggatcactacacccaaccggctatgttttggaacagtatgtccgactgggaaagacaacacatcatcgatgctttccgattcgagctgggcaaatgcaagcataagcatacccaccaaaagcttgtggatatgctgggcaacgtggatccggagctggcccaaaaggtggcggagggcttaggggccacacctccggccaacggggccaatcccaccacggcttcttctcccgctctcagtatggccaataccgccaagagcccgaaaaccagaaaagtggctgtcctgcttgaaagcggtttcgataaagctcagtttgatgctcttaccgctacccttattgctgccggcgcttgttttgatgtggtgtcctgtaagctgggaccggttactgccggtgataacggcagggtagaaggcaaccaaacctacgctaccacagcttcggtcttttacgatgccgtttatatccccggcggttcccacactgaggccctcaaaggctcggcggatgtaaagggtttcctcctggacacctttaaccattataagaccattgggctaagcggtgaggcgtcggccctgctgggcctgttgccttccggacaaaagccggcgccaggtatcgtctgcgagtcggccggaaacatggaaatctatgccaacaacttcctggcagctctcacaacaggccgccatttcgagcggaatgtccactaa

SEQ ID NO: 42882 - protein, 684 aa, Desulfitobacterium hafniense DCB-2
MENQQTNQKSLDLDAARVSHNKGYLTTNQGVGVSNTDDSLKAGKRGPTLMEDFIFREKVTHFDHERIPERVVHARGSGAHGYFQVYENLSHLTKAHFLSDPNLITPVFVRFSTVAGFRGSSDTVRDVRGFAVKFYTQEGNYDIVGNNMPVFFIQDAIKFPDLIHSLKPEPNNEMPQAASAHDTFWDFVVNTPETMHNVMWLMSPRAVPKSFRMMEGFGINTFRLVNAKGEFKFVKFHWKPVLGVHSLVWDEAQKVAGKDPDFNRRDLWETIEHGQAVEFELGIQVLKPEDEFRFDFDILDPTKLWPEELIPVQKIGKMTLNQNPDNFFAETEQVAFCPANVVPGIDFSNDPLLQGRLFSYLDTQLSRLGGPNFHQLPINRPLPKVNNNQRDGMHRMTIDEGQTSYYPNSLNKGEPHAARAGESHFEHYQEKVDGHVIRERSESFRDHYTQPAMFWNSMSDWERQHIIDAFRFELGKCKHKHTHQKLVDMLGNVDPELAQKVAEGLGATPPANGANPTTASSPALSMANTAKSPKTRKVAVLLESGFDKAQFDALTATLIAAGACFDVVSCKLGPVTAGDNGRVEGNQTYATTASVFYDAVYIPGGSHTEALKGSADVKGFLLDTFNHYKTIGLSGEASALLGLLPSGQKPAPGIVCESAGNMEIYANNFLAALTTGRHFERNVH

SEQ ID NO: 42883 - DNA, 1494 bp, Nostoc punctiforme PCC 73102
  CDS (1)..(1494)
atgactgaaccccaaaacttgacaactgctgatggtattccagttagcgataaccagaactcactcactgctggagcgcgtggccctgtattaatccaggatttccaccttatagaaaagctggctcatttcaacagagaacgtattcctgaaagagttgttcacgctaaaggtgctgctgctcacggcactttgactattaccaatgacattacccgctacagtaaagccaaacttttttctgaaattggcaagaaaacggaacttatcttgcgtttttctacagttggcggagaaaaaggttcagcagatgccgagcgtgaccctagaggtttttccctcaagttttatactgaggagggtaactgggatcttgtaggtaacaatacccctattttcttcatccgcgaccctttgaagtttcctgattttatccatacccaaaagcgcaatccgcaaaccaattgcaaagaccagaatgcaaagtgggatttttggtcactcagtccagaatcgcttcaccaggtgacgatcctcttttcagaccggggaattcccaaaacccatcgacacatggacggttttggtagccacaccttcagtttaattaatgccgagggcgatcgcgtttggtgtaaatttcactttaagacgctgcaaggacatcaaaccttgacagaggaagaatccgctaagattaagggcgaagatcccgatcatgcgactcacgatttgtttgaagcgatcgctaaaaaagactatcctaagtggcggatgtgtattcaggtgatgaccgaggagcaagcggaaaaacatcctgacaatccttttgacttgaccaaagtttggaaacaaggcgaatatcctttaattgaagtcgggatattagagctaaatcgtaacccagagaattattttgccgaagttgagcaagccgcttttagccctagtgcagtggttcctggcgttagtttctctccagacaaaatgctgcaagctcgaattttttcttacccagatgctcaacggtatcgcttgggtggtaactatcagcaactacccgttaaccagcccaaatgtccagtgatgcattatcagcgagatggctttatggcatcggggaacaacggcggtagcgttcctaactatgaaccgaatagtgctgagggtacgcccaaagaaaatccagcttatgcagaaccacctagtcatttgggcgatgtcacagtcgatcgttacagtcatcgtgaaggaaacgacgattatactcaagcaggtaatttgtatcggttactaactcctgagcagcaggagcgtcttgctaaaaatattgtcggcagtctctctcaagcaagagaggacatccaaatgcgtcaactttgccacttcttccgggcagatgtttcttatggtcgtcgtgtagctgaaggattgggcattgcgatcgatccttcaatgttttctcatgatgctcaacctgtaggtaactggtag

SEQ ID NO: 42884 - protein, 497 aa, Nostoc punctiforme PCC 73102
MTEPQNLTTADGIPVSDNQNSLTAGARGPVLIQDFHLIEKLAHFNRERIPERVVHAKGAAAHGTLTITNDITRYSKAKLFSEIGKKTELILRFSTVGGEKGSADAERDPRGFSLKFYTEEGNWDLVGNNTPIFFIRDPLKFPDFIHTQKRNPQTNCKDQNAKWDFWSLSPESLHQVTILFSDRGIPKTHRHMDGFGSHTFSLINAEGDRVWCKFHFKTLQGHQTLTEEESAKIKGEDPDHATHDLFEAIAKKDYPKWRMCIQVMTEEQAEKHPDNPFDLTKVWKQGEYPLIEVGILELNRNPENYFAEVEQAAFSPSAVVPGVSFSPDKMLQARIFSYPDAQRYRLGGNYQQLPVNQPKCPVMHYQRDGFMASGNNGGSVPNYEPNSAEGTPKENPAYAEPPSHLGDVTVDRYSHREGNDDYTQAGNLYRLLTPEQQERLAKNIVGSLSQAREDIQMRQLCHFFRADVSYGRRVAEGLGIAIDPSMFSHDAQPVGNW

SEQ ID NO: 42885 - DNA, 1491 bp, Actinobacillus pleuropneumoniae serovar 1 str. 4074
  CDS (1)..(1491)
atgaacaacggtgcgcctgttgttgataaccaaaacagcatgactgcgggtcctcgtggtccgttacttgctcaagacttatggttaaacgaaaaattagccaacttcgtacgtgaagtgattcctgagcgtcgtatgcacgcgaaaggctccggtgcattcggtaaatttaccgtaacgcacgatattactcaatatactaaagcggcaatctttagtgaagtgggtaaagaaaccgaattattcgcacgttttactaccgtagccggtgaacgtggtgcggcagatgctgagcgtgatattcgtggtttcgcagttaaattctataccgaacaaggtaactgggacttcgtaggtaacaatacgccggtattcttcttacgtgatccgcgtaaattcccggatttaaacaaagcggttaaacgtgaccctcgcacaaatatgcgtagtgcgacaaacaactgggacttctggacattattacctgaagcgttccaccaagtaacgatcgtaatgtcagagcgcggtatccctgcttcatatcgtcatatgcacggttacggttcacacacatatagcttaatcaatgcaaataacgaacgtttctgggtaaaattccacttccgtaccgaacaaggtattaaaaacttaaccaacgaagaagcggcggcaatcatcgcaaacgatcgtgaatcacaccaacgtgatttatacgagtcaatcgaaaaaggcgatttcccgaaatggaaactttacattcaagtaatgcctgaagcggaagcggaacaagtggatttccacccgttcgatttaaccaaaatctggtcgaaaaaagattatccgttaatcgaagtgggcgtgatggaattaaaccgtaacccggcaaatttctttgccgacgttgaacaatccgcatttgctccaagcaacttggtaccgggtatcagcgtatcgccggatcgtatgttacaagcgcgtttatttaactatgcagacgcacaacgttaccgtttaggtgtaaaccaccaccaaattccggtaaacgcacctcgttgcccggttcacagcaatgcgcgtgacggtcaaagtcgtgtagacggtaactacggttcaaccttacattatgaaccgaacagcttcggccaatggcaagaacaggcgcaatttgccgagccgcctcttaaaattaacggcgatgcggcattctgggattatcgtcaagatgactcggattacttcagccaaccgcgtgcattatttaacttaatgacggagaaagaaaaacaatctctctttaaaaatactgccgaaggtatgggtgatgcgttagatttcatcaaatatcgtcatattcgtaactgctacttctgtgaccctgcatacggtgaaggcgtagcgaaagcgttaggaatgacggttgccgatgcaatggaagcatacaatacggatccggcaatgggtcagccgggtttaatcaaacctaacttctaa

SEQ ID NO: 42886 - protein, 496 aa, Actinobacillus pleuropneumoniae serovar 1 str. 4074
MNNGAPVVDNQNSMTAGPRGPLLAQDLWLNEKLANFVREVIPERRMHAKGSGAFGKFTVTHDITQYTKAAIFSEVGKETELFARFTTVAGERGAADAERDIRGFAVKFYTEQGNWDFVGNNTPVFFLRDPRKFPDLNKAVKRDPRTNMRSATNNWDFWTLLPEAFHQVTIVMSERGIPASYRHMHGYGSHTYSLINANNERFWVKFHFRTEQGIKNLTNEEAAAIIANDRESHQRDLYESIEKGDFPKWKLYIQVMPEAEAEQVDFHPFDLTKIWSKKDYPLIEVGVMELNRNPANFFADVEQSAFAPSNLVPGISVSPDRMLQARLFNYADAQRYRLGVNHHQIPVNAPRCPVHSNARDGQSRVDGNYGSTLHYEPNSFGQWQEQAQFAEPPLKINGDAAFWDYRQDDSDYFSQPRALFNLMTEKEKQSLFKNTAEGMGDALDFIKYRHIRNCYFCDPAYGEGVAKALGMTVADAMEAYNTDPAMGQPGLIKPNF

SEQ ID NO: 42887 - DNA, 2088 bp, Psychrobacter sp. 273-4
  CDS (1)..(2088)
atgaataagaatattgatcatactgaccccgctaaagacatgaatatggaacgtggcaatggtggtgaaacccatcaacgtgccggtgacgacaccaaaatactgactacccagcagggtgtgccaatttcggacaatcaaaactcactcaaagcaggaccgcgcggtccaacgctattagaggatttcgtcttacgtgaaaagattcatcactttgaccatgagcgtattcctgagcgtattgtgcatgcgcgtggtagtgctgcacacggttattttgagctgaccgaatcactagaagaatatactacggctaaaattttgactgagaccggtaagcagacgcctttatttacgcgtttttcgactgttgctggtagtaaaggctcaaaagatacgccacgtgatgtacgtggctttgcagtcaaaatctataccgaagaaggaaactgggatttggtcggtaatgacatgcctattttctttatccaagatgcgatgaaattcccagatcttgtccatgcggttaaacctgaaccggatcgcggtttcccgcaagccgcttctgctcacgatactttttgggatttcgtgtcattaagtcctgaaaccatgcacaacgttatttggttaatgagtgatcgtgggataccgcgtagcttacgcatgatcgaaggttttggtattcatagctatcgtctgattaataaagcgggcaaaagtacctttatgcgttttcactggaaaccggtgcttggtgtgcaatcaacgacatgggatgaagcagtaaaaatctctggtgccgatccagattatcatcgccgcgacttgtttgagtcgattaataatggcgattttcctgaatgggaatttggcgtgcaattattcactgaagaagaagcaagcaaatttccgtttgaccatttagatgccaccaagatgattccagaagaaatggtaccagtcaaaatcgttggaaaaatggtgttaaatcgttatcctgataatttctttgctgaaacggagcaagtagctttctgtccatcgcatgtaccaccgggtatcgattttagtaacgaccccttattacaaggtcgcctattcagctacttagatacccagctgtcacgtttgggctcaccgaactttgctcagattccaatcaatgcaccgaaatgtccatttgccaataatcagcaagatggtcatatgcagatgcaagtgccaaagactcgtgtcctatacgagccacaaagtctagatccaaccagaccacgtgagagtgttaaaagaggctttgcgtcttttgccgagacgctagatgatggtgttaaaggtcgcatacgcgcggagagcttcgctgatcattatagtcagccgcgtatgttctatcgtagccaaacgacaattgagcaagcacacattgcctcagcttatgcctttgagctaggtaaagtagatacggcgcatgtacgcagtcgtacgctcggtcatctacgtaatatcgatgaagatttagcaagtcgtgtggcaaaagcgttgggtatggagttgccggaagctgctgatgctgccgcacctatccaagatatggaaatatctcctgccgtaagaacgattggtctgtcacctaagagcttaaagggtcgcatgattggtattctagtggcggaaggctcaaagcatagtgaaatagaaaagtatgagaaggcggcgcaagcgcaaggtgccagtgtcaaaattattgcaccgaataaagaagtcacattagacgatgatactatcatacaagctgatgagcgcgtagcagggggtccgtccgtgatgttcgatgcggtcgtcagtatcattatgccagaccaagctaaaaagctggctaaagacagtgccacgttagattggtttacggacgcctatgtacactgtaaagcgatttcttattgcggggcaacggatgagtttatcttaagtaagctaccaattgaaaaagatgcgttcgtcacgccattatctgatttggatgtctttattgaaaatgccaaatcgcgtctatgggagcgtgagccaaaggttcgtgaccttgcctaa

SEQ ID NO: 42888 - protein, 695 aa, Psychrobacter sp. 273-4
MNKNIDHTDPAKDMNMERGNGGETHQRAGDDTKILTTQQGVPISDNQNSLKAGPRGPTLLEDFVLREKIHHFDHERIPERIVHARGSAAHGYFELTESLEEYTTAKILTETGKQTPLFTRFSTVAGSKGSKDTPRDVRGFAVKIYTEEGNWDLVGNDMPIFFIQDAMKFPDLVHAVKPEPDRGFPQAASAHDTFWDFVSLSPETMHNVIWLMSDRGIPRSLRMIEGFGIHSYRLINKAGKSTFMRFHWKPVLGVQSTTWDEAVKISGADPDYHRRDLFESINNGDFPEWEFGVQLFTEEEASKFPFDHLDATKMIPEEMVPVKIVGKMVLNRYPDNFFAETEQVAFCPSHVPPGIDFSNDPLLQGRLFSYLDTQLSRLGSPNFAQIPINAPKCPFANNQQDGHMQMQVPKTRVLYEPQSLDPTRPRESVKRGFASFAETLDDGVKGRIRAESFADHYSQPRMFYRSQTTIEQAHIASAYAFELGKVDTAHVRSRTLGHLRNIDEDLASRVAKALGMELPEAADAAAPIQDMEISPAVRTIGLSPKSLKGRMIGILVAEGSKHSEIEKYEKAAQAQGASVKIIAPNKEVTLDDDTIIQADERVAGGPSVMFDAVVSIIMPDQAKKLAKDSATLDWFTDAYVHCKAISYCGATDEFILSKLPIEKDAFVTPLSDLDVFIENAKSRLWEREPKVRDLA

SEQ ID NO: 42889 - DNA, 1515 bp, Methanococcoides burtonii DSM 6242
  CDS (1)..(1515)
atgagtgatgagaaaacttccagtttaactactgcttttggaattccagtcggtgatgatcagaatagcctcacggcaggagagcgtggaccagttctcatacaggacgttcacctattggagaaacttggtcattttaatcgtgaacgtatacctgagcgtgttgtgcatgctaaaggtgcaggggctggcggttattttgaagtgacagctgatgtgaccaaatatacaaaagccaaattcctttcagaaataggcaaacgcactgaggtctttgctcgcttttccactgtaggtggggaaaaaggttctgccgatgcagcaagggatccacgtggttttgctataaagttctacactgaagatggtaaccatgatctcacgggcaacaacacacctgtgttcttcattcgagaccctctgaagtttcctgatttcattcatacacagaagcgaaaccctgctacaaactgcaaagatccaaacatgttctgggactttctgtctctcactccggaatcaattcatcaggtcacgatccttttttcagacaggggtactcctgcaactttccgtaatatgaacggatattcaagtcatacttataagtggtataacgataagggcgaatacttctgggtgcagtatcattttaagactgatcagggtacaaagacccttacacgtgaggaagcagaaaaattaagtgggactgatccggatcatgctgttcgggatctctatgatgctatagaaaagggggattatccttcctggacccttgagatgcagataatgaccccggagcaggctgaagaatatcgctttgacattcttgatataaccaaggtctggccacatggtgatttccctaccatcaagatcggtaaaatggtgcttaataggaatccaaccaattattttgctgaagtggaacaatctgcttttagccctggtaatctggtaccgggtattgatatatctccagataagatgttacaggccagagttttctcatatcatgactctcatgttcatcgtttgggtcccaattatcatcagatccctgtgaatgctcctaaaaatgcacctgaaaccagctatcagcgtgatgggttcatgcgaattgatgccaatggaggaagtggaccaaattactggccaaacagttttggtggtcctgccccggaccctgatgctctgaagccaccattcgaagtttccggtaaagcagatcgtacgccttatgtccactccaatgatgactttgtgcaggcaggtaacctgtatcgtgacgtaatggatgatcaggctcgtgagaaccttgtgggtaatattatttcacatctctcgggtgcacaaaagcgtattcaactcagacagactgctctgttcttcaaagccgatcccgattacggagggcgtgtggctgatggattgggtttggatgtaaaagaaattgagcgtcttgccaatatgacccaaacggaacgtgtaaaagctacagaaaagtaa

SEQ ID NO: 42890 - protein, 504 aa, Methanococcoides burtonii DSM 6242
MSDEKTSSLTTAFGIPVGDDQNSLTAGERGPVLIQDVHLLEKLGHFNRERIPERVVHAKGAGAGGYFEVTADVTKYTKAKFLSEIGKRTEVFARFSTVGGEKGSADAARDPRGFAIKFYTEDGNHDLTGNNTPVFFIRDPLKFPDFIHTQKRNPATNCKDPNMFWDFLSLTPESIHQVTILFSDRGTPATFRNMNGYSSHTYKWYNDKGEYFWVQYHFKTDQGTKTLTREEAEKLSGTDPDHAVRDLYDAIEKGDYPSWTLEMQIMTPEQAEEYRFDILDITKVWPHGDFPTIKIGKMVLNRNPTNYFAEVEQSAFSPGNLVPGIDISPDKMLQARVFSYHDSHVHRLGPNYHQIPVNAPKNAPETSYQRDGFMRIDANGGSGPNYWPNSFGGPAPDPDALKPPFEVSGKADRTPYVHSNDDFVQAGNLYRDVMDDQARENLVGNIISHLSGAQKRIQLRQTALFFKADPDYGGRVADGLGLDVKEIERLANMTQTERVKATEK

SEQ ID NO: 42891 - DNA, 1527 bp, Haemophilus influenzae R2846
  CDS (1)..(1527)
atgagttctcaatgccctttctcgcacttagctgcgacaaacttaacaatgggtaacggtgcacccgttgctgataaccaaaacagcttaacagctggtccgcgtggtccattactttcacaagatttatggcttaacgaaaaattagctgatttcgtacgtgaagtgatcccagagcgtcgtatgcacgctaaaggttctggtgcatttggtacctttactgtgacacacgatattactaaatatactcgtgcaaaaatttttagtgaagtgggtaaaaaaacggaaatgttcgcacgttttaccaccgtggcaggcgaacgtggtgcagcagatgctgagcgtgatattcgtggttttgcattaaaattctatactgaagaaggtaactgggatttagtaggtaacaatacgccagtattcttcttacgtgatccacgtaaattccctgacttaaacaaagcggtaaaacgtgatccgcgtactaatatgcgttcagcaactaataactgggatttctggacattattaccagaagcattacaccaagtaactgttgtaatgagtgatcgtggtattccagcaagttatcgtcatatgcacggtttcggttctcacacttatagtttctggaatgaagcaggcgaacgtttttgggtaaaattccacttccgtactcaacaaggcattaaaaatttaacaaatgctgaagcagcagaaattattgcaaatgaccgtgaaagccatcaacgtgatttatatgaagcgattgaacgtggtgatttccctaaatggacattatttgtacaaattatgccggaagcagatgcggaaaaagtgccttatcacccattcgacttaactaaagtatggccgaaaaaagactatccattaattgaagtcggcgagtttgaattaaaccgtaacccagaaaacttcttcgctgatgtagaacaatctgcatttgcaccaagtaacttggttccgggtattggcgcaagccctgacagaatgttacaagcccgtttatttaactatgcggatgcacaacgttaccgtttaggtgtgaactaccgtcaaattccagtaaaccgtccacgttgcccagttcatagcaaccaacgtgatggtcaaggtcgtgtagatggcaactacggtagcttgccacactacgagccaaacagcttcagccaatggcaacaacaaccagactttgctgaaccaccacttcgtatcaacggagatgcagcacactgggattatcgtaacgatgataacgattacttcagccaacctcgtgcattatttaacttaatgaatgcagagcaaaaacaatcattattcaacaacacggcagcagcaatgggcgatgcacctgatttcatcaaatatcgtcatattcgtaactgccactggtgtgatgccgcatacggtgaaggcgttgcgaaagcattaggtttaaccgttgaagatgcattaaaagctcgtgatactgatcctgcattaggtcaaggtggattgttataa

SEQ ID NO: 42892 - protein, 508 aa, Haemophilus influenzae R2846
MSSQCPFSHLAATNLTMGNGAPVADNQNSLTAGPRGPLLSQDLWLNEKLADFVREVIPERRMHAKGSGAFGTFTVTHDITKYTRAKIFSEVGKKTEMFARFTTVAGERGAADAERDIRGFALKFYTEEGNWDLVGNNTPVFFLRDPRKFPDLNKAVKRDPRTNMRSATNNWDFWTLLPEALHQVTVVMSDRGIPASYRHMHGFGSHTYSFWNEAGERFWVKFHFRTQQGIKNLTNAEAAEIIANDRESHQRDLYEAIERGDFPKWTLFVQIMPEADAEKVPYHPFDLTKVWPKKDYPLIEVGEFELNRNPENFFADVEQSAFAPSNLVPGIGASPDRMLQARLFNYADAQRYRLGVNYRQIPVNRPRCPVHSNQRDGQGRVDGNYGSLPHYEPNSFSQWQQQPDFAEPPLRINGDAAHWDYRNDDNDYFSQPRALFNLMNAEQKQSLFNNTAAAMGDAPDFIKYRHIRNCHWCDAAYGEGVAKALGLTVEDALKARDTDPALGQGGLL

SEQ ID NO: 42893 - DNA, 2139 bp, Methylobacillus flagellatus KT
  CDS (1)..(2139)
atgaagaacaaaacggagaaagtcaaaagccaactggcagggtcaaccgctccagacaagaaaaacaccactgcaaaaacgcgcgatctagagtcgtacaagtcggatgccaccgggcagccactgaggaccaatcagggcgtcaagattgcagacaacaagaactccctgcgtgccggcagccgtgggccctccctgctggaagacttcattctcagggagaagattacccattttgatcatgagcgcatcccggaacgaatcgtccatgcacgtggcgtcggcgcccatggttattttgaatcctatgccgaccactcttcactcaccaaggcgggattcctcggcgaaaaaggcaagcaaaccccggtcttcgtcaggttttccaccgtccagggccccaggggctctgccgacacggtacgggacgtgcgcggctttgccatcaagttttataccgaggagggcaacttcgacctcgtaggcaataatattcccgttttttttatccaggatgccatcaagtttcccgacttcgtccatgcggtcaagcccgagcctcacaatgagatcccgacgggcgccagcgcccacgacaccttctgggattttgtttcgctacagccggagtcggcgcatgccgtcatctgggccatgtccgaccgtgccattcccaggagcttgcgcgccatgcagggatttggcgtccataccttcaggctcatcaatgccaagggcgttgccaagttcgtcaagttcatctggaccccgaagcagggggtgctgtcgctggtatgggatgaagcgcagaagatcgcgggcaaggatcccgacttccaccggcgcgacctgggcgaatccattgagctcggcaattatcctgaatgggaattcggcgtgcagatcattgacgaacaagacgagcacagcttcgatttcgacatcctcgaccccaccaagatcgtgcccgaagaactggttccgatcacgccgctgggcaagctggtactgaatcgcaacccggataatttttttgccgagaccgagcaaatcgccttttgccccgggcacatcgtgcccggcctggacttcagcaacgatccgctcctgcaaggccgtctgttctcttacacggatactcagctgagccggctgggcggacccaatttccatgaaatccccatcaacaagccggtatgccctttccacaacaaccagcgggacgcattgcacagaacgacgatacacaagggccaggctgcctacgagcctaactcgatcgacggaggctggccgcaggaaacgccgccagcagccaaggatggcggcttcgagagctactacgagcgcatcgatgcacacaaggtcagggaaaggtcggcgtcgttcaaggaccatttctcccaacccaggcttttttacaagagcttgagcgccacggaacaactacacattgcagaggcttacagcttcgagctgggcaaggtcaagaggcaacatatccgggaaagagtcgtcaacgagatcctgtccaatatcgacctgggcctggcaggcaccgttgcgcagaagctgggcattccggcgcccaagaaaccgaccatcaaggtgcccgaacccagcctgaagcaatcgtcggcgctgagccagatgaagctgactccccaggacctgcaggggaagaaaatcgcggcactggtgttcgacggcttgtccgccaaggccatccgcccgctgcttgactgggcacaacagcacagcatcgcgctacagcttcttggccccacttctgcgccagtcaagaccagcgagggaaaatcgttggcggtggatggctcaatcaagggagaaccctcgattttgttcgacgcggcgatagtaccggatatcccgacggaccatacggcgctactagacaatggacaagccgtgcacttcatcctcgaaacattcaagcacctgaagccgctggcactgaccgggccaggcgcgagcctgataaaagcacttcatctggaggaagatgcgggcttgttgcaggccaaggatttcagtgcagtacgcgagcagttcgagcgcgccttgctggctcatcgtgtatgggagcgggaaaagaaggccgaacgcatcccggcatga

SEQ ID NO: 42894 - protein, 712 aa, Methylobacillus flagellatus KT
MKNKTEKVKSQLAGSTAPDKKNTTAKTRDLESYKSDATGQPLRTNQGVKIADNKNSLRAGSRGPSLLEDFILREKITHFDHERIPERIVHARGVGAHGYFESYADHSSLTKAGFLGEKGKQTPVFVRFSTVQGPRGSADTVRDVRGFAIKFYTEEGNFDLVGNNIPVFFIQDAIKFPDFVHAVKPEPHNEIPTGASAHDTFWDFVSLQPESAHAVIWAMSDRAIPRSLRAMQGFGVHTFRLINAKGVAKFVKFIWTPKQGVLSLVWDEAQKIAGKDPDFHRRDLGESIELGNYPEWEFGVQIIDEQDEHSFDFDILDPTKIVPEELVPITPLGKLVLNRNPDNFFAETEQIAFCPGHIVPGLDFSNDPLLQGRLFSYTDTQLSRLGGPNFHEIPINKPVCPFHNNQRDALHRTTIHKGQAAYEPNSIDGGWPQETPPAAKDGGFESYYERIDAHKVRERSASFKDHFSQPRLFYKSLSATEQLHIAEAYSFELGKVKRQHIRERVVNEILSNIDLGLAGTVAQKLGIPAPKKPTIKVPEPSLKQSSALSQMKLTPQDLQGKKIAALVFDGLSAKAIRPLLDWAQQHSIALQLLGPTSAPVKTSEGKSLAVDGSIKGEPSILFDAAIVPDIPTDHTALLDNGQAVHFILETFKHLKPLALTGPGASLIKALHLEEDAGLLQAKDFSAVREQFERALLAHRVWEREKKAERIPA

SEQ ID NO: 42895 - DNA, 1470 bp, Exiguobacterium sp. 255-15
  CDS (1)..(1470)
atgagtgaaaaacgattaaccacaaaccagggtgtcccgattggtgacaatcagaattcgcgtacggccggtcgtcgcggtccaacactgcttgaagactatcaactgattgagaaaatggcccatttcgaccgggaacgtgttcctgagcgtgttgtacacgcccgcggttttggtgcacacggcgtcttcacggtaaaaaattcgatgaagaaatatacaaaagcggcattccttcaaaacgaagggaccgaggttcctgtattcgcccgtttctcaaccgttattcacggtacacattctcctgaaacgttacgtgatccacgtggcttctcggttaagttctatacagaagaaggaaactgggatttcgtcggaaacaacttaccggtcttctttattcgcgattcgatgaagttcccggatatggtccactcgctgaaaccggatccacgcacgaatattcaagaccctgaccgctactgggacttcatgacattacgcccggaatctacaaatatgttgatgcacctctttacggatgagggaattccggcaagctaccgtaaaatgcgcggttcgtccgtccatgcttttaaatgggtgaacgctcacggcaatacggtttatgtcaagttacgttgggtgccaaaagtcggtgttcataacctgtcagcagatgaagcgacagagattcaaggaaaagactttaaccatgcatcaaacgacacgtatcaggcgattgaagacggagaattcccggagtgggatctgttcgtccaagttcttgatccggctgatgtcgacaacttcgacttcgatccactcgatgcaacaaaagattggtttgaagatgtcatcccgttccaacacgtcggaacgatggtattaaacaaaaacgtcgacaactactttgctgaaacggaatcggtcggctttaacccgggtgtactgatcccaggcatgttgccgtcagaagataaattgctccaagggcgtctcttctcgtattccgatacacagcgttaccgtatcggaacgaactatcaacagttgccgattaactgcccgttcgctcaggtcaacaactatcaacgtgacggtgcaatgccggtcggacaacaaacaagcccggtcaactacgaaccaaaccgttaccaggacgagccgaaacaaacgccggaatacacggaagaaaaccagccgttgtatgatgacattcacggtcgtcttgaaatcgaaaaaacaaataacttcggtcaagccggtgaagtgtaccgtcgtatgacagaagaagaacaaacggcactcctgaacaatttagtggatgacttaaaacaagtccgccatgaaaacactgtcttgcttgccatctgtaacttctaccgtgcggacgaatcgctcggcaagaaattatcagaagcgttacaagtcgatatccaaccgttcttgcaacagatgcaaaaataa

SEQ ID NO: 42896 - protein, 489 aa, Exiguobacterium sp. 255-15
MSEKRLTTNQGVPIGDNQNSRTAGRRGPTLLEDYQLIEKMAHFDRERVPERVVHARGFGAHGVFTVKNSMKKYTKAAFLQNEGTEVPVFARFSTVIHGTHSPETLRDPRGFSVKFYTEEGNWDFVGNNLPVFFIRDSMKFPDMVHSLKPDPRTNIQDPDRYWDFMTLRPESTNMLMHLFTDEGIPASYRKMRGSSVHAFKWVNAHGNTVYVKLRWVPKVGVHNLSADEATEIQGKDFNHASNDTYQAIEDGEFPEWDLFVQVLDPADVDNFDFDPLDATKDWFEDVIPFQHVGTMVLNKNVDNYFAETESVGFNPGVLIPGMLPSEDKLLQGRLFSYSDTQRYRIGTNYQQLPINCPFAQVNNYQRDGAMPVGQQTSPVNYEPNRYQDEPKQTPEYTEENQPLYDDIHGRLEIEKTNNFGQAGEVYRRMTEEEQTALLNNLVDDLKQVRHENTVLLAICNFYRADESLGKKLSEALQVDIQPFLQQMQK

SEQ ID NO: 42897 - DNA, 1467 bp, Listeria monocytogenes str. 1/2a F6854
  CDS (1)..(1467): transl_table=11
atgacagatagaaaaaatttaacgacgaatcaaggtgtgccagttggtgataaccaaaattcaatgacagcgggacgtaaaggacctactttgatagaagattatgtgcttattgagaaattggcgcattttgatagagaacgagttcctgagagggttgtacatgctcgtggtgctggtgcgcacgggaaatttgttactaaaaaaagcatgaaaaaatatacaatggctaaatttttgcaagaagaaggaacggaaacagaggtttttgctcgtttttcaacagtaattcatgggcaacattctccagaaacattacgtgatccacgcggtttctccgttaagttttatacggaagagggaaattatgactttgtcggaaataatttgccagtatttttcattcgtgatgcgattaagtttccagatgttattcattccttgaagcctgacccgcgcacaaatattcaagatggcaatcgttactgggatttctttagccttacaccggaagctacgacgatgattatgtacttattcagtgatgaaggaacgccggcttcttaccgcgaaatccggggctctagtgttcatgcgttcaaatggattaacgaagaaggcaaaacagtttatgtaaaattgcgctgggttccaaaagcaggaatagtgaacctttcgacggagcaagcttctcaaattcaagcaaaagaatttaaccatgcaagtcgtgatttgtacgaagcaattgaaaatggagactatcctgaatgggatttatatgtgcaagtgttggatccgaaagacttagatagctttgatttcaatccattagatgctacaaaagattggtttgaagatgtattcccttatgaacacgtaggaacaatgacgctagaccgcaacccagataatatttttgcggagacagaatcagttgggtttaaccctggtgtacttgtacgcggaatgctaccttctgaggatcgtttgttgcaaggtcgtttattctcgtattcagatacgcaaagacatcgcgtggggccaaactacttacaactgccaattaacagcccgaaagcgcctgtcgctaacaaccaacgtgacggtcatatgccatttaaacaacaaacgagctcgattaattatgagccaaatagctatgatacagaaccaaaagaaaatccagcatttatcgaaccggagcaagaaatccgtggtgatgtagctggtcgtctgattgctgaaaaaccaaataactttggtcatgcaaaagaagtatgggatcgctattcagatgctgaacgtgcggcgcttgtgaaaaacattgttgacgattggtctgcagtgcgtgaggatattaaaatccgcaacctacgtaatttctatcaagtagatccggaattcgctagtcgagttgctgcgagaactggtattaatcttgaagaacatgtaactgatttaaaataa

SEQ ID NO: 42898 - protein, 488 aa, Listeria monocytogenes str. 1/2a F6854
MTDRKNLTTNQGVPVGDNQNSMTAGRKGPTLIEDYVLIEKLAHFDRERVPERVVHARGAGAHGKFVTKKSMKKYTMAKFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMIMYLFSDEGTPASYREIRGSSVHAFKWINEEGKTVYVKLRWVPKAGIVNLSTEQASQIQAKEFNHASRDLYEAIENGDYPEWDLYVQVLDPKDLDSFDFNPLDATKDWFEDVFPYEHVGTMTLDRNPDNIFAETESVGFNPGVLVRGMLPSEDRLLQGRLFSYSDTQRHRVGPNYLQLPINSPKAPVANNQRDGHMPFKQQTSSINYEPNSYDTEPKENPAFIEPEQEIRGDVAGRLIAEKPNNFGHAKEVWDRYSDAERAALVKNIVDDWSAVREDIKIRNLRNFYQVDPEFASRVAARTGINLEEHVTDLK

SEQ ID NO: 42899 - DNA, 1467 bp, Bacillus cereus G9241
  CDS (1)..(1467): transl_table=11
atgaatccaaataatcgcttaacaacaaaccaaggtgctccagttggagacaatcaaaattctcgtacagctggtcgccgtggaccggtattattagaagactatcatttagtagaaaaattggctcactttgatcgtgaacgtattccagagcgtgttgtacacgcacgtggtgcaggtgctcacggtgtattcgttacgaaaaatagcatgaagcaatatacgaaagcagcatttttacaaaatgaaggaactgaaacgcctgtatttgttcgtttttcaacggttattcatggtcaaggttctccggaaacagctcgtgatccacgtgggttcgctgttaaattttatacagaagaaggaaactatgatatcgtaggtaatcatttaccggtcttcttcattcgtgatgcaattaaattccctgatatggtgcattctttaaaaccagcacctgatacaaatattcaaacaccagatcgttactgggatttcatgacgttaagtccagaatctacacatatgatgacgtgggtattttctgattacggtacaccagcaagctatcgtgaaatggaagggttcggtgtacattcatttaaatggattaatgcagaaggtaaaattgtctacattaaatatcactggaaaccacagcaaggtgtacgtaacttaagtgcaaaagaagtgcaagaagtacaaggaaaagacttcaaccatgcaactcgtgacttattcgatgcaatcgaaaaagggaattatccaaagtgggatttacacgtacaagtgatgcaactagaagaaacggattctttagatttcgatccgttagatccaacgaaagtttggccagaagatcgtttcccgttaatggaagtagggacaatgacgttaaatcgtaacccgaaaaacttctttgcggaagtagaacaagtggcgttctctccaagtgcaactgtaaatggtattgaaccatctgaagataaattattacaaggtcgtttattctcttatccagatacacagcgttatcgccttggtgcaaactacttacaaattcctgtaaactgcccatacgcagctgttcataaccaacaacgtgatggtgcgatgcaaatcaatcaaaacccatctacaatcaattacgaaccgagccgtcatgctgaaaatccagttgaagacccagcttaccgcgattcaactatgaaagtagaaggctatgtatctcgtgaaaaaattgacaaaccaaatgacttcaaacaagcaggtgagcgttaccgttcattctctaaagaagagcaagacaacttaattgccaacttaacaaatgacttaaaagacgtaagtgaacgaacgaaattactagctgtttgtaacttcttccgtgcagatcaagagtacggtatgcgtttagcgcaatcgttaaatgttgatattacgcaatatgtaggaaatgctccgaaataa

SEQ ID NO: 42900 - protein, 488 aa, Bacillus cereus G9241
MNPNNRLTTNQGAPVGDNQNSRTAGRRGPVLLEDYHLVEKLAHFDRERIPERVVHARGAGAHGVFVTKNSMKQYTKAAFLQNEGTETPVFVRFSTVIHGQGSPETARDPRGFAVKFYTEEGNYDIVGNHLPVFFIRDAIKFPDMVHSLKPAPDTNIQTPDRYWDFMTLSPESTHMMTWVFSDYGTPASYREMEGFGVHSFKWINAEGKIVYIKYHWKPQQGVRNLSAKEVQEVQGKDFNHATRDLFDAIEKGNYPKWDLHVQVMQLEETDSLDFDPLDPTKVWPEDRFPLMEVGTMTLNRNPKNFFAEVEQVAFSPSATVNGIEPSEDKLLQGRLFSYPDTQRYRLGANYLQIPVNCPYAAVHNQQRDGAMQINQNPSTINYEPSRHAENPVEDPAYRDSTMKVEGYVSREKIDKPNDFKQAGERYRSFSKEEQDNLIANLTNDLKDVSERTKLLAVCNFFRADQEYGMRLAQSLNVDITQYVGNAPK

SEQ ID NO: 42901 - DNA, 1488 bp, Pseudomonas fluorescens PfO-1
  CDS (1)..(1488)
ttggccgccagcctgctgaccctttccgtgaacgccgcccccctgacccgggataacggtgcggcagtcggcgacaaccagaactcgcaaaccgccggcgccaatggcccggtgctgttgcaggacgtgcaactgatccagaagctgcaacgtttcgaccgtgaacgcattcccgaacgtgtcgtgcatgctcgcggcaccggtgcccatggcacgttcaccacaaccaacgatctgagtgatctgagcaaggccaaggtgtttaccgccggccaggtcacgccggtgttcgtacgtttctcggcggtggttcacggcaatcactctccggaaaccctgcgtgaccctcgggggttcgcaaccaagttctacaccgctgacggcaattgggatctggtgggcaacaactttccgacgttcttcatccgcgatgcgatcaagtttccggacatggtgcatgccttcaagcccgatccgcgtactaaccttgacgatgactcgcgtcgcttcgatttcttctcccatgtaccggaagctacccgcacattgaccgagttgtattccaactcgggcactccggccagctatcgggagatggacggcaatagtgtgcacgcctacaagttggttaacgccaagggcgatgtgcactatgtgaagtttcactggaaaagtttgcaaggcatcaaaaatctcgatccgaaacaagttgagaaagttcaggggcgcgactacagccacatgactcacgacttggtagaaaacattcaaaaaggaaactttcccaagtgggacttgtacattcaagtcttgaatccgcaagacttgtccaagtttgaattcgatcctcttgatgcaaccaagatctggccaggtgttccagagcgaaaagttggacaaatggtgttgaaccgtaatcctgcgaatgtcttccaggaaactgaacaggtcgccatggcgccatcgaatgtggtgccgggcatcgagccttcggaagaccgtctgttgcaaggccggatatttgcctacgccgatacccagatgtatcgccttggcgccaacgccctgcaattgccgatcaatgccgccaaaactgctgtcaacaatggcaatcaggatggcgcgatgaatgccggtgcgagcacctcgggcgtcaactatgagcctagccgtctgcagccgcgtgaagagacggcaggcgcgcgatacagccagaccgcgctgcagggcagcacgcaacaggcgaagatccagcgtgaacagaacttcaagcaggccggagatctgtatcgctcgttcagcaagaaggaacgtcaggatctgatcgagagctttggcggttcgctggcgagtgccgatgacgagagcaagcacatcatgctgtccttcctctataaggcggatccggaatacggcgccggggtgaccaaagtggccaagggtgacctgagtcgggtcaaggcgttggcggccaaactggccgactga

SEQ ID NO: 42902 - protein, 495 aa, Pseudomonas fluorescens PfO-1
MAASLLTLSVNAAPLTRDNGAAVGDNQNSQTAGANGPVLLQDVQLIQKLQRFDRERIPERVVHARGTGAHGTFTTTNDLSDLSKAKVFTAGQVTPVFVRFSAVVHGNHSPETLRDPRGFATKFYTADGNWDLVGNNFPTFFIRDAIKFPDMVHAFKPDPRTNLDDDSRRFDFFSHVPEATRTLTELYSNSGTPASYREMDGNSVHAYKLVNAKGDVHYVKFHWKSLQGIKNLDPKQVEKVQGRDYSHMTHDLVENIQKGNFPKWDLYIQVLNPQDLSKFEFDPLDATKIWPGVPERKVGQMVLNRNPANVFQETEQVAMAPSNVVPGIEPSEDRLLQGRIFAYADTQMYRLGANALQLPINAAKTAVNNGNQDGAMNAGASTSGVNYEPSRLQPREETAGARYSQTALQGSTQQAKIQREQNFKQAGDLYRSFSKKERQDLIESFGGSLASADDESKHIMLSFLYKADPEYGAGVTKVAKGDLSRVKALAAKLAD

SEQ ID NO: 42903 - DNA, 2115 bp, Rhodospirillum rubrum
  CDS (1)..(2115)
atggccaaacgctcaaccgacgccctgaccccggccgaaatcgccgacgccaaaattctgcgcggcaccgggggcgaaacccatcagatcgccgagggcgacacccccgtgctgacgacccagcaggggatcccagtggccgacgatcagaattccctgcgcatcggcccacgtggaccaaccctgctggaagacttcgccttccgcgaaaagatcttccatttcgaccacgagcgcattcccgagcgcatcgttcatgcccgggggttcggcgcccatggcaccttcgaaacctatgaagacctaagcgccctgacctcggccgatatctttcagcgcgccggcgaaaagacccccgccttcgtccgcttctcgacggtggcgggcaatctcggctcgtccgatgtcgcccgcgatgtgcggggattcgccgtcaagctttataccaagcaaggtaattgggacatcgtcggcaacaacatcccggtgttcttcatccaagacgccatcaagtttcccgatctgatccacgccgccaaacaggaacccgacagcggcttcccccaggcgcaaaccgcccacgacaatttctgggacttcatctccctgatgccggaatcgctgcatatggcgttatggatcatgtccgatcgcaccatcccgcgctcgttccgcttcatggaaggctttggcgttcataccttccgactggtcaccgccgagggcaaatccagcttcgtcaaatttcactggaagcccaagcttggcctgcagtcggtggtgtggaacgaggcggtcaagatcaacggcgccgatcccgatttccaccgccgcgacctgtggtcggcgatcaagcgcggcgattatcccgaatgggacttgggtctgcaggtttttgatgacgccttcgccgacagcttccccttcgatgtgctggacgccaccaagctgatccccgaggaattggtgccgatccgcatcgtcggccgcctggtgctagatcgcaccgtcgataacttcttcgccgaaaccgaacaggtggccttccataccgccaacatcgtgcccggcatcgatttcaccaatgatcccctgcttcagggccgcaatttctcctatctcgacacccagatcaaacgcctgggcggccccaatttcacccatctgccgatcaatgccgccaagtgtcccttccacagcttccagcaagacggccatatggccttcgtcaatccgaaaggtcgggccaattacgagccgaattcctggggaccgggcatcggcggcccccgggaatcacccgaaagcggcttccacagctttcccgccgaggacggcggcgagaagcgccgggtgcgcggcgagttgttcgccgatcactacagtcaggcccgccagttctaccggagccagacgcccgtcgagcaaacccacatcaaagattcgttcgtttttgaactgagcaaggtcgaaaccccggccatccgcgcccgggtggtgtcgcatctgctgaccatcgatcagactctggcccagaaagtggccgatggcctggggctggccgagctgccggaagcggctaaaccggcccgcccgctggtcgaggatctgcccgcctcgccggcgctcagcatccttctcaacccgcccaaggatttctccggacgcaaggtcggcgtgctggtcagcgatggcgtcgacggcgcctttcttgacgagatcgagcgcctcctgacggcggaaggcgcccaaatggaggtgatcgcccccagggtcggcggcttcaccgccaaggatggcaccctgcgcccggcccaccagaaggtgaacggcgccccttccgtgctgtacgacgccgtcgccgttcttctgtcgaccgagggcgccaagcttctgctgaacgaagccaccgccaaggatttcgtcagcgacgccttcgcccatgccaaggtcatcgcctttacccaggccgcccagcccttgctggaaaaggccggggtgatcgccgacgagggctgcctgctgcttgatacccccgccaaggccgaaacgttcctcggcctctgccgcaagggccggcgttgggaacgcgaggccaaggttcacgcggtctag

SEQ ID NO: 42904 - protein, 704 aa, Rhodospirillum rubrum
MAKRSTDALTPAEIADAKILRGTGGETHQIAEGDTPVLTTQQGIPVADDQNSLRIGPRGPTLLEDFAFREKIFHFDHERIPERIVHARGFGAHGTFETYEDLSALTSADIFQRAGEKTPAFVRFSTVAGNLGSSDVARDVRGFAVKLYTKQGNWDIVGNNIPVFFIQDAIKFPDLIHAAKQEPDSGFPQAQTAHDNFWDFISLMPESLHMALWIMSDRTIPRSFRFMEGFGVHTFRLVTAEGKSSFVKFHWKPKLGLQSVVWNEAVKINGADPDFHRRDLWSAIKRGDYPEWDLGLQVFDDAFADSFPFDVLDATKLIPEELVPIRIVGRLVLDRTVDNFFAETEQVAFHTANIVPGIDFTNDPLLQGRNFSYLDTQIKRLGGPNFTHLPINAAKCPFHSFQQDGHMAFVNPKGRANYEPNSWGPGIGGPRESPESGFHSFPAEDGGEKRRVRGELFADHYSQARQFYRSQTPVEQTHIKDSFVFELSKVETPAIRARVVSHLLTIDQTLAQKVADGLGLAELPEAAKPARPLVEDLPASPALSILLNPPKDFSGRKVGVLVSDGVDGAFLDEIERLLTAEGAQMEVIAPRVGGFTAKDGTLRPAHQKVNGAPSVLYDAVAVLLSTEGAKLLLNEATAKDFVSDAFAHAKVIAFTQAAQPLLEKAGVIADEGCLLLDTPAKAETFLGLCRKGRRWEREAKVHAV

SEQ ID NO: 42905 - DNA, 1455 bp, Rhodospirillum rubrum
  CDS (1)..(1455)
atgaccacgcgcctgaccaccaccgccggtgccccggtcgccgataatcaaaacagcctgaccgccggaccccgggggccggtgctgctgcaggattatcagttgatcgagaagctggcccaccagaaccgggaacgcattcccgaacgcgtcgtccacgccaagggctggggcgcccatggcaccttgaccatcacccatgacatcagccgctatacccgagccaagctgttctcggcggtcggcaaaacgacaccggtgctcgcccgcttttcgacggtggcgggcgaattgggggcggccgacgccgaacgcgacgtgcgcggcttttcgctgaagttctataccgaggaaggcaactgggatctggcgggcaacaacaccccggtgttcttcgtgcgcgatcctttgaagtttcccgatttcatccatacccagaaacgccatccgcgcacccatctgcgctcgcccaccgccatgtgggatttctggtcgctcagcccggaaagcctgcatcaggtcaccatcttgatgagcgatcgcggtctgccgcttgatcccatgcatatgaacggctacggcagccacacctattccttctggaacgacgccggcgagcgcttttgggtgaagttccacttcaagacccaacagggccatgctcatctgaccaatgccgccgccaaggtcgtggtcggcgagtcgcgcgaaagctatcaggaggcgctgtttggcaccatcgagtcgggtcacttcccgcgctggacgctgtttgtgcagatcatggccgaacgcgaggccgaaaccaccccctataaccccttcgacctcaccaaggtctggccgcacggcgattttccgctgatcgaggtcggggtgctggaactcaaccgcaacgccgagaactatttcgccgagatcgagcaggcggccttttcgccgtcgaacgtcgtcccgggcatcggccattcgcccgacaagatgcttcaagcccgggtgttcgcctatgccgacgcccatcgctatcgcctgggcacccattacgaggccctgccggtgaacgccccgctcagcccggtcaatcactaccacaaagacgggccgatgcgctttttccccaataatcccaacgccgacgcctattacgagcccaacagcttcggtggacccaaagaggacccctcggtcaaggagccgccgctgcgcatcaacggcgatgccgatcactacaaccaccgcgagggcaacgacgattacgtccaggtcggcgccctcttcgccctgtttgacgagggcgagcgccagcgtctgttctccaatatcgccgaggccatggccggcgtgcccgaggagatcatccgccgccagttggtccatttccaccgcgccgatccggcttacggcgagggcgtggccaaggcgctgggactggccccggtttcccaaccggcctga

SEQ ID NO: 42906 - protein, 484 aa, Rhodospirillum rubrum
MTTRLTTTAGAPVADNQNSLTAGPRGPVLLQDYQLIEKLAHQNRERIPERVVHAKGWGAHGTLTITHDISRYTRAKLFSAVGKTTPVLARFSTVAGELGAADAERDVRGFSLKFYTEEGNWDLAGNNTPVFFVRDPLKFPDFIHTQKRHPRTHLRSPTAMWDFWSLSPESLHQVTILMSDRGLPLDPMHMNGYGSHTYSFWNDAGERFWVKFHFKTQQGHAHLTNAAAKVVVGESRESYQEALFGTIESGHFPRWTLFVQIMAEREAETTPYNPFDLTKVWPHGDFPLIEVGVLELNRNAENYFAEIEQAAFSPSNVVPGIGHSPDKMLQARVFAYADAHRYRLGTHYEALPVNAPLSPVNHYHKDGPMRFFPNNPNADAYYEPNSFGGPKEDPSVKEPPLRINGDADHYNHREGNDDYVQVGALFALFDEGERQRLFSNIAEAMAGVPEEIIRRQLVHFHRADPAYGEGVAKALGLAPVSQPA

SEQ ID NO: 42907 - DNA, 1446 bp, Ralstonia metallidurans CH34
  CDS (1)..(1446)
atgaataagctcacgaccgcatttggcgcgcccgttgtcgataaccagaacgttcagaccgccggcccgcgtggccccgccctgctccaggatgtctggttcctcgaaaagcttgcccacttcgaccgtgaagtgattccggaacgccgcatgcacgccaagggcgccggcgcttacggcacgttcacggtcacgcatgacatcaccaagtacacgcgcgcgaacctgttctcacaggttggcaagaaaaccgacctgttcctgcgcttctcgtcggtggccggcgagcgcggcgcggccgatgcggaacgcgacatccgcggctttgcgatcaagttctacaccgaggaaggcaactgggacctggtgggcaacaacaccccggttttcttcctgcgcgaccccctgaagttccccgacctgaaccacgccgtgaagcgcgacccgcgcacgggcatgcgtagcgccgaaagcaactgggacttctggaccggcctgcccgaagccctgcaccaggtcacgatcgtgatgagtgaccggggtatcccgcgcacctggcgtcatatgcacgggttcggcagccatacctacagcttcatcaacgccaacatggagcgtttctgggtgaagttccacttcgtcacccagcagggcatccagaacctgactgacgaggaagctgcggagatcacgggccaggaccgcgaatatcaccagcgcgatctgtttgaatcaatcgaacgtggcgatttcccgcgctggaagctctgcgtgcagatcatgccggaagccgaagccagcaaggttccctaccacccgttcgacctgaccaaaatctggccgaagaaggactacccgctgatcgaagtcggcgtgctggaactgaaccgcaatccggacaacttcttcgccgaagtcgaacaggcatcgttcgcgccgtcgacgatcgtccctggcgtcggtttctcgcccgacaagatgttgcagggccgtctattctcgtacggcgacgccgcgcgctatcgcgtcggcgtgaatcatcaccagattccggtgaactcgccgaaagccgcgaagtacgtcaacagctatcaccgcgacggcacgatgcgcgtcgacggcaaccggggggccgccatcggctatgagcccaatacgaagggcgagtgggccgagcaacccgacttccgcgaaccgccgctgacgctggaaggcactgccgaccactggaaccatcgcgaggacggcgactacttctcgcaggtcggcgcgttgttccgcctgatgtcgccgacgcagcagcaggcgctgttcgacaacacggcccgctcgatcaagggtgtgtcgaaacacatccagcagacccacatcaagcattgcacggcggctgaccccgcctatggtgcgggtgtcgcggctgctatcgagatgatcgaggccaagtaa

SEQ ID NO: 42908 - protein, 481 aa, Ralstonia metallidurans CH34
MNKLTTAFGAPVVDNQNVQTAGPRGPALLQDVWFLEKLAHFDREVIPERRMHAKGAGAYGTFTVTHDITKYTRANLFSQVGKKTDLFLRFSSVAGERGAADAERDIRGFAIKFYTEEGNWDLVGNNTPVFFLRDPLKFPDLNHAVKRDPRTGMRSAESNWDFWTGLPEALHQVTIVMSDRGIPRTWRHMHGFGSHTYSFINANMERFWVKFHFVTQQGIQNLTDEEAAEITGQDREYHQRDLFESIERGDFPRWKLCVQIMPEAEASKVPYHPFDLTKIWPKKDYPLIEVGVLELNRNPDNFFAEVEQASFAPSTIVPGVGFSPDKMLQGRLFSYGDAARYRVGVNHHQIPVNSPKAAKYVNSYHRDGTMRVDGNRGAAIGYEPNTKGEWAEQPDFREPPLTLEGTADHWNHREDGDYFSQVGALFRLMSPTQQQALFDNTARSIKGVSKHIQQTHIKHCTAADPAYGAGVAAAIEMIEAK

SEQ ID NO: 42909 - DNA, 1485 bp, Thermobifida fusca
  CDS (1)..(1485)
ttgaccgagaccaacgaggcactgtccactgcgagcaacgccacgggctccacgctcgactctggtgcgcctgcggctagcgaccgcaactcgctgagcgtgggcagcaacggcccgctgctgctgcacgacgtacggctcgttgagacgctcgcccacttcaaccgtgagcgggtccccgagcgcaacccgcacgccaagggcgccggtgccttcggtgtcttcgaaaccacggaggacgtctcccagtacaccaaggctgccctgttccagaagggtgcccgtaccgagatgctcgcccggttctccacggtcgctggtgagcagggctccccggacacctggcgggacgtgcgcggtttcgctctgaagttctacacctctgagggcaactacgacctggtcggcaacaacacgccgatcttcttcgtccgcgacccgatgaagttcccgcacttcatccgctcccagaagcggatgccggacacgggtctgcgcgacaacaacatgcagtgggacttctggaccctcaacccggagaccgcccaccaggtcacctacctcatgggtgaccgcggcctgccgcggacctggcgccacatgaacggctacggttcgcacacctacatgtggatcaacgccaagggcgagaagttctgggtcaagtaccacttcaaaaccgaccagggcatcgagaacatgaccaacgaggaagccgagcgtctcgccggtgtggacgccgacttccaccgtcgtgacctggtcgaggccatcgaacgcggggactacccgagctggaccctctacgtgcaggtcatgccgtacgaggacgccaagacctaccggttcaacccgttcgacctgaccaaggtctggccgcacagcgactacccgctcatcaaggtcggcaagatgaccttgaaccgcaacccggagaacttcttcgccgagatcgagcaggccgcgttcgcgccgtcgaacctggtcccgggtatcggcgtctccccggacaagatgctgctgggccgcgtcttcgcctacgcggacgcccaccgggcccggatcggcaccaactacttccagctgccggtgaacaagccgcgggtgaaggtcaactcctacaccttcgacgggcacatgacctacgagcactccggcaaggccccggtgtacgcgcccaactcctacggccgtccctggtctgaccagaccggcccggtcgaggacagctgggaggccgacggcgagctggtgcgcagcgcctacgagctgcacgctgaggacgacgacttctcgcaggccggcaccctggtccgcgaggtcttcgacgacgcccagcgggaccggctcgtggagacggtcgccgaccacctgtccaagggtgtcgtcgagccggtgctctcccgggccttccagtactggaagaacatcgacgagaccatcggcgagcggatcgagaagcggtaccacgagatcgctcggtga

SEQ ID NO: 42910 - protein, 494 aa, Thermobifida fusca
MTETNEALSTASNATGSTLDSGAPAASDRNSLSVGSNGPLLLHDVRLVETLAHFNRERVPERNPHAKGAGAFGVFETTEDVSQYTKAALFQKGARTEMLARFSTVAGEQGSPDTWRDVRGFALKFYTSEGNYDLVGNNTPIFFVRDPMKFPHFIRSQKRMPDTGLRDNNMQWDFWTLNPETAHQVTYLMGDRGLPRTWRHMNGYGSHTYMWINAKGEKFWVKYHFKTDQGIENMTNEEAERLAGVDADFHRRDLVEAIERGDYPSWTLYVQVMPYEDAKTYRFNPFDLTKVWPHSDYPLIKVGKMTLNRNPENFFAEIEQAAFAPSNLVPGIGVSPDKMLLGRVFAYADAHRARIGTNYFQLPVNKPRVKVNSYTFDGHMTYEHSGKAPVYAPNSYGRPWSDQTGPVEDSWEADGELVRSAYELHAEDDDFSQAGTLVREVFDDAQRDRLVETVADHLSKGVVEPVLSRAFQYWKNIDETIGERIEKRYHEIAR

SEQ ID NO: 42911 - DNA, 2175 bp, Novosphingobium aromaticivorans DSM 12444
  CDS (1)..(2175)
atggctacccccacgaaaggcaaggcccccgctcgtgccgcgaaggagcgctcgcccgcgctcgacaatgcgcttcgcgaccatcagcccggagcgggccagaccgatgaagcgactgctctcggcaatgccggggaaatccaccaggaggctgctgccgaaaacgatgcggctgccttcctgaccgacaacttcggccatcgcctgtccgacaaccagaatagcctcagggccggaatgcgcggtccgacgctgatcgaggacttcatcctccgcgagaagatcttccacttcgaccacgagcgcattccggagcggatcgtccacgcgcgcggatcgggtgcgcacggcgtgttcgaggtgacgcgcgcgatccccgacctgaccagggccgggttgttccagaaaaagggccagacctgcccggtcttcgtgcgcttttccaccgtggccggcggggccggctcgatcgacaccccgcgcgacgtgcgcggcttcgcggtcaaattctataccgacgagggcaactgggacctggtcggcaacaacatcccggtgttcttcatccaggacgcgatgaagtttcccgatctggtccattcggtgaagatggaagccgatcgcggctatccgcaggcggccagtgcccatgacaccttctgggacttcatcgggctgatgccggaatcgatgcacatgatcatgtgggcgatgagcgaccgcgccattccccgcacgctgcgcatgatggaaggctttggcgtgcacaccttccgcttcgtcaatgcggcgggcgaggggcggttcgtcaagttccactggaagccggtgctgggcatggaatcgctgatctgggacgaggcggtgaaggtcgccggggccgatcccgatttccatcgccgcgacctgttcgaatccatcgctgccgggcacttcccggcgtgggaccttggggtccaggtcttcgacgaggaattcgccgcgagccagccgtacgatgtgctcgatgcgaccaagctgattccggaagaggacgtccccgtcgagatcgtcgggcgcatgacgctgaaccgcaatgtcgacaacttcttcgccgagaccgagcaggtggcgttcctgccatcgaacgtgatcccgggtatcgacttctcgaacgacccgttgctgcaagggcgcctgttctcctacctcgatacgcagaaatcgaggcttggcacgacaaacttccaccagattccggtcaatgcgcccaagtgcccgttccataacatgcagcgcgacggcctgatgcagacgctggtgcccacaggccgcgccaactacgagcccaattcgctcgacgaagcgggcgaggacagcgggccgcgcgcctgcccggaaaccggcttcacgtcgttccgcgagaatggcgagcgccacgatccgaccgaaaaggtgcgcgtgcgggcggatctcttcgccgaccactacagccaggcggcgctgttcttccactcgcagaccgagagcgaacaggcgcacatcgcctctgcgctggtgttcgaactgtccaaggtcgcgctggaacatgtccgggcgcgggtcgtgtcgcggttgcgcaacattgacgagacgctggcgcagcgcgttgccgatggccttgcgatggacctgccggaaaaggcgcctgccgcacgccagccggtgaagatgaagccatcggacgccctgtcgatccagaagcaggcgaagaagacctttgccggacgcaaggtcggcattctctttgccgaaggatcggacaaggcgacgatcgacaagctgaaggcgggtgtggaggaggcgggtggcaccgtcttcctcgtcgcgcccaaggtcggcggcatcccggtcaagggcggcacgctgaaggccgatggcaagctggatggatcgccctccgtcctgttcgacgcggtggcatcggtgctgatgccggaagcggcggcgaagctcgccatgcagggtgcggccgtgcagtggttcatggatgcctatggccactgcaagacaatcgcccactgcaacggcacccggatcatcctcgagaaggccggggtggagcctgacgagggcgtggtgcccaatgaaaagctgctcgaagtcggccctgtgcgccacttcgcgcgtgagccgaaggttcgcgatctggcctga

SEQ ID NO: 42912 - protein, 724 aa, Novosphingobium aromaticivorans DSM 12444
MATPTKGKAPARAAKERSPALDNALRDHQPGAGQTDEATALGNAGEIHQEAAAENDAAAFLTDNFGHRLSDNQNSLRAGMRGPTLIEDFILREKIFHFDHERIPERIVHARGSGAHGVFEVTRAIPDLTRAGLFQKKGQTCPVFVRFSTVAGGAGSIDTPRDVRGFAVKFYTDEGNWDLVGNNIPVFFIQDAMKFPDLVHSVKMEADRGYPQAASAHDTFWDFIGLMPESMHMIMWAMSDRAIPRTLRMMEGFGVHTFRFVNAAGEGRFVKFHWKPVLGMESLIWDEAVKVAGADPDFHRRDLFESIAAGHFPAWDLGVQVFDEEFAASQPYDVLDATKLIPEEDVPVEIVGRMTLNRNVDNFFAETEQVAFLPSNVIPGIDFSNDPLLQGRLFSYLDTQKSRLGTTNFHQIPVNAPKCPFHNMQRDGLMQTLVPTGRANYEPNSLDEAGEDSGPRACPETGFTSFRENGERHDPTEKVRVRADLFADHYSQAALFFHSQTESEQAHIASALVFELSKVALEHVRARVVSRLRNIDETLAQRVADGLAMDLPEKAPAARQPVKMKPSDALSIQKQAKKTFAGRKVGILFAEGSDKATIDKLKAGVEEAGGTVFLVAPKVGGIPVKGGTLKADGKLDGSPSVLFDAVASVLMPEAAAKLAMQGAAVQWFMDAYGHCKTIAHCNGTRIILEKAGVEPDEGVVPNEKLLEVGPVRHFAREPKVRDLA

SEQ ID NO: 42913 - DNA, 2136 bp, Cytophaga hutchinsonii
  CDS (1)..(2136)
atgaaaaagcctacttcaaagacagaaggtacagatcctaaatttcaggatctccaaaaaaacacatcggatgccaccgatcaatttatgacaacggatcagggattgaaaattaatgatgataataattcattaaaagccggagagcgtgggccttctttactggaagattttattttaagagaaaaaattacacattttgatcacgaacgtattcctgaacgcatcgtacatgcgcgtggatctgcggcacatggctatttccaggtgcacgaatcgatggcgcaatataccaaagccggctttttgcaggatccatcaatcaaaacacctgtcttcgtaagattctctacagttgctggttccagaggctctacagatctcgcgcgcgatgtacgtggattttctgttaaattttatacagcggaaggaaattatgatcttgtaggaaataacatgcccgtcttttttattcaggatgcagcaaaatttcccgacctgatccatgctgtaaaaccggaaccgcatcatgaaatgccgcaggcagcttctgcgcacgatactttctgggattttatttcactgatgcccgaatccatgcacatgatcatgtgggtcatgtctgaccgtgcaattccacgcagtttaaggatgatggaaggttttggggtacatacgttccgatttataaataagaataatgaatctcattttgtaaaattccactggaaaccgaaacaaggtacgcatagtgtagtatgggatgaagcacaaaaaatttccggtaagaattgtgattttcaccgtcaggatttgtgggaagcaatcgaaagcggcaattttccggaatgggaattgggtgtgcaattgattccggaagcggatgaacacaaatttgcatttgacctgctggatcctaccaagcttgtgcctgaagaggaagtgccggttaccattataggaacaatggtactgaaccggaatccggataatttctttgctgaaacagaacaggtggctttccatcccggacatttggtaccgggcattgattttacaaacgatccattactgcagggaagattgttctcttatacggacacacaattatcccgcctcggcagtcccaattttcatgagattccgattaaccgcagtgttgctcctactcataacaatcaacgcgatggccacatgcgccaggaaattaataccggacgtgtaagttatcacccgaattcattgggcggcggctgccccttccaggcaaagatggctgaaggtggtttcaccagcttcaacgaacgtattgatgcaaagaaagttcgggaacgcagtgaaagtttctcggaccatttcagccaggctaccctattctttaacagccagacagaagtagagaaagggcatattattaaagcacttcgctttgaactgggcaaagttgaaacagaagcaatccgcgtacgcatggttggtttgctttctcagattgacaaaacactggcaacgaaagtagctgccggacttggtatcgcagttcctgctcctgcatttcctatgaatcatggtgtgggcgcagatgatgattttgaaaagcatgagcctaaaaaagcagagcaggtaacaaaatcttctgatgcacttaccatattgagaaatccaacggttaccccttctattgcaacaaaacagattgcctttttatgtgcagatgaggtaagtggtgcgtctgtggtgagttataaaaatgcgttggaaagaaaaggtgctgtagtgaagatcattgcgcctcaccttggatttatcaaaacagaagaaggtaaaaaaataaaagtggatcaaagtttattgattgctgcttcggtattatttgatgctgtttttattcctgcagggaaaggaattaaacaattaaaaggtataaaagaagtagctgaatttatcaccgatacatacaaacattgtaaagtaattggtggcgaagacgaaggtgctttagtaattcaatctgtacaagcgattatggaggccggaaaaaatgcagatgaaggaattgttctgaataaagacacaacggcatttgttaaagcacttggcaaacatcgtttctgggaacgcgaagaagcggtgtaa

SEQ ID NO: 42914 - protein, 711 aa, Cytophaga hutchinsonii
MKKPTSKTEGTDPKFQDLQKNTSDATDQFMTTDQGLKINDDNNSLKAGERGPSLLEDFILREKITHFDHERIPERIVHARGSAAHGYFQVHESMAQYTKAGFLQDPSIKTPVFVRFSTVAGSRGSTDLARDVRGFSVKFYTAEGNYDLVGNNMPVFFIQDAAKFPDLIHAVKPEPHHEMPQAASAHDTFWDFISLMPESMHMIMWVMSDRAIPRSLRMMEGFGVHTFRFINKNNESHFVKFHWKPKQGTHSVVWDEAQKISGKNCDFHRQDLWEAIESGNFPEWELGVQLIPEADEHKFAFDLLDPTKLVPEEEVPVTIIGTMVLNRNPDNFFAETEQVAFHPGHLVPGIDFTNDPLLQGRLFSYTDTQLSRLGSPNFHEIPINRSVAPTHNNQRDGHMRQEINTGRVSYHPNSLGGGCPFQAKMAEGGFTSFNERIDAKKVRERSESFSDHFSQATLFFNSQTEVEKGHIIKALRFELGKVETEAIRVRMVGLLSQIDKTLATKVAAGLGIAVPAPAFPMNHGVGADDDFEKHEPKKAEQVTKSSDALTILRNPTVTPSIATKQIAFLCADEVSGASVVSYKNALERKGAVVKIIAPHLGFIKTEEGKKIKVDQSLLIAASVLFDAVFIPAGKGIKQLKGIKEVAEFITDTYKHCKVIGGEDEGALVIQSVQAIMEAGKNADEGIVLNKDTTAFVKALGKHRFWEREEAV

SEQ ID NO: 42915 - DNA, 1443 bp, Microbulbifer degradans 2-40
  CDS (1)..(1443)
atgagcaagtgtccgtaccaaacaacctctgctggcagcccagtagcagataaccaaaatagtcaaaccgctggcccacgtggcccagtattaatgcaagactatcaattactagaaaagctcgcccatcaaaatcgtgagcgcattcccgagcgcgtggtgcacgcaaaaggctggggtgcctttggtactttcaccgtaaccaaagatattagcaaatatactcgcgccaaaatttttgacaccgtaggcaagcaaacacctttattgacgcgtttttctaccgttgccggtgaattgggcgctgcggacgccgagcgcgatgtgcgcggttttgcggtaaagttttacaccgaagaaggcaactgggatttagtaggcaataacacgccagtgttttttattcgcgacccgttaaagttccccgactttattcacacgcaaaagcgtcacccaaaaacgaatttacgttcgccaacggcgatgtgggatttctggtcacagtcgcctgaatcattacatcaaataaccattttgatgagcgaccgcggcttgccaaccgatgtgcgtcacattaatggttatggttcacacacgttttctttctggaataatgacggcgagcgtttttgggtgaaatttcactttaaaacccagcagggccataggcattggacaaacgaagaagcagaaaaggtggtgggtaaaacgcgcgaatctacgcaagaagatttgttcagtgcgatagaaaacggcaattaccccaagtggacggtaaatgtgcaaattatgcctgaagcggatgcagagaaaacatcctacaacccgttcgaccttaccaaagtatggccgcacagcgagtacccgttaatcgaagtaggtgaaatggagttaaatcgcaatgccgaaaactattttgccgaaatagagcaagctgcgttttcgccatcgaatgtggtaccgggcattggcttttcgcccgacaaagtattacaggcgcgtatttttagttatgccgatgcgcaccgttatagaataggcactcactacgaagcgctaccggttaacgcccctaaatgcccagtgcaccattaccataaagatggctcgatgaatttctttggtaataaaagtggcagcaccgatgcatactacgaacccaattcatttggtggcgcagtacaaaacccagatgtggccgagccaccactaaaaataagtggcgatgccgacaggtataaccaccgtgaaggtaacgacgattttagtcagccagcggcattgtttaatttgtttgacgatgggcagaagcagcgtttatttaataatattgccggtgctatgcaaggtgtgccacaaaatattatcgataagcaattagccctattcgataaagtagacccagcctatggcgcaggtattcgagcagcgttaaaggcctag

SEQ ID NO: 42916 - protein, 480 aa, Microbulbifer degradans 2-40
MSKCPYQTTSAGSPVADNQNSQTAGPRGPVLMQDYQLLEKLAHQNRERIPERVVHAKGWGAFGTFTVTKDISKYTRAKIFDTVGKQTPLLTRFSTVAGELGAADAERDVRGFAVKFYTEEGNWDLVGNNTPVFFIRDPLKFPDFIHTQKRHPKTNLRSPTAMWDFWSQSPESLHQITILMSDRGLPTDVRHINGYGSHTFSFWNNDGERFWVKFHFKTQQGHRHWTNEEAEKVVGKTRESTQEDLFSAIENGNYPKWTVNVQIMPEADAEKTSYNPFDLTKVWPHSEYPLIEVGEMELNRNAENYFAEIEQAAFSPSNVVPGIGFSPDKVLQARIFSYADAHRYRIGTHYEALPVNAPKCPVHHYHKDGSMNFFGNKSGSTDAYYEPNSFGGAVQNPDVAEPPLKISGDADRYNHREGNDDFSQPAALFNLFDDGQKQRLFNNIAGAMQGVPQNIIDKQLALFDKVDPAYGAGIRAALKA

SEQ ID NO: 42917 - DNA, 2085 bp, Thiobacillus denitrificans ATCC 25259
  CDS (1)..(2085)
atgagccagaaaaaaaagccggcgaaggccggccccgacgaaaatttcgagcgcggcgccgggggtgaaatccaccagaccgccaacggcgcgcatccgccgctgacgactaacgacggtgtaccgatttccgacgaccagaattcgctgcgcagccacccgcgcggcccgacgctgctcgaggatttcgtcctgcgcgacaagatcacgcacttcgaccacgagcgcattcccgaacgcgtcgtccacgcccgcggcagcgcggcgcacggctacttcgaactgaccgaatcgctcgagaaatacacgaccgcgcgcatcctcaccgaggtcggcgagaagaccccggtgttcacgcggctctcgaccgtcgccggcggcgcgggctcggtcgacacgccgcgcgacgtgcgcggcttcgcggtcaagttctacaccaaggaaggcaactgggacctcgtcggcaacaacatccccgtgttcttcatccaggacgcgatcaagtttcccgacctcgtccactcgttcaagatggagcccgaccgcggctttccgcagtcgtcgacggcgcacgacaccttctgggactacgtgtcgctcacgcccgagtccatgcacatgattctgtggatcatgtccgaccgcacgacgccgcgctccctgcgcatgatcgaggccttcggcgtgcacagcttccgtctcgtcaatgcgaagggcgcgtcgaccttcgtcaaattccactggcgacccaagctcggcctgcaatcgacgatctgggacgagacggtcaagatcgccggcgccgaccccgacttccaccgccgcgaccttttcgaggcgatcagcgagggcaatttcccggaatgggagttcgccgtgcagctcttcaccgaggccgacgccgagcgcttccccttcgaccatctcgacgcgaccaagctcatccccgaagaactcgtgccgctcaaggtcatcggccgcatggtgctcgaccgctggccggacaatttcttcgccgagaccgaacaggtcgcctactgcccgacgcacgtcgtgcccggcatcgacttttccaacgacccgctgctgcagggccggctcttctcctacgtcgacacccagttgctgcgcttcaactcgccgaatttccaccaggtgccggtcaacatgccgaagtgcccgttcgccaacctgcagcgcgacggccacatgcagatggagcggccgaaggggcgcgtgaactacgaacccaacacgctcggcacggacacgccgcgcgagacgccgcaaggcttccgcagcgcggccgtgaccgaaagcggcgagaagggccgcatccgcgccgagcgtttcgccgaccactacagccaggcgcgccagttctacgtcagccagaccgaatacgagcaggcgcatatcgcgtcgacgctcgtgttcgagctcgccaaggtcgaccacgttcacatccgcgaggcgatggtcgggcatttgcgtcatgtcgacgaggacctcgcgcaccgcgtcgcgaaggggctcggcatcgatcccttgccgccggcgcccgaggccgccgcgcccgtgcaggacctgccgccctcgcccgccctgcagatcatcggcaacatgaaggacacgctcgaagggcgcatggtcggcatcctcgtcggcgacggctccgacggcgcgcgcgtcgaggcgctgcgccgggccgcgacggacgccggcgccgccgtgaagatcatcgccgcgcacgtcggtcaggtgaagctcgccaacggcaagatgctcaaggtcgacaagcagctcgccggaacgccgtcggtcctcttcgacgccgtggccgtcgtcgtctccgaggacgccgcgaagatgctgctgaaggagagcgcggcgctcgatttcgtccacgacgcgttcggccacctcaaggcgatcgcgagcgacgcgggcggccaggcgctgctcgacgccgtccacgtcgtgcgcgacgcgggtgtcgtcgatgcggccgacgtcggcgccttcatcgccgcggcaaaaacgcggcagtgggaccgcgaaccgtcggtgcgactactcgcgtga

SEQ ID NO: 42918 - protein, 694 aa, Thiobacillus denitrificans ATCC 25259
MSQKKKPAKAGPDENFERGAGGEIHQTANGAHPPLTTNDGVPISDDQNSLRSHPRGPTLLEDFVLRDKITHFDHERIPERVVHARGSAAHGYFELTESLEKYTTARILTEVGEKTPVFTRLSTVAGGAGSVDTPRDVRGFAVKFYTKEGNWDLVGNNIPVFFIQDAIKFPDLVHSFKMEPDRGFPQSSTAHDTFWDYVSLTPESMHMILWIMSDRTTPRSLRMIEAFGVHSFRLVNAKGASTFVKFHWRPKLGLQSTIWDETVKIAGADPDFHRRDLFEAISEGNFPEWEFAVQLFTEADAERFPFDHLDATKLIPEELVPLKVIGRMVLDRWPDNFFAETEQVAYCPTHVVPGIDFSNDPLLQGRLFSYVDTQLLRFNSPNFHQVPVNMPKCPFANLQRDGHMQMERPKGRVNYEPNTLGTDTPRETPQGFRSAAVTESGEKGRIRAERFADHYSQARQFYVSQTEYEQAHIASTLVFELAKVDHVHIREAMVGHLRHVDEDLAHRVAKGLGIDPLPPAPEAAAPVQDLPPSPALQIIGNMKDTLEGRMVGILVGDGSDGARVEALRRAATDAGAAVKIIAAHVGQVKLANGKMLKVDKQLAGTPSVLFDAVAVVVSEDAAKMLLKESAALDFVHDAFGHLKAIASDAGGQALLDAVHVVRDAGVVDAADVGAFIAAAKTRQWDREPSVRLLA

SEQ ID NO: 42919 - DNA, 2175 bp, Polaromonas sp. JS666
  CDS (1)..(2175)
atgccgcgacccaagcgcaaagctgctggccccacccggccagcggacggcgccagagacaagcaaacccagcttgatgcctttactgccggctcagccaatgtcttgaccaccaaccagggtctacagattccggacaatcacaactccctgaagggtggtgttcgcggccctaccctgctggaagatttcatcctccgcgaaaaaatcacgcattttgatcacgagcgcattccggaacgtgtcgtacacgcccggggttcaggcgcacacggctatttcaagccctacaagtcgatggtgcagtacaccagcgccgcctttttgcaggaccctgccattgaaacgcctgtatttgtgaggttttcaaccgtggccggctcccggggttcggcagacacggtgcgggatgtgcgggggttcgcggtcaagttttacaccgccgaaggcaactacgatttggtgggcaacaacattcctgttttctttatccaggacgccatcaaatttcccgacctgatccatgcggtcaaacccgaaccgcaccatgagatgccgcaagcagcaagtgcccatgacactttctgggatttcgcgtcgctgatgcccgagtcaacccacatgttgatgtggacgatgtcagaccgcgccctgccgcgcagctttcggatgatggaagggttcggtgttcatgctttccgctttatcaatgcgcggggggattctcatttcgtcaagtttcactggaagccaaaactgggggtgcatggcctggcttgggatgaggcgcagaagattgccggcaaagaccccgactttcaccggcgcgacctgtgggaagcgattgagagcggtcattttcccgagtgggagctgggcgttcagatcgtggacgacggccaggagagcgagcttggctttgacattctggacgctaccaaactcattccagaggagcaggttcccgtccagatcattggcaagctggtgctcaaccgcaatccggataattttttcgccgaaaccgaacaggtggcatttcatccaggccaccttgtgccaggcattgatttttcaaacgatcccctgttgcaggggcggctcttctcgtacaccgatacccagctgtccaggctcggcggtgcgaacttccatgaattacccatcaatcgggcagtttgcccaatgcataacttccagcgcgacgggatgcatcgccaggccatcagcaagggacgcgtggcgtacgagcccaatacgctgggcaatggcgcagagtaccgggttgatggcgcggcgcaaggcttccagtcttaccccgagcaactggagccgcccaaaatccggcggcgcagcccctcgtttgacgatcatttctcgcaggctaccctgttctggaacagccagagcgttgccgagaaagaccatatcgtcgcagcgttcaggtttgagctgtccaaggtggatgtgccggaaatccggcagcgcatcgtggacaaccttgcgcatgtggacctgaaacttgccggccgggttgctgtgactttgggcatcgccgccccggaccccaaagccgctgcgggccggctaggctttcgggattaccgaatcaccagcaaggtcgacgaagatcccacattgcgcatggttggcaggccgggcggtggcgtgaagacccgcaaggtggccattctggtggccaatggcgttgaatccgcccctctccgtcgcatccagcaggatttgacggaagccggcgccctgtgcaagctggttgcccagcacctgggtacagtcagcaccgccagcggccgccagctggcagtcgaccatacctttgccaacatgccgtccgtcatgtttgatgccgtgctgattcccggtggtgcgtccagcgccgcagcgctgagcgggctcggcgaggcggttcactttgtgctggaggcttacaaacacggcaagaccatttgtgcggtgaacgatggcgtgcagttgctcggcacgctgggcttcagccaggggaaaaatcccgagctggtaacagtacccacagtcggtgtcctgattgccgacgggcgcaaggtgctggatggacaggtgtcacaagacttcatggccgccattgcactgcaccgccactgggaccgcctcaacattgacgccattccggcctga

SEQ ID NO: 42920 - protein, 724 aa, Polaromonas sp. JS666
MPRPKRKAAGPTRPADGARDKQTQLDAFTAGSANVLTTNQGLQIPDNHNSLKGGVRGPTLLEDFILREKITHFDHERIPERVVHARGSGAHGYFKPYKSMVQYTSAAFLQDPAIETPVFVRFSTVAGSRGSADTVRDVRGFAVKFYTAEGNYDLVGNNIPVFFIQDAIKFPDLIHAVKPEPHHEMPQAASAHDTFWDFASLMPESTHMLMWTMSDRALPRSFRMMEGFGVHAFRFINARGDSHFVKFHWKPKLGVHGLAWDEAQKIAGKDPDFHRRDLWEAIESGHFPEWELGVQIVDDGQESELGFDILDATKLIPEEQVPVQIIGKLVLNRNPDNFFAETEQVAFHPGHLVPGIDFSNDPLLQGRLFSYTDTQLSRLGGANFHELPINRAVCPMHNFQRDGMHRQAISKGRVAYEPNTLGNGAEYRVDGAAQGFQSYPEQLEPPKIRRRSPSFDDHFSQATLFWNSQSVAEKDHIVAAFRFELSKVDVPEIRQRIVDNLAHVDLKLAGRVAVTLGIAAPDPKAAAGRLGFRDYRITSKVDEDPTLRMVGRPGGGVKTRKVAILVANGVESAPLRRIQQDLTEAGALCKLVAQHLGTVSTASGRQLAVDHTFANMPSVMFDAVLIPGGASSAAALSGLGEAVHFVLEAYKHGKTICAVNDGVQLLGTLGFSQGKNPELVTVPTVGVLIADGRKVLDGQVSQDFMAAIALHRHWDRLNIDAIPA

SEQ ID NO: 42921 - DNA, 1479 bp, Chlamydomonas reinhardtii
  CDS (1)..(1479)
atggacccagcgaagattcgcccctcgtccgcgtacaacaccccctactggaccaccaacagcggtgcgccggtatggaacaacaacaactccatgacagtggggacgcgcggtcccatcctcctggaggactaccacctggttgagaagctggcgcagttcgaccgggagcgcatccccgagcgcgtcgtgcacgcccgcggggctgcggcaaagggcttcttcgaggtgacgcacgacatctcagccctgacggcggccgacttcctgcccgccccgggcgtgcagacgcccgtcatcgtgcggttctccactgtggtgcacgagcgcggctcgcccgagaccctccgggaccctcggggcttcgcggtaaagttctacacacgtgagggcaatttcgacatggtcggcaacaacatgccggtgttcttcatccgcgacggcatgaagttcccggacatggttcacgccttcaagcccaaccccaagagccacatccaggaggcctggcgcattatggacttcctgtcgcaccaccccgagtcatgccacatgctgacgttcctgctggacgacgccggcatcccgctcaactaccgccacatgccgggctttggcgtgcacaccatgaagctgatcaacaaggccggccgcgagacgtatgtcaagttccactgggtgcccaagtgcggcgagaagtacctgctggacgacgaggcggtgatggtgggccggagcaaccacagccacgccaccaaggacctgttcgacgccatcgcagcgggcgactacccggagtgggcgctcatggtacagaccatggaccccgcggacgaggacaagtttgactttgaccctctggacgtgaccaagacctggcccgagtcgctgttccccatgcagccggtgggccgcatggtgctcaaccgcaacgtggacaacttcttcaacgagaatgagcaggtggccttctgccccgccatcatcgtgccgggcatcggctacagcgatgacaagctgctgcagacgcgcatcttctcctacgccgacacgcagcggcaccggttggtccccaactacctactgctcccggtgaacgcgccgcgcgccccccaccacaacaaccaccacgagggcttcatgaacttcatgcaccgcgacgaggaaatcaactacttccccagcaggtttgacccggtgcgcaacgcggaagggtggctgccgtgtcgagtcccgctgtctgggcgccgcgagaagatggtgatcgccaaggagaacaacttcatgcaggccggcgctcgctggcgcgcgttcgacgcggcgcggcaggagcggtttgtggtgcgggtggcggacatgctggcggacccccgctgcacgcaggagatccggcgcatctgggtgggctactggtcccaggccgacccgcagctgggcgcgggcattgccgccaagctgcagggccgcggctgcctgtag

SEQ ID NO: 42922 - protein, 492 aa, Chlamydomonas reinhardtii
MDPAKIRPSSAYNTPYWTTNSGAPVWNNNNSMTVGTRGPILLEDYHLVEKLAQFDRERIPERVVHARGAAAKGFFEVTHDISALTAADFLPAPGVQTPVIVRFSTVVHERGSPETLRDPRGFAVKFYTREGNFDMVGNNMPVFFIRDGMKFPDMVHAFKPNPKSHIQEAWRIMDFLSHHPESCHMLTFLLDDAGIPLNYRHMPGFGVHTMKLINKAGRETYVKFHWVPKCGEKYLLDDEAVMVGRSNHSHATKDLFDAIAAGDYPEWALMVQTMDPADEDKFDFDPLDVTKTWPESLFPMQPVGRMVLNRNVDNFFNENEQVAFCPAIIVPGIGYSDDKLLQTRIFSYADTQRHRLVPNYLLLPVNAPRAPHHNNHHEGFMNFMHRDEEINYFPSRFDPVRNAEGWLPCRVPLSGRREKMVIAKENNFMQAGARWRAFDAARQERFVVRVADMLADPRCTQEIRRIWVGYWSQADPQLGAGIAAKLQGRGCL

SEQ ID NO: 42923 - DNA, 2187 bp, Aspergillus fumigatus
  CDS (1)..(2187)
atgcgtctcacgttcatccccagcctcattggcgttgccaatgcggtatgtccctatatgaccggcgagctcaaccgtcgtgatgagatatccgatggcgacgctgccgcagccacagaggaattcttgtcccagtattatttcaacgacaatgatgccttcatgacgtccgatgtgggcggccctatcgaagatcagaatagtttcagtgccggagagcgtggtcccaccctgctcgaagatttcattttccgtcaaaagatacagcgtttcgaccatgaacgggtccccgagcgtgcggtccatgcccgtggtgccggcgcccatggagtcttcacttcatatggcgacttctcgaacatcactgcggcttctttcctggccaaggaaggcaagcaaacccctgtatttgtccgcttctcgacggtcgcaggaagcagaggcagttcggatctggcccgtgatgttcacggttttgccactcgtttctataccgacgagggcaatttcgatatcgttggaaacaatatccctgtattcttcatccaggatgctatcctcttccccgatctgatccacgccgtcaagcccagaggtgacaacgagatccctcaggctgcgactgctcatgactcggcctgggacttcttcagccagcagccaagcacgatgcacacactgctctgggctatgtctgggcatggcattcctcgttctttccgacatgttgatgggttcggtgtgcataccttccgattcgtgacagatgacggtgcatccaagctcgtcaaatttcactggaagtctttgcagggcaaggccagcatggtctgggaagaggcccagcagacctctggcaagaatcctgacttcatgcgtcaggatttgcacgatgcaatcgaggctggacgctatccggagtgggaactcggtgttcaaatcatggatgaggaggaccaactgcggttcggttttgacctcttggaccccacaaagatcgtgccagaggaattcgtgcccatcaccaagttgggcaagatgcaactgaaccgcaaccctcgcaactatttcgctgagaccgaacaagttatgttccaacctggtcacattgtccgtggtgttgacttcactgaagaccctctcctgcaaggccgtctgttttcgtacctggacactcagctgaaccgtcacggtggccccaactttgaacaactccccatcaaccaacctcgcgttcccgtgcacaacaacaaccgcgatggagcaggccaaatgttcattcccctcaaccctcacgcgtactcgcccaagacctccgtcaacggttccccaaaacaagccaaccagaccgtcggcgatggcttcttcacagctcctggacgtaccaccagtggcaagcttgtccgtgcggtcagctcaagctttgaggatgtctggtctcagccacggctcttctacaattctttggttcctgccgagaagcagttcgttattgacgccatccgcttcgaaaatgcaaacgttaaatctcccgtggtaaagaacaacgtcatcattcagttgaaccgcatcgataacgaccttgcacgacgcgttgcgcgcgctattggtgtcgccgagcctgagcccgacccgaccttctatcacaacaacaagactgccgatgtcggcacttttggaaccaagctgaagaagcttgatggcctcaaggtcggcgtcctgggttctgtccagcacccgggctcggttgagggagcttccaccctccgcgaccgtctgaaggacgacggtgtcgacgtggttcttgtcgcagagcgtctggccgacggtgttgaccagacctattctacttcagatgcaatccaatttgacgctgtggtcgttgccgccggtgcagagagtctcttcgcggcatcctcgtttaccggtgggtccgccaactcagctagtggtgcaagctctctgtaccccaccggtcggcccctgcagattctcattgacggattccggttcggcaagactgttggggcgctgggaagcggcacagctgctctccgcaacgcggggattgcaacgtctcgggacggcgtgtatgtggctcagtcagtcactgatgactttgccaatgatcttaaggagggccttagaacttttaagtttttggaccggtttcccgtggatcactag

SEQ ID NO: 42924 - protein, 728 aa, Aspergillus fumigatus
MRLTFIPSLIGVANAVCPYMTGELNRRDEISDGDAAAATEEFLSQYYFNDNDAFMTSDVGGPIEDQNSFSAGERGPTLLEDFIFRQKIQRFDHERVPERAVHARGAGAHGVFTSYGDFSNITAASFLAKEGKQTPVFVRFSTVAGSRGSSDLARDVHGFATRFYTDEGNFDIVGNNIPVFFIQDAILFPDLIHAVKPRGDNEIPQAATAHDSAWDFFSQQPSTMHTLLWAMSGHGIPRSFRHVDGFGVHTFRFVTDDGASKLVKFHWKSLQGKASMVWEEAQQTSGKNPDFMRQDLHDAIEAGRYPEWELGVQIMDEEDQLRFGFDLLDPTKIVPEEFVPITKLGKMQLNRNPRNYFAETEQVMFQPGHIVRGVDFTEDPLLQGRLFSYLDTQLNRHGGPNFEQLPINQPRVPVHNNNRDGAGQMFIPLNPHAYSPKTSVNGSPKQANQTVGDGFFTAPGRTTSGKLVRAVSSSFEDVWSQPRLFYNSLVPAEKQFVIDAIRFENANVKSPVVKNNVIIQLNRIDNDLARRVARAIGVAEPEPDPTFYHNNKTADVGTFGTKLKKLDGLKVGVLGSVQHPGSVEGASTLRDRLKDDGVDVVLVAERLADGVDQTYSTSDAIQFDAVVVAAGAESLFAASSFTGGSANSASGASSLYPTGRPLQILIDGFRFGKTVGALGSGTAALRNAGIATSRDGVYVAQSVTDDFANDLKEGLRTFKFLDRFPVDH

SEQ ID NO: 42925 - DNA, 1482 bp, Chlamydomonas reinhardtii
  CDS (1)..(1482)
atggacccagcgaagattcgcccctcgtccgcgtacaacaccccctactggaccaccaacagcggtgcgccggtatggaacaacaacaactccatgacagtggggacgcgcggtcccatcctcctggaggactaccacctggttgagaagctggcgcagttcgaccgggagcgcatccccgagcgcgtcgtgcacgcccgcggcgctgcggcaaagggcttcttcgaggtgacgcacgacatctcagccctgacggcggccgacttcctgcgcgcgccgggcgtgcagacgcccgtcatcgtgcgcttctccactgtggtgcacgagcgcggctcgcccgagaccctccgcgaccctcgcggcttcgcggtcaagttctacacacgtgagggcaatttcgacatggtcggcaacaacatgccggtgttcttcatccgcgacggcatgaagttcccggacatggttcacgccttcaagcccaaccccaagagccacatccaggaggcctggcgcattatggacttcctgtcgcaccaccccgagtcatgccacatgctgacgttcctgctggacgacgccggcatcccgctcaactaccgccacatgccgggctttggcgtgcacaccatgaagctgatcaacaaggccggccgcgagacgtatgtcaagttccactgggtgcccaagtgcggcgagaagtacctgctggacgacgaggcggtgatggtgggcggagccaaccacagccacgccaccaaggacctgttcgacgccatcgcagcgggcgactacccggagtgggcgctcatggtacagaccatggaccccgcggacgaggacaagtttgactttgaccctctggacgtgaccaagacctggcccgagtcgctgttccccatgcagccggtgggccgcatggtgctcaaccgcaacgtggacaacttcttcaacgagaatgagcaggtggccttctgccccgccatcatcgtgccgggcatcggctacagcgatgacaagctgctgcagacgcgcatcttctcctacgccgacacgcagcggcaccggctgggccccaactacctactgctgccggtgaacgccccgcgcgccccccaccacaacaaccaccacgagggcttcatgaacttcatgcaccgcgacgaggaaatcaactacttccccagcaggtttgacccggtgcgcaacgcggagcgggtggctgccgtgtcgagtgcgccgctgtctgggcgccgcgagaagatggtgatcgccaaggagaacaacttcatgcaggccggcgctgctggccgcgcgttcgacgcggcgcggcaggagcggtttgtggtgcgggtggcggacatgctggcggacccccgctgcacgcaggagatccggcgcatctgggtgggctactggtcccaggccgacccgcagctgggcgcgcgcattgccgccaagctgcagggccgcggctgcctgtag

SEQ ID NO: 42926 - protein, 493 aa, Chlamydomonas reinhardtii
MDPAKIRPSSAYNTPYWTTNSGAPVWNNNNSMTVGTRGPILLEDYHLVEKLAQFDRERIPERVVHARGAAAKGFFEVTHDISALTAADFLRAPGVQTPVIVRFSTVVHERGSPETLRDPRGFAVKFYTREGNFDMVGNNMPVFFIRDGMKFPDMVHAFKPNPKSHIQEAWRIMDFLSHHPESCHMLTFLLDDAGIPLNYRHMPGFGVHTMKLINKAGRETYVKFHWVPKCGEKYLLDDEAVMVGGANHSHATKDLFDAIAAGDYPEWALMVQTMDPADEDKFDFDPLDVTKTWPESLFPMQPVGRMVLNRNVDNFFNENEQVAFCPAIIVPGIGYSDDKLLQTRIFSYADTQRHRLGPNYLLLPVNAPRAPHHNNHHEGFMNFMHRDEEINYFPSRFDPVRNAERVAAVSSAPLSGRREKMVIAKENNFMQAGAAGRAFDAARQERFVVRVADMLADPRCTQEIRRIWVGYWSQADPQLGARIAAKLQGRGCL

SEQ ID NO: 42927 - DNA, 1476 bp, Raphanus sativus
  CDS (1)..(1476)
atggatccttacaagtatcgtccagcgagttcatacaactctccattcttcaccaactccggtgctcctgtatggaacaacaactcctccatgaccgttggacccagaggtcctatccttcttgaggattaccatctcgttgagaagcttgccaacttcgacagggagcgtattccagagcgtgtggttcatgctagaggagcaagtgcaaagggtttcttcgaggtcactcatgatatatctaacctcacgtgtgccgacttcctcagagctccaggtgttcagaccccagtcattgttcgtttctccactgtcatccatgagcgtggaagtcccgagaccttgagagaccctcgtggctttgccgtcaagttctacaccagagagggaaactttgatcttgtcggaaacaacttccctgtcttcttcatccgcgacggtatgaagttccctgacatggtccacgctcttaagccaaacccaaaatctcacatccaagagaactggagagtccttgacttcttctcccaccaccctgagagcttaaacatgttcactttccttttcgatgacatcggtatcccacaagactaccgccacatggaaggttcaggtgtcaacacatacatgctgatcaacaaatccggcaaagctcactacgtgaagttccactggaaaccaacatgtggagtcaagtctctgttagaagaagatgcaatccgcgttggtggaaccaaccacagccacgcgactcaggacttgtacgactccatcgctgctggtaactaccctgagtggaagctctttgttcagataatcgatccggcggatgaagacaagttcgactttgaccctctcgatgtgaccaagacctggcctgaggatctcttgcctctccagcccgttggtcgtatggtgttgaacaagaacattgataacttctttgcggagaatgagcagcttgccttctgccctgcgatcattgttccggggatacactactctgatgacaagctgcttcaaacacgtgtcttctcctatgcggatactcagagacaccgtcttggacctaactaccttcagctaccagtgaatgctccaaaatgtgctcaccacaacaaccaccatgagggcttcatgaatttcatgcacagggacgaggaggttaactacttcccttcgaggtatgacccggttcgccatgctgagaagtatccaactccaccagcagtctgctctgggaagcgtgagaggtgcattattgagaaagagaacaacttcaaggagcctggagagagataccgttcctttacaccagagaggcaagaacgtttcatcggtagatggattgatgctctatcagaccctcgcatcacacatgaaatccgcagtatctggatctcttactggtctcaggctgataagtcactgggacagaagctggcaagccgtctgaacgtgagaccaagcatctaa

SEQ ID NO: 42928 - protein, 491 aa, Raphanus sativus
MDPYKYRPASSYNSPFFTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPTCGVKSLLEEDAIRVGGTNHSHATQDLYDSIAAGNYPEWKLFVQIIDPADEDKFDFDPLDVTKTWPEDLLPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAVCSGKRERCIIEKENNFKEPGERYRSFTPERQERFIGRWIDALSDPRITHEIRSIWISYWSQADKSLGQKLASRLNVRPSI

SEQ ID NO: 42929 - DNA, 1479 bp, Nicotiana glutinosa
  CDS (1)..(1479)
atggatccttacaagtaccgtccgtcaagtgccttcaattctccattctgcaccactaattctggtgctcctgaaaaaaacaacaattcatatcttactgttggtgcaagaggtctcgtattgcttgaggattaccatttggtggagaaacttgccaattttgacagggaacgtgtccctgaacgtgttgttcatgcccgaggtgctagtgccaaagggtttttcgaagttacccatgacatcactcaccttacctgtgctgatttccttcgagctccgggagtccagactcctgtcattgtgagattctccactgttatacatgagaggggtagtcctgaaactctgagggaccctcgtggttttgctgtcaagttctacaccagagagggaaactttgatctggtagggaacaacttccccgtattcttcatccgtgatggaatgaagttccctgacatggtccatgctctgaagccaaatcctaagtcccatatccaggagaattggagggtccttgattttttctctcatgttcctgaaagcctgcacatgttcactttcctcttcgacgatattggtattccacaagattacaggcatatggacggatctggtgtccacacattcacattgatcaacaaggctgggaaatcaacctatgcgaagttccactggaagcccacatgtggtgtacagtccttgttggaagatgaggcagcccgtgtcggaggagcaaatcatagccacgctactcaggacctctatgactctattgcagctggaaattatcctgaatggaagctcttcattcagactatggatccaagtcatgaagacagatttgatttcgatccgcttgatgtgactaaaacttggccagaggatatcttgcctttgcagccggtgggaagattagttctgaacaagaacattgataacttctttaatgaaaatgagcagctagctttctgcccttctattgtggttccaggagtttattactcagatgataagatgcttcaaactcgtattttctcgtactctgatacccagaggtatcgactgggaccaaactatttgcaacttcctgctaatgctccaaagtgcgctcatcacaacaatcactacgatggctccatgaattttatgcacagggatgaggagatcgactacttcccttcaaggtatgatcctgttcgccacgctgagaagtatcctattccttctacaatgtgcactggcaaacgcgagaagtgtgtcattctgaaagagaacaatttcaagcaaccaggagaaaggtaccgctcattcacaccagacaggcaagaacgctttattcgtcggtgggtggaggccttgtctgatcctcggatcactcacgagatacgcagcatttggatctcatactggtctcaggctgacaaatctctgggtcaaaagcttgcttctaggcttaatgtgagaccaagcatatga

SEQ ID NO: 42930 - protein, 492 aa, Nicotiana glutinosa
MDPYKYRPSSAFNSPFCTTNSGAPEKNNNSYLTVGARGLVLLEDYHLVEKLANFDRERVPERVVHARGASAKGFFEVTHDITHLTCADFLRAPGVQTPVIVRFSTVIHERGSPETLRDPRGFAVKFYTREGNFDLVGNNFPVFFIRDGMKFPDMVHALKPNPKSHIQENWRVLDFFSHVPESLHMFTFLFDDIGIPQDYRHMDGSGVHTFTLINKAGKSTYAKFHWKPTCGVQSLLEDEAARVGGANHSHATQDLYDSIAAGNYPEWKLFIQTMDPSHEDRFDFDPLDVTKTWPEDILPLQPVGRLVLNKNIDNFFNENEQLAFCPSIVVPGVYYSDDKMLQTRIFSYSDTQRYRLGPNYLQLPANAPKCAHHNNHYDGSMNFMHRDEEIDYFPSRYDPVRHAEKYPIPSTMCTGKREKCVILKENNFKQPGERYRSFTPDRQERFIRRWVEALSDPRITHEIRSIWISYWSQADKSLGQKLASRLNVRPSI

SEQ ID NO: 42931 - DNA, 1479 bp, Nicotiana tabacum
  CDS (1)..(1479)
atggatccatacaagtaccgtccgtcaagtgccttcaattctccattctgcaccactaattctggtgctcctgtttttaacaacaattcatctcttactgttggtgcaagaggtcctgtattgcttgaggattaccatttggtggagaaacttgccaattttgacagggaacgtgtccctgaacgtgttgttcatgcccgaggtgctagtgccaaagggtttttcgaagttacccatgacatcactcaccttacctgtgctgatttccttcgagctcccggtgtccagactcctgtcattgtgagattctccactgttatacatgagaggggtagtcctgaaactctgagggaccctcgtggttttgctgtcaagttctacaccagagagggaaactttgatctggtagggaacaacttccccgtcttcttcatccgtgatggaatgaagttccctgacatggtccacgcgctgaagccaaatcctaaatcccatatccaggagaattggagggtccttgattttttctctcatgttcctgaaagcctgcacatgttcactttcctcttcgacgatattggtattccacaagattacaggcatatggatggttctggtgtccacacattcacattgatcaacaaggctgggaaatcaacctatgtgaagttccactggaagcccacatgtggtgtcaagtccttgttggaagaagaagcagcccgtatcggaggagcaaatcacagccacgctactcaagacctctatgactctattgccgctggaaattatcctgaatggaagctcttcattcagactatggatccagatcatgaagacagatttgattttgatccacttgatgttacaaaaacttggccagaggatatcttgccgttgcagccggtgggaagattagttctgaacaagaacattgataacttctttaatgagaatgagcaactcgctttctgcccttctattgtggttccaggtgtttattactcagatgacaagatgcttcaaactcgtattttctcctactctgatacccagaggtatcgacttggaccaaactatttgcaacttcctgctaatgctccaaagtgtgctcatcacaacaatcactatgatggctctatgaattttatgcacagggacgaggagatcgactacttcccttcaaggtatgatcctgttcgccatgctgagaagtatccaattccttctacaatgtgcactggcaaacgagagaagtgtgtcattcagaaagagaacaattttaagcaaccaggagataggtaccgctcattcacaccagacaggcaagaacgctttattcgtcggtgggtggaggccttgtctgatcctcgtatcacttatgagatccgcaccatttggatctcatactggtctcaggctgacaaatctctgggtcaaaagcttgcttctaggcttaatgtgagaccaagcatatga

SEQ ID NO: 42932 - protein, 492 aa, Nicotiana tabacum
MDPYKYRPSSAFNSPFCTTNSGAPVFNNNSSLTVGARGPVLLEDYHLVEKLANFDRERVPERVVHARGASAKGFFEVTHDITHLTCADFLRAPGVQTPVIVRFSTVIHERGSPETLRDPRGFAVKFYTREGNFDLVGNNFPVFFIRDGMKFPDMVHALKPNPKSHIQENWRVLDFFSHVPESLHMFTFLFDDIGIPQDYRHMDGSGVHTFTLINKAGKSTYVKFHWKPTCGVKSLLEEEAARIGGANHSHATQDLYDSIAAGNYPEWKLFIQTMDPDHEDRFDFDPLDVTKTWPEDILPLQPVGRLVLNKNIDNFFNENEQLAFCPSIVVPGVYYSDDKMLQTRIFSYSDTQRYRLGPNYLQLPANAPKCAHHNNHYDGSMNFMHRDEEIDYFPSRYDPVRHAEKYPIPSTMCTGKREKCVIQKENNFKQPGDRYRSFTPDRQERFIRRWVEALSDPRITYEIRTIWISYWSQADKSLGQKLASRLNVRPSI

SEQ ID NO: 42933 - DNA, 2151 bp, Claviceps purpurea
  CDS (1)..(2151)
atggtgcgaacttcgctagctgccttctccctggcagtcgccggcctggccagcgcacaatgccccttcgcagacccaggacgtcttgccgcaagagctcagggcctagatgaatcgtccagaggccatctggctggtttcgaagtcgacgacagcgagggctacctgacgtccgacgtcggtggcccaatcgaggatcagaacagtctcaaagccggggaccgaggccctacactgctggaagattttattttccgacagaaaatcacccattttgaccacgagcgagttcccgaaagagctgttcacgcccgaggaacaggcgcccacggcaccttcaccagctacggcgattatagcaatatcaccgcagcctcatttttgggccaaaaggacaagaagacgcccgtatttgttcgtttctccactgtagcgggctctcgtggaagtgcggacacagctcgtgacgtgcacggatttgccgttcgattgtataccgacgaaggaaacttcgatatcgtgggcaacaatgttcctgtgttcttcattcaggatgctatccaattccccgatcttatccattcggtcaagccacgccaggacaatgagatcccacaggctgccactgctcacgactcagcgtgggacttcttctcgcaacagacgtcgactctgcacactttgttctgggccatggctggttatggtatcccacgtagtttgcgccacatggacggttttggtgtacacacataccgactcgttaccgatgatggcacgtccaagctggtaaagtggcactggaagtctaagcagggcaaagccagtctagtttgggatgaggcccagcgcgccgccggcaagaatgccgactaccacagacaggatctcttcgacgccatccagtcgggcaactatcccgagtgggagctcaacctgcaaatcatcaacgaggatcaagccctagcctttggattcgacgtgctcgatcctaccaagatcattcctgaggaatatgcccctctgatgccggtcggtgtcatgagactcgatgccaatccttccaactattttgctgagactgaacaagtcatgttccaacctggccatattgtgcgaggcgtcgacttcacggaggaccctctgctgcagggccgcatcttctcgtacctggatactcaaattaacagacacggtggccccaactttgagcagcttcccatcaacaggcctgtcgttcctattcacaacaacaatcgcgatggagctggccagaatttcattcataagaacaatgctccttatacccccaacactctgaacaagggatttcccaagcaagccaaccagaaggaaggcaagggctttttcaccgctcccggacgcaaggtctctggctccctgcaacggcgtctcagcaacacgttccttgatcactggacccagccccgtctattcttcaactccatcacgcctatcgagcagcagttcttgattaatgcgatccgcttcgaaacctcgcacctcagccaggttgtgcagaagaacgtcctcgcgcagctcaacaagatcagccacgatgttgccgtccgcgtcggcaaggctcttggcctggacgcaccccccgcagatgacaagtactaccacaacaaccagaccaagggcctgtccatctttggcgaggagctgcccaccatcgctaccctcatcgtcggcgtcttggcctctactgcatccaaaaactcgctggcccaggcccaggccctcaaggacgccttcaaaaccagggaggtcaacgtcatcgtggtggctgaatccctcgccaccggtgtggaccagacatacgacgccgccgacgcagtcagcttcgacggcatcgttgtcgccgacggagtcgaggccctctttgacaacaccaagaaatcctcgctcttccagcctggtcgtcctagccaaatcgtaaacgacggatacaactggggcaaacccatgggattcctcggcagcgccaagagggccgttaaggcgacttctgtggtggagggtgccggtgtgtacatgagaaacagcacggctactctggtgggagacttccagaaggggcttgccaagttcaagtttacggaccggttccctatggacactaaataa

SEQ ID NO: 42934 - protein, 716 aa, Claviceps purpurea
MVRTSLAAFSLAVAGLASAQCPFADPGRLAARAQGLDESSRGHLAGFEVDDSEGYLTSDVGGPIEDQNSLKAGDRGPTLLEDFIFRQKITHFDHERVPERAVHARGTGAHGTFTSYGDYSNITAASFLGQKDKKTPVFVRFSTVAGSRGSADTARDVHGFAVRLYTDEGNFDIVGNNVPVFFIQDAIQFPDLIHSVKPRQDNEIPQAATAHDSAWDFFSQQTSTLHTLFWAMAGYGIPRSLRHMDGFGVHTYRLVTDDGTSKLVKWHWKSKQGKASLVWDEAQRAAGKNADYHRQDLFDAIQSGNYPEWELNLQIINEDQALAFGFDVLDPTKIIPEEYAPLMPVGVMRLDANPSNYFAETEQVMFQPGHIVRGVDFTEDPLLQGRIFSYLDTQINRHGGPNFEQLPINRPVVPIHNNNRDGAGQNFIHKNNAPYTPNTLNKGFPKQANQKEGKGFFTAPGRKVSGSLQRRLSNTFLDHWTQPRLFFNSITPIEQQFLINAIRFETSHLSQVVQKNVLAQLNKISHDVAVRVGKALGLDAPPADDKYYHNNQTKGLSIFGEELPTIATLIVGVLASTASKNSLAQAQALKDAFKTREVNVIVVAESLATGVDQTYDAADAVSFDGIVVADGVEALFDNTKKSSLFQPGRPSQIVNDGYNWGKPMGFLGSAKRAVKATSVVEGAGVYMRNSTATLVGDFQKGLAKFKFTDRFPMDTK

SEQ ID NO: 42935 - DNA, 1479 bp, Mesembryanthemum crystallinum
  CDS (1)..(1479)
atggatccctacaagtaccgaccgtcaagtgctttcaattctccttacttcaccaccaattcaggtgctccggtttataacaacaactcttcattgactgtcggtaccagaggtccaattcttctggaggattaccatctagtggaaaagcttgcgaactttgaccgggagcgtataccagagcgtgttgttcacgccagaggagcaagtgccaagggtttttttgaagttactcatgatgtttcacaccttacatgtgccgatttcctgcgtgcccctggtgtccagacacctgtgattgtccggttctccactgttattcatgagcgtggaagtcctgaaactatcagggaccctcgaggttttgctgtgaagttctacaccagagagggtaactttgatatggtaggaaacaatttccctgtgttcttcatccgtgatggtatgaagttccccgatatggtgcatgctctcaaacccaaccccaaatcccacatccaagagaattggagagtcctcgatttcttctcccaccatcccgagagtttgcacatgttcactttcctctttgatgatgtgggagtccctacagactacaggcacatggaaggctctggtgtcaacacatacactttgattagcaagtctggcaaagtgcactatgtgaagttccattggaaaccaacctgtggtgtcaaatgtctgttggaggaagaggcagtcaaaattggaggagctaaccacagccatgcgactcaggacctctatgactcaattgcggctggaaactatcctgagtggaaactctacatccaaacaatcgacccagctgatgaagataaatttgactttgacccactagatgttaccaagacttggcctgaggacattttgccgctgcagccagtgggtcgtttggttttgaacaaaaacattgacaacttctttgcagaaaatgagcagctggccttttgccctggtattgtggttcctggtgtctactactcagatgataagctcctgcagactagaattttctcgtacgctgatacccagagacaccgtcttggacccaactacctgcagcttccagttaatgcaccaaagtgtgctcaccacaacaatcactatgatggtcaaatgaactttatgcatagggatgacgaggttgattacttcccatcaagatatgatcctgttcgtcatgcggagagatatcccattccaccaaacgtcttgaatggaaaccgtgataggcaaatcatccagaaggagaacaacttcaagcaaccaggagagagatacaggtcatgggacccagcaaggcaagagagatttatttgcagatgggttgacgctctttctgatcctcgtatcactcacgagattcgcaacatttggatctcttactggtctcaggccgacaaatctgtgggtatgaaactagcaagcagacttaatgtgaggccaaccatgtga

SEQ ID NO: 42936 - protein, 492 aa, Mesembryanthemum crystallinum
MDPYKYRPSSAFNSPYFTTNSGAPVYNNNSSLTVGTRGPILLEDYHLVEKLANFDRERIPERVVHARGASAKGFFEVTHDVSHLTCADFLRAPGVQTPVIVRFSTVIHERGSPETIRDPRGFAVKFYTREGNFDMVGNNFPVFFIRDGMKFPDMVHALKPNPKSHIQENWRVLDFFSHHPESLHMFTFLFDDVGVPTDYRHMEGSGVNTYTLISKSGKVHYVKFHWKPTCGVKCLLEEEAVKIGGANHSHATQDLYDSIAAGNYPEWKLYIQTIDPADEDKFDFDPLDVTKTWPEDILPLQPVGRLVLNKNIDNFFAENEQLAFCPGIVVPGVYYSDDKLLQTRIFSYADTQRHRLGPNYLQLPVNAPKCAHHNNHYDGQMNFMHRDDEVDYFPSRYDPVRHAERYPIPPNVLNGNRDRQIIQKENNFKQPGERYRSWDPARQERFICRWVDALSDPRITHEIRNIWISYWSQADKSVGMKLASRLNVRPTM

SEQ ID NO: 42937 - DNA, 1482 bp, Mesembryanthemum crystallinum
  CDS (1)..(1482)
atggatccctacaagtatcggccatcgagttcttacaacactagtttcatgaccactaaaactggtcaaccagtttggaatgatgactcttcattgactgttggagcaagaggtccaatccttttggaggattaccatctgttggaaaagattgctagctgggatagagagcgtatacctgaacgtgttgttcatgctaggggagctagtgctaaggggttttttgaagttaccaatgatattactcacctcacatgtgccgacttcttgcgcgctcctggtgttcaaacacctgttattgttcgtttctctactgttattcatgagcgtggcagtcctgaaaccatgagggatcctcgtggttttgctctcaagttctacactagagagggtaacttcgatttagtaggaaacaatttccctgtgtttttcaaccgtgatgcaatgaaatttcctgatgtagtccgggctttcaaacccaacccaaaatctcacattcaagagatgtggaggattctggatttctgctctcaccttcctgagagtttgcacacatttgcttggttctttgatgatgtgggaatcccaataaactacaggcacatggaagggtttggtgtgcatacattcactatgctcaacagggctggcaaagaaacatatgtcaagttccactggaagccaacctgtggagtgaaatctatcgtcaccgaagaagaagctattcaagtaggaggagcaaaccacagtcatgcaactcaggatctctatgactccattgcagctgggaattaccctgagtggaggttgttcattcaaacaatggatcctgcagatgaagataaattcgactttgacccgttagatattaccaagacatggccagaggacattctgcccctgcagccagtgggtcgtttggtgttgaacaagaacatcgacaactttttcactgagaatgaaatgctggcttttaacccggctagtatagttcccgggatccacttctcacatgacaagatgctccaggctcggacttttgcttatgctgatacccagagacatcgtcttggtgtcaacttccttctgcttcctgttaatgctcctaagtgtgctcatcacaatgatcatcatgatggattcatgaacttcatgcaccgtgatgaggaggttaattacttcccttcaagaagtaatgtctgtcatcatgctgagagattccccattccatcacataccttgactggaaggcgagaaaggcgaattattccaaaggaaaacaacttcaagcagcctggagacagatacagatcatgggacccagccaggcaagagagataccttgcgagatgggtaaaggctctgtctgatccaaaggtcactcctgagatccggggcgtttgggtctcatggttgtctcagtcggacagatctcttggcatgaaactagctaataaactcaatgtgaggccgaccatgtga

SEQ ID NO: 42938 - protein, 493 aa, Mesembryanthemum crystallinum
MDPYKYRPSSSYNTSFMTTKTGQPVWNDDSSLTVGARGPILLEDYHLLEKIASWDRERIPERVVHARGASAKGFFEVTNDITHLTCADFLRAPGVQTPVIVRFSTVIHERGSPETMRDPRGFALKFYTREGNFDLVGNNFPVFFNRDAMKFPDVVRAFKPNPKSHIQEMWRILDFCSHLPESLHTFAWFFDDVGIPINYRHMEGFGVHTFTMLNRAGKETYVKFHWKPTCGVKSIVTEEEAIQVGGANHSHATQDLYDSIAAGNYPEWRLFIQTMDPADEDKFDFDPLDITKTWPEDILPLQPVGRLVLNKNIDNFFTENEMLAFNPASIVPGIHFSHDKMLQARTFAYADTQRHRLGVNFLLLPVNAPKCAHHNDHHDGFMNFMHRDEEVNYFPSRSNVCHHAERFPIPSHTLTGRRERRIIPKENNFKQPGDRYRSWDPARQERYLARWVKALSDPKVTPEIRGVWVSWLSQSDRSLGMKLANKLNVRPTM

SEQ ID NO: 42939 - DNA, 2223 bp, Pleurotus ostreatus
  CDS (1)..(2223)
atgtcctccgtcacagcagcagcaaagcaggcggtatcgagtatcaccgacaatgcaaaaatggctagtttgactcaattccgcgtcgagtgtggtccttcgcagcggatgaccaccgaccagggacttcatgtagccgacacagacaactgtaactcaaacgtaggaccagcattgcttgaagaccacatcgcacgagagaagattatgcgctttgaccacgagcgcatcccagaacgagtggtacacgcacgaggcgctggtgcgcatggctatttcaaagcgtatgattcgagtgcagagcagtggacgaaggccaaagtcctcatggatccgtcacgtacgacaccggtattcgtgcggtttagcacggtgcaaggctccagaggaagtgctgacactgttcgcgacgtcaggggctttgcggtgaaattctacaccgaggaggggaattgggacatcgtggggaacaatatcccggtgttcttcatccaggatgcgatcaagttccctgatatcatccatgcggtcaagcctgagcctcacaacgaagtacctacagggcagagcgcgcacaacaacttctgggactttgttgggcttcaaccagagtcggcgcatatgatcatgtgggtgatgtctgaccgcgcgatccctcgttcgtaccggatgatgcagggttttggcgtgaacacgtacacgctcttaaacgctacgggcgagaagcactttgtgaagtttcattggatcccagagctcggtgtccacagcctagtctgggatgaagctcttaaaatcgcgggtcaagatcctgatttccatcgcaaagatttgaatgaagccatcgagtccggggcctatcctaaatggcgtctagcactccaagtcatctctgagaaggacgaacacaacttcgacttcgatatcctcgacgcgacgaagatatggcccgaggagttggtgccactgcattttgtgggcgagatggttctgaacaaggtggttgatgagtattttgccgaggtggagcaggttgctttttgtaccagcaacattgtaccaggaatcgggttcagcgacgacccgctgctccaaggcaggaactttagttacctcgacacgcagcttagccgtctaggtatcaactggcaacagattcccattaaccgacctgtctgccctgtgatgaatttccagcgcgatgggcaaatgcagatgaagatccacaagggcaccgtcaactattggcccaaccgccaggaagccgttcagcccgtcgctgtttcggaaggcggctacgatgatcatgttcgcaagatctccggaatagcccaacgcatgcgtggaccaaaattcaacgagcactactctcaggcccagctcttctacaactccctctcgcctacggagcaaacacacctgcagagcgcgcttgccttcgagctcagccactgcgaggacccggccgtgtaccgcaactacattaacatcctcaacaacatcgactatcagctcgcgaagtatgtcgccgtcgccgtgggaggcgacgtccccgatgcgtcagcgaagcccaacgaggggaacaaaagcgctaggctgagccaggtgtactatgcgccgaaggagccgactatcaaaggccggcgcatcgccattctgctggcggatgggttcgataaggcggaggttgtggctatcaaggcactcattacgtcggcgtcggcgaatgcgttcgttattgggccgaggaggggcaaggtctacgctgctggcgagaagattggtgtcgaaggaggcgggattgatgcggatcatcactttgaagggcagcgtagcacaatgttcgatgcgctcgtcattccgagcggggagcatgttgcgttgttgatgaagagtgggcgcgctgtgcattggttgagagaggcgttcgggcattgcaaggcgatcggtgccgttggggaagctatactcttcgtgcaacaggccatcaaccttccagaagtccaatacgcagaccccaccgatagttctatggaagttgtagcgtcgtacagcgtagtgacaacggcccactatggcgtatcgacggctatcggagacgctacgaagatgacgctgaacattggtgagaaggggttcatggaaaggtttgcgtacgaggtcagcaagcaccggtgcttcaagagggaggaggacgggttgactgcgaggattgcgtactga

SEQ ID NO: 42940 - protein, 740 aa, Pleurotus ostreatus
MSSVTAAAKQAVSSITDNAKMASLTQFRVECGPSQRMTTDQGLHVADTDNCNSNVGPALLEDHIAREKIMRFDHERIPERVVHARGAGAHGYFKAYDSSAEQWTKAKVLMDPSRTTPVFVRFSTVQGSRGSADTVRDVRGFAVKFYTEEGNWDIVGNNIPVFFIQDAIKFPDIIHAVKPEPHNEVPTGQSAHNNFWDFVGLQPESAHMIMWVMSDRAIPRSYRMMQGFGVNTYTLLNATGEKHFVKFHWIPELGVHSLVWDEALKIAGQDPDFHRKDLNEAIESGAYPKWRLALQVISEKDEHNFDFDILDATKIWPEELVPLHFVGEMVLNKVVDEYFAEVEQVAFCTSNIVPGIGFSDDPLLQGRNFSYLDTQLSRLGINWQQIPINRPVCPVMNFQRDGQMQMKIHKGTVNYWPNRQEAVQPVAVSEGGYDDHVRKISGIAQRMRGPKFNEHYSQAQLFYNSLSPTEQTHLQSALAFELSHCEDPAVYRNYINILNNIDYQLAKYVAVAVGGDVPDASAKPNEGNKSARLSQVYYAPKEPTIKGRRIAILLADGFDKAEVVAIKALITSASANAFVIGPRRGKVYAAGEKIGVEGGGIDADHHFEGQRSTMFDALVIPSGEHVALLMKSGRAVHWLREAFGHCKAIGAVGEAILFVQQAINLPEVQYADPTDSSMEVVASYSVVTTAHYGVSTAIGDATKMTLNIGEKGFMERFAYEVSKHRCFKREEDGLTARIAY

SEQ ID NO: 42941 - DNA, 1455 bp, Rhizobium sp
  CDS (1)..(1455): transl_table=11
atgaaaaagctgaccaacgccaccggggcaccggttgccgacaacttcaatatccagaccgccggcccccgtggaccggccctcttgcaagacatctggttgctggaaaaactcgcccacttcgaccgtgagctgatcccggaacggcgcatgcacgccaagggtgcgggcgcctacggcaccttcaccgtcacccatgacatcacccgttatacaaaagccagcatcttcagctcggtgggcaaggaaacgccgctgttcgtgcgtttttcctcggtggccggcgagcgcggcagcgcggatgccgagcgtgatatccgtggcttcgcggtgaagttctacaccgacgaaggcaactgggacattgtcggcaacaacacgccggtgtttttcttccgcgacccgctgcgtttctccgacctcaaccacgtggtcaagcgcgaccccagcccggccctgcgcaatgccaccagcaactgggacttctggaccctgctgcccgaagcgctgcaccaggtgaccagcgtgatgagcgatcgcggattacctaccagcttccgtcacatgcacggtttcggcagtcacaccttcagcctgatcgaccgcgacaacaaacgggtgtgggtgaagtttcattttgtctgccagcaaggcatcgaaaacctctcggacgccgaggccgaagcagtggttggcaaggaccgcgaaagcaatctgcgcgacctttacgaagtcatcgagcagggcaacttcccgcgctggaaattgtgcattcaggtgatggaggaagaacaggcgctcaactatcggcacaacccgttcgacttgaccaaggtctggccacacgctgcccgcgtgattgaagtgggcatcatggagctcaatcgcaacagccgaaaagccaactttgccgaaatcgaacaggcagcgttttcgccggccaacgtggtgccgggcgtgagtttttcgccggaccgcatctccagggcgcggctgttttcctatggtgatgcccagcgttatcgcctttggctgaacttcaaccacatcccggtcaatgcgccgcgctgcccggccagcagctaccaccgcagctaccaccgcgacggcgccatgcacgccgacggcaacctcggcggtaccgccagttacttcccgaacagtgtcggtgaatggcaggactcgccggaacgtgccgagccgccgctgccgctggaaggctttgaccagcattatgatcatcggttggaagaggatcattacgaacagccgggtaacctgtttcgactgctcgatccggcccgcaacgagttgctgttcgacaacaccgcacgcgccatgaacggcgtgccgcagcgaatccgccagcgtcatatgacaattgcaccaaagccgagtcctgcgtacggatttggcgtggccgaggcgttggagcggttggtgccgctagggtaa

SEQ ID NO: 42942 - protein, 484 aa, Rhizobium sp
MKKLTNATGAPVADNFNIQTAGPRGPALLQDIWLLEKLAHFDRELIPERRMHAKGAGAYGTFTVTHDITRYTKASIFSSVGKETPLFVRFSSVAGERGSADAERDIRGFAVKFYTDEGNWDIVGNNTPVFFFRDPLRFSDLNHVVKRDPSPALRNATSNWDFWTLLPEALHQVTSVMSDRGLPTSFRHMHGFGSHTFSLIDRDNKRVWVKFHFVCQQGIENLSDAEAEAVVGKDRESNLRDLYEVIEQGNFPRWKLCIQVMEEEQALNYRHNPFDLTKVWPHAARVIEVGIMELNRNSRKANFAEIEQAAFSPANVVPGVSFSPDRISRARLFSYGDAQRYRLWLNFNHIPVNAPRCPASSYHRSYHRDGAMHADGNLGGTASYFPNSVGEWQDSPERAEPPLPLEGFDQHYDHRLEEDHYEQPGNLFRLLDPARNELLFDNTARAMNGVPQRIRQRHMTIAPKPSPAYGFGVAEALERLVPLG

SEQ ID NO: 42943 - DNA, 1467 bp, Streptomyces coelicolor
  CDS (1)..(1467): transl_table=11
ttgcctgagaacaaccagaagccgctgaccacggtcgccggtccgccggttcccgacaaccagaactccctgacctccggcccgcgccgcccgatgctcctgcaggacgtgtggttcctggagaagctcgcgcacttcgaccgggaggtcatcccggagcgccggatgcacgccaaggggtcggggctgttcggcactttcacggtcactcacgacatcacccggtacaccagcgcgaagatcttctccgagatcggcaagaagaccccgctgttcacccggttctccaccgtcgccggtgagcgcggtgccgccgacgccgagcgcgacatccgcggcttcgccgtgaagttctacacggacgagggcaactgggacctggtcggaaacaacaccccggtcttcttcttccgcgacccgctgaagttcccggacctcaaccacgcggtgaagcgcgacccgcgcaccaacctgcgcaacgccgagaacaactgggacttctggaccaacctccccgaggccctgcaccaggtcacgatcgtgatgtcggaccgcggcatcccggcctcctaccggcacatgcacgggttcggctcgcacacgtacagcctgatcaacgccgagggcgagcggttctgggtcaagttccaccaccgcacccagcagggcatcaagaacctcaccgacgccgaggccgaggccctggtcggcaaggaccgcgagtcccaccagcgcgacctcttcgacgcgatcgaggacggcgacttcccgaagtggaagctgttcatccaggtcatgccggaggccgacgcggagaactaccgcttccaccccttcgacctcaccaaggtctggtcgaagaaggactacccgctgatcgaggtcggcgagtgggagctcaaccgcaaccccgacaactacttcgcggacgtggagcaggccgccttcagcccggccaacgtggtcccgggcatcgaggcttcccccgaccggatgctgcagggccgcctcttctcctacggcgacgcccagcgctaccgcctcggcgtcaaccaccaccaccagatcccggtcaacgccccgaagaacccggtgaactcctaccaccgcgacccggccatgcgcgtcgacggcaaccagggagccaccccgggcatcgagcccaactcctacggccgctggcaggagcagccggcctaccgcgacccggcccaggccgtgggcgccgtcgccgaccggttcaactaccgcgaggacgacgacaactacttcgagcagcccggcaacctgttccggcagatgagcccggagcagcagcaggttctgttcgagaacacggcacgcgccatcgacggcgcctcggcgcagaccatcgagcgccacatcggcaactgcacccaggccgacccggcctacggcgcgggcgtccgcaaggcgatcgaggccctggccgccggcaacctctga

SEQ ID NO: 42944 - protein, 488 aa, Streptomyces coelicolor
MPENNQKPLTTVAGPPVPDNQNSLTSGPRRPMLLQDVWFLEKLAHFDREVIPERRMHAKGSGLFGTFTVTHDITRYTSAKIFSEIGKKTPLFTRFSTVAGERGAADAERDIRGFAVKFYTDEGNWDLVGNNTPVFFFRDPLKFPDLNHAVKRDPRTNLRNAENNWDFWTNLPEALHQVTIVMSDRGIPASYRHMHGFGSHTYSLINAEGERFWVKFHHRTQQGIKNLTDAEAEALVGKDRESHQRDLFDAIEDGDFPKWKLFIQVMPEADAENYRFHPFDLTKVWSKKDYPLIEVGEWELNRNPDNYFADVEQAAFSPANVVPGIEASPDRMLQGRLFSYGDAQRYRLGVNHHHQIPVNAPKNPVNSYHRDPAMRVDGNQGATPGIEPNSYGRWQEQPAYRDPAQAVGAVADRFNYREDDDNYFEQPGNLFRQMSPEQQQVLFENTARAIDGASAQTIERHIGNCTQADPAYGAGVRKAIEALAAGNL

SEQ ID NO: 42945 - DNA, 1479 bp, Oryza sativa
  CDS (1)..(1479)
atggatccctacaagcatcggccgtccagcgggagcaattccaccttctggaccaccaactccggcgcccccgtctggaacaacaactccgccctcaccgtcggagagcgaggccctatcctccttgaggactatcatctgattgaaaagcttgcacagtttgacagggagcgtatccctgaacgtgtcgttcatgcaaggggagccagtgccaagggattttttgaggttactcatgatatttctcacctcacatgtgctgattttctccgtgctcctggtgttcagaccccagttattgttcggttctccacagtcgtgcatgagcgtggaagccctgagacattgagggatccacgtggttttgctgtcaagttttacactagagagggtaattttgatcttgttgggaacaatatgcctgtcttttttatccgagatgggatgaaattccctgacatggtccatgctttcaagccaagtccaaagaccaatatgcaggagaactggagaatagttgatttcttttcacaccacccagagagcctgcacatgttctccttcctctttgacgatgtaggcatcccactcaactacaggcacatggagggttttggtgtcaacacctacaccctaatcaataaggatggaaagcctcaccttgtcaaattccactggaagcctacctgtggtgtcaaatgcctgttggatgatgaagctgtgactgttggcggcacctgccacagccatgccacgaaggacttgactgattctattgcagcagggaattacccagagtggaagctttacatccagactattgatcctgatcatgaggacagatttgacttcgatcctcttgatgtcaccaagacatggccagaggatatcatccccctgcagccagttggacggatggtcctgaacaaaaacattgataacttctttgcagaaaatgaacagcttgctttctgcccagcgataattgtccctggaatccattactctgatgataagctgctccagacaagaattttctcctatgctgatacccaaaggcaccgtcttggcccaaactatttgatgcttcctgtgaatgcaccaaaatgtgcataccacaacaaccaccacgatggctccatgaatttcatgcacagggatgaagaggttaactacttcccttcaaggtttgatgctgcacgtcatgctgagaaggtccctattcctcctcgtgttctaacaggctgtcgggaaaagtgtgtcattgacaaggagaacaatttccaacaggctggtgagagataccggtcatttgaccctgccaggcaagatcgttttctccagcggtgggttgatgctctctcagatcctcgtattacacatgaactccgtggcatctggatctcctactggtcgcagtgtgatgcgtcccttgggcagaagctggcttcacgtctcaacctgaaaccaaacatgtag

SEQ ID NO: 42946 - protein, 492 aa, Oryza sativa
MDPYKHRPSSGSNSTFWTTNSGAPVWNNNSALTVGERGPILLEDYHLIEKLAQFDRERIPERVVHARGASAKGFFEVTHDISHLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFSFLFDDVGIPLNYRHMEGFGVNTYTLINKDGKPHLVKFHWKPTCGVKCLLDDEAVTVGGTCHSHATKDLTDSIAAGNYPEWKLYIQTIDPDHEDRFDFDPLDVTKTWPEDIIPLQPVGRMVLNKNIDNFFAENEQLAFCPAIIVPGIHYSDDKLLQTRIFSYADTQRHRLGPNYLMLPVNAPKCAYHNNHHDGSMNFMHRDEEVNYFPSRFDAARHAEKVPIPPRVLTGCREKCVIDKENNFQQAGERYRSFDPARQDRFLQRWVDALSDPRITHELRGIWISYWSQCDASLGQKLASRLNLKPNM

SEQ ID NO: 42947 - DNA, 1485 bp, Secale cereale
  CDS (1)..(1485)
atggatccctgcaagttccggccgtcgagcagcttcgacaccaagacgacgacgacgaacgccggccagccggtgtggaacgacaacgaggcgctcaccgtcggcccgcgtggcccgatcctgctggaggactaccacctgctggagaagatcgcccacttcgcgcgcgagcgcatcccggagcgcgtcgtccacgcgcggggcgcctccgccaagggcttcttcgagtgcacccacgacgtcacgggcctcacctgcgccgacttcctccgcgcgcccggggcgcgaacgccggtgatcgtccgcttctccaccgtcatccacgagcgcggctcccccgagaccatccgcgacccgcgcggcttcgccgtcaagttctacacgcgcgagggcaactgggacctcctcggcaacaacttccccgtcttcttcatccgggacggcatcaagttccccgacgtcatccacgccttcaagcccaaccccaagtcccacgtgcaggagtactggcgcgtcttcgacttcctttcccaccaccccgagagcctccacaccttcttcttcctcttcgacgatgtcggcatccccaccgactaccgccacatggacggcttcggcgtcaacacctacaccttcgtcacccgcgccgggaagtcccactacatcaaggtccactggcgccccacctgcggcgtcagctgcctcatggacgacgaagccaccctcgtcggcggcaagaaccacagccacgccacccaggacctcttcgactccattgacgccggtaacttccccgagtggaagctcttcgtgcaggtcatcgaccccgaggaggaggaccgctttgactttgacccgctggatgacaccaagacgtggcccgaggacctcgtccccctccagcccgtggggcgcctcgtgctcgaccgaaacgtagataacttcttcaacgagaacgagcagctggccttcggccccggcctcgtcgtgcccgggatctactattctgatgacaagatgctgcagtgcagggtgttcgcttacgccgacacgcagcgctaccgcctggggccaaactacctgatgctccccgtcaacgcgcccaagtgcggcttcaagaacaaccactacgacggcgccatgaacttcatgcaccgcgacgaggaggtggactactacccgtcacgccacgcgccgctccggcaggcggagccggccagcttccccgtgccaacgcgacccgtcgtcggaaaaagggagaagacgaggatcaagaaggagaacgacttcgtgcagcccggggagaggtaccgcagctgggcgcccgaccgccaggacaggttcgtgcgccgcttcgccgacgccctcgcccaccccaaggtcagccacgagctacgcgtcatctggatcgacttcctctccaagtgtgacaagtcgtgcgggatgaaggtggcaaaccgtctcaacgtgaagccaagcatgtga

SEQ ID NO: 42948 - protein, 494 aa, Secale cereale
MDPCKFRPSSSFDTKTTTTNAGQPVWNDNEALTVGPRGPILLEDYHLLEKIAHFARERIPERVVHARGASAKGFFECTHDVTGLTCADFLRAPGARTPVIVRFSTVIHERGSPETIRDPRGFAVKFYTREGNWDLLGNNFPVFFIRDGIKFPDVIHAFKPNPKSHVQEYWRVFDFLSHHPESLHTFFFLFDDVGIPTDYRHMDGFGVNTYTFVTRAGKSHYIKVHWRPTCGVSCLMDDEATLVGGKNHSHATQDLFDSIDAGNFPEWKLFVQVIDPEEEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRQAEPASFPVPTRPVVGKREKTRIKKENDFVQPGERYRSWAPDRQDRFVRRFADALAHPKVSHELRVIWIDFLSKCDKSCGMKVANRLNVKPSM

SEQ ID NO: 42949 - DNA, 1593 bp, Gallus gallus
  CDS (1)..(1593)
atggctgacggacgggacgtcgcctcggagcagctgaagcggtggcaaagccagcgaggctctcagaagccagatgccttgaccactggtgctggcaacccaataggagataagctgaatattatgacagttgggccacgtggacctcttcttgttcaagatgttgttttcactgatgagatggctcattttgacagagagaggattcctgaaagagttgtgcatgcgaaaggagcaggtgcctttggctattttgaagtgactcatgatattaccaagtactgcaaggcgaaagtgtttgaacacattggaaaaagaactccaattgctatacggttctccactgttgctggagaatctgggtcagctgatacagttcgtgaccctcgaggctttgcaatgaaattctatacagaagaaggtaactgggatcttgtgggaaataatactcctatcttctttattcgggatgcaatgttgtttccatccttcatccatagccagaagaggaaccctcagactcatttgaaggatccagatatggtatgggacttcttgagtcttcgccctgagtctttacatcaagtgtctttcctgtacagtgatcgtggtattcctgatggatttcgccatatgaatggatatggatctcatacttttaaacttgttaatgctagtgggggagctgtttactgcaagttccacgttaagaccgatcagggtatcaaaaatctttctgttgaagaagcagcaagactggcttctactgatcctgattatggaattcgtgatctttacaatgccatagccaatggaagctatccttcctggtctttctacattcaagttatgacttttgaagaagcagagaggttcccatttaatccttttgatttgactaagactaagatttggccacatggtgactaccctctcattccagtgggcaagattgtcttgaacaggaatcctgtcaattactttacggaggtagaacagatggcgtatgaccctagcaacatgccacctggtattgaacctagccctgataagatgctgcagggtcgtctctttgcgtatcctgacacgcatagacatcgtctaggaccaaactatctgcaaattcctgtgaattgcccctacagggctcgcgtggccaattatcagagggacgggccaatgtgtgtgtctgacaaccaaggtggcgccccgaactattatccaaatagctttacaggcccagaagatcagcctgttctgaaggagagccgcatgtccgtttcaggagatgtgcagcgtttcagtagtgcaaatgaagataatgtgtctcaggtgcgagacttctatctcaaagtgttgaaagaggatgaacgccaaaggctgtgtaagaatatcgctgatcatcttaaagacgctcaacttttcattcagaagagagctgtgaaaaacttcactgatgttcatcctgactatggcgcacgtattcaggcactgctggacaaatacaatgctgaagctgggaaaaaggatgtaattaggacatacacgcaagccacttctcgtgtgtctgccaaagagagatccaacttgtaa

SEQ ID NO: 42950 - protein, 530 aa, Gallus gallus
MADGRDVASEQLKRWQSQRGSQKPDALTTGAGNPIGDKLNIMTVGPRGPLLVQDVVFTDEMAHFDRERIPERVVHAKGAGAFGYFEVTHDITKYCKAKVFEHIGKRTPIAIRFSTVAGESGSADTVRDPRGFAMKFYTEEGNWDLVGNNTPIFFIRDAMLFPSFIHSQKRNPQTHLKDPDMVWDFLSLRPESLHQVSFLYSDRGIPDGFRHMNGYGSHTFKLVNASGGAVYCKFHVKTDQGIKNLSVEEAARLASTDPDYGIRDLYNAIANGSYPSWSFYIQVMTFEEAERFPFNPFDLTKTKIWPHGDYPLIPVGKIVLNRNPVNYFTEVEQMAYDPSNMPPGIEPSPDKMLQGRLFAYPDTHRHRLGPNYLQIPVNCPYRARVANYQRDGPMCVSDNQGGAPNYYPNSFTGPEDQPVLKESRMSVSGDVQRFSSANEDNVSQVRDFYLKVLKEDERQRLCKNIADHLKDAQLFIQKRAVKNFTDVHPDYGARIQALLDKYNAEAGKKDVIRTYTQATSRVSAKERSNL

SEQ ID NO: 42951 - DNA, 2106 bp, Xanthomonas oryzae
  CDS (1)..(2106): transl_table=11
atggccaagtcttccggcaaacctgcatccgccgtctccgtcgaccgttccgcaagcgcgcctgatgcgcgcggtactggcgacgaattgcaccagaaggcccgcggtaggcatccgcagctgaccaccaaccagggcattcccgttggtgacaaccaaaactcgctgcgcgcaacaccacgcggcccgacgctgctggaagatttcatcctgcgcgagaagatcacccacttcgatcacgagcgcatccccgagcgcatcgtgcatgcgcgtggcagcgcctcgcacggctacttcaagctcaccaagtcgttgagccaatacaccactgccaagatctttaccgaggtcggtgaaaaaacaccgctatttacccgtttttctaccgttgcgggcggcgccggctcggtggacacgccgcgcgatgtgcgcgggtttgccgtgaagttctataccaaggaaggcaattgggatctggtgggcaacaatatcccggtgtttttcatccaggatgcgatcaagttccctgacctgatccatgcagtgaagatggaaccggatcgcggttttccgcaggctgccagcgcacacgacacgttctgggatttcatctcgctgacccccgaatcgatgcacatgatcatgtgggcgatgagcgaccgcaccatcccgcgctcgctgcgcatgatcgaagggttcggcatccacagcttccgtttcctcaatgacaaaggcgaaagcaccttcgtcaaattccattggcgtcccaagctgggcctgcaatcgaccatctgggacgaggcggtcaagattgccggcgccgatcaggacttcccaccccgtgatctgttcgaggcgatccagaacggcgacttcccggaatgggaacttggcgtgcaattgttcaccgaggccgaggcggatgcattcccgttcgaccatctggattcgaccaagatcattcccgaagagttggtgccgctgcaaatcgtcggccgcatggtgctcgaccgctggccggacaacttctttgccgaaaccgaacaggttgcctactgcccggccaacatcgtgcccggcatcgacttcagcaacgacccgctgctgcaaggccgcctgttctcctatctggatacgcagctgagccgcctgggcgggccgaatttccatcagattccgatcaacgcccccaagtgtccattcgccaacaatcagcgcgatggtcatatgcagatggacgtaccgaaggcccgtgttgcctacgagcccagcttactgcaggcagatgcgccgcgtgaagcgctgcgtggattccccagccattcaaccccggctgaggatggcgccaagggccgcgtgcgtgcagaacgcttcgccgatcattacagccaggcaagactgttcttccgcagccagaccgcaccggaacaggcacatatggcgtcggccctggtgttcgaactgtcgaaggtcgaaaccgcacacgtgcgcgaagccatcgtggggcatctgcgccacatcgaccagaagctcgcgcagcgtgtggccgatggcatgggtatgaccaccttaccgccggcaccaccggctgcagtagcgccgatcgacatgccactgtcgcccgccttgcaggtcatcggcaagatgaaagacacattgaagggacgcacggtcggtatcctgattcacgacggctccgatgcatcgacgatcaaagcggtgcgcaaggcagcggaagctgagggcgcaacagtcaagatcgtcgcccccaagcttggcggcgccaagctcagcgatggcaagcaactggccgccgatgggcagctggcagggacgccctcggtggtgttcgatgccgtggcagtcctactgtcttcggaagcggccaagctgctgacacgcgaatcggccgcactggatttcgtgagctgtgcctgggcgcatctgaaggccatcgcattcgacgaaggcgcgcagttgttgttgaaagcgggcaatatcggcaaggatgcgggcgtggttccggccgccgataccaaggcattcatttccgcagcaaaaacccgacagtgggcacgcgagccgaaggtgcgcatgctggcctaa

SEQ ID NO: 42952 - protein, 701 aa, Xanthomonas oryzae
MAKSSGKPASAVSVDRSASAPDARGTGDELHQKARGRHPQLTTNQGIPVGDNQNSLRATPRGPTLLEDFILREKITHFDHERIPERIVHARGSASHGYFKLTKSLSQYTTAKIFTEVGEKTPLFTRFSTVAGGAGSVDTPRDVRGFAVKFYTKEGNWDLVGNNIPVFFIQDAIKFPDLIHAVKMEPDRGFPQAASAHDTFWDFISLTPESMHMIMWAMSDRTIPRSLRMIEGFGIHSFRFLNDKGESTFVKFHWRPKLGLQSTIWDEAVKIAGADQDFPPRDLFEAIQNGDFPEWELGVQLFTEAEADAFPFDHLDSTKIIPEELVPLQIVGRMVLDRWPDNFFAETEQVAYCPANIVPGIDFSNDPLLQGRLFSYLDTQLSRLGGPNFHQIPINAPKCPFANNQRDGHMQMDVPKARVAYEPSLLQADAPREALRGFPSHSTPAEDGAKGRVRAERFADHYSQARLFFRSQTAPEQAHMASALVFELSKVETAHVREAIVGHLRHIDQKLAQRVADGMGMTTLPPAPPAAVAPIDMPLSPALQVIGKMKDTLKGRTVGILIHDGSDASTIKAVRKAAEAEGATVKIVAPKLGGAKLSDGKQLAADGQLAGTPSVVFDAVAVLLSSEAAKLLTRESAALDFVSCAWAHLKAIAFDEGAQLLLKAGNIGKDAGVVPAADTKAFISAAKTRQWAREPKVRMLA

SEQ ID NO: 42953 - DNA, 1518 bp, Penaeus vannamei
  CDS (1)..(1518)
atgccgcgtgacaagtgtgcagagcaattgaatgacttcaagaaacaacagacggctcccgataacctgaccacgagccatgggtgcccacttgcggacaagcttaattccctgactgtaggtccaaggggccccatcctcctgcaggacattcaactccttgatgagatggctcacttcgaccgtgagcgcatcccagagagggttgtgcatgctaagggagcaggtgcctttggttattttgaggtaacacatgatatatccaagtattgtaaggctgctttgttcagtgagattgggaaacgaactcctattgctgttcgttactccactgtaggaggtgagagtggatcaactgacactgccagggatcctcgaggctttgccgtgaagttttacacagaagaaggaaattgggatcttgtggggaacaacactcccattttcttcatcagggatcctattctgttcccatccttcattcacacgcagaagaggaatcctgcaactcatctaaaggattgtgacatgttttgggacttcattagtttgcgaccagaaacaacacaccaagtgtcattcctcttctctgacagaggaacccctgatggctatcgtcacatgaatggctatggttctcgtacttccaagcttgtcaatgaaaagggagaggccgtctactgcaagttccattacaagacggaccaaggcatcaagtgtcttagcagcaagaaggctgatgaactggcaggttctgacccagattatgcaacaagggacctatacaatgcgatttcaagtggcgattacccctcatacactatgtgtattcaggtgatgacattcgaagaagcagagaagtggaagtttaatccattcgaccttaccaaagtatggcctcatggggaattcccactcatcccagtaggccgtcttacttttgaccgcaatccaaagaattactttgctgaggtggagcagattgcgttctcttctgccaacatggtgccgggtattgaggcttcccctgacaaaatgttgcaaggtcgcctcttttcttacaacgacactcaccgtcaccgtctgggtgccaactacacccagatccccgtgaactgcccgtaccgtgcccgtacaaggaactaccagagagatggccccatgtgtgttgatggcaatcaggaaagtgctcctaactacttccccaacagctttagtggcccacaggactgcaggaaacacactgctcctaaattttctgtttctgctgatgttgatcgctacaacagtgctgatgaggacaactttacccaagttggcattttctatcgtcaggtgctgaatgaggcagaacgtcagcgtttggtggagaacattgctggtcacatggttggagcccaagagttcatccaggatcgagcaatcaaaaactttacccaggctgatccagaatatggtgctaacatccggcgtgcgattgacaagataaagatgagccaggcttcatctaaaacttaa

SEQ ID NO: 42954 - protein, 505 aa, Penaeus vannamei
MPRDKCAEQLNDFKKQQTAPDNLTTSHGCPLADKLNSLTVGPRGPILLQDIQLLDEMAHFDRERIPERVVHAKGAGAFGYFEVTHDISKYCKAALFSEIGKRTPIAVRYSTVGGESGSTDTARDPRGFAVKFYTEEGNWDLVGNNTPIFFIRDPILFPSFIHTQKRNPATHLKDCDMFWDFISLRPETTHQVSFLFSDRGTPDGYRHMNGYGSRTSKLVNEKGEAVYCKFHYKTDQGIKCLSSKKADELAGSDPDYATRDLYNAISSGDYPSYTMCIQVMTFEEAEKWKFNPFDLTKVWPHGEFPLIPVGRLTFDRNPKNYFAEVEQIAFSSANMVPGIEASPDKMLQGRLFSYNDTHRHRLGANYTQIPVNCPYRARTRNYQRDGPMCVDGNQESAPNYFPNSFSGPQDCRKHTAPKFSVSADVDRYNSADEDNFTQVGIFYRQVLNEAERQRLVENIAGHMVGAQEFIQDRAIKNFTQADPEYGANIRRAIDKIKMSQASSKT

SEQ ID NO: 42955 - DNA, 1479 bp, Solanum tuberosum
  CDS (1)..(1479)
atggatccgtctaagtatcgcccatcaagcgcatacgacacccctttcttgacaacaaatgctggtggtcctgtgtacaacaatgtttcttccttgactgttggacctagagggcctgttctgcttgaggattattatctaattgagaaacttgcgacttttgatcgcgaaaagacacctgagcgtgttgttcatgctagaggtgctagtgctaagggattctttgaagttactcatgacatttctcatcttacctgtgctgattttctccgagctcctggtgctcaaacgcctgttatttgtcgattctctactgttgtccatgaacgtggaagccccgagtcaatcagggacattcgcggttttgctgtcaagttttacaccagagagggtaactttgatcttgttggaaacaatgtccctgtgttctttaatcgtgatgctaagtcgttccctgacacgattcgtgcattgaaaccaaatccaaagtcacacattcaggagaactggaggatccttgatttcttctcgttccttcctgagagtttgcatacattcgccttcttctacgatgatgtttgtctcccaactgattacagacacatggaaggttttggcgttcacgcgtatcaattgattaacaaagaggggaaagcacattatgtgaagttccactggaagccaacttgtggtgtgaaaagtatgtctgaggaagaagctattagagtcggaggtactaatcatagtcacgcgaccaaggatctttacgattcaattgctgctggaaactatcctgagtggaaacttttcatccaaacaatggaccctgaggatgtagacaagttcgattttgatcctctagatgtaaccaagacatggcctgaggatctcttgccgttgatcccagttggtcgattggtattgaacaggaacattgataacttctttgctgagaatgagcagctcgcgtttaaccctggacatatcgtccctggtatttactattccgaggataagcttctccagactaggatattcgcgtatgctgatactcagaggcaccgtattggaccaaactatatgcagctcccagttaatgctcccaagtgtggtcatcacaacaatcatcgcgatggtgccatgaacatgacacatcgcgatgaagaggtggattatttgccctcgaggtttgatccttgtcgccctgctgagcagtacccaattcctgcttgtgtcttgaatggaaggcgtacaaattgtgtcattccgaaagagaacaacttcaaacaggcaggggagaggtacagatcctgggaatctgacaggcaagacagatacatcaccaaatgggttgagtctctatccgatccacgagtcactcatgagattcgcagcatatggatatcatacttgtctcaggctgacaagtcctgtggtcagaaggttgcttctcgtctcactgtgaagcctacaatgtga

SEQ ID NO: 42956 - protein, 492 aa, Solanum tuberosum
MDPSKYRPSSAYDTPFLTTNAGGPVYNNVSSLTVGPRGPVLLEDYYLIEKLATFDREKTPERVVHARGASAKGFFEVTHDISHLTCADFLRAPGAQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPTDYRHMEGFGVHAYQLINKEGKAHYVKFHWKPTCGVKSMSEEEAIRVGGTNHSHATKDLYDSIAAGNYPEWKLFIQTMDPEDVDKFDFDPLDVTKTWPEDLLPLIPVGRLVLNRNIDNFFAENEQLAFNPGHIVPGIYYSEDKLLQTRIFAYADTQRHRIGPNYMQLPVNAPKCGHHNNHRDGAMNMTHRDEEVDYLPSRFDPCRPAEQYPIPACVLNGRRTNCVIPKENNFKQAGERYRSWESDRQDRYITKWVESLSDPRVTHEIRSIWISYLSQADKSCGQKVASRLTVKPTM

SEQ ID NO: 42957 - DNA, 2280 bp, Paracoccidioides brasiliensis
  CDS (1)..(2280)
atggctagcaaggctacagaaggattacggaagatccaggggatggtggaaagcatgcatcccgggaacaaaaaggtcgcagacctcgcccgtgataccgtcgatgtccacgcgcctgctcctttcaccaccgaccacgggaccaaagtcagcaatacagacaattggttgagggctgcatccgaaaatcaaactggcccgtcgttgttggaggatcagattgctcgcgaaaagatccatcggtttgatcatgaaagaatcccagagcgcgttgtgcatgctcgaggaacaggtgccttcgggcacttcaaacttgttgagagcgcagaagacgcaacttctgccggcgtgttaactgatacttcacggacaactcctgtttttgtccgcttttctaccgtccaaggtagcaaaggcagtttcgatacagtccgtgatgtgcgtggtttcgccaccaagttttatacgcaagaaggcaattgggatcttgttggcaataatattcctgtcttttttatccaggatgccataaaatttgacataagtaagcaatcgatacctttttcttttttgagtcggtgttatttatcatcagttcacgctgtcaagccggaacgacaacgaagtcctcaaggcaactgccacaacaacttctgggacttcgtttcttgcatcctgaaagcgacccatatgtttatgtgggccatgtcggacagagcgatcccgcgaatcttacccgtatgcaggggatttggcgtcaacacatttgttcttgtgaatcgtcaaggaaaacgacatttcgtaaaattccattggatgccagaacttggagtccattcactcgtacccgatgagtctttcaaactcggaggtcaagatccggattaccatcgcaaagatctcatggaggccattgacaacaaagtctacccgaaatggaaatttgggatccaggtgattcctgaggagaaggaacatgaatttgagtttgacatccttgatgccactaagatatggcctgaagacttggtccccgttcgatatattggagagatggagctcaacaggaatgtggacgagttctttccacagaccgaacaagttgccttctgcacctcccatatcgtccctggaattgaattctccgatgatcctctactgcagggccgtaacttctcatatttcgatacccaaatctccagacttggtgtgaactgggaggaactgcctatcaatcgtcctgtgtgtcctgtcatgaaccacaacagagatggcgccatgcgccacaaaataactcagggaaccgtaaactattggccaaaccgctttgaagcctgcccacccacgaaccccgaggacggcggcttcgtcacataccctcagaagataaccagaacattaagttacatggttagcaataagttcgcgaacacatcaccagcacaattattttacaactccctttcttacgaacagctccatattcagaacgccttctgttttgagttagaccactgctatgacccggtcgttacaacagactcgtcgagcgacttactgaaatctccttaccgctcgcacgagctgtcgcaatcaaagtcggcgctccaacaccaaacaggcttagacgtcccaaccaaaggtcaaaaaaccattaacctcagccaagaatacataaacgagcgccagcctttctgtacccacaatccaaggggcgaaaataccatcctgattggtgatggtacgacccaatcgccctcgcctctgtcaaaccgcggcaatagccatgaatgctctgcccatcataatggtacaaaacgccaacccatctttgctgaccacgaagatagggagaccggtgcaggcgtaattcctgatcacaactatatcggccagcggtctactctcttgacgccacgttcatacccggtggctcgcatatcaaggagctgtgccagcctaggcgcttttagacattggattgcagaacagttcggacattgcaaggccataggtgctacaggggaagctgtggatcttatcgcccaggttctgaacagcctgcctggtctaaacgttgcgttggcctcatctagcgatgttgtcgaatggtacggcgttgtcacatcaagcaagctgcacgaaccccacactttgacagaagggttcaagttattccctgaggcgaaggatttcctgggcaagttcctgtaccaagtttcacaacatcggaattatcagagagatatggtaggattgactgatcaggtcgcattttaa

SEQ ID NO: 42958 - protein, 759 aa, Paracoccidioides brasiliensis
MASKATEGLRKIQGMVESMHPGNKKVADLARDTVDVHAPAPFTTDHGTKVSNTDNWLRAASENQTGPSLLEDQIAREKIHRFDHERIPERVVHARGTGAFGHFKLVESAEDATSAGVLTDTSRTTPVFVRFSTVQGSKGSFDTVRDVRGFATKFYTQEGNWDLVGNNIPVFFIQDAIKFDISKQSIPFSFLSRCYLSSVHAVKPERQRSPQGNCHNNFWDFVSCILKATHMFMWAMSDRAIPRILPVCRGFGVNTFVLVNRQGKRHFVKFHWMPELGVHSLVPDESFKLGGQDPDYHRKDLMEAIDNKVYPKWKFGIQVIPEEKEHEFEFDILDATKIWPEDLVPVRYIGEMELNRNVDEFFPQTEQVAFCTSHIVPGIEFSDDPLLQGRNFSYFDTQISRLGVNWEELPINRPVCPVMNHNRDGAMRHKITQGTVNYWPNRFEACPPTNPEDGGFVTYPQKITRTLSYMVSNKFANTSPAQLFYNSLSYEQLHIQNAFCFELDHCYDPVVTTDSSSDLLKSPYRSHELSQSKSALQHQTGLDVPTKGQKTINLSQEYINERQPFCTHNPRGENTILIGDGTTQSPSPLSNRGNSHECSAHHNGTKRQPIFADHEDRETGAGVIPDHNYIGQRSTLLTPRSYPVARISRSCASLGAFRHWIAEQFGHCKAIGATGEAVDLIAQVLNSLPGLNVALASSSDVVEWYGVVTSSKLHEPHTLTEGFKLFPEAKDFLGKFLYQVSQHRNYQRDMVGLTDQVAF

SEQ ID NO: 42959 - DNA, 1455 bp, Lactobacillus plantarum
  CDS (1)..(1455): transl_table=11
atgacggaaaaattaacgacggaaaccggccaaccatgggctaacaatgaacattcccaaacggcaggagctcgtggtcccgtattaatgcaagactataatcttttggaaaaactagcccattttgatcgtgaacgaattccagaacgggtcgttcatgctaagggggccggagcaaaaggtttttttgaacttgaaaacgacatgggggaatatactaaggcagacttatttaatggtgtcggtaagaaaactcccgtaatcttaaggttctcacaagttgccggtgaaaaaggttatcctgacaccgttcgagacgtgcgcggttttgccttaaaattttatactcagcaaggcaattatgatctcgttggaaacaacacaccggtcttttttgtaaacgaccctttaaaatttcctgacttcatccattcacaaaaacgggatcctaaaacgaaccgtcgtacacaaaatatgcaatgggatttttgggctcattctccagaatcattgcaccaggtcacttatttaatgggcgaccgaggacttcctgcgtcctatcgaaccatgaatggttacggttcccatacttttaaatgggttaatcagaatggcgaacagttttgggttaagtatcacttcatctcagaccaaggcgttaaaaatatgactgctcaagcagctgaaaaagcaatgagccaagatttagattatttacaagatgacttatatgatgcaattcaagaaaaaaattacccatcatggacgatgtatgtccaaatcttgccatatgaggaaggtctaaactataaatgggacatttttgatgtcactaaagtcatctcccacaaagactatccactaattaaagtcggcaaactaactttaaatgagaatcccactaataactttaccgatattgaagaggcggccatgtcgccagcaaattttgttcctggtatcgaaccatctcccgacaaattactacaaggtcgcctattctcctataaagatgcacagcgatatcggttaggtgccaactttgaagatttacccgtgaacaagccggttgttccagttcataattatgaacgtgatggttacatgaaaattaataatcaaggtgctgaggtcaactacgagcctaatgcactgcatgggccagaagaggtgccggatgccgcactttcacctgattctgttcgtggtgaaacacgcgcacagccttatcgctatcaagttgattacacaactcaagcaggcgacctatatcgcttaatgtcagaacccgagcaagaacgcttaattaatactatcaaagatgcgttaggccaagttactttgcctggtgtcaaagaactcgaaatcaagcaattttatgaggccgacaaaaactacggtacacgcgtggctaatgctctgggaatgaatattgctgatattatcagtgattaa

SEQ ID NO: 42960 - protein, 484 aa, Lactobacillus plantarum
MTEKLTTETGQPWANNEHSQTAGARGPVLMQDYNLLEKLAHFDRERIPERVVHAKGAGAKGFFELENDMGEYTKADLFNGVGKKTPVILRFSQVAGEKGYPDTVRDVRGFALKFYTQQGNYDLVGNNTPVFFVNDPLKFPDFIHSQKRDPKTNRRTQNMQWDFWAHSPESLHQVTYLMGDRGLPASYRTMNGYGSHTFKWVNQNGEQFWVKYHFISDQGVKNMTAQAAEKAMSQDLDYLQDDLYDAIQEKNYPSWTMYVQILPYEEGLNYKWDIFDVTKVISHKDYPLIKVGKLTLNENPTNNFTDIEEAAMSPANFVPGIEPSPDKLLQGRLFSYKDAQRYRLGANFEDLPVNKPVVPVHNYERDGYMKINNQGAEVNYEPNALHGPEEVPDAALSPDSVRGETRAQPYRYQVDYTTQAGDLYRLMSEPEQERLINTIKDALGQVTLPGVKELEIKQFYEADKNYGTRVANALGMNIADIISD

SEQ ID NO: 42961 - DNA, 2193 bp, Cochliobolus heterostrophus
  CDS (1)..(2193)
atggtacggtctaacgttttgacagcaattgctgctatttgccatgtcgctcacgctgtttgcccctacatggatgaccaaccactcgcccgccgcgagggtgccactgccatgtcaactgatgatttcatgaagcagtatgagattgacgacagcaaggcctacctcacgagtcctgtgggagggccccaacccgaccaagagagcctctcggctggtgagcgaggtccatcactgctcgaggatcaaattctccgccggaaaatcatgagctttgatcacgagcgtgttcctgagcgcgccgtgcacgcccgtggtgccggtgctcatggaacgttcaagtcatatggtgactggtctaatattaccggagcctccttccttgccaactctgagaaggaaaccccagttttcattcgattctctactgttgcaggaagccgtggctccgccgatactgcccgagatgttcatggctttgctgtcaggttctacaccgacgaaggcaactttgatattgtcggtaacaacattcctgttttctttatccaggatgccatcaagttccctgatctcatccacgctgtcaagcccaagccggaccgtgagattcctcaggcagcaacggctcacgattcggcatgggacttcttcagtcagcagcctagcaccatgcacaccctcctgtgggctatgagtggacatggtaccattcgttcctacaggcataccgatggctggggtgtacacactttccgctttgtccgtgacgacggcaagtccaagctcgtcaagttccgcttccgatctctccagggtaaggcctccctgttgtgggaagaggctcaaaccactgccggaatgaacgcggatatgcaccgacaggatctcttcgagagcatcgagaacggctactacccagaatggatctttgaggcccaaatcatggaggagtcggaccaacttcgattcggattcgacgttctcgaccccaccaagattgttcccgaagacattgttcctttcacccctcttggaaagttgaccttgaaccgcaaccctcgcaactactttgccgagactgagcaaattatgttccaacctggtcatctcgtccgcggtattgatgtttccgacgacccgctccttcaaggacgcatgttctcgtacttggacactcagttgaaccgcaacggtggtcccaactttgaacagatccctatcaaccagccccgtgttcccgtccacaacaacgagcgtgatggtgccggccaaatgtatattcctctcaacactgccgcctactcgcccaacaccttgaacggtggttaccccaagcaagccacccaggccgaaggtcgcgggttcttcacagcaccctctcgatccgtcagcggaaaccttgtccgcaccgtctccagcacctttgccgacaactggtcgcagcctcgtctgttctacaattccttgtccgcagtcgagcagcagtttgtcatcaatgccatccgatttgagacttcgcaactccagagcgaggttgtcaagcagaacgtcttgatccagcttaaccgtatcagccacgacattgctacccgtgttgctactgctcttggcatgactgcacccgcacctgatgacaagttctaccacaataacaagacgattggtgttaacccggctggcgagcccctgctcaagatcgagggcttgaaggttggataccttacctctgcgggatccactggcgacaagggcaaggcgctcaaggccgcgctcaaggacgagaaggttagcttgacggtagtcgctgagcaccttggcgctggcattgaccagacctactctgctacttcggccgttaactttgacgccatcatcgttgatggtagcgcttcagccctcttcgcccccgcgggcagcctcgccaactccaactccacggctgccaagggccgttccactttgtaccctgctggtcgccctctcgagatcctccagaccggttaccagtttggcaagcccgttggtgttctcggagccagcaactcgactctatctgctgctggtgttgtggccggcacccctggtgtttacagcttcgactccgccagcgacatggcggcagttgttaccaagatcactgagggtctgcgcactttcaagttccttgacaggtacccattggacaactag

SEQ ID NO: 42962 - protein, 730 aa, Cochliobolus heterostrophus
MVRSNVLTAIAAICHVAHAVCPYMDDQPLARREGATAMSTDDFMKQYEIDDSKAYLTSPVGGPQPDQESLSAGERGPSLLEDQILRRKIMSFDHERVPERAVHARGAGAHGTFKSYGDWSNITGASFLANSEKETPVFIRFSTVAGSRGSADTARDVHGFAVRFYTDEGNFDIVGNNIPVFFIQDAIKFPDLIHAVKPKPDREIPQAATAHDSAWDFFSQQPSTMHTLLWAMSGHGTIRSYRHTDGWGVHTFRFVRDDGKSKLVKFRFRSLQGKASLLWEEAQTTAGMNADMHRQDLFESIENGYYPEWIFEAQIMEESDQLRFGFDVLDPTKIVPEDIVPFTPLGKLTLNRNPRNYFAETEQIMFQPGHLVRGIDVSDDPLLQGRMFSYLDTQLNRNGGPNFEQIPINQPRVPVHNNERDGAGQMYIPLNTAAYSPNTLNGGYPKQATQAEGRGFFTAPSRSVSGNLVRTVSSTFADNWSQPRLFYNSLSAVEQQFVINAIRFETSQLQSEVVKQNVLIQLNRISHDIATRVATALGMTAPAPDDKFYHNNKTIGVNPAGEPLLKIEGLKVGYLTSAGSTGDKGKALKAALKDEKVSLTVVAEHLGAGIDQTYSATSAVNFDAIIVDGSASALFAPAGSLANSNSTAAKGRSTLYPAGRPLEILQTGYQFGKPVGVLGASNSTLSAAGVVAGTPGVYSFDSASDMAAVVTKITEGLRTFKFLDRYPLDN

SEQ ID NO: 42963 - DNA, 1644 bp, Cochliobolus heterostrophus
  CDS (1)..(1644)
atgcagagctcaaatgagggcccagcagacatcatcgccaaggttgctggggttactcagggtggaaagcgtgaagatgacggcccatatttcaccaacaatgaaggcattccatggcccgacgcagaacatagcaagaccatcggcggaatcccagtcgctagcgatgttttcctcttccagaagcagcagacatttaaccgctcaaaaaatctcgagcgcatggtgcacccctgtggttcaggtgcttttggttatttcgagaccaccaaagatgtcacccacctcaccaaggccgactttttgaagactgtaggtgagaagacgcccatattcatacgattcagtaccgttactcctggacgcgagtatcccgacgaagctcgtaaccctcgtggatttgccatcaagttctatactggagaaggcaactacgacatcgttgggttgaacttcccagttttcttctgccgtgatcctatccagggcccagatgtcatccgatcgcaatggcgtaaccccaagaacttccttttcgattacgatgctattttcgacttgcttgccaacacccccgagggtaaccacgctggcctaatgttcttcagtgaccatggcacgccccagggttggcgtttcaaccacgggtatggatgccacacgttcaagtgggtgaacaaggacggtcaattcgtgtacatcaagtaccactttgttgctgagcacggtcaaaagcaattcacccaggaacaagcgacacaaatgtgtggcgaggaccctgactattccaagcgtgatctatatgagactattgagaatggcgaggaggtagtctggaaagcacacgtacaggtcatgagcccagaggaagccgatcccgataagcttggcttcgatccttttgacgtcaccaaggtctggccgcgtaagcaatttcctatgcaagagtttggacgcctggttttgaacaagaaccctgaaaatttccatcgtgacgtcgagcaggcggccttctccccgggtagcatggtgcccggtgttgaagactcgcctgatccacttcttcagttccgcatgttcttctaccgcgatgcgcagtaccaccgtattggtgtgaacttgcaccagattcccgtcaactgcccattcatggccaagtctttcgcatccctcaattttgatggccagatgcgtgtcgatgccaatcatgctgggaacaagccgtatgccccaaacagcttcgcgcacaagttccggcccgatgtcgctgaagcaccataccaggtcaatgacaacatcatgagccgaaagagtcattattggcatgagggcaagaagaacgagtacgaccaggctaaggagctttggtcacgcgtaatgagcgtacaggagaagcaaaacaccatcaagaacaccgcaaacatgcttaagtttgtccgataccccgagattcagcaatataatatcggtaccgacctgtcgagaggcatttacgacctcctcccgaagccagcgttcgatttcagcgaagtcgaggagctttctcacacagcccatgagtggtataaggagaagaagtttaggtctatcgatggcgagaggcttacaggtttccctccatcgatgcctgtttataattactga

SEQ ID NO: 42964 - protein, 547 aa, Cochliobolus heterostrophus
MQSSNEGPADIIAKVAGVTQGGKREDDGPYFTNNEGIPWPDAEHSKTIGGIPVASDVFLFQKQQTFNRSKNLERMVHPCGSGAFGYFETTKDVTHLTKADFLKTVGEKTPIFIRFSTVTPGREYPDEARNPRGFAIKFYTGEGNYDIVGLNFPVFFCRDPIQGPDVIRSQWRNPKNFLFDYDAIFDLLANTPEGNHAGLMFFSDHGTPQGWRFNHGYGCHTFKWVNKDGQFVYIKYHFVAEHGQKQFTQEQATQMCGEDPDYSKRDLYETIENGEEVVWKAHVQVMSPEEADPDKLGFDPFDVTKVWPRKQFPMQEFGRLVLNKNPENFHRDVEQAAFSPGSMVPGVEDSPDPLLQFRMFFYRDAQYHRIGVNLHQIPVNCPFMAKSFASLNFDGQMRVDANHAGNKPYAPNSFAHKFRPDVAEAPYQVNDNIMSRKSHYWHEGKKNEYDQAKELWSRVMSVQEKQNTIKNTANMLKFVRYPEIQQYNIGTDLSRGIYDLLPKPAFDFSEVEELSHTAHEWYKEKKFRSIDGERLTGFPPSMPVYNY

SEQ ID NO: 42965 - DNA, 2073 bp, Antonospora locustae
  CDS (1)..(2073)
atggaagacagcaagagcagtgaaaacaaaaacctggcagatactaagaaaacaccagaaacacaccagcaggcaggtggaaataccccagtgatgaccaccgcacaggggataccaatcgcagacggacagaactctctacatccgtcaccatgcggccctactctcctcgaggatttcatataccgcgagaagatatttcactttgaccatgaacgcgttcccgagcgtgtagtccatgcccgtggctttggagcacatgggtacctggaaattcttgagccaattccccagtacacgaaggcagacatttttcagcgtacaggaagaacaccagcttttgtacgcttctccacagcgctgggcagcaagggctctcctgacctagccagagacgtgaggggctttgcagttaagatatacacaagaaagggaaactgggacattgtgggaaacaacatacccgttttctttgtccaggaggcaatcaagtttcccgacataatccatgcaggcaaggaagagcccgatagcggctttccacaggcacaaacagcacatgacagcttctgggacttcattagcctcaaccccgagtctctgcacatcacaatgtgggcaatgtcggacagagggattccgcgttccttccgattcatggagggctttggtgtccacacatttcgccttgtcaacgcaaaaaacgagtacacgtttgtaaagttccactggaagcccagactagggctgcagtccgtgacatggagcgaggcacagcggctcaacggcgcagacccggactttcatcggcgtgatttgtggaatgcaatcaaaacgggaaactatcccgagtgggacctaggtctccagatatttagcgaggagactgcaaagacatttgactttgatgtcttagatgcgacaaagctcattccagaagaacttgtgcctgtgagaagagtcgggcgccttgtcttggaccgctgtgtcgacaacttctttgcagagacagaacaggttgcattttgcacagcgaacatcgtgcccggcatcgacttcaccgacgaccctctgttgcagggaagaaacttctcgtatctggacacacaactgagccgcctgggcagtccaaacttcacccagctgccaataaacgcacccaagtgtcctgtgcgtcactttcaacaggacgggcgcatggccttttacaacatcattgggcctgcaaactacgagcccaactctttgggagacaagggcggtccgcgagagtcgcccgaagaggggtttgtgtcgtacccagcaaaggccacggggccaaagatgcgcgtgcgcccaagcagcttttcagaccactacagccaggccacgctgttctacaacagtcagacagatattgaacagaggcacatacagagcgcgttcacatttgagctgagcaaggtcaccagcccggccatacagatgcgtgtcatttcgcatctgctaaacatcaacgaggaccttgcaaaaaacattgctcacaacctaggcgtgagggagctgccaaagccagcgcccatgttggtgcccaaaaaggagggaataaaggaatcccctgcactgagcataataaaaaacggccctgtgacatttaagggaagaaggcttgggctgcttgtctccgaaaatagcgatttctcgctgattgatggtatagacacgcggatgaaaatggaggaggcagagcttgtagtgattgccccaaagatccagggcctccgcactgaaagcagtgggtggagaaagccttcacagtgtcttcagagcacacttgctgcctggtacgacgcagttgcattgcttttatcaacagcggacttgaagaaaatggacgggcctgcactggtcagctttgtccaagatagctactacaactacaagttcattgccttttcaggtgacgtggctcctctaatggaaagacttggtattcagaaggacgatggcatggttgaaataagggacaactgcgactgggatacgtttattacaaagtgcaggaagcttcgctactggcaaagaaaaatttga

SEQ ID NO: 42966 - protein, 690 aa, Antonospora locustae
MEDSKSSENKNLADTKKTPETHQQAGGNTPVMTTAQGIPIADGQNSLHPSPCGPTLLEDFIYREKIFHFDHERVPERVVHARGFGAHGYLEILEPIPQYTKADIFQRTGRTPAFVRFSTALGSKGSPDLARDVRGFAVKIYTRKGNWDIVGNNIPVFFVQEAIKFPDIIHAGKEEPDSGFPQAQTAHDSFWDFISLNPESLHITMWAMSDRGIPRSFRFMEGFGVHTFRLVNAKNEYTFVKFHWKPRLGLQSVTWSEAQRLNGADPDFHRRDLWNAIKTGNYPEWDLGLQIFSEETAKTFDFDVLDATKLIPEELVPVRRVGRLVLDRCVDNFFAETEQVAFCTANIVPGIDFTDDPLLQGRNFSYLDTQLSRLGSPNFTQLPINAPKCPVRHFQQDGRMAFYNIIGPANYEPNSLGDKGGPRESPEEGFVSYPAKATGPKMRVRPSSFSDHYSQATLFYNSQTDIEQRHIQSAFTFELSKVTSPAIQMRVISHLLNINEDLAKNIAHNLGVRELPKPAPMLVPKKEGIKESPALSIIKNGPVTFKGRRLGLLVSENSDFSLIDGIDTRMKMEEAELVVIAPKIQGLRTESSGWRKPSQCLQSTLAAWYDAVALLLSTADLKKMDGPALVSFVQDSYYNYKFIAFSGDVAPLMERLGIQKDDGMVEIRDNCDWDTFITKCRKLRYWQRKI

SEQ ID NO: 42967 - DNA, 1548 bp, Edwardsiella tarda
  CDS (1)..(1548): transl_table=11
atgcatatagtcaatggaatcaatggattaatcgcaaaaaagaatgtgttgtttttcttaacctccttagccatcagcccttccgtattggctgacaccttaacccgggataatggagcccccgtcggggataatcaaaactcacaaactgccggccctattggtccagtaatgctacaggatgtacagctattacaaaaactacagcgctttgatcgtgagcgtgttccagaacgcgtagtgcatgctcgcggtacaggcgctcacggtgtatttacgccaacggcggatatttcagatttaaccgttgcaaaagtatttacccccggtagtacaacgcctgtttttgtccgtttctcaagcgtggtgcatggaacccactcgccggaaaccctgcgcgatccgcgtggctttgcgacaaaattttatactgccgagggtaactgggacttggtaggcaataacttccccaccttctttattcgtgatgcaatcaagttcccggatatggtgcatgcgtttaagcccgatccccggacaaatcttgataatgatgcgcgacgctttgattttttctcacacctgcctgagtcaacgcggaccttgaccttgctctactctaacgagggtacgccgctatcctatcgcaatatggacggtaacagcgtacatgcctataagctgattaatgacaaaggcgaagtccactatgtgaagtttcactggaaaacgcgccaagggatcaagaatctggatccacagcaggttgaacagattcaaggtaaagattatagccatatgacgcaggatctggtgacggcaatcaaccgtggcgactatccaaaatgggatctgtacatccaggttctcaagcccgccgacctaaaaaacttcgatttcgatccgcttgatgccacgaaggtctggccagatgtgcctgagcgaaaaattggcgaaatggttcttaacaaaaaccctgataacgttttccaagagaccgagcaggtggcgatggcgccctcaaacctcatcccgggcattgaaccatcggaagataagctactgcaagggcgcctgttcgcctatgccgatacacaattttaccgtatcggcgccaatggacttagcctaccgataaacaagcctcatagcgcggtcaataatggcaaccaggatgggcaactcaacagtgggcatacgctagacaaaggggttaactaccagccaagccgtatttacccgcgggaagagttggtctccagccgttatagccagacgcccctgtcaggcaccacgcagcaaagtaaaatccagcgcgagcaaaatttcaaacaggcgggagagctttatcgctcgtacagtaaaaaagagcaaaatgacctcatcaatagcctgggaacctccctggctagcgctgacactgtcagtaaaaacattatgttatcctatttttataaagcggataaggactacggcactcgccttaccagcgtcgctaacggtgatttgccaacggtaaaaaacttggcggataagctccaagattaa

SEQ ID NO: 42968 - protein, 515 aa, Edwardsiella tarda
MHIVNGINGLIAKKNVLFFLTSLAISPSVLADTLTRDNGAPVGDNQNSQTAGPIGPVMLQDVQLLQKLQRFDRERVPERVVHARGTGAHGVFTPTADISDLTVAKVFTPGSTTPVFVRFSSVVHGTHSPETLRDPRGFATKFYTAEGNWDLVGNNFPTFFIRDAIKFPDMVHAFKPDPRTNLDNDARRFDFFSHLPESTRTLTLLYSNEGTPLSYRNMDGNSVHAYKLINDKGEVHYVKFHWKTRQGIKNLDPQQVEQIQGKDYSHMTQDLVTAINRGDYPKWDLYIQVLKPADLKNFDFDPLDATKVWPDVPERKIGEMVLNKNPDNVFQETEQVAMAPSNLIPGIEPSEDKLLQGRLFAYADTQFYRIGANGLSLPINKPHSAVNNGNQDGQLNSGHTLDKGVNYQPSRIYPREELVSSRYSQTPLSGTTQQSKIQREQNFKQAGELYRSYSKKEQNDLINSLGTSLASADTVSKNIMLSYFYKADKDYGTRLTSVANGDLPTVKNLADKLQD

SEQ ID NO: 42969 - DNA, 1479 bp, Homogyne alpina
  CDS (1)..(1479)
atggatccttacaagcagcggccggcaagcgcttacaactccccgtttttgaccacaaatgccggtttacctgtttacaacaatactgcatcattgactgtcggaaatagaggtccaattctgcttgaggactatcatttgattgagaaacttgccaattttactcgtgaacgaattccagaacgtattgtccatgcaagaggtgcaagtgcaaagggattcttcgaggtcacacatgacatcactcatctcacttgtgctgatttccttcgcgccccaggagttcaaactcctaccatcgttcgtttctctactgttatccatgaacgtggaagccccgaaactatcagagatccccgaggttttgcaacaaaattttatacccgagagggtaactttgatattgttggaaacaatttcccggtcttttttactcgtgatgcaatggcattccctgatgtgattcacgcgtttaaaccaaacccgaagtcacacatccaagaagactggagaattctcgacttcttatcacaccatcccgagagtttaaacacaatgacattctggcttgatgacatcggtatcccaacagattaccgacacatggaaggctcaagtgtcaacgctctaactctagtaaacaaagaagggaaaatgcactatgtgaaattcacatggaaaccaacttgtggagtcaaatgtttaatggacgaagaagcaatcaaaatcggaggagctaatcacagtcatgccacccaagatctttacgactcgattcaagctggtaatttccctgaatggaagttgtttcttcaagttattgatcctgatcatgaagatcggcttgactttgacccgcttgatgggacaatgacatggcctgatgacatcattcctttgcagcctgttggaaggatggttttgaataagaatatcgacaacttctttgctgagaatgaacagctggcgcttaacccgggccttgttgttcctgggatttattattctgatgataagatgctccaaggtcgaatctttgcgtattctgatactcagaggcaccgtcttggaccaaattaccttcagcttcctgttaatgcgcctaaatgtgctcatcgtaataatcactatgatggaaatatgaatttcatgcacagagatgaggaggttgattacttcccttcgaggtatgatcgtgttcagcatgctcagaagtacccgatcagtcctgctaaggttaccggaactcgtgataggactgttatcccgaaagctaatgatttcaagcagccgggagagagatacagatcatgggaaccagacaggcaagaacgattcattatccgaatggttaagatgttgtctgacccacgggtcacccatgagctccgcagtatttggatctcatactggacccaggctgaccagtctctggggcagaagatagcatcacgcctcaatgtgcgccccaactattga

SEQ ID NO: 42970 - protein, 492 aa, Homogyne alpina
MDPYKQRPASAYNSPFLTTNAGLPVYNNTASLTVGNRGPILLEDYHLIEKLANFTRERIPERIVHARGASAKGFFEVTHDITHLTCADFLRAPGVQTPTIVRFSTVIHERGSPETIRDPRGFATKFYTREGNFDIVGNNFPVFFTRDAMAFPDVIHAFKPNPKSHIQEDWRILDFLSHHPESLNTMTFWLDDIGIPTDYRHMEGSSVNALTLVNKEGKMHYVKFTWKPTCGVKCLMDEEAIKIGGANHSHATQDLYDSIQAGNFPEWKLFLQVIDPDHEDRLDFDPLDGTMTWPDDIIPLQPVGRMVLNKNIDNFFAENEQLALNPGLVVPGIYYSDDKMLQGRIFAYSDTQRHRLGPNYLQLPVNAPKCAHRNNHYDGNMNFMHRDEEVDYFPSRYDRVQHAQKYPISPAKVTGTRDRTVIPKANDFKQPGERYRSWEPDRQERFIIRMVKMLSDPRVTHELRSIWISYWTQADQSLGQKIASRLNVRPNY

SEQ ID NO: 42971 - DNA, 1479 bp, Acacia ampliceps
  CDS (1)..(1479)
atggatccttacaagtaccgaccatcaagtaccttcaatactccgttctggactaccaactccggtactccagtttataacaacgattcagctctcaccatcggatctagaggtccaattctgctagaggattaccacttggtggagaagattgcaaatttcaccagggaacgaaccccagaacgtgttgtgcatgcaaggggagctagtgctaagggtttcttcgaagtcacacatgatatcactcacctcacttgtgctgattttcttcgaggccctggagttcaaacccccgtcattgttcgtttctccactgttatccatgaacgtggtagccctgaaaccattagagaccctcgtggtttcgctgtcaagttttacaccagagagggtaacttcgatctagttggaaacaactttcctgtcttcttcatccgtgatggaatgaagtttccagatgtgattcatgctttcaaaccaaaccccaagtctcatatccaagagtactggagggtgcttgacttctgttcctatcttccagaaagccttcacacattcatgttcttatttgatgatgtgggtgtcccacaagattacagacacatggaaggttctagtgttaacacatatactttgatcaacaaagctggcaaagtacactatgtcaaatttcactggaaacctaccttgggtgtcaagtgtctgttggaggaagaagccattcgggtcggaggagccaaccatagtcatgcaactcaagatctttatgattcaattgcagccggaaactatcctgagtggaaactctacatccaaaccattgatcctgattttgaagacagatttgactttgacccacttgatggaaccaagacctggccagaggacctcgtacctctccaaccagttggtcgcttggtcttgaataggaacatcgacaacttctttgctgagaatgagcaacttgcattttcaccttcccttgttgtgcctggtatatacttctctgatgataaggtgctccaagctcgtatctttgcctatggtgatactcagcggcatagaattggaccaaactatctgcaacttcctgtaaatgctcctaagtgtgctcatcacaacaatcactatgacggaaccatgaacttcatgcacagggatgaggaggtcgattacttcccatcaaggtatgacacggctcgccatgcagagaagttcccaattcctcctgttaatctcatcggaaggcgtgataggcgcataattgagaaggagaacaacttcaagcaacccggggatctataccgaacctgggcacctgacaggcaagaaagatttatccgaagatggattggagttttatcagacccaaaggtcacccatgaggtccgcagcatctggatatcttacttgtctcaggctgatcgctctctgggtcagaaggtagcatcccatctgaacatgaggccaagtatctaa

SEQ ID NO: 42972 - protein, 492 aa, Acacia ampliceps
MDPYKYRPSSTFNTPFWTTNSGTPVYNNDSALTIGSRGPILLEDYHLVEKIANFTRERTPERVVHARGASAKGFFEVTHDITHLTCADFLRGPGVQTPVIVRFSTVIHERGSPETIRDPRGFAVKFYTREGNFDLVGNNFPVFFIRDGMKFPDVIHAFKPNPKSHIQEYWRVLDFCSYLPESLHTFMFLFDDVGVPQDYRHMEGSSVNTYTLINKAGKVHYVKFHWKPTLGVKCLLEEEAIRVGGANHSHATQDLYDSIAAGNYPEWKLYIQTIDPDFEDRFDFDPLDGTKTWPEDLVPLQPVGRLVLNRNIDNFFAENEQLAFSPSLVVPGIYFSDDKVLQARIFAYGDTQRHRIGPNYLQLPVNAPKCAHHNNHYDGTMNFMHRDEEVDYFPSRYDTARHAEKFPIPPVNLIGRRDRRIIEKENNFKQPGDLYRTWAPDRQERFIRRWIGVLSDPKVTHEVRSIWISYLSQADRSLGQKVASHLNMRPSI

SEQ ID NO: 42973 - DNA, 1479 bp, Prunus persica
  CDS (1)..(1479)
atggatccttacaagcaccgcccttcaagtgcttttgattccccatactggaccacaaacgccggtgctccagtttggaacaacgactcttctttgactgttggacctagaggtccagttctccttgaggactatcatctggtggagaaacttgccacctttgatagagaacgaatcccagagcgtgttgtccatgctaggggagccagtgcaaagggattctttgaggtcactcatgatatttctcagcttacttgtgctgacttccttcgagcccctggtgttcagacacctgtcattgtgcgtttctccactgttatccatgagcgtggcagccctgaaaccctgagggatcctcgtggttttgcagtgaagttttacaccagagagggtaattttgacctggttggaaacaatttccccgtcttttttgtccgtgatgcaatgaaattcccggacgcgatccgtgctttcaaaccgaaccccaagtcgcacatccaagagacttggaggatccttgacttcttctcccaccttccagaaagcctgcacacgttcgccttcttttatgatgatctgggagttccacaagattacaggcacatggaaggctctagtgttcacgcctataccctcatcagtaaggcagggaaagtacactatgtgaaatttcattggaaacctacttgtggagtcaagtgtttgttggaggatgaagctattaaggttggaggagctaatcacagccatgctaccaaggacctctatgattccattgcagctggcaactaccctgagtggaaactttatattcagacaatggatcctgatcacgaggacagatttgactttgaccctcttgacttaactaagacctggcctgaagatatccttcccctgcagccagttggccgtttggttctgaataaaaacatcgataacttctttgcagagaatgaacaacttgcgtttaaccctgcccatgttgtccctggtatctactattcagatgataaggtgctccaaactcgaatcttcgcatattctgatactcagaggcaccgtcttggcccgaactatctgcagctcccagtgaatgctcccaagtgtcctcatcataacaatcatcatgagggattcatgaatttcatgcacagggatgaggaggttaattacttcccttcaaggcatgatcctgttcgtcatgctgagcgctaccccattccttctaatatcctttctggaaagcgtgagaagtgcgtcattgagaaggagaacaactttaagcaacctggagagagatacagatcttgggcgccagacaggcaagagcgattcatccgccgatgggtggatgccctatcagaccctcgtgtcacccatgagattcgcagcatttggatctcatactggtctcaggcagataagtctctgggtcaaaagcttttatcccgtctcaatgtgaggccaagcatttga

SEQ ID NO: 42974 - protein, 492 aa, Prunus persica
MDPYKHRPSSAFDSPYWTTNAGAPVWNNDSSLTVGPRGPVLLEDYHLVEKLATFDRERIPERVVHARGASAKGFFEVTHDISQLTCADFLRAPGVQTPVIVRFSTVIHERGSPETLRDPRGFAVKFYTREGNFDLVGNNFPVFFVRDAMKFPDAIRAFKPNPKSHIQETWRILDFFSHLPESLHTFAFFYDDLGVPQDYRHMEGSSVHAYTLISKAGKVHYVKFHWKPTCGVKCLLEDEAIKVGGANHSHATKDLYDSIAAGNYPEWKLYIQTMDPDHEDRFDFDPLDLTKTWPEDILPLQPVGRLVLNKNIDNFFAENEQLAFNPAHVVPGIYYSDDKVLQTRIFAYSDTQRHRLGPNYLQLPVNAPKCPHHNNHHEGFMNFMHRDEEVNYFPSRHDPVRHAERYPIPSNILSGKREKCVIEKENNFKQPGERYRSWAPDRQERFIRRWVDALSDPRVTHEIRSIWISYWSQADKSLGQKLLSRLNVRPSI

SEQ ID NO: 42975 - DNA, 1479 bp, Prunus persica
  CDS (1)..(1479)
atggatccatacaagtaccgcccttcaagtgcttttgattccccattctggaccacaaactccggtgctcctgtttggaacaacaactcttctttgactgttggatctagaggcccaattctccttgaggactatcatctggtggagaaacttgccaactttgatagagaacgaatcccagagcgtgttgtccatgctaggggagccagtgcgaagggattctttgaggtcactcatgatatttctcagcttacatgtgccgacttccttcgagcccccggtgttcagacacctgtcattgtgcgtttctccactgttatccatgagcgtggcagccctgaaaccctgagggatcctcgtggttttgcagtgaagttttacaccagagagggtaattttgacctggttggaaacaatttccctgtcttttttgttcgtgatggaatgaaattcccggacatggtccatgctctcaaaccgaaccccaagtcgcacattcaagagccttggaggatccttgacttcttctcccaccacccagaaagcctgcacatgttcaccttcctatttgatgatctgggagttccacaagattacaggcacatggaaggctctggtgttaacacctatacccttatcaataaggcggggaaagcacagtatgtgaaatttcattggaaacctacgtgtggagtcaagtgtttgttggaggatgaagctattaaggttggaggagctaatcacagccatgctaccaaggatctctatgattccattgcagctggcaactaccctgagtggaaactttatattcagacaattgatcctgatcatgaggacagatttgactttgacccacttgatgtaactaagacctggcctgaagatattcttcctctgcagccagttggccgtctggttctgaataaaaacattgataacttctttgcagagaatgaacaacttgcattttgccctgccattgttgtccctggtgtctactattcagatgataagttgctccaaactcgaatcttctcctattctgatactcagaggcaccgtcttggcccgaactatctgcagctcccagtgaatgctcccaagtgttctcatcataacaatcatcatgagggattcatgaatttcatgcacagggatgaggaggttaattacttcccttcaaggtatgatcctgttcgtcatgctgagcgcttccccattcctcctaatatcctttctggaaagcgtgagaagtgcatcattgagaaggagaacaactttaagcaacctggagagagatacagatcttgggcgccagaccggcaagagcgattcatccaccgatgggtggatgccctatcagacccacgtgtcacccatgagattcgcagcgtttggatctcatactggtctcaggcagataagtctctgggtcaaaagctcgcatcccgtctcaatgtgaggcccagcatttga

SEQ ID NO: 42976 - protein, 492 aa, Prunus persica
MDPYKYRPSSAFDSPFWTTNSGAPVWNNNSSLTVGSRGPILLEDYHLVEKLANFDRERIPERVVHARGASAKGFFEVTHDISQLTCADFLRAPGVQTPVIVRFSTVIHERGSPETLRDPRGFAVKFYTREGNFDLVGNNFPVFFVRDGMKFPDMVHALKPNPKSHIQEPWRILDFFSHHPESLHMFTFLFDDLGVPQDYRHMEGSGVNTYTLINKAGKAQYVKFHWKPTCGVKCLLEDEAIKVGGANHSHATKDLYDSIAAGNYPEWKLYIQTIDPDHEDRFDFDPLDVTKTWPEDILPLQPVGRLVLNKNIDNFFAENEQLAFCPAIVVPGVYYSDDKLLQTRIFSYSDTQRHRLGPNYLQLPVNAPKCSHHNNHHEGFMNFMHRDEEVNYFPSRYDPVRHAERFPIPPNILSGKREKCIIEKENNFKQPGERYRSWAPDRQERFIHRWVDALSDPRVTHEIRSVWISYWSQADKSLGQKLASRLNVRPSI

SEQ ID NO: 42977 - DNA, 1587 bp, Melopsittacus undulatus
  CDS (1)..(1587)
atggctgacaaccgggacgacgcctcggaccagctgaagcagtggcggagccagcgaggctcgcagaaaccagatgtcttgaccactggtgctgggaaccctgtaggggataagctgaatatcctgacagtagggccacgtggtcctcttcttgttcaagatgttgttttcactgatgagatggctcattttgacagagagaggattcctgaaagagtcgtgcatgcaaagggagcaggagcctttggttattttgaagttactcatgatattacccagtattgcaaggcaaaagtgtttgaacacattggaaaaagaactccgattgctatccgattctccactgttgctggagaatctgggtcagctgacacagttcgggaccctcgaggctttgcaatgaaattctacacagaagagggtaactgggatcttgtaggaaataatactcccatcttctttattcgggacgcaatgctgtttccatccttcatccatagccaaaagaggaaccctcagactcatttgaaggatccagacatggtgtgggacttctggagtcttcgccctgagtttttgcatcaagtgtctttcttgttcagtgaccgtggtattccggatggttatcgccatatgaatggatatggatcgcatacttttaaactggtgaatgctagtggaagagcagtttactgcaaattccatgcgaagacagatcagggcatcaaaaatcttcctgttgaagaagcaggaaggctggcttctactgatcctgattatggaatacgtgatctttacaatgccattgccaaaggggactatccgtcatggtctttcttcattcaagttatgacatttgaagaagcagagaaatttccatttaatccttttgatttaactaagatctggccacatggtgactaccccctcatccctgtgggaaagcttgtcttgaacaggaatcctgtcaattactttgcagaggtagaacagatggcatttgatcctagcaacatgccacctggtattgaacctagccctgacaaaatgctgcagggtcgtctcttttcgtatcctgacactcatagacaccgtctgggacccaactatctacaaattcctgtgaactgccccttcagaactcgtgtggccaattaccagagggatggaccgatgtgcgtttctgacaaccaaggtggtgccccaaactattacccaaacagttttactggtccagaagatcagcctgtgtggaaggagtcccgcatgtctatttcgggagatgtgcagcgcttcaacagtgccaatgaagataatgtgactcaggtgcgagacttctataccaaagtgctgaaagaggatgaacgccaaaggctgtgcaaaaacattgctgatcatcttaaggatgcacaactcttcattcagaagagagctgtgaaaaacttcactgatgttcatcctgactatggtgctcgtattcaggctttgctggacaagtacaatgctgacagtgggaagaaggatgtaatcaggacatacacacagtccacatctcgtatgtctgccaaagagagatccaacttgtaa

SEQ ID NO: 42978 - protein, 528 aa, Melopsittacus undulatus
MADNRDDASDQLKQWRSQRGSQKPDVLTTGAGNPVGDKLNILTVGPRGPLLVQDVVFTDEMAHFDRERIPERVVHAKGAGAFGYFEVTHDITQYCKAKVFEHIGKRTPIAIRFSTVAGESGSADTVRDPRGFAMKFYTEEGNWDLVGNNTPIFFIRDAMLFPSFIHSQKRNPQTHLKDPDMVWDFWSLRPEFLHQVSFLFSDRGIPDGYRHMNGYGSHTFKLVNASGRAVYCKFHAKTDQGIKNLPVEEAGRLASTDPDYGIRDLYNAIAKGDYPSWSFFIQVMTFEEAEKFPFNPFDLTKIWPHGDYPLIPVGKLVLNRNPVNYFAEVEQMAFDPSNMPPGIEPSPDKMLQGRLFSYPDTHRHRLGPNYLQIPVNCPFRTRVANYQRDGPMCVSDNQGGAPNYYPNSFTGPEDQPVWKESRMSISGDVQRFNSANEDNVTQVRDFYTKVLKEDERQRLCKNIADHLKDAQLFIQKRAVKNFTDVHPDYGARIQALLDKYNADSGKKDVIRTYTQSTSRMSAKERSNL

SEQ ID NO: 42979 - DNA, 1521 bp, Acinetobacter calcoaceticus
  CDS (1)..(1521): transl_table=11
atgaatgacgatactaaaaaatgtcctttttcccaacttactactgattttggggctccagttgtagacaaccagaatagtatgacggcaggtgcaagaggacctctacttgctcaagacctatggctaaatgagaaactagctaactttgttcgtgaagtaattccagaacgtcgtatgcatgcaaaaggttcaggtgcattcggtactttcacagtgactcatgatattactcaatatacccgcgctaaaatatttagcgaaattggtaaaaaaacggaaatgtttgcccgatttaccacagtagctggtgaacgtggagcagcagatgctgaacgagatattcgcggctttgctttaaaattttatacagaagaaggtaactgggacatggtgggtaacaatacaccagtgttcttcttacgtgatccacgtaaatttccagatttaaataaagcagtaaaacgcgatccaaaaactaacttgcgtagcgcaacgaataactgggatttctggactttattacctgaagctttacatcaagtcactattgtcatgtctgatcgtggtattcctgcctcttaccgtcatatgcacggttttagtagccatacttatagtttcatcaatagtgtgaatgaacgtttctgggtgaaatttcatttccggacccaacagggaattaaaaacttaacagatgctgaagctggtgaattagtggggcatgatcgcgaaagtcatcaacgtgatttattcgatgcgattgaacgaaaagattttcctaagtggactttgtatgtacaagttatgcctgagcaagatgctgaaaaggttccatatcatccatttgatttaacaaaagtctggcctcatggagattatccgttaattgaggttggtgagtttgagttgaatcggaaccctgaaaacttcttcttagatgttgaacaatctgcttttgcgccaagtaatctcgttccaggtattagtgcttcaccagaccgcatgttgcaagcccgtttatttaactatgcggatgctcagcgttatcgtttaggtgtgaattatcagcaaatacctgtaaatgcagcacgttgtccagttcatagtaatcaccgtgacggtcaaggacgcattgatgccaattatggtggacttccacattacgagccaaatagttttggacaatggcaagagcagcctcagtacaaagaaccaccgttaaaaatcaatggagatgctgatttctggaattatcgtgaagatgacaacgattatttcagtcaacctcgtgctttgtttgaacttatgactcctgagcaacaacaggctttatttgataatactgaacgcgcaatgggtgatgctcttgatttcattaaatatcgccacattcgtaactgctatgcatgtcatccagcttatggcgaaggtgtggctaaggcgcttggtttgacagttgaaaatgctcaagcagctagagaaactgaccctgcacgtggtttaccaagttttatttaa

SEQ ID NO: 42980 - protein, 506 aa, Acinetobacter calcoaceticus
MNDDTKKCPFSQLTTDFGAPVVDNQNSMTAGARGPLLAQDLWLNEKLANFVREVIPERRMHAKGSGAFGTFTVTHDITQYTRAKIFSEIGKKTEMFARFTTVAGERGAADAERDIRGFALKFYTEEGNWDMVGNNTPVFFLRDPRKFPDLNKAVKRDPKTNLRSATNNWDFWTLLPEALHQVTIVMSDRGIPASYRHMHGFSSHTYSFINSVNERFWVKFHFRTQQGIKNLTDAEAGELVGHDRESHQRDLFDAIERKDFPKWTLYVQVMPEQDAEKVPYHPFDLTKVWPHGDYPLIEVGEFELNRNPENFFLDVEQSAFAPSNLVPGISASPDRMLQARLFNYADAQRYRLGVNYQQIPVNAARCPVHSNHRDGQGRIDANYGGLPHYEPNSFGQWQEQPQYKEPPLKINGDADFWNYREDDNDYFSQPRALFELMTPEQQQALFDNTERAMGDALDFIKYRHIRNCYACHPAYGEGVAKALGLTVENAQAARETDPARGLPSFI

SEQ ID NO: 42981 - DNA, 1479 bp, Hypericum perforatum
  CDS (1)..(1479)
atggatccgtacaagtaccggccgtcgagcgccttcaactcaccgttttggacgaccaactcgggtgctcccgtctacagcaacgaccactccctcaccgttggatctcgaggtcctatcctcctggaggactatcaccttgtggaaaagcttgccaactttgacagggagaggattcctgagcgtgtcgttcatgccagaggagcaagtgcaaagggattctttgaagtcacccatgatatctctcatctcagctgtgctgattttctgcgagcccctggagttcagacccctgtcattgttcgattctccactgtcatccatgaacgcggaagccccgagaccttgagagatcctcgtggttttgctgtcaagttctatacccgagagggtaactttgatcttgtggggaacaacttccctgtgttcttcattcgtgatggaatgaagttccctgacatggtgcatgccctgaagcccaaccccaagtcccacattcaggaggattggaggatccttgatttcttctctcaccatcctgaaagtttgcacatgttctccttcctctttgatgatattggcattcctcaagactacaggcacatggaaggctccggtgttaacacatacactctagtcaacaaggctggcaaagtccattacgtgaagttccactggaagcctacttgtggtgtgaagagtttgctagaggatgaagcaattaaagttggaggatctaatcacagccatgctacaaaagatctgtatgactcgattgctgctggtaactatccggaatggaagctcttcatccagacgattgatcctgatcatgaggataggtttgactttgaccctcttgatgtgaccaagacatggccggaagacattttgcctcttcagcctgttggccgcttggtcctgaacaagaacatcgacaacttctttgctgagaatgagcagcttgcattctgccctgccattgttgttcctggcatctactactcagacgataagcttcttcagactcgaatcttctcttactcggacactcagagacaccgtcttgggcccaactatcttcagctccctgtcaatgctcccaagtctgcccatcataacaaccatcatgaaggtttcatgaacttcatgcacagggatgaagaggttaattacttcccttcaaggtatgacccagttcgccatgctgagaaatatccaattcctcctgttgttctcaatggaagacgtgagaagtgcatgattgcgaaagagaacaactttaagcagcctggagagaggtaccggtcgttttcgccagacaggcaagaacgcttcctcaacagatggattagctcgctgtctgacccccgtgtcacccatgaaatcagagccatctgggtcacctactggtaccaggctgacaaatctcttggtcagaagctcgcgtctcgtctcaatgtcaggccaaacatgtga

SEQ ID NO: 42982 - protein, 492 aa, Hypericum perforatum
MDPYKYRPSSAFNSPFWTTNSGAPVYSNDHSLTVGSRGPILLEDYHLVEKLANFDRERIPERVVHARGASAKGFFEVTHDISHLSCADFLRAPGVQTPVIVRFSTVIHERGSPETLRDPRGFAVKFYTREGNFDLVGNNFPVFFIRDGMKFPDMVHALKPNPKSHIQEDWRILDFFSHHPESLHMFSFLFDDIGIPQDYRHMEGSGVNTYTLVNKAGKVHYVKFHWKPTCGVKSLLEDEAIKVGGSNHSHATKDLYDSIAAGNYPEWKLFIQTIDPDHEDRFDFDPLDVTKTWPEDILPLQPVGRLVLNKNIDNFFAENEQLAFCPAIVVPGIYYSDDKLLQTRIFSYSDTQRHRLGPNYLQLPVNAPKSAHHNNHHEGFMNFMHRDEEVNYFPSRYDPVRHAEKYPIPPVVLNGRREKCMIAKENNFKQPGERYRSFSPDRQERFLNRWISSLSDPRVTHEIRAIWVTYWYQADKSLGQKLASRLNVRPNM

SEQ ID NO: 42983 - DNA, 1491 bp, Dictyostelium discoideum
  CDS (1)..(1491)
atgtcagctccagttttaaccaccagtagtggttcaccaattgataacaatttaaactcaatgaccgcaggtgttaatggtccaattttaattcaagatttcactttaattgataaacttgctcatttcgatcgtgaacgtatcccagaacgtgttgtacatgctaaaggtgctggtgcccatggttatttcgaagttccctcaagtgatgtaccaaaatggtgtaaagctaaattcttaaataaagttggtaagagaacaccaatcttcacccgtttctctactgttggtggtgaaaaaggttcatccgattctgaaagagatccaagaggtttcgctgtcaaattttatactgaagaaggtaactttgatatggtcggtaataatactccagttttctttattcgtgatccatcaaaattcccagatttcattcatacacaaaaacgtaatccacaaacaaattgtaaagatccaaatatgttttgggattttttaggtcaaacaccagaatcaacacatcaagtatcaattttattctctgatagaggtacaccaaaatcatatcgtcatatgcatggtttctcatcacataccttaaaatttgttaatgctcaaggtaaaccatattgggttaaattacatttcaccagtgaaactggtattcaaaattacacagctgaagaagctgccaagatgtcaatgaacgatccagattcagcaactcgtgatctctttgaaaccatcgccaaaggtggtgaaccagcttggaaagtttccattcaattgatggaatttgaagatgccttaaagtatcgtttcaatccattcgatgtaacaaagatttggtcacacaaagactatccattaattcaaattggtcgtatggttttgaatcgtaatccagagaattactttgctgaagttgaacaagctgccttctcaccatcccacatggttccaggtattgaaccatcaccagataagatgttacaaggtcgtctcttctcttatccagatactcatcgtcatcgtttaggtgtaaactatcaacaaatcccagtcaattgtccattcgccgtaaagggtggtgttaaaaactaccaacgtgatggtttcatggctgtcaatggtaatggtggtaaaggtccaaactatcaaccaaactctttcggtggtccagagccacatccagaatttgctcaacataaatttgacgtctctggtttcgctgctcgtcaaccatacaatcatccaaatgacgactttgttcaaccaggtgatttatatagactcatgtctgaagatgccaaatctcgtttcgtctctaatttagtcggtcacatgtccggtgtcaccatcaaagaaattcaagttcgtgccgtttcaaacttttacaaggctgacaaagatttaggtgctcgtttatgtaagggtcttggtattgatgttaatgatgtcatcaaattcgctgctagatcaaacttgtaa

SEQ ID NO: 42984 - protein, 496 aa, Dictyostelium discoideum
MSAPVLTTSSGSPIDNNLNSMTAGVNGPILIQDFTLIDKLAHFDRERIPERVVHAKGAGAHGYFEVPSSDVPKWCKAKFLNKVGKRTPIFTRFSTVGGEKGSSDSERDPRGFAVKFYTEEGNFDMVGNNTPVFFIRDPSKFPDFIHTQKRNPQTNCKDPNMFWDFLGQTPESTHQVSILFSDRGTPKSYRHMHGFSSHTLKFVNAQGKPYWVKLHFTSETGIQNYTAEEAAKMSMNDPDSATRDLFETIAKGGEPAWKVSIQLMEFEDALKYRFNPFDVTKIWSHKDYPLIQIGRMVLNRNPENYFAEVEQAAFSPSHMVPGIEPSPDKMLQGRLFSYPDTHRHRLGVNYQQIPVNCPFAVKGGVKNYQRDGFMAVNGNGGKGPNYQPNSFGGPEPHPEFAQHKFDVSGFAARQPYNHPNDDFVQPGDLYRLMSEDAKSRFVSNLVGHMSGVTIKEIQVRAVSNFYKADKDLGARLCKGLGIDVNDVIKFAARSNL

SEQ ID NO: 42985 - DNA, 2244 bp, Aspergillus oryzae
  CDS (1)..(2244)
atggccaatattgtggctgggggcctccacaaggttcaagaagcagtgcagggcgctgcttccaaggataagaagctagttgacctagcacccgacacccataatgtacagtccagcaaggagccactgaccaccgaccatggtgtgcgtatcagcgatacggaccactggctgaaggaggtgaatgacaaccacaccggtcctatgatgcttgaggaccagattgcacgagagaagattcatcgtttcgatcatgagcgcattcccgagagagtcgtccatgcgcgtggcaccgctgcattcggaaacttcaagctccatgagagcgctgaagatgtatcctacgctggtatcttgacggatacctcaaggaacactccggttttccttcgtttctccacggtccagggcagtaaaggaagtgccgacaccgtccgtgacgttcgtgggtttgccgtgaaattctacaccgacgaaggaaattgggatctggttggaaacaacatccccgttttctttatccaagatgcgattaagttcccggattttgtccatgctgttaagcccgagccgcacaacgaggtaccacaggcccaaactgctcacaacaacttctgggactttgtctatcttcacccggaagccacccatatgttcatgtgggccatgtctgatcgggccattcctcggtcataccgtatgatgcagggtttcggtgtcaacacattcagtctcatcaacaaggaaggaaagcgccattttgtcaagttccatttcatcccccacctgggagtgcactctttggtgtgggacgaggctctgaaactggctggccaggaccccgatttccatcgcaaggatctcatggaggccattgataacggcgcatacccgaaatgggacttcgccatccaggtcatccctgaggagaaacaggatgacttcgaatttgacattttcgacgcgacgaagatctggcccgaggagctcgtgcctctgcgcgtgatcggcgaactggaactgaaccgcaacgtcgacgagttcttccctcaaaccgagcaagtcgccttctgcaccagccacatcgtccccggcattgacttcagtgacgacccgcttctccagggccgtaacttctcctacttcgacactcagatcagtcgactgggcatcaactgggaagaaatccccatcaaccgccccgtctgccccgttctgaaccacaaccgagacggcgccaaacgccaccgcatcgcccagggcactgtcactacttggtcgaaccggtccgaggccggaccacccgcaccagtagaacatggtggcttcgcgtcctaccctgcgaaactgaacggtatcaagaagcgcggcctgagccccaagttccgcgagcaccacaaccaggctcaactcttctacaactctctctccgagcacgagaaggtccacgtcaagaaggccttcggcttcgaactggaccactgcgacgaccccatcgtctacgagcgcctcgccggccaccgtctcgccgagatcgatctcactctcgcccaggaagtcgccgagctcgtcggcgccccgatcccagacaaggcacttcgcccgaaccatggaaagcgcagcaagcatctttcgcagaccgagttcccgggtaagcagccgacgatcgccagtcgccgaatcgccatcattatcggcgacggatacgaccccgtcgctttcaatggcctcaagggcgccatcacggcggttggagccttaccgttcgtcattggcaccaagcggtcacctatctacgccgacggtgaggacaaatcatcttccaagggcgtgatcgccgaccaccagtatgacggacagcgttcgacgatgtttgacgctaccttcatccctggcggtccgcacgtcgaaagcctcaaggccaatggccagatccggtactggatcattgagacattcggtcatctcaaggctctgggcgccactggtgaagcggcggctttcatcaaggaagccctgggctccgcgcttgatgtgaaggtcgctacgtctgataacccccagccggttgagtggtatggtgttgtcacggctggaaagatccacaaacctgagagcttcaaggagggtatccagattgtcaaggatgcgaaggatttcattagcaccttcttctaccagatcagtcagcatcggaactacaagcgtgaactggatggcctcgcctcgacagttgcattctaa

SEQ ID NO: 42986 - protein, 747 aa, Aspergillus oryzae
MANIVAGGLHKVQEAVQGAASKDKKLVDLAPDTHNVQSSKEPLTTDHGVRISDTDHWLKEVNDNHTGPMMLEDQIAREKIHRFDHERIPERVVHARGTAAFGNFKLHESAEDVSYAGILTDTSRNTPVFLRFSTVQGSKGSADTVRDVRGFAVKFYTDEGNWDLVGNNIPVFFIQDAIKFPDFVHAVKPEPHNEVPQAQTAHNNFWDFVYLHPEATHMFMWAMSDRAIPRSYRMMQGFGVNTFSLINKEGKRHFVKFHFIPHLGVHSLVWDEALKLAGQDPDFHRKDLMEAIDNGAYPKWDFAIQVIPEEKQDDFEFDIFDATKIWPEELVPLRVIGELELNRNVDEFFPQTEQVAFCTSHIVPGIDFSDDPLLQGRNFSYFDTQISRLGINWEEIPINRPVCPVLNHNRDGAKRHRIAQGTVTTWSNRSEAGPPAPVEHGGFASYPAKLNGIKKRGLSPKFREHHNQAQLFYNSLSEHEKVHVKKAFGFELDHCDDPIVYERLAGHRLAEIDLTLAQEVAELVGAPIPDKALRPNHGKRSKHLSQTEFPGKQPTIASRRIAIIIGDGYDPVAFNGLKGAITAVGALPFVIGTKRSPIYADGEDKSSSKGVIADHQYDGQRSTMFDATFIPGGPHVESLKANGQIRYWIIETFGHLKALGATGEAAAFIKEALGSALDVKVATSDNPQPVEWYGVVTAGKIHKPESFKEGIQIVKDAKDFISTFFYQISQHRNYKRELDGLASTVAF

SEQ ID NO: 42987 - DNA, 2178 bp, Aspergillus oryzae
  CDS (1)..(2178)
atgcgcgccctctcccttgccagcctcattggcattgctagtgcggcgtgtccgtacatgaccggtgagcttgaacgtcgcgacacaggaaccgacgatgccaccgccgcgacagaggaattcttgtcccagtactatatggccgacaatgacacattcctgacctccgacgtgggcggccctattgaggatcagaacagccttcaagtcggagaccgcggcccgacattgctggaggatttcatcttccgacagaagatccagcgcttcgatcacgaacgtgttcctgaacgtgcagtccacgctcgcggtgttggtgcccatggtgtcttcacctcgtacggtgactactctaacatcactgctgcctcgttccttggagctgagggcaaggagactccggttttcgtgcgattctcgactgttgcgggtagccgtggtagttcggatttggctcgcgatgttcatggctttgcgactcgtttctacactgatgagggtaacttcgatattgttggcaacaacattcccgtcttcttcatccaggacgctattcttttccctgatctcatccacgctgtcaagcctcgtggtgacaatgagatccctcaggctgccactgcccatgactctgcttgggacttcttcagccagcagcccagttccctgcacaccctgctctgggccatgtccggccatggtatcccgcgctctcttcgccacgtcgatggctttggtatccacaccttccgcttcgtcactgacaacggtgactccaagctcgtcaagttccactggaagtccctgcagggtaaggccagcatggtctgggaagaagcgcagcaggtctctggcaagaaccccgacttcatgcgccaggatctcttcgaagcgatcgaggcgggcagataccctgagtgggagctcggtgttcaaatcatggatgaggaagaccagctgaagtttggcttcgatctgtttgatcccaccaagatcgtccccgaggaatacgtgccaatcaccaagctgggcaagatgactctcaaccgcaaccctcgcaactactttgccgagactgagcaggtcatgttccaacctggccacatcgtccgtggtgttgacttcaccgaggatcctcttctccagggccgtctcttttcgtacctcgacacccagttgaaccgtcacggcggacccaacttcgagcagctgcccatcaatcagcctcgcgtgcctgtgcacaacaacaaccgcgatggagccggccagatgttcatccccctgaaccccaacgcctactctccgaacaccctcaacaagggctctcctaagcaggccaaccagactgtgggcaagggcttcttcacggctcctggacgcgagtctactggccgtttcacccgtgccgtcagcccgtccttcgaggacgtctggtcgcagccgcgtctgttctacaactcacttactcccgccgaacagcagttcgtcgtcgatgctattcgttttgagaactccaacgtcaagagctcggtcgtacgcaacaatgtcatcatccagctgaaccgcgtgtccaacgacctcgcccgccgcgtcgctcgcgctatcggcgttgaggagcctgaggctgacccgacctactaccacaacaacaagaccactgacgttggcactttcggacagaagctgaagaagctcgatggactgaaggttggcttcctggcttcggttgagacccctgcctccatcgaggcagcctctgagctcagcaagcagctttctgaggacggcgttgatgttgtcgtcgttgcggagcgtctgtccgatggcgttgatcagacttactccggatcggatgccatccagttcgatgctgtgatcgtcgcgcccggcgctgagggtcttttctctactttctccttcactgcgcctagcaatgccacctcctcgtccactctgttcccggccggccggcccctgcagattgtcatcgatggattccgtttcggaaagcctgttggtgccgtcggcagcgccgctactgcgctcaagaacgccggtatccagacttctcgcgacggtgtgtacgtcgacaagtcggtgactagtggattcgtcgatggtatcaaggacggtcttcgcactttcaagttccttgaccgtttcaagctggaccattaa

SEQ ID NO: 42988 - protein, 725 aa, Aspergillus oryzae
MRALSLASLIGIASAACPYMTGELERRDTGTDDATAATEEFLSQYYMADNDTFLTSDVGGPIEDQNSLQVGDRGPTLLEDFIFRQKIQRFDHERVPERAVHARGVGAHGVFTSYGDYSNITAASFLGAEGKETPVFVRFSTVAGSRGSSDLARDVHGFATRFYTDEGNFDIVGNNIPVFFIQDAILFPDLIHAVKPRGDNEIPQAATAHDSAWDFFSQQPSSLHTLLWAMSGHGIPRSLRHVDGFGIHTFRFVTDNGDSKLVKFHWKSLQGKASMVWEEAQQVSGKNPDFMRQDLFEAIEAGRYPEWELGVQIMDEEDQLKFGFDLFDPTKIVPEEYVPITKLGKMTLNRNPRNYFAETEQVMFQPGHIVRGVDFTEDPLLQGRLFSYLDTQLNRHGGPNFEQLPINQPRVPVHNNNRDGAGQMFIPLNPNAYSPNTLNKGSPKQANQTVGKGFFTAPGRESTGRFTRAVSPSFEDVWSQPRLFYNSLTPAEQQFVVDAIRFENSNVKSSVVRNNVIIQLNRVSNDLARRVARAIGVEEPEADPTYYHNNKTTDVGTFGQKLKKLDGLKVGFLASVETPASIEAASELSKQLSEDGVDVVVVAERLSDGVDQTYSGSDAIQFDAVIVAPGAEGLFSTFSFTAPSNATSSSTLFPAGRPLQIVIDGFRFGKPVGAVGSAATALKNAGIQTSRDGVYVDKSVTSGFVDGIKDGLRTFKFLDRFKLDH

SEQ ID NO: 42989 - DNA, 1458 bp, Porphyromonas gulae
  CDS (1)..(1458): transl_table=11
atggaaaagaacaaacttactacagctgcgggtgcccccgtagcagacaatcagaatgtggccactgcaggcaagcgtggtcctatgcttctgcaggatgtctggtttttggaaaagctggctcacttcgatcgtgaagtgatccccgaacgtcgtatgcatgccaaaggttcgggagctttcggcacatttactgtcactcatgacatcaccaagtacacgaaggcggctattttctccgaaatcggcaagcagaccgagctgtttgtacgcttctcgactgtggctggagagcgtggtgcggctgatgcggagcgggatatacgtggctttgctatcaagttttatactgaggaaggtaactgggacctcgtaggaaacaatacccccgtatttttcctgagagatcctctcaaattccccgacctgaaccacgtagtaaagcgtgacccacgcaccaatatgaggagtcctcaaaacaactgggacttttggacgcttttgcccgaagctctccaccaggtgactatcacgatgagcgaccgaggtatacctgccagctatcgtcacatgcacggctacggaagccatgcattctcgtttatcaacgccgaaggagtaagacattgggtgaaatttcatctccacactcaacaggggataaagaatctgacagatgcagaggcggaagcattgatcgggaaagatcgtgaaagtcatcagagagacttatttgaaagcattgagcgtggcgactatcctcgttggacgctcaaggtgcagatcatgacggaggaagaagccaaagctttgccgtataatcctttcgacttgacaaaggtgtggtcgcagaaagattttccccttatcgaagttggcgtaatggagctgaaccgcaatccggaaaactacttcgccgatgtggagcagtcggcattcaaccctgccaatgtggtgcccggcattagtttctcacctgacaggatgttgcaggggcgtctgttttcctatggcgatacgcaacgctatcgcctcggcgtgaatcatcaccaaatacctgtgaacaggagtcgttgtcctttcctgaatatgtatcacagggatggagccatgagggtagatggcaacttcggttcgcgtcttggctatgagcctaacagctatgggcactggcaagatcagaatgagtacaaagagccacccctcgaacttgatggtgctgcctatcaatgggatttcagggaagatgacagtgactattattctcagcctcgcaagctcttccatatcatgtcgccggatcagcagcaggtactattcgacaatacggctcgtgccatgggtgatatccccaaagagatcaagctgcgccatatagcgaattgctacaaggccgatccggactatggcaagggagtagcaaaggctttggggcttgacgtaaacgaagcactgtaa

SEQ ID NO: 42990 - protein, 485 aa, Porphyromonas gulae
MEKNKLTTAAGAPVADNQNVATAGKRGPMLLQDVWFLEKLAHFDREVIPERRMHAKGSGAFGTFTVTHDITKYTKAAIFSEIGKQTELFVRFSTVAGERGAADAERDIRGFAIKFYTEEGNWDLVGNNTPVFFLRDPLKFPDLNHVVKRDPRTNMRSPQNNWDFWTLLPEALHQVTITMSDRGIPASYRHMHGYGSHAFSFINAEGVRHWVKFHLHTQQGIKNLTDAEAEALIGKDRESHQRDLFESIERGDYPRWTLKVQIMTEEEAKALPYNPFDLTKVWSQKDFPLIEVGVMELNRNPENYFADVEQSAFNPANVVPGISFSPDRMLQGRLFSYGDTQRYRLGVNHHQIPVNRSRCPFLNMYHRDGAMRVDGNFGSRLGYEPNSYGHWQDQNEYKEPPLELDGAAYQWDFREDDSDYYSQPRKLFHIMSPDQQQVLFDNTARAMGDIPKEIKLRHIANCYKADPDYGKGVAKALGLDVNEAL

SEQ ID NO: 42991 - DNA, 1479 bp, Capsicum annuum
  CDS (1)..(1479)
atggatccctacaagcaccgtccttcaagcgctgccaattcgccctattggacaactaattcaggtgctccggtgtataacaacaattcttccctgaccgtgggagctagagggccaattcttctcgaggattatcatttgcttgagaagcttgccaattttgatcgtgagagaatcccagagcgtgttgttcatgccagaggtgccagtgccaagggtttctttgaggtcactcatgatataacccgtcttacatgtgctgattttcttcgagctcctggtgtccagacacctgttattgtgaggttctctactgttattcacgagcgtggaagccccgaaaccctcagggatcccagaggattcgctgtaaagttttacaccagagagggtaacttcgatctggttggaaacaacttccctgtcttctttgtccgtgatggaatgaagttccctgacatggttcatgctctaaaaccaaatccaaagtcccacattcaggagaactggaggatccttgatttcttctctcaccatccagaaagtcttcatatgttcagtttcctgtttgatgatctgggtatcccacaagattacaggcacatggaaggttccggtgttaatacctacacgctgatcaacaaagctgggaaagcacattatgtgaaattccattggaaaccaacttgtggagtcaaatgcttgttggatgacgaagctgttaaggttggtggaacaaatcatagtcacgccacccaggatctctatgattcaattgctgctgggaactatccaaagtggaaactgttcatccaaactatcgatcctgatcatgaagacaaatttgactttgaccccttagatgtaaccaagatctggcctgaggacattttgccattacaaccagttggtcgcttggtattgaacaagaatatcgacaacttctttgtagagaacgagcagcttgctttttgccctgccattattgtccctggtatccattactcggatgataagcttctccagactagggtattctcatatgctgatacccagagacaccgtcttgggccaaactatctgcagcttccacctaacgctcccaagtgtgctcatcacaataatcaccatgaaggtttcatgaatttcatgcaccgtgatgaagaggtcaactattttccctcaaggtttgatccttgtcgccatgcagagcagtacccaattcctcctcgtgtcttgaatggaaaacgtgataggtgcatcattcagaaagagaacaacttcaagcagccaggggagagataccgatcttgggcccctgacaggcaagaaagatttatctgcagatgggttgatgctctatctgaacctcgagtcactcatgaaatacgcactatttggctctcatactggtcacaggctgacaagtctcttggtcagaagctcgcctctcgtctcaatgtaaagcctacaatgtga

SEQ ID NO: 42992 - protein, 492 aa, Capsicum annuum
MDPYKHRPSSAANSPYWTTNSGAPVYNNNSSLTVGARGPILLEDYHLLEKLANFDRERIPERVVHARGASAKGFFEVTHDITRLTCADFLRAPGVQTPVIVRFSTVIHERGSPETLRDPRGFAVKFYTREGNFDLVGNNFPVFFVRDGMKFPDMVHALKPNPKSHIQENWRILDFFSHHPESLHMFSFLFDDLGIPQDYRHMEGSGVNTYTLINKAGKAHYVKFHWKPTCGVKCLLDDEAVKVGGTNHSHATQDLYDSIAAGNYPKWKLFIQTIDPDHEDKFDFDPLDVTKIWPEDILPLQPVGRLVLNKNIDNFFVENEQLAFCPAIIVPGIHYSDDKLLQTRVFSYADTQRHRLGPNYLQLPPNAPKCAHHNNHHEGFMNFMHRDEEVNYFPSRFDPCRHAEQYPIPPRVLNGKRDRCIIQKENNFKQPGERYRSWAPDRQERFICRWVDALSEPRVTHEIRTIWLSYWSQADKSLGQKLASRLNVKPTM

SEQ ID NO: 42993 - DNA, 1479 bp, Vitis vinifera
  CDS (1)..(1479)
atggatccttacaagtatcgtccttcaagcgcctataattctccttacttcaccacaaatgctggtgcgcctgtttataacaatgactcgtcgctcaccgttggatcaagaggcccagttcttcttgaggattatcatttggtggagaagcttgcaaattttcaaagagaacgcattccagaacgtgtggtccatgctagaggagctagtgctaaagggttttttgaggtcactcacgatgtctctgacctcacatgtgctgatttccttcgtgccccgggagtgcagactccagttattgttaggttttccactgttatccacgagcgtggcagccctgagaccataagggaccctcgaggttttgctgtgaagttctatactagagagggcaattttgatatggtgggaaacaatttcccagtcttctttattcgtgatgcaatgaagttccctgatgtgatccatgctttcaaacccaatccgaagtcccatatccaggagtattggagagttgttgacttcttgtcctaccatccagaaagcttgagcacatttgccttcctcttcgatgatgtgggtatcccacaggactataggcacatggaaggctttggtgttcacaccttcactctactcaacaaggctgggaaggcaaattatgtgaagttccactggaaacccacgtgtggagtcaagtgtttgttggaggatgaagccataagagttggaggaactaaccacagtcatgctactcaggatctctatgactcgatcaaggctggaaactatcctgagtggaagcttttcatccagacgatggatcctgaacatgaagacaagtttgactttgatccacttgatgttaccaagacttggcctgaggatatcttgcccttgcagccagtgggccggttggtattaaacaagaacatagataatttctttgctgagaatgagatgcttgccttcaacccagctcttgttgtacctggtatatattacacaaatgataaaatgctccaaggtagaatctttgcctattctgatactcagaggcaccgccttggaccgaactatctgcagcttccagtaaatgcacccaagtgtgcttttcacaacaatcaccatgacggttccatgaatttcatgcacagggatgaggaggtcgactacttcccttcaaggtttgatcctgttcgtcatgcggagacattccctattccttctactatttgccatggcaagcgtgagaaggtcgtcattgagaaggagaacaatttcaagcagcctggtgagagataccgttcatttgcaccggacaggcaagagcgtttcatcaacagatgggttgagaccttgtctgatccaagggtcacctatgagatccgcagtatctggatttcatattggtctcaggctgacaggtctctgggtcagaagcttgcttctcgtcttaatgtcaagcctaagtattga

SEQ ID NO: 42994 - protein, 492 aa, Vitis vinifera
MDPYKYRPSSAYNSPYFTTNAGAPVYNNDSSLTVGSRGPVLLEDYHLVEKLANFQRERIPERVVHARGASAKGFFEVTHDVSDLTCADFLRAPGVQTPVIVRFSTVIHERGSPETIRDPRGFAVKFYTREGNFDMVGNNFPVFFIRDAMKFPDVIHAFKPNPKSHIQEYWRVVDFLSYHPESLSTFAFLFDDVGIPQDYRHMEGFGVHTFTLLNKAGKANYVKFHWKPTCGVKCLLEDEAIRVGGTNHSHATQDLYDSIKAGNYPEWKLFIQTMDPEHEDKFDFDPLDVTKTWPEDILPLQPVGRLVLNKNIDNFFAENEMLAFNPALVVPGIYYTNDKMLQGRIFAYSDTQRHRLGPNYLQLPVNAPKCAFHNNHHDGSMNFMHRDEEVDYFPSRFDPVRHAETFPIPSTICHGKREKVVIEKENNFKQPGERYRSFAPDRQERFINRWVETLSDPRVTYEIRSIWISYWSQADRSLGQKLASRLNVKPKY

SEQ ID NO: 42995 - DNA, 1509 bp, Paracoccidioides brasiliensis
  CDS (1)..(1509)
atgggtgccgacgttgcgtccagtacttaccgttatactgaaactcccacctacaccacgtccaatggctgcccggtcatggaccctgagtcttcccagcgggtgggaatgaaaggccccctgctcctccaggatttccacctgattgaccttgcccatttcgatcgcgagcgaattcccgaacgagtggtccatgctaaaggtgcaggagcttacggtgaattcgaagtcttggatgatatcagcgacattacggtcattgatatgcttttgggtgtgggaaagaagacaaagtgtattacccgcttctccactgtgggtggagagaaggggtccgccgatagtgctcgcgatcctagagggttctccaccaaattttacaccgagcaaggaaattgggactgggtcttcaacaacaccccagtcttcttcttgcgtgatccatcaaagtttcctatcttcattcatacccagaagagaaacccacagaacaacctgaaggatgctactatgttctgggactacctctccacccatcaggagtccgccaacaggtcatgcatgcatctcttcagtgaccgtggcaccccgatactccctaccggcacatgtaacggtattctaggacaccacattacacagtggaccaagcctgacggaaccttcaactacgtccaaatccactgcaagaccgatcagggcaacaagacctttaacaacgaagaagccaccaagatggccgccgataatccagattggcataccgaagatctattcaaagccatcgagcgcggcgaatacccatcctggacgtgtacgttcaggtcctcagccccgagcaggctagaaatccgctggaatgtcttcgacctgaccaaagtctggcctcaggcggaggtgcccctccgccgcttcggccgcttcaccctctgcgagaacccgcagaactacttcgcggaaatcgaacaggccgccttctcaccctcccacatggtcccgggtgtcgaaccatccgccgaccctgtcctgcaatcccgcctcttctcctatccagacacccaccgccaccgcctgggcgtcaactaccagcagatccctgtcaactgtcctctgcgcgccttcaacccgtaccagcgtgacggtgccatggctatcaatggcaactacggcgccaaccccaactacccatccaccttccgcccgatggagttcaagcccgtcaaggcctgccaggagcacgagcagtgggctggcgccgccttgtcgaagcaaattcccgtcacggatgaggatttcgtccagcccaatggcctctggcaggttcttggacgccagccgggacaacaggagaatttcgttcacaatgtgtccgtccacctctgtggggcacaggagaaagtgcgcaaggccacctactgcatgttttcgcgcattaacgcggaccttggagcgcggattgagaaagccacggagaggttggttgcttctcagccacagtcgcatctgtga

SEQ ID NO: 42996 - protein, 502 aa, Paracoccidioides brasiliensis
MGADVASSTYRYTETPTYTTSNGCPVMDPESSQRVGMKGPLLLQDFHLIDLAHFDRERIPERVVHAKGAGAYGEFEVLDDISDITVIDMLLGVGKKTKCITRFSTVGGEKGSADSARDPRGFSTKFYTEQGNWDWVFNNTPVFFLRDPSKFPIFIHTQKRNPQNNLKDATMFWDYLSTHQESANRSCMHLFSDRGTPILPTGTCNGILGHHITQWTKPDGTFNYVQIHCKTDQGNKTFNNEEATKMAADNPDWHTEDLFKAIERGEYPSWTCTFRSSAPSRLEIRWNVFDLTKVWPQAEVPLRRFGRFTLCENPQNYFAEIEQAAFSPSHMVPGVEPSADPVLQSRLFSYPDTHRHRLGVNYQQIPVNCPLRAFNPYQRDGAMAINGNYGANPNYPSTFRPMEFKPVKACQEHEQWAGAALSKQIPVTDEDFVQPNGLWQVLGRQPGQQENFVHNVSVHLCGAQEKVRKATYCMFSRINADLGARIEKATERLVASQPQSHL

SEQ ID NO: 42997 - DNA, 1479 bp, Arabidopsis thaliana
  CDS (1)..(1479)
atggatccttacaagtatcgtccagctagttcttacaactctcccttcttcaccaccaactctggtgctcctgtatggaacaacaactcctccatgaccgttggacccagaggtcctatccttcttgaggattaccatctcgttgagaagcttgccaatttcgacagggaacggattccagagcgtgtggttcatgccagaggagccagtgctaaaggtttctttgaggtcactcatgatatctctaacctcacttgtgctgactttctccgagctcccggtgttcagactcctgtcattgtccggttctccaccgttatccatgagcgtggaagtcccgagaccttgagagaccctcgtggttttgcagtcaagttctacaccagagaggggaactttgatcttgttggaaacaactttcctgttttcttcatccgcgatgggatgaagttccctgacatggtccacgctcttaagccgaacccaaaatctcacatccaagagaactggagaatccttgacttcttctcccaccaccctgaaagtttgaacatgttcactttcctcttcgatgatatcggtatcccacaagattacaggcacatggatggttcaggtgtcaatacatacatgttgatcaacaaagctggcaaagctcactacgtgaagttccattggaaaccaacttgtggagtcaagtctcttttggaagaagatgcaattcttgttggaggaaccaaccacagtcatgcgactcaagacttgtatgactctatagctgctggaaactaccctgaatggaagctctttatccaaatcattgatcctgctgatgaagacaagttcgactttgacccgctcgatgtgaccaagacctggcctgaggatatcttgcctcttcaacctgttggacgtatggtgttgaacaagaacattgacaacttctttgcagagaatgagcaacttgctttctgtcctgcaattattgtcccagggatacattactcagatgataagctgcttcaaacccgtgtcttctcctatgccgatactcagagacaccgtcttggaccaaactaccttcagctgccagtcaatgctccaaaatgtgctcaccacaacaaccaccatgagggattcatgaatttcatgcacagggacgaggaggttaactacttcccgtcgaggtatgaccaggttcgtcatgctgagaagtatccaactccgcctgctgtctgttctggaaaacgtgagaggtgcattattgagaaagagaacaacttcaaggagcctggagagagataccgtacctttacaccagagaggcaagaacgattcatccagagatggattgatgccctatccgacccacgcatcacgcatgaaatccgcagtatctggatctcttactggtctcaggctgataagtctttgggacagaagctggcaagccgtctgaacgtgagaccaagcatctaa

SEQ ID NO: 42998 - protein, 492 aa, Arabidopsis thaliana
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLNMFTFLFDDIGIPQDYRHMDGSGVNTYMLINKAGKAHYVKFHWKPTCGVKSLLEEDAILVGGTNHSHATQDLYDSIAAGNYPEWKLFIQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDQVRHAEKYPTPPAVCSGKRERCIIEKENNFKEPGERYRTFTPERQERFIQRWIDALSDPRITHEIRSIWISYWSQADKSLGQKLASRLNVRPSI

SEQ ID NO: 42999 - DNA, 1479 bp, Suaeda salsa
  CDS (1)..(1479)
atggatccatacaagtttcgaccttcaagtgctaacaattctccatacttcaccgccaattctggtgcacctgtttggaacaataacaattcgttaactgttggtcacagaggtcccattcttttggaggactatcatttggtggagaagcttgccaatttcgacagagagcgtataccagagcgtgttgtgcatgccaggggagcgagtgcaaaggggttttttgaagttactcatgatgtttcacaccttacatgtgctgattttctgcgcagccctggtgttcagacacctgtaattgttcgtttctccactgttattcatgaacgtggaagtccagaaaccatcagggatcctcgtggttttgctgtgaagttctacaccagagagggtaactttgatctggtggggaacaatttccctgtcttttttatccgtgatggtatgaaattccctgatatggtgcactccctcaagcccaaccccaaatctcacatccaagagaactggaggatcatggatttcttctcccaccatcctgagagtttgcacatgttcacttttctctttgatgatatcggaattcctgcaaactacaggcacatggaaggttctggtgttaacacatacactttaattaacaaggctggaaaaacatactacgtgaagttccactggaaaccaacatgtggggtgaagagcctgttggaggatgaggccattaaagttggaggagctaaccacagccatgctacgcaggacctctatgactcaattgcaagtgggaactatcctgagtggaagcttttcatccagacaatagacccagctgatgaagataaatttgactttgaccccctagatgttacaaaaacatggcctgaggatattttgcccctacagccagtgggtcgtttagtgttgaacaagaacattgacaacttctttgcagaaaacgagcaactggcattttgcccttctattgttgttcctggggtccactactcagatgacaagctgcttcaaactcgaattttctcgtactctgatactcaaagacaccgtcttggccccaactacctgcaacttcctgtgaatgcccccaagtgttctcatcacaacaatcactatgatggttttatgaacttcatgcacagagatgaagaggttgactacttcccatcaagatacgaccctgttcgtcatgctgagaggtatccaattccttcaaacgtcttgaatggatgccgtgaaaagcaatgcatcccaaaggaaaacaacttcaagcagcctggagagagatacagatcaatggacccagctaggcaagagagatttatttgccgagtggttgatgccctgtctgatcctcgtgtcactcatgagatccgtagcatttggatttcatactggtctcaggctgacaaatctctgggaatgaaagtagcaagtagactaaacgtgaggccaaccatgtga

SEQ ID NO: 43000 - protein, 492 aa, Suaeda salsa
MDPYKFRPSSANNSPYFTANSGAPVWNNNNSLTVGHRGPILLEDYHLVEKLANFDRERIPERVVHARGASAKGFFEVTHDVSHLTCADFLRSPGVQTPVIVRFSTVIHERGSPETIRDPRGFAVKFYTREGNFDLVGNNFPVFFIRDGMKFPDMVHSLKPNPKSHIQENWRIMDFFSHHPESLHMFTFLFDDIGIPANYRHMEGSGVNTYTLINKAGKTYYVKFHWKPTCGVKSLLEDEAIKVGGANHSHATQDLYDSIASGNYPEWKLFIQTIDPADEDKFDFDPLDVTKTWPEDILPLQPVGRLVLNKNIDNFFAENEQLAFCPSIVVPGVHYSDDKLLQTRIFSYSDTQRHRLGPNYLQLPVNAPKCSHHNNHYDGFMNFMHRDEEVDYFPSRYDPVRHAERYPIPSNVLNGCREKQCIPKENNFKQPGERYRSMDPARQERFICRVVDALSDPRVTHEIRSIWISYWSQADKSLGMKVASRLNVRPTM

SEQ ID NO: 43001 - DNA, 2145 bp, Botrytis cinerea
  CDS (1)..(2145)
atgtacttggcaacagtcctaagcctcgtaggcttagtcaccgctcaatgtccatacggaatggacaagcaaccccaaaagcgcgaacctaaagattctcaaaccagtagttctaattttctagaccagttcacattaaatgacaccaatacatacttcactaccgatgcaggcgggcctatacaagaggacaccagtttaaaagctggtgcaagaggcccgacactacttgaagattttatttttcgtcaaaagatacaacatttcgatcatgaacgggtaccagaacgtgccgtacacgccagaggtgccggtgcacatggtattttcacaagttatggaaattatagcaacataacggcagctagctttctgaatcaagaaggtaaagagacacccgtctttgtacgattttctactgttgccgaaagtcgaggtagcgctgatactgcacgcgacgtccatggttttgctactaggttctataccgatgaagggaattttgatattgttgggaataatattcctgttttcttcattcaggatgcaatccttttccccgacttgattcacgctgtcaaaccatctccagacaacgaaatacctcaagcagcaacagcacacgattctgcttgggacttttttagtcagcaaccaagttcactgcacacactcttttgggccatggccggaaacggaattccaagatcattccgccacatggatggatttggtatccacacatttcgcttggttacagattctggtacttccaaactggtcaagtggcattggaagagtaaacaaggaaaggcaagcttggtctgggaggaagctcaggtactcgcgggaaaaaatgcagatttccacagaaaagatttgtgggatgctattgagagcggcaatggccctgaatgggaactcgggattcagatcgtggaggaagaagatgtgttgaagtttggatttgatcttttggaccccaccaagatccttcctgaagagcttgttccagtccaaaagattggagtcatgagattaaatgccaatcctcgaaattacttcgcggaaacagagcaagttatgttccaaccagggcacatagtgcgtggtattgattttacggatgatccacttcttcaaggacgcatcttttcatacttggatacacaactaaatcgtcatggtggaccaaatttcgagcaattacctatcaatcgcccaattgttcctgttcacaacaacaatcgcgatggtgcagcgcacaattatatccctcttaacacagctgcttattcccctaacactctcaatgatgcggctccaaagcaagcaaatcaaacagtgggtagaggattcttcacagctcctggaagaacggtctcaggtcatctagtaagagaggtgtcgtcaaccttctcagacgtttggtctcaacccaggctattctacaattctctcatcccagtagaacaacaattcctcattaacgcgatccgattcgaaacgtcccaacttacatccagcgttgtgaaatcaaatgttctcattcagttgaatcgcgtttcacacgatcttgctgcacgcgtcgcttcagttttgaatctaccagttccagaagcagataacacttactataatgataacaaaacttcctccatcacaatatttggcaatgaactcccaacgatagcaacactaaatgtcggagtgttggtgagtgttaagaacaatgcgactttaacacaagcagccaatcttgcaacatcgttttcgacatccggggtaaacgtcaaagtcataggagaaatcttgacaaacggagtagatgccacttatagcgcatcggatgcgacactgtttgatggtattattgtaactgatggtgccgagaatttgttcacaaacggttcaaaatcaacgtacttcccggctgaccgacctcgtcagatcttgttggatgcgtacaattggggaaagcctgtgggaactttgggaaatgcgagaacgtcattaaatgttgcgtcaatctccactacaccaggcgtgtacagtaattcaacgagtgtgagtggccttgttaaggagtttgaagccggattgaagactttcaggttcgtcgatagatttgccttggatgattga

SEQ ID NO: 43002 - protein, 714 aa, Botrytis cinerea
MYLATVLSLVGLVTAQCPYGMDKQPQKREPKDSQTSSSNFLDQFTLNDTNTYFTTDAGGPIQEDTSLKAGARGPTLLEDFIFRQKIQHFDHERVPERAVHARGAGAHGIFTSYGNYSNITAASFLNQEGKETPVFVRFSTVAESRGSADTARDVHGFATRFYTDEGNFDIVGNNIPVFFIQDAILFPDLIHAVKPSPDNEIPQAATAHDSAWDFFSQQPSSLHTLFWAMAGNGIPRSFRHMDGFGIHTFRLVTDSGTSKLVKWHWKSKQGKASLVWEEAQVLAGKNADFHRKDLWDAIESGNGPEWELGIQIVEEEDVLKFGFDLLDPTKILPEELVPVQKIGVMRLNANPRNYFAETEQVMFQPGHIVRGIDFTDDPLLQGRIFSYLDTQLNRHGGPNFEQLPINRPIVPVHNNNRDGAAHNYIPLNTAAYSPNTLNDAAPKQANQTVGRGFFTAPGRTVSGHLVREVSSTFSDVWSQPRLFYNSLIPVEQQFLINAIRFETSQLTSSVVKSNVLIQLNRVSHDLAARVASVLNLPVPEADNTYYNDNKTSSITIFGNELPTIATLNVGVLVSVKNNATLTQAANLATSFSTSGVNVKVIGEILTNGVDATYSASDATLFDGIIVTDGAENLFTNGSKSTYFPADRPRQILLDAYNWGKPVGTLGNARTSLNVASISTTPGVYSNSTSVSGLVKEFEAGLKTFRFVDRFALDD

SEQ ID NO: 43003 - DNA, 1479 bp, Zantedeschia aethiopica
  CDS (1)..(1479)
atggatccctgcaagtaccgcccgtccagctcgtatgacgcgtccttcaccaccacaaatgctggcggacccgtgtggaatgatgacgttgccctgaccgtcggatctcgggggcccattcttctggaggattaccatttgatcgagaaggttgctcacttcgctcgggagcgcatcccagaacgagttgttcatgccaggggagccagcgccaagggcttcttcgagtgcactcatgatgtcactcacctcacttttgccgatttcttgagggcacctggcgtccagacccctgttatagtccggttctccactgtgatccatgagaggggaagccctgaaaccatcagggacccaagaggctttgctgtgaaattttacaccagagagggtaactgggatctgctggggaacaacttcccggtcttcttcatccgcgatggaataaaattcccagacgtgatccatgccttcaaacccaaccccaagtctaatgtccaagagtactggagggtcctggacttcctctcgcacctcccggagagcttgcacaccttctgcttcctgtacgacgatgtgggcgtccccttgaactacaggcacatggaaggcttcggcgtcaacacctacaccttcatcaacaaggcgggcaagaccaactacgtgaagttccactggaagcccacatgcggggtgaagtgcatgctggaggacgaggccgtggtggtgggagggaagaaccacagccacgccacccaggacctctacgattccatcgccgccgggaactaccccgagtggaagctcttcgtccaggtcatggacccggacgaggaggacaagtatgacttcgacccactggacgacaccaagacctggccggaggacctgctccccctgcagccagtgggccgcctggttctcaacaggaacatcgacaacttcttcaacgagaacgagcagcttgccttctcccctggcattattgtgcccggcatctactactcggacgacaagatgctgcaatgcagaactttcgcctacggggacacccagaggtaccgtctcgggccaaactacctgatgctcccggtgaacgcacccaagtgcgcgcacaagaacagccactacgatggcctcatgaactttatgcacagagatgaagaggtgaattattacccttcaaggcatgaccgtcttagaaatgcggagagattcccgattaacaaccgtcctattattgggaagcgtgagaagtgcacaattgagaaacagaatgatttcaagcagcccggagagagataccgctcttgggcacctgataggcaagagcggtttgttcgccgctgggttgaggcattggcccaccccaaagttacctttgaaatccgcaccatctgggtatcctatctctccaagtgcgatgcttctctggggcagaaggttgccaatcgtctgaacatgaaaccaagcatgtaa

SEQ ID NO: 43004 - protein, 492 aa, Zantedeschia aethiopica
MDPCKYRPSSSYDASFTTTNAGGPVWNDDVALTVGSRGPILLEDYHLIEKVAHFARERIPERVVHARGASAKGFFECTHDVTHLTFADFLRAPGVQTPVIVRFSTVIHERGSPETIRDPRGFAVKFYTREGNWDLLGNNFPVFFIRDGIKFPDVIHAFKPNPKSNVQEYWRVLDFLSHLPESLHTFCFLYDDVGVPLNYRHMEGFGVNTYTFINKAGKTNYVKFHWKPTCGVKCMLEDEAVVVGGKNHSHATQDLYDSIAAGNYPEWKLFVQVMDPDEEDKYDFDPLDDTKTWPEDLLPLQPVGRLVLNRNIDNFFNENEQLAFSPGIIVPGIYYSDDKMLQCRTFAYGDTQRYRLGPNYLMLPVNAPKCAHKNSHYDGLMNFMHRDEEVNYYPSRHDRLRNAERFPINNRPIIGKREKCTIEKQNDFKQPGERYRSWAPDRQERFVRRWVEALAHPKVTFEIRTIWVSYLSKCDASLGQKVANRLNMKPSM

SEQ ID NO: 43005 - DNA, 2238 bp, Cladosporium fulvum
  CDS (1)..(2238)
atggccaccgagaagatctcctccgggcttggaaagctccaagaccagctcaatggcgccgcagaaggccagaaggtggcgcatgtgaagaacgacccgctctacaaggactaccacgaaccgagcaacagaatcaccaccgactatggcgtcaagcagcacaacacagacgactggctcaagattgcctccgaggacaagacaggtccaatgctgcttgaagaccatgcagcacgagagaagatcaaccgtttcgaccacgagcgaatcccagaacgtgttgtccacgcccgtggctcagcggctttcggtactttcaagctgcacaagagcttggagcaatacaccaccgccggcgtcctgaccgatacatcccgcaccacacctaccttccttcgattctccaccgtgttgggaagccgcggcagtgctgacactgtccgcgatgtaagaggattcgccatcaaacactacaccccagagggcaactgggatgtcgttggtaacaatataccggtcttcttcatccaggatgccatcaagttccctgatgtcatccatgctggcaagccagagccagacaacgaagttccgcaagcgcagactgcgcacaacaacttctgggacttccaattcatgcacactgaggcgacacatatgttcatgtggactcaatccgaccgagcaattccaagatcataccgtatgatgcaaggatttggtgtcaacaccttcaccttgaccaacgcaaagggcgagcgattcttcgtcaagttccactggactccacaccttggtgtacacagctttgtctgggacgaggcattgaagctcgctggccaggatccggactttcaccgcaaggacctttgggaagcgatcgaggccaaagcctaccccaagtgggactttggagttcaagtcatttcagagggtgaagaggacaactttgagttcgacattctcgacgccaccaaggtttggcccgaggaacttgtgccaatccagtatgtcggcgagcttgaactcaaccgcaatcccgatgagttcttcccacagaccgagcaggtggctttctgcacgggccacgttgtaccaggcataggtttctctgacgaccctctgctccagggacgaaactttagctaccaggacacccagatctccagacttggtgtcaacttccaggagctgcccatcaaccgacctgtctgccccgtgatgaacaacaaccgagacggcgcgctccgacacaccgttactaagggcaaggtaaattactggcccaaccgtttcgaagctacacctccagccgcagcagaagagaagccatacctcgactacccacagaaggtggctggcatgaagacccgtctgcgctcgaagaagttcagcgagcacttcaaccaggcccagctcttctacaactcaatgtcggaacccgagaaggagcacatcaagttcgcgcttgccttcgagctcgatcactgtgaggatcccgtcgtctacgaccgcgtgtcgcagcgtcttgcagacatcgacctcagcctcgcacaaagcgtagccgacctcgtcggtggccagatcccacagcagcaaggtcgtcccaaccacggcaagaagtccaagggtctatctcagaccgagttccccggcaagaccccaaccatcgaaacccgccgcattgccatcatcatcgccgacggctacgatttagtggcatacaacggcatcgtcgctgcagcaaaggcatgccaagctctgccattcaccattgctcccagaagatccccaatctacgctgcgggcgaaagcaaggagaacagcaagggcgtcaagccagaccatcacctcgaaggcatgcgcagcaccatgttcgactccgtcttcgtcccaggtggtgcagactcggtcgctacgctccgcaagaatggccgcgcactgcactgggtccgcgaagcgttcgctcacctcaaggccattggtgccgttggtgaggccgtcgacttcgtccgcaatgcctgtcaattacctggcatgacattctccgccagtgaggaggtcaccgactcgtacggtgttgtgaccgccgcgaaagtcaagccggagagcctgagtgaggctgtgaagatcggaaaggatgcagcggactttgtctcgaagtacttctacgagatttcccagcataagaactttgagagggagctgaagggattcccgctgatggttgcgtattag

SEQ ID NO: 43006 - protein, 745 aa, Cladosporium fulvum
MATEKISSGLGKLQDQLNGAAEGQKVAHVKNDPLYKDYHEPSNRITTDYGVKQHNTDDWLKIASEDKTGPMLLEDHAAREKINRFDHERIPERVVHARGSAAFGTFKLHKSLEQYTTAGVLTDTSRTTPTFLRFSTVLGSRGSADTVRDVRGFAIKHYTPEGNWDVVGNNIPVFFIQDAIKFPDVIHAGKPEPDNEVPQAQTAHNNFWDFQFMHTEATHMFMWTQSDRAIPRSYRMMQGFGVNTFTLTNAKGERFFVKFHWTPHLGVHSFVWDEALKLAGQDPDFHRKDLWEAIEAKAYPKWDFGVQVISEGEEDNFEFDILDATKVWPEELVPIQYVGELELNRNPDEFFPQTEQVAFCTGHVVPGIGFSDDPLLQGRNFSYQDTQISRLGVNFQELPINRPVCPVMNNNRDGALRHTVTKGKVNYWPNRFEATPPAAAEEKPYLDYPQKVAGMKTRLRSKKFSEHFNQAQLFYNSMSEPEKEHIKFALAFELDHCEDPVVYDRVSQRLADIDLSLAQSVADLVGGQIPQQQGRPNHGKKSKGLSQTEFPGKTPTIETRRIAIIIADGYDLVAYNGIVAAAKACQALPFTIAPRRSPIYAAGESKENSKGVKPDHHLEGMRSTMFDSVFVPGGADSVATLRKNGRALHWVREAFAHLKAIGAVGEAVDFVRNACQLPGMTFSASEEVTDSYGVVTAAKVKPESLSEAVKIGKDAADFVSKYFYEISQHKNFERELKGFPLMVAY

SEQ ID NO: 43007 - DNA, 1512 bp, Methanobrevibacter arboriphilus
  CDS (1)..(1512)
atgtcaaataaaaaaaaattcacaacaaataaaggaattcctgtacctaatgatcaggcatccattaccacaggtaaaggatcaaattatacaatgttaggagattctcatttaactgagaaacttgcgcatttcggtagagaaagaataccggaaagagtcgttcatgcgaaaggaactggggcttatggatattttgaagttacaaatgacctttcaaaatatactagagctaaatttctttcagaagttggtaaaaaaactgaggtttttataagattctctaccgttgggggagaaagaggttctgctgatgcaaaaagagatcctcgtggaactgctatgaaatattatactgaagaaggaaattatgatcttgttggaaataatactcctattttctttattagagatgcaataaagttcccagattttatccacactcaaaagagaaaccctaaaaataatctatctgatgctgatatgttttgggattttatgtccttaacacctgaatcaatacatcaagcaacatttttatttactgatagaggaactccacaaaattaccgacatatggatttatttggaagtcattcttttatgtggtataatgaaaaaaatgaatatgtatgggtaaaatatcattttaaaacagctcagggaatacaaaacttaacaaatgatgaagcaattaaaatgtgtggtgaaaatccagaccatgccacagaagatctatttaatgctattgaagaaggaaattatccagaatggaatgtctatgttcaaataatgactcccgaagaagcagaaaaatatgaatttgatccatttgatgtaacaaaagtttggttccatggagattatccattaatccctctaggaaaattagttttaaataaaaatccagaaaatttctttgctgaagttgaacaggttgcattcgcaccttcaaattttgttccaggaattggaccttcaccagacaggcttttgcaaggaaggttattttcttatgaagacactcaaagacatagactaggtccaaatcatcaccaaattccaataaatagggcaaaaaatgctgaagtaaacacctatcaaagagacggaccgatgacagtcacagataatggaggaagtgggcctaattactatccaaattcatttgatgggccagaagtagatgaaacagttactccaccaactatagaattgaaagcggaaattaatagacacccaaggccagttgaagatgttgactttttccaaacaggcgaactttggagaagagttttaagtgatgaggataaggatcatctagtatataatatagttgcacacttaggaaatgcccaagaaagaattcaatatagacaatgtgctcttttctacaaagcagaaccagaatatggaacacgtgtagctgagggaattggacttgatatatccaaagttaaaaatctttctgaaatgactcaagaagaaagagttgaagccacaaaaaaatga

SEQ ID NO: 43008 - protein, 503 aa, Methanobrevibacter arboriphilus
MSNKKKFTTNKGIPVPNDQASITTGKGSNYTMLGDSHLTEKLAHFGRERIPERVVHAKGTGAYGYFEVTNDLSKYTRAKFLSEVGKKTEVFIRFSTVGGERGSADAKRDPRGTAMKYYTEEGNYDLVGNNTPIFFIRDAIKFPDFIHTQKRNPKNNLSDADMFWDFMSLTPESIHQATFLFTDRGTPQNYRHMDLFGSHSFMWYNEKNEYVWVKYHFKTAQGIQNLTNDEAIKMCGENPDHATEDLFNAIEEGNYPEWNVYVQIMTPEEAEKYEFDPFDVTKVWFHGDYPLIPLGKLVLNKNPENFFAEVEQVAFAPSNFVPGIGPSPDRLLQGRLFSYEDTQRHRLGPNHHQIPINRAKNAEVNTYQRDGPMTVTDNGGSGPNYYPNSFDGPEVDETVTPPTIELKAEINRHPRPVEDVDFFQTGELWRRVLSDEDKDHLVYNIVAHLGNAQERIQYRQCALFYKAEPEYGTRVAEGIGLDISKVKNLSEMTQEERVEATKK

SEQ ID NO: 43009 - DNA, 1479 bp, Hevea brasiliensis
  CDS (1)..(1479)
atggatccgtacaagaaccttccatcaaacgcttataattgctccttctggactacgaattctggtgctccagtatggaacaacaattcgtccttgactgttggagccagaggtccaatccttcttgaggactatcatctgttggagaaacttgcaaactttgatagggagcggattccagagcgtgttgtgcatgctaggggagcaagtgcaaagggtttctttgaggtcacccataatgtctctcaactcacatgtgctgatttccttcgagctccgggggttcagactcctgtcattgtccgtttctccactgttattcatgagcggggcagcccagaaaccataagggatcctcgaggttttgctgtgaagttttacaccagagagggtaactttgatctggtgggaaacaatttccctgtttttttcatccgcgatggaatgaagttcccagatgtggtgcatgcttttaagcccaaccctaagtctcacatccaggagagctggaggatctttgacttcctatcccatgttcctgaaagcttgcacatgctcaccttcctttttgatgacctgggtattcctcaagattacaggcacatggaaggctctggcgttaacacatatactttaataaacaatgctggaaaagtacactgtgttaaatttcactggaaacctacttgtggtgtgaagtgtttgctagaggaagaggcaatcaaggttggaggatctaatcatagccatgccactcaggatctatatgactcgattgcagctggcaactatccagaatggaaactttacatccagacaatggatcctgatcatgaagacaaatttgattttgatccacttgatgtgactaagacctggcccgaggatatcctgcctcttcaaccggttggccgcttggtcttgaataagaacattgacaatttctttgctgagaatgagcaacttgcgttctgccctggtattgtggttcctggtatttcatattcggaggacaaattactccaaactaggatcttttcctattctgatacccagaggcatcgtcttggatcgaactatctacagctacctgttaacgctccaaagtgtgctcatcacaacaatcaccatgacggtttcatgaatttcatgcacagagatgaggaggtcaattacttcccatccaggtgtgatccagttcgccattctgagagatttcccattccttccactatctgcagtggaaggcgcgataagtgtgtcattgagaaggaaaacaatttcgagcaacctggagagagatatagatcctgggcacctgacaggcaagagcgattcctaaaccggatggttggttgcctatctgatccccgtatcactcatgagcttcgtagtatctggatctcctactggactcagtgtgacagatccctgggtcaaaagctagcattccggctcaacgtgaggccaagcatttga

SEQ ID NO: 43010 - protein, 492 aa, Hevea brasiliensis
MDPYKNLPSNAYNCSFWTTNSGAPVWNNNSSLTVGARGPILLEDYHLLEKLANFDRERIPERVVHARGASAKGFFEVTHNVSQLTCADFLRAPGVQTPVIVRFSTVIHERGSPETIRDPRGFAVKFYTREGNFDLVGNNFPVFFIRDGMKFPDVVHAFKPNPKSHIQESWRIFDFLSHVPESLHMLTFLFDDLGIPQDYRHMEGSGVNTYTLINNAGKVHCVKFHWKPTCGVKCLLEEEAIKVGGSNHSHATQDLYDSIAAGNYPEWKLYIQTMDPDHEDKFDFDPLDVTKTWPEDILPLQPVGRLVLNKNIDNFFAENEQLAFCPGIVVPGISYSEDKLLQTRIFSYSDTQRHRLGSNYLQLPVNAPKCAHHNNHHDGFMNFMHRDEEVNYFPSRCDPVRHSERFPIPSTICSGRRDKCVIEKENNFEQPGERYRSWAPDRQERFLNRMVGCLSDPRITHELRSIWISYWTQCDRSLGQKLAFRLNVRPSI

SEQ ID NO: 43011 - DNA, 2181 bp, Podospora anserina
  CDS (1)..(2181)
atgaaaaggctgctaacgtgggccaccctcgtggggtccatgtcggcggtgacaaaagcggcatgcccttttgctgatcccaactaccacctcgccaagagggacgagggcgcgagccagcagacggagaatatcctcgaggagtacgaggttgacgacagcaatgcttacatgtcgtccgacgttggtgggccgatggaggaccagaacagcctcaaggctgggtacagggggtctaccttgatggaggactggatctttaggcaaaagattcagcattttgatcatgaacggattcccgaaagggctgttcacgctcgtggtgccggtgctcacggtaccttcaccagctatgccgactggagcaacatcacggctgcttccttcctcggtggagctggaaagaagactcccgtcttcgtccggttctcgaccgttgctggttcccgcggcagtgctgataccgctcgcgatgtccacgggttcgctacccgcttctacactgacgaaggaaactttgacattgtcggcaacaacatccccgtcttttttatccaagacgccatccgcttccccgacttgatccactctgtcaagcccagcccggacaatgaggtcccccaggcggccaccgctcacgattcggcgtgggacttcttcagccagcagcccagcactatgcacactctcttctgggccatgtccggcaacggcatccctcgcagttatcgtcacatggacggcttcggcgtgcacaccttccgcttcgtcacggacgacggcaactccaagctcatcaagtggcacttcaagaccaagcaaggcaaggcttctctggtctgggaagaggcccaggttctcgctggcaagaacgccgacttccaccgtcaggatctctgggacgcgatcgagtcaggcaacggtccagagtgggagctgtccgtccagatcgtcgacgaagaaaaggccctcgcctttgggtttgacctcctcgaccccaccaagatcatccccgaggagctcgccccgttggttcccctcggtatcatgaagctggaccggaacccgaccaattactttgccgagacggagcaggtcatgtaccagcctggtcacattgtccgtggtgtcgactttaccgaggacccgcttctccaaggccgtttgttttcgtaccttgacacgcagctcaaccggaaccagggcgggcccaactttgagcagatccccatcaacagacccgtctcgcctgttcacaacaacaaccgggacggggcgggacagatgcttattcataaaaatgtttacccttatacccctaacactctcaacggggggtaccccctccaagccaaccagacgcacgggaaagggttctttacggcgccgaacaggatcgtggatgggaagctggtcagggcgctgtcgccgacgtttgatgatcattggtcgcagccgaggttgttttacaactcgttgacgagggttgagcagcagtttttgatcaacgctatccggtttgaggcatctcatctcaagaacgagcaggtgaagaagaacgtgttggagcagatcaaccgtgtgtcaaacgatgtggcgaagcgggttgcggtggctcttggacttgaggcgccggctccggacccggcattctaccataacaatgtcacggctgggctttccatctttaacggaaccctccccacgattgcgactttgagggttggcgtccttgcctcgtctttcaatgatggatcgcttgctcaggcgcgggagttgaaggagcagctcagcaaggagggggttgtggtcactgttgttggcgaggttctcaaggagggggtggatcagacttactctgctgctgatgccactgggtacgacgcggtggttgtgacggatggggcggaggggttgttgactggaggaaagaactctccgttgttccctgccggacggccggggcagatcttggtggatagttatcgttgggggaagccggtcgctgctgtgggggagaattcgggacaggcgttggagcagacggttggggtgagtagggggcaggatgagggtgttgttgttggggagggggttgagcaggttgtgaagggggtcgaggaggggttgagggtgtttagatacttggggaggttccctgttgatgagggggcagagtag

SEQ ID NO: 43012 - protein, 726 aa, Podospora anserina
MKRLLTWATLVGSMSAVTKAACPFADPNYHLAKRDEGASQQTENILEEYEVDDSNAYMSSDVGGPMEDQNSLKAGYRGSTLMEDWIFRQKIQHFDHERIPERAVHARGAGAHGTFTSYADWSNITAASFLGGAGKKTPVFVRFSTVAGSRGSADTARDVHGFATRFYTDEGNFDIVGNNIPVFFIQDAIRFPDLIHSVKPSPDNEVPQAATAHDSAWDFFSQQPSTMHTLFWAMSGNGIPRSYRHMDGFGVHTFRFVTDDGNSKLIKWHFKTKQGKASLVWEEAQVLAGKNADFHRQDLWDAIESGNGPEWELSVQIVDEEKALAFGFDLLDPTKIIPEELAPLVPLGIMKLDRNPTNYFAETEQVMYQPGHIVRGVDFTEDPLLQGRLFSYLDTQLNRNQGGPNFEQIPINRPVSPVHNNNRDGAGQMLIHKNVYPYTPNTLNGGYPLQANQTHGKGFFTAPNRIVDGKLVRALSPTFDDHWSQPRLFYNSLTRVEQQFLINAIRFEASHLKNEQVKKNVLEQINRVSNDVAKRVAVALGLEAPAPDPAFYHNNVTAGLSIFNGTLPTIATLRVGVLASSFNDGSLAQARELKEQLSKEGVVVTVVGEVLKEGVDQTYSAADATGYDAVVVTDGAEGLLTGGKNSPLFPAGRPGQILVDSYRWGKPVAAVGENSGQALEQTVGVSRGQDEGVVVGEGVEQVVKGVEEGLRVFRYLGRFPVDEGAE

SEQ ID NO: 43013 - DNA, 2211 bp, Podospora anserina
  CDS (1)..(2211)
atggccagttatttgccctccatggagaaagtacagcacgccgttcttgggccccgagggggtgacaaggtcgccgaccttcagaaggagaccaaggagatgtcagacaaggcccgcctcacaacagactatggtgtcaagcagacctctgccgatgactggctcaagatcgtcaacaacgacaagactggtcccatgctgttggaagacccctttgctcgcgagagaatccacaggttcgaccacgaaagaatcccagagcgcgtcgtccatgcccgtggcagcggtgccttcggcaagttcaagctcttcgagagtgccgaggatgtcacttttgctccaatccttaccgacacatcgcgcgagacgcccatttttatccggttttcgacagtgctcggtagccgtggcagcgctgataccgttcgcgatgtgcgaggttttgcgatcaagttctacacacaggaaggaaactgggatattgtcgccaacaatattcccgtgttcttcattcaggacgccatcaagtttcccgatgtcatccatgctggcaaacccgagccacacaacgaggttccccaagcccagacagcccataacaacttctgggatttccagtacaaccacaccgaggcgacgcacatgttcatgtgggcgatgagcgacagaggtattcctcgttcgtaccgcatgatgcaaggatttggcgtcaacaccttcacgctcatcaacgccaagggagagcgtcactttgtcaagttcatcttcaccccggaactcggcgtgcactctcttatttgggacgaggccctcaagcttgccggccaggatccagacttccaccgcaaggacctgtgggaggccatcgagaacggtgtcttccccaagtggaagttcggtattcaggtgatccctgaagctgatgagcacaagttcgacttcgacattttggatgctaccaagatctggcccgaggatctggtacctgtgcgttacattggcgagttcgagctcaaccgcaacccagacgagttcttcccacagactgagcaggttgcattctgcacaagccacatcgtccccggtattggcttctccgatgaccctcttctccaaggccgcaacttcagctatttcgatacacaattgagccgtctgggtatcaactggcaggagcttcccatcaaccgcccagtatgccccgtcatgaacttcaaccgcgatggtgctatgcgccacaccatcaccaaaggcaccgtcaactactggcccaaccggtttgagaaggtcaagcctgctactcacgaggaaggcgggtatgttgaatacgctgagaaggttgccggcatcaaggcccgcgcccgcagtgccaagttcaaggagcattttgctcaggcgcaactgttctggaacagtatgtcggcggttgagaagaaccacatcatcaacgccctcggattcgagcttgaccactgtgaggatcctgtcgtgtacgagcgcatggtgacgcgattggccgatatcgacttgggtctcgcccagacagtcgccgagatggttggtggtgagccccccaaggaggccagccgtcccaaccacggccgcaaggcaccaggcttgagccaaacagagttccccggatcaaagcctaccattgcgtcccggagaatcgccatcttggttgccgatgggtacgatcaggtcgcctactcagctgcgtacgctgctatctcggctggcttggccatcccattggttatcggaaccaagagaagcaagattgttgccgccggtggagctggtagcaccacacctcatcatcacttggaaggcttccgctccaccatggtggacgccatcttcattcccggcggtgttgattccattcgcgctctgtccaagaacggcagagctctgcattggatcagggaggcctttggtcatctcaaggctattggagccacaggcgaagctgtcgacttggtcaacaaggccatcggcctgccagctgttagtgtctcggagagtgccgaggtccaggacagctatggtgtcgtgactatgcgtgagaccaagccaggaagcttgagtgaggcggtggacatcgtcaaggccggtgctggttttatggagaagttcttccacaacattgcccagcacaggtgctgggccagagagctggatggcctccacagccaggtggcctactag

SEQ ID NO: 43014 - protein, 736 aa, Podospora anserina
MASYLPSMEKVQHAVLGPRGGDKVADLQKETKEMSDKARLTTDYGVKQTSADDWLKIVNNDKTGPMLLEDPFARERIHRFDHERIPERVVHARGSGAFGKFKLFESAEDVTFAPILTDTSRETPIFIRFSTVLGSRGSADTVRDVRGFAIKFYTQEGNWDIVANNIPVFFIQDAIKFPDVIHAGKPEPHNEVPQAQTAHNNFWDFQYNHTEATHMFMWAMSDRGIPRSYRMMQGFGVNTFTLINAKGERHFVKFIFTPELGVHSLIWDEALKLAGQDPDFHRKDLWEAIENGVFPKWKFGIQVIPEADEHKFDFDILDATKIWPEDLVPVRYIGEFELNRNPDEFFPQTEQVAFCTSHIVPGIGFSDDPLLQGRNFSYFDTQLSRLGINWQELPINRPVCPVMNFNRDGAMRHTITKGTVNYWPNRFEKVKPATHEEGGYVEYAEKVAGIKARARSAKFKEHFAQAQLFWNSMSAVEKNHIINALGFELDHCEDPVVYERMVTRLADIDLGLAQTVAEMVGGEPPKEASRPNHGRKAPGLSQTEFPGSKPTIASRRIAILVADGYDQVAYSAAYAAISAGLAIPLVIGTKRSKIVAAGGAGSTTPHHHLEGFRSTMVDAIFIPGGVDSIRALSKNGRALHWIREAFGHLKAIGATGEAVDLVNKAIGLPAVSVSESAEVQDSYGVVTMRETKPGSLSEAVDIVKAGAGFMEKFFHNIAQHRCWARELDGLHSQVAY

SEQ ID NO: 43015 - DNA, 1368 bp, Staphylococcus aureus
  CDS (1)..(1368): transl_table=11
atgtcacaacaagacaaaaagttaactggtgtttttgggcatccagtatcagatcgagaaaatagtatgacagcagggcctaggggacctcttttaatgcaagatatttactttttagagcaaatgtctcaatttgatagagaagtaataccagaacgtcgaatgcatgccaaaggttctggtgcatttgggacatttactgtaactaaagatataacaaaatatacgaatgctaaaatattctctgaaataggtaagcaaaccgaaatgtttgcccgtttctctactgtagcaggagaacgtggtgctgctgatgcggagagtgacattcgaggatttgcgttaaagttctacactgaagaaggaaactgggatttagtagggaataacacaccagtattcttctttagagatccaaagctatttgttagtttaaatcgcgcggtgaaacgagatcctagaacaaatatgagagatgcacaaaataactgggatttctggacggggcttccagaagcattgcaccaagtaacgatcttaatgtcagatagagggattcctaaagatttacgtcacatgcatgggttcggttcacacacatactctatgtataatgattctggtgaacgtgtttgggttaaactccattttagaacgcaacaaggtattgaaaacttaactgatgaagaagctgctgaaattatagcaacaggtcgtgattcatctcaacgcgatttattcgaagccattgaaaaaggtgattatccaaaatggacaatgtatattcaagtaatgactgaggaacaagctaaaaaccataaagataatccatttgatttaacaaaagtatggtatcacgatgagtatcctctaattgaagttggagagtttgaattaaatagaaatccagataattactttatggatgttgaacaagttgcgtttgcatcaactaatattattccaggattagatttttctccagacaaaatgctgcaagggcgtttattctcatatggcgatgcgcaaagatatcgattaggagttaatcattggcagattcctgtaaaccaacctaaaggtgtgggtattgaaaatatttgtccttttagtagagatggtcaaatgcgcgtagttgacaataaccaaggtggaggaacacattattatccaaataaccatggtaaatttgattctcaacctgaatataaaaagccaccattcccaactgatggatacggctatgaatataatcaacgtcaagatgatgataattattttgaacaaccaggtaaattgtttagattacaatcagagggcgctaaagaaagaattttacaaatacagcaaatgcaatggaaggcgtaa

SEQ ID NO: 43016 - protein, 455 aa, Staphylococcus aureus
MSQQDKKLTGVFGHPVSDRENSMTAGPRGPLLMQDIYFLEQMSQFDREVIPERRMHAKGSGAFGTFTVTKDITKYTNAKIFSEIGKQTEMFARFSTVAGERGAADAESDIRGFALKFYTEEGNWDLVGNNTPVFFFRDPKLFVSLNRAVKRDPRTNMRDAQNNWDFWTGLPEALHQVTILMSDRGIPKDLRHMHGFGSHTYSMYNDSGERVWVKLHFRTQQGIENLTDEEAAEIIATGRDSSQRDLFEAIEKGDYPKWTMYIQVMTEEQAKNHKDNPFDLTKVWYHDEYPLIEVGEFELNRNPDNYFMDVEQVAFASTNIIPGLDFSPDKMLQGRLFSYGDAQRYRLGVNHWQIPVNQPKGVGIENICPFSRDGQMRVVDNNQGGGTHYYPNNHGKFDSQPEYKKPPFPTDGYGYEYNQRQDDDNYFEQPGKLFRLQSEGAKERILQIQQMQWKA

SEQ ID NO: 43017 - DNA, 1479 bp, Raphanus sativus
  CDS (1)..(1479)
atggatccttacaagtatcgtccagcgagttcatacaactctccattcttcaccaccaactccggtgctcctgtatggaacaacaactcctccatgaccgttggacccagaggtcctatccttcttgaggattaccatctcgttgagaagcttgccaacttcgacagggagcgtattccagagcgtgtggttcatgctagaggagcaagtgcaaagggtttcttcgaggtcactcatgatatatctaacctcacgtgtgccgacttcctcagagctccaggtgttcagaccccagtcattgttcgtttctccactgtcatccatgagcgtggaagtcccgagaccttgagagaccctcgtggctttgccgtcaagttctacaccagagagggaaactttgatcttgtcggaaacaacttccctgtcttcttcatccgcgacggtatgaagttccctgacatggtccacgctcttaagccaaacccaaaatctcacatccaagagaactggagagtccttgacttcttctcccaccaccctgagagcttaaacatgttcactttccttttcgatgacatcggtatcccacaagactaccgccacatggaaggttcaggtgtcaacacatacatgctgatcaacaaatccggcaaagctcactacgtgaagttccactggaaaccaacatgtggagtcaagtctctgttagaagaagatgcaatccgcgttggtggaaccaaccacagccacgcgactcaggacttgtacgactccatcgctgctggtaactaccctgagtggaagctctttgttcagataatcgatccggcggatgaagacaagttcgactttgaccctctcgatgtgaccaagacctggcctgaggatctcttgcctctccagcccgttggtcgtatggtgttgaacaagaacattgataacttctttgcggagaatgagcagcttgccttctgccctgcgatcattgttccggggatacactactctgatgacaagctgcttcaaacacgtgtcttctcctatgcggatactcagagacaccgtcttggacctaactaccttcagctaccagtgaatgctccaaaatgtgctcaccacaacaaccaccatgagggcttcatgaatttcatgcacagggacgaggaggttaactacttcccttcgaggtatgacccggttcgccatgctgagaagtatccaactccaccagcagtctgctctgggaagcgtgagaggtgcattattgagaaagagaacaacttcaaggagcctggagagagataccgttcctttacaccagagaggcaagaacgtttcatcggtagatggattgatgctctatcagaccctcgcatcacacatgaaatccgcagtatctggatctcttactggtctcaggctgataagtcactgggacagaagctggcaagccgtctgaacgtgagaccaagcatctaa

SEQ ID NO: 43018 - protein, 492 aa, Raphanus sativus
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPTCGVKSLLEEDAIRVGGTNHSHATQDLYDSIAAGNYPEWKLFVQIIDPADEDKFDFDPLDVTKTWPEDLLPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAVCSGKRERCIIEKENNFKEPGERYRSFTPERQERFIGRWIDALSDPRITHEIRSIWISYWSQADKSLGQKLASRLNVRPSI

SEQ ID NO: 43019 - DNA, 1479 bp, Helianthus annuus
  CDS (1)..(1479)
atggatccctacaagcaacgcccttcgagtgcttacgatacccctttctggactacaaatgccggtgcacccgtttacaacaatactgcatcattgactgtgggcaatagaggtccaattctcctggaggactatcatttgatcgagaaactagccaacttcactcgtgaaaggatcccagaacgtattgtgcatgcaagaggtgcgagtgcaaaggggttcttcgaggtcactcatgacatcacccatctcacctgtgcagatttccttcgtgctcctggagtccagactccggttatcgttcgattctcaaccgttatccatgaacgaggaagccctgaaaccatcagagaccccagaggttttgcaacaaagttttataccagagagggtaactttgatattgtggggaacaacttccccgtgttctttactcgcgacgcaatggcattcccggatgtgattcatgctttcaaaccaaaccccaagtcacacatccaagaagactggaggatcctcgacttcttgtcacaccatcctgagagcttgaacactatgacattctggctcgatgacgtcggtatcccaaccgattacaggcacatggaagggtcaagtgtcaacaccctcactttagttaacaaagaaggtaaaatacactatgtgaagttcacatggaagcccacatgtggagtcaagtgtttgatggatgatgaagctatcaaaatcggaggagctaatcacagtcacgccactcaagatctttacgattcgattcaagccggtaacttccctgaatggaagctgtttcttcaagttattgacccggatcatgaagacaggcttgactttgacccgctcgatggcaccatgacctggcctgaggatgtgataccgctgcagcctgtcgggcgtatggtgttgaataagaatattgataacttctttgctgagaatgaacagctggcgttcaacccgggtcttgttgtcccgggaatttattattctgatgataagatgcttcaaggtcggatcttcgcgtattctgatacgcagaggcaccgtcttggaccgaactatttgcagcttccggttaatgcgcctaaatgcgctcatcataataatcactatgatggacatatgaattttatgcacagagatgaggaggttgattacttcccttcgaggtatgatcgtgttcaacatgctcagaaatacccgatcaatccggctagggttactggaacccgtgacaggactgtgatcccaaaatataacgatttcaagcagccaggggagagatacagatcatgggatccagccaggcaagaaagattcattgtccgaatgtgtaagatgttgtccgacccacgggttacccacgaacttcgcagtatttggatctcatattggacccaagctgacaagtctctggggcagaagatagcatcacgtctcaatgtgcgccccaactactga

SEQ ID NO: 43020 - protein, 492 aa, Helianthus annuus
MDPYKQRPSSAYDTPFWTTNAGAPVYNNTASLTVGNRGPILLEDYHLIEKLANFTRERIPERIVHARGASAKGFFEVTHDITHLTCADFLRAPGVQTPVIVRFSTVIHERGSPETIRDPRGFATKFYTREGNFDIVGNNFPVFFTRDAMAFPDVIHAFKPNPKSHIQEDWRILDFLSHHPESLNTMTFWLDDVGIPTDYRHMEGSSVNTLTLVNKEGKIHYVKFTWKPTCGVKCLMDDEAIKIGGANHSHATQDLYDSIQAGNFPEWKLFLQVIDPDHEDRLDFDPLDGTMTWPEDVIPLQPVGRMVLNKNIDNFFAENEQLAFNPGLVVPGIYYSDDKMLQGRIFAYSDTQRHRLGPNYLQLPVNAPKCAHHNNHYDGHMNFMHRDEEVDYFPSRYDRVQHAQKYPINPARVTGTRDRTVIPKYNDFKQPGERYRSWDPARQERFIVRMCKMLSDPRVTHELRSIWISYWTQADKSLGQKIASRLNVRPNY

SEQ ID NO: 43021 - DNA, 1479 bp, Helianthus annuus
  CDS (1)..(1479)
atggatccctacaagcaacgcccttcaagtgcttacaacgcccctttctggactacaaatgcgggtttaccggtttacaacaacactgcatcattgactgttggaaatcgaggtccaattctccttgaggactatcatttgattgagaaacttgccaacttcactcgcgagcggatccccgaacgtatcgttcatgcgaggggtgcgagcgcaaaggggttcttcgaggtcacacacgacatcactcatctcacctgcgctgacttcctccgcgcccctggagttcaaactcctaccattgttcgtttctcgactgttatccatgaacgtggaagccccgaaaccatccgagatccccgaggatttgcaacaaagttctacaccagagagggtaactttgacatcgtgggaaacaatttccccgtgttctttacgcgcgacgcaatggcgttcccagacgtgatccacgcgtttaaaccaaacccgaagtcacacatccaagaagactggaggattcttgacttcttgtcacaccatccagagagcttgaacaccatgacattctggctcgatgatgtcggtatcccaaccgattaccgacacatggaaggctcgagtgtcaacactctcactttagttaacaaagaaggaaaaattcactatgtgaagttcacatggaagcccacatgtggagtcaaatgtttgatggacgacgaagcgatcaaaatcggaggcgcgaatcacagtcacgccactcaagatctttacgattcgatccaagctggtaacttccctgaatggaagctgtatctccaagtgattgaccctgatcatgaagataggcttgactttgacccgctcgatggcaccatgacctggcccgaggacatcatacctttgcagcccgttgggcgtatggtgttgaacaagaacattgacaacttctttgctgaaaatgaacagctagcgttcaacccgggtcttgttgttcctgggatttattactctgatgataagatgcttcaagggcgtattttcgcgtactctgatacccaaaggcaccgtctcggaccgaattacttgcagctccctgtcaatgcacctaagtgtgctcatcataataatcattatgatggaaacatgaacttcatgcacagagatgaggaggttgattacttcccttcgaggtatgatcgtgttcaacatgctaagcagtacccgatcaattcccgtcaagttactggaacccgtgacaggactgtgatcccaaaatacaacgatttcaagcagcccggagacagataccgatcatgggatccagccaggcaagaaagattcattgtccgaatgtgtaagatgttgtctgacccacgggtaacccacgaactccgcagtatttggatctcctactggacccaggccgaccagtctctggggcagaagatagcatcacgcctcaatgtgcgccccaattattga

SEQ ID NO: 43022 - protein, 492 aa, Helianthus annuus
MDPYKQRPSSAYNAPFWTTNAGLPVYNNTASLTVGNRGPILLEDYHLIEKLANFTRERIPERIVHARGASAKGFFEVTHDITHLTCADFLRAPGVQTPTIVRFSTVIHERGSPETIRDPRGFATKFYTREGNFDIVGNNFPVFFTRDAMAFPDVIHAFKPNPKSHIQEDWRILDFLSHHPESLNTMTFWLDDVGIPTDYRHMEGSSVNTLTLVNKEGKIHYVKFTWKPTCGVKCLMDDEAIKIGGANHSHATQDLYDSIQAGNFPEWKLYLQVIDPDHEDRLDFDPLDGTMTWPEDIIPLQPVGRMVLNKNIDNFFAENEQLAFNPGLVVPGIYYSDDKMLQGRIFAYSDTQRHRLGPNYLQLPVNAPKCAHHNNHYDGNMNFMHRDEEVDYFPSRYDRVQHAKQYPINSRQVTGTRDRTVIPKYNDFKQPGDRYRSWDPARQERFIVRMCKMLSDPRVTHELRSIWISYWTQADQSLGQKIASRLNVRPNY

SEQ ID NO: 43023 - DNA, 1479 bp, Helianthus annuus
  CDS (1)..(1479)
atggatccttacaagtaccgtccgtcaagcgcttacaatgccccgttttggaccactaattatggtgctccggtttacaacaacgactcctcattgacagttggcaccagaggcccaatccttctagaagattaccactttgtggagaaactagctaacttcgaccgtgaacgtatacccgaacgcgtggttcatgccagaggtgctagcgcaaagggctttttcgaagtcacacacgacatttctgccctcacatgtgccgattttcttcgcgcccctggtgtccaaacacctgttatcgtccgtttctctactgttattcacgagcgtggaagtcccgaaaccctcagagaccctagaggtttcgcagtcaaattctatacccgagagggaaacttcgatttggtgggaaacaacttccccgtgttctttgttcgcgacgggatgaagtttccggacatggttcattcactaaaaccgaatcctaagtcacacattcaagaagactggagaattctcgactttttctcgcaccatcccgagagtctacacatgttcacatttcttcaagacgacgttggcgtgccgcaagattaccgacacatggacggttctggtgtcaacacctacactctgattaacaaaaccgggaaaacacattacgtgaagtttcactggagaccgacatgcggagtaaaatgcttgttggaggacgaagccatcaaggttggtggaatgaatcacagccacgcaacaaaagatctttacgattctattgcggatgggaattatccggaatggaagcttttcattcagactatggatccggatcatgaggataggtttgactttgacccgcttgatgtgaccaagacctggcccgaggatatcttgcctttgcagcctgtgggtcgtatggttttgaacaagaacattgataacttctttgcggagaatgaacaactggcgttttgccctgcgatcattgtgcctgggatttattattcggatgataagctgcttcaaacgcgtatcttctcgtatgctgacacgcagaggcatcgtcttggaccgaactatttgcagcttcctgctaacgctcctaagtgtgctcatcataataatcatcatgatggattcatgaatttcatgcacagggatgaggaggtgatttacttcccttcaagatacgatcccgttcgtcatgctgagcagtcccctattcctcctgtaatgctgtcaggaaagcgcaataagtgtgtgatcgagaaagagaacaacttcaagcagccaggagagagatttagatcctgggatccagataggcaagaacgatttatccgcagaattgtcggtgctctgtctgatccgcgtgttacccacgaggtctgcacaatttgggtttcatactggtctcaggctgacaagtctcttgggcagaagatagcttcccgcttgaatgtgaagccaagttactaa

SEQ ID NO: 43024 - protein, 492 aa, Helianthus annuus
MDPYKYRPSSAYNAPFWTTNYGAPVYNNDSSLTVGTRGPILLEDYHFVEKLANFDRERIPERVVHARGASAKGFFEVTHDISALTCADFLRAPGVQTPVIVRFSTVIHERGSPETLRDPRGFAVKFYTREGNFDLVGNNFPVFFVRDGMKFPDMVHSLKPNPKSHIQEDWRILDFFSHHPESLHMFTFLQDDVGVPQDYRHMDGSGVNTYTLINKTGKTHYVKFHWRPTCGVKCLLEDEAIKVGGMNHSHATKDLYDSIADGNYPEWKLFIQTMDPDHEDRFDFDPLDVTKTWPEDILPLQPVGRMVLNKNIDNFFAENEQLAFCPAIIVPGIYYSDDKLLQTRIFSYADTQRHRLGPNYLQLPANAPKCAHHNNHHDGFMNFMHRDEEVIYFPSRYDPVRHAEQSPIPPVMLSGKRNKCVIEKENNFKQPGERFRSWDPDRQERFIRRIVGALSDPRVTHEVCTIWVSYWSQADKSLGQKIASRLNVKPSY

SEQ ID NO: 43025 - DNA, 2109 bp, Xanthomonas campestris
  CDS (1)..(2109): transl_table=11
atggccaagtcccccagcaaatccgcgcaggtccctgcccttgcacctgtcagcgccaccgtcgatggggcgcgcggtactggcgatgagttgcaccagaaggcaggcggcacgcacccgcaactgaccaccaaccagggcattccggtcggtgacaaccagaactcgctccgcgccacgccgcgcggcccgacgttgctggaagatttcatcctgcgcgaaaagatcacccacttcgatcacgaacgcattcccgaacgcatcgtgcatgcgcgcggcagtgccgcgcacggctacttcgaactcaccaagtcgttgagccagtacaccaccgccaagatctttaccgaggttggcgaaaaaactccgttgtttacgcgtttttccactgtcgcaggtggcgccggctcggtggatacgccgcgcgatgtgcgcggcttcgcggtgaagttctacaccaaggaaggcaattgggatctggtcggcaacaacatcccggtgttcttcatccaggatgcgatgaaattcccggacctgattcatgcggtgaagatggagccggaccgtggtttcccccaggctgccagcgcgcacgacacgttctgggatttcatttcgctgacacccgaatcgatgcacatggtgatgtgggcgatgagcgaccgcaccatcccgcgctcgctacgcatgatcgaagggttcggcatccacagcttccggttcctcaatgacaagggcgaaagcaccttcgtcaagttccattggcgccccaagctgggcctgcaatcgaccatctgggacgaggcggtcaagatcgccggcgccgatcaggatttccaccgccgcgacctgttcgaagcgatccagaacggcgatttccccgaatgggaactcggcgtgcaattgttcaccgaagcgcaggcagcaacgttcccgttcgatcatctggattcgaccaaggtcattcccgaggagctggtgccgttgcagatcgtcggccgcatggtgctcgaccgctggccggacaacttctttgccgaaaccgagcaggttgcctactgcccggccaacatcgtgcccggcatcgacttcagcaacgacccgctgctgcaaggccgcctgttctcctatctggatacgcagctgagccgtctgggcgggccgaatttccatcagattccggtcaacgcgccaaagtgcccgttcgccaacaaccagcgcgatggtcacatgcagatgggcgtgcccaagggccgcgttgcctatgagcccagctcgctgcaggccgatgcgccgcgtgaagcgctgcgtggtttccccagccacgcaactcctgccgaagaaggtgccaagggccgcgtgcgcgcagaaagcttcgccgatcactacagccaggcgcgcctgttcttccgcagccagaccgcaccggaacaggcgcatatcgcctcggcattggtgttcgaactgtcgaaggtggagaccgctcacgtgcgcgaggccatcgtgggtcatctgcgccacatcgaccaggaactggcgcagcgtgtggccgatggcatgggcatgacggccctgccgccagcccccccggcggcagtggcgccgatcgacatgccgctctcgcctgccttgcaggtcatcggcaagatgaaggacaccttgaaagggcgcacggtgggcatcctgatccacgacggctcggacgcagcagcgatcaaggcagtccgcaaggcggccgaagctgcaggcgcgacggtcaagatcgttgcgcccaaactcggcggcgccaagcttagcgacggcaagcagcttgccgccgatgggcaactggcgggcacgccctcggtggtcttcgatgcggtggcggtgctgctgtcctcggaagcggccaagctgctgacacgcgaatcggcggcactgaattttgtgagctttgcctgggcgcatctgaaggccatcgcattcgacgaaggcgcgcaggtgttgttgaaggccggcaacgtgggcaaggatgcgggcgtcgttcccgctgccgataccaaggcattcatcaccgcagcaaaaacccgccaatgggcacgcgagccgaaggtgcgcatgctggcgtaa

SEQ ID NO: 43026 - protein, 702 aa, Xanthomonas campestris
MAKSPSKSAQVPALAPVSATVDGARGTGDELHQKAGGTHPQLTTNQGIPVGDNQNSLRATPRGPTLLEDFILREKITHFDHERIPERIVHARGSAAHGYFELTKSLSQYTTAKIFTEVGEKTPLFTRFSTVAGGAGSVDTPRDVRGFAVKFYTKEGNWDLVGNNIPVFFIQDAMKFPDLIHAVKMEPDRGFPQAASAHDTFWDFISLTPESMHMVMWAMSDRTIPRSLRMIEGFGIHSFRFLNDKGESTFVKFHWRPKLGLQSTIWDEAVKIAGADQDFHRRDLFEAIQNGDFPEWELGVQLFTEAQAATFPFDHLDSTKVIPEELVPLQIVGRMVLDRWPDNFFAETEQVAYCPANIVPGIDFSNDPLLQGRLFSYLDTQLSRLGGPNFHQIPVNAPKCPFANNQRDGHMQMGVPKGRVAYEPSSLQADAPREALRGFPSHATPAEEGAKGRVRAESFADHYSQARLFFRSQTAPEQAHIASALVFELSKVETAHVREAIVGHLRHIDQELAQRVADGMGMTALPPAPPAAVAPIDMPLSPALQVIGKMKDTLKGRTVGILIHDGSDAAAIKAVRKAAEAAGATVKIVAPKLGGAKLSDGKQLAADGQLAGTPSVVFDAVAVLLSSEAAKLLTRESAALNFVSFAWAHLKAIAFDEGAQVLLKAGNVGKDAGVVPAADTKAFITAAKTRQWAREPKVRMLA

SEQ ID NO: 43027 - DNA, 1455 bp, Actinobacillus actinomycetemcomitans
  CDS (1)..(1455): transl_table=11
atgtcagcaaaatgccctttcgatcataactctgccacattgactaccgctgccggcgcgccggtggtggataatgacaacaccatgagtgccggcccccgcggcccgttactgttacaagatgtttggtatcaagaaaaactagcccactttgcccgcgagcgcattcctgagcgtgtggtgcacgccaagggttccgccgcattcggtacattcaccgtcactcacgacatcacccaatacaccaaagctgcgctgttcagcgaagtgggcaaacaaacggaagtgctgttgcgcttttccaccgttgccggcgaacgcggtgctgccgacgcggaacgtgatgtacgcggtttttcgttgaaattctacaccgaacaaggcaactgggacttagtgggcaataacacgccggtgttcttcatccgtgacccgctcaaattcccggatttcattcacactcaaaaacgcaacccgcaaaccaacttacgcgacgctaccgccgcatgggatttctggtcgcgtcatcctgaatccatgcaccaaattatgattctgttcagcgatcgtggtattccggcaagcctgcgcaatatgaacggttacggcagccacacttacagctttatcaatgcggacaacgaacgcttttgggtgaaatttcacttcaaaacccaacaaggtcataaatttttaaccaacgcagaagcggcgaaggtggtgggtgaagatcgtgaatccagccaacgtgatttatatgatgccattgccaacggcaatttcccccgttggaacgtgcgaattcaaatcatgccggaagccgatgcagaaaaacacaattacagttttgacttaaccaaagtatggccgcacaaagattatccgttgattgatgtaggcgtattggaactgaatcgcaatccgcaaaactattttgctgaagtggaacaagccgccttcgcgccgaacaacaacgtgcccggcatcggcttctcgcccgatcgtatgttgcagggtcgtttattctcttatcaagatgcacaacgctaccgcttgggcgtaaaccaccaccaaattccggtgaatgcaccaaaatgcccgtatcacaccacccaccgtgacggtgcaatgcgcgtagatcacaacggcggcacacacccgaactatgctccaaaccgctttgacacctatgtgccaacccacgatcaaggtccgtcattgcaactggaacgtgaaggcgcgcactttaatttccgtgattacgacgaagattactactcacaacctgccgcgctttacgccattatggacgccgcccaacgcgaccgcctcgccggcaacttcgccgccagcctggcagaagtcaccgacgatgccatcgtggaacaccagttggtacactttgaacgcgttaatacggaattggcaaacgccattcgcacaaaacttgcttga

SEQ ID NO: 43028 - protein, 484 aa, Actinobacillus actinomycetemcomitans
MSAKCPFDHNSATLTTAAGAPVVDNDNTMSAGPRGPLLLQDVWYQEKLAHFARERIPERVVHAKGSAAFGTFTVTHDITQYTKAALFSEVGKQTEVLLRFSTVAGERGAADAERDVRGFSLKFYTEQGNWDLVGNNTPVFFIRDPLKFPDFIHTQKRNPQTNLRDATAAWDFWSRHPESMHQIMILFSDRGIPASLRNMNGYGSHTYSFINADNERFWVKFHFKTQQGHKFLTNAEAAKVVGEDRESSQRDLYDAIANGNFPRWNVRIQIMPEADAEKHNYSFDLTKVWPHKDYPLIDVGVLELNRNPQNYFAEVEQAAFAPNNNVPGIGFSPDRMLQGRLFSYQDAQRYRLGVNHHQIPVNAPKCPYHTTHRDGAMRVDHNGGTHPNYAPNRFDTYVPTHDQGPSLQLEREGAHFNFRDYDEDYYSQPAALYAIMDAAQRDRLAGNFAASLAEVTDDAIVEHQLVHFERVNTELANAIRTKLA

SEQ ID NO: 43029 - DNA, 1479 bp, Oryza sativa
  CDS (1)..(1479)
atggatccctacaagcatcggccgtccagcgggagcaattccaccttctggaccaccaactccggcgcccccgtctggaacaacaactccgccctcaccgtcggagagcgaggccctatcctccttgaggactatcatctgattgaaaagcttgcacagtttgacagggagcgtatccctgaacgtgtcgttcatgcaaggggagccagtgccaagggattttttgaggttactcatgatatttctcacctcacatgtgctgattttctccgtgctcctggtgttcagaccccagttattgttcggttctccacagtcgtgcatgagcgtggaagccctgagacattgagggaaccacgtggttttgctgtcaagttttacactagagagggtaattttgatcttgttgggaacaatatgcctgtcttttttatccgagatgggatgaaattccctgacatggtccatgctttcaagccaagtccaaagaccaatatgcaggagaactggagaatagttgatttcttttcacaccacccagagagcctgcacatgttctccttcctctttgacgatgtaggcatcccactcaaccacaggcacatggagggttttggtgtcaacacctacaccctaatcaataaggatggaaagcctcaccttgtcaaattccactggaagcctacctgtggtgtcaaatgcctgttggatgatgaagctgtgactgttggcggcacctgccacagccatgccacgaaggacttgactgattctattgcagcagggaattacccagagtggaagctttacatccagactattgatcctgatcatgaggacagatttgacttcgatcctcttgatgtcaccaagacatggccagaggatatcatccccctgcagccagttggacggatggtcctgaacaaaaacattgataacttctttgcagaaaatgaacagcttgctttctgcccagcgataattgtccctggaatccattactctgatgataagctgctccagacaagaattttctcctatgctgatacccaaaggcaccgtcttggcccaaactatttgatgcttcctgtgaatgcaccaaaatgtgcataccacaacaaccaccacgatggctccatgaatttcatgcacagggatgaagaggttaactacttcccttcaaggtttgatgctgcacgtcatgctgagaaggtccctattcctcctcgtgttctaacaggctgtcgggaaaagtgtgtcattgacaaggagaacaatttccaacaggctggtgagagataccggtcatttgaccctgccaggcaagatcgttttctccagcggtgggttgatgctctctcagatcctcgtattacacatgaactccgtggcatctggatctcctactggtcgcagtgtgatgcgtcccttgggcagaagctggcttcacgtctcaacctgaaaccaaacatgtag

SEQ ID NO: 43030 - protein, 492 aa, Oryza sativa
MDPYKHRPSSGSNSTFWTTNSGAPVWNNNSALTVGERGPILLEDYHLIEKLAQFDRERIPERVVHARGASAKGFFEVTHDISHLTCADFLRAPGVQTPVIVRFSTVVHERGSPETLREPRGFAVKFYTREGNFDLVGNNMPVFFIRDGMKFPDMVHAFKPSPKTNMQENWRIVDFFSHHPESLHMFSFLFDDVGIPLNHRHMEGFGVNTYTLINKDGKPHLVKFHWKPTCGVKCLLDDEAVTVGGTCHSHATKDLTDSIAAGNYPEWKLYIQTIDPDHEDRFDFDPLDVTKTWPEDIIPLQPVGRMVLNKNIDNFFAENEQLAFCPAIIVPGIHYSDDKLLQTRIFSYADTQRHRLGPNYLMLPVNAPKCAYHNNHHDGSMNFMHRDEEVNYFPSRFDAARHAEKVPIPPRVLTGCREKCVIDKENNFQQAGERYRSFDPARQDRFLQRWVDALSDPRITHELRGIWISYWSQCDASLGQKLASRLNLKPNM

SEQ ID NO: 43031 - DNA, 1479 bp, Zantedeschia aethiopica
  CDS (1)..(1479)
atggatccctataggcaacgcccctcgagcgcgttcaactcgcccttctggaccaccaactccggggcgcccgtctggaacaacaacaattcgctcactgttggagccaggggacctatactccttgaggattaccatttgcttgaaaagcttgcacagtttgatagggagcgaattcctgaacgtgttgttcatgccaggggtgctagtgccaagggcttctttgaggttacccatgatgtttctcatcttacttgtgctgattttctgcgggcaccaggtgtccagacgcctgtgattgttcgtttttcgactgttattcacgagagggggagccctgagactttgagagacccaagaggttttgctgtgaagttctacactagagagggtaactttgatcttgtggggaataatttcccagtgttttttatccgtgatggcattaaattccctgacatggtccacgcattgaagccaaacccgaaaacacacatccaagagaactggaggatccttgactttttctctcaccacccagagagtctgcatatgtttacatttctctttgatgacattggtattcctacagactataggcatatggatggttcaggtgtgcacacctacacacttgtcagcaaggaagggaaagcccattatgttaagttccactggaaacccacatgtggagtgaaatctctgttggatgatgaggctgttgtggttggaggtgccaatcatagtcatgccaccaaggatcttactgatgccattgctgctggtaactaccctgagtggaagctctatattcagataatggatccggatcatgaggacaggttcgattttgacccacttgatgtcaccaagacatggcctgaagatatcttgcctctccagccagttggacgcatggtcttgaacaagaatatcgataacttctttgcagagaatgaacagctagctttttgcccagcaatcattgtgcctggaatctattattcagacgataagttgctacagactaggatcttctcctatgctgatactcagagacaccgcctggggccaaactacttgatgctcccagcaaatgcaccaaaatgtgctcaccacaacaaccaccatgagggttttatgaatttcatgcacagggatgaggaggtaaattacttcccttcaagatatgatcctgtccgacatgctgaacagttccccattcctccccgtattcttaatggaggacgtgagaagtgttgcattcaaaaggaaaacaacttcaaacagcctggagagaagtaccggtcctgggcccctgacaggcaagagcgtttcattaagcgctggatcgatgcactctctgatcccagggtcacccatgaaatccgcaccatttggattacatactggtcacagtgcgacaagtttcttggccagaagctggccagtcgccttaacatcaagcccactttgtga

SEQ ID NO: 43032 - protein, 492 aa, Zantedeschia aethiopica
MDPYRQRPSSAFNSPFWTTNSGAPVWNNNNSLTVGARGPILLEDYHLLEKLAQFDRERIPERVVHARGASAKGFFEVTHDVSHLTCADFLRAPGVQTPVIVRFSTVIHERGSPETLRDPRGFAVKFYTREGNFDLVGNNFPVFFIRDGIKFPDMVHALKPNPKTHIQENWRILDFFSHHPESLHMFTFLFDDIGIPTDYRHMDGSGVHTYTLVSKEGKAHYVKFHWKPTCGVKSLLDDEAVVVGGANHSHATKDLTDAIAAGNYPEWKLYIQIMDPDHEDRFDFDPLDVTKTWPEDILPLQPVGRMVLNKNIDNFFAENEQLAFCPAIIVPGIYYSDDKLLQTRIFSYADTQRHRLGPNYLMLPANAPKCAHHNNHHEGFMNFMHRDEEVNYFPSRYDPVRHAEQFPIPPRILNGGREKCCIQKENNFKQPGEKYRSWAPDRQERFIKRWIDALSDPRVTHEIRTIWITYWSQCDKFLGQKLASRLNIKPTL

SEQ ID NO: 43033 - DNA, 1479 bp, Manihot esculenta
  CDS (1)..(1479)
atggatccttgcaagttccgtccatcaagctcaaacaatacccccttctggaccaccgatgctggtgctccagtatggaacaacaattcctccatgactgttggaaccagaggtccaatccttttggaggactatcatatgatagagaaacttgccaactttaccagagagaggattccagagcgtgtcgtccatgctaggggaatgagtgcaaagggcttctttgaagtcacccacgatgtctctcaccttacttgtgctgatttccttcgagcccctggagttcaaacccctgtcatcgtccgtttctccactgttatccacgagcgtggcagccctgaaacactcagggatcctcgaggttttgcgactaagttctacaccagagagggcaactttgatattgtgggaaacaacttccctgtcttcttcatccgtgatggaataaaattcccagatgtgatacacgcttttaagcccaatcccaagtctcacatccaagaatactggaggatctttgacttcttatcacaccatcctgagagcttgagcaccttcgcctggttcttcgatgatgttggaattccccaagattacagacacatggaaggtttcggtgttcacacctttactttcatcaacaaggctggaaaagtaacctacgtgaaatttcactggaaacccacttgcggggtcaagtgtttgatggatgatgaggcacttaagatcggaggtgccaaccacagccatgctacgcaggatttatacgactccattgccgctggcaactatcctgagtggagactcttcatccagacaatggatccagctgatgaagacaaattcgactttgatccacttgatatgaccaagatctggcctgaggatatttttcctctacagcaaattggccgtttggtcttgaacaggaacatcgataactggtttgctgagaatgaaatgctcgcattcgaccctggtcatattgttcctggcattcactattcaaacgacaagttgtttcagctcagaacctttgcatatgctgacactcagaggcaccgtctcggacccaactataagatgctccctgttaatgctcccaagtgtgcttatcacaacaatcattacgatggtttcatgaatttcatgcacagggatgaggaggtggattacttcccatccaggtatgatccagttcgccatgctgagagaagccccattcctaacgctatctgtagtggaaggcgtgaaaagtgcgtcattgaaaaggagaacaatttcaagcaacctggagagagatatcgatcctgggcacctgatagacaagaaagattcctgtgcagattggttaacgccttatcagagccacgtatcacctttgagattcgcagtatctgggtctcttactggtctaagtgcgacgcgtctctgggtcaaaagctggcttctcgtctcaacgtgaggccaaatatatga

SEQ ID NO: 43034 - protein, 492 aa, Manihot esculenta
MDPCKFRPSSSNNTPFWTTDAGAPVWNNNSSMTVGTRGPILLEDYHMIEKLANFTRERIPERVVHARGMSAKGFFEVTHDVSHLTCADFLRAPGVQTPVIVRFSTVIHERGSPETLRDPRGFATKFYTREGNFDIVGNNFPVFFIRDGIKFPDVIHAFKPNPKSHIQEYWRIFDFLSHHPESLSTFAWFFDDVGIPQDYRHMEGFGVHTFTFINKAGKVTYVKFHWKPTCGVKCLMDDEALKIGGANHSHATQDLYDSIAAGNYPEWRLFIQTMDPADEDKFDFDPLDMTKIWPEDIFPLQQIGRLVLNRNIDNWFAENEMLAFDPGHIVPGIHYSNDKLFQLRTFAYADTQRHRLGPNYKMLPVNAPKCAYHNNHYDGFMNFMHRDEEVDYFPSRYDPVRHAERSPIPNAICSGRREKCVIEKENNFKQPGERYRSWAPDRQERFLCRLVNALSEPRITFEIRSIWVSYWSKCDASLGQKLASRLNVRPNI

SEQ ID NO: 43035 - DNA, 1479 bp, Brassica juncea
  CDS (1)..(1479)
atggatccttacaagtatcggccggcgagttcttacaactctccattcttcaccaccaactctggtgctcctgtatggaacaacaactcctccatgaccgttggacccagaggtcctatccttcttgaggattaccatctcgtcgagaagcttgccaacttcgacagggagcgtattccagaacgtgtggttcacgcaagaggagccagtgcaaagggtttcttcgaggtcacgcatgatatatccaacctaacgtgtgcagacttccttagagctccaggtgtacagacaccggtcattgtccgtttctccaccgttatccatgaacgtggaagtcccgagaccttgagagaccctcgtggcttcgcagtcaagttctacaccagagaagggaactttgatcttgtcggaaacaacttccctgtcttcttcataagggacgggatgaagttccctgacatggtccacgctcttaaaccaaaccctaaatctcacatccaagaaaactggagagtccttgacttcttctcacaccaccctgagagcttgaacatgttcactttcctctttgacgacatcggtatcccgcaagattacagacacatggaaggctcaggtgtgaacacctacatgctcatcaacaaatccggcaaagctcactacgtgaagttccactggaaaccaacatgtggagtaaagtctcttttagaagaagatgcagtccgtgtaggaggaaccaaccacagtcacgccacacaggacttgtatgactccattgctgctggaaactaccctgagtggaagctctttatccaggtcattgatccagctgacgaagacaagttcgactttgacccactcgatgtcaccaagacctggcctgagaatcttttgcctctccaacccgttggtcgtatggtgttgaacaagaacattgacaacttctttgcggagaatgagcagcttgccttttgccctgctatcattgttcctgggatacattactcggacgacaagctgcttcagacgcgtgtcttctcttatgctgacactcagagacaccgccttggaccgaactaccttcagctgccagttaatgcacccaaatgtgctcatcacaacaatcaccatgaggggttcatgaacttcatgcacagggacgaggaggtcaactacttcccatcgaggtatgatcctgttcgtcatgctgagaagtatccaactccacctgctgtctgctctgggaaacgtgagagatgtgttattgagaaagagaacaacttcaaggagcctggagagagataccgttcctttacaccagagaggcaagaacgtttcatccgtagatggattgaagccttatctgacccccgcatcacacatgaaatccgcagcatctggatctcttactggtctcaggctgacaaaactctgggacagaagcttgcaagccgtctgaacgtgagaccaagcatctaa

SEQ ID NO: 43036 - protein, 492 aa, Brassica juncea
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPTCGVKSLLEEDAVRVGGTNHSHATQDLYDSIAAGNYPEWKLFIQVIDPADEDKFDFDPLDVTKTWPENLLPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAVCSGKRERCVIEKENNFKEPGERYRSFTPERQERFIRRWIEALSDPRITHEIRSIWISYWSQADKTLGQKLASRLNVRPSI

SEQ ID NO: 43037 - DNA, 2250 bp, Ajellomyces capsulata
  CDS (1)..(2250)
atgactagcaaggttgaagaagggctccagagggtcaaggagctggtggaaaatatgcagccaggagagcaaaaggtcgcagacctcgcccgcgatactacagacgtcaacggatgcctccccttcaccactgaccatggagtcaaagttagcaatacggacttttggcttcgacttgcatccgaaaatcaaaccggcccattgcttttggaggatcagattgctcgtgaaaagatccatcgatttgaccatgaaagaatcccagaacgtgttgtccatgcacgaggaacaggtgcttttgggcacttcaagctcttcgagagcgcggcagacgtgacgtccgctggtgttctaactgacacgtcccgaactactccggtgttcgttcggttttccaccgtccagggcagcaaaggcagtttcgatacagtccgtgatgtcagaggtttcgctaccaaattctatacggaagaaggcaactgggatcttgttggcaataacattcctgtattcttcattcaagatgctgtgaaattcccagattttgttcatgctgtgaagccggaacctcataacgaagttccccagggacaaacagcacataacaacttctgggactttgtatatatgcatcctgaggcgacgcatatgttcatgtgggctatgtcggacagggctattccgcgatcatatcggatgatgcaaggatttggtgttaatacttttgttttggtgaataaacaagggaaaagacatttcgttaagtttcactggatgccggaacttggggttcattcgctggtccccgatgaatcattcaaacttggtggccaggacccagacttccaccgtaaagatctaatggaggcaatcgacaataaggtgtacccgaaatggaagtttggaattcaggttcttcctgaagaaaaagagcacgattttgattttgatatacttgatccaactaagatatggccagagagcctaatacctgttcggtatattggagagatggagctcaaccgcaacgtcgatgagtttttcccacagacagaacaggttgccttctgtaccgcccacattgttcctggaattgaattctccggcgatcctctgctccagggacgcaatttctcctattttgacactcaaattacccgccttggcgtcaactgggaggagctcccgatcaatcgtcctgtgtgccctgttatgaatcacaacagggatggtgcaatgcgccataagataacccaaggaaccgtaaactattggccgaaccgtttcgaggcttgcccacccacgaagcccgaggatgggggttttgtcacttaccctcaaaaggtagagcagagtatcaaagcgaggatgcttagtagcaagttccgcgagcatatcaaccaagcgcaattattctataactctctctccgaatacgaaaagctccatgtcaataatgctttttgctttgagttggatcactgcgatgaccccattgtctacaatagacttgtgtctcggatttctgaaatcgaccatgccctcgcccaagccgttgcagtgaaagtcggcgcaccgaccccaccaaggcctgggagagacaacccaggtcaaacaaccattaacctaagccaaaaatacatcaacgaccgtcagctgtcctctcccacaattaaaggtcggaggatcgccatattgattggggatggttacgattccgtcgcctttggcacggtcatagccgcggtgagcgccatgggcgcgctacccttcataatcggcacgaagcggcaacccatctttgccgacgacgaagacaggaatcactccaagggtgtgactccaaaccacaactataccagccaacgctccacttgtttcgacgctactttcatccctggtggctcacatatcaaggaattgagccagctgggccttatccagcactgggttgccgagcagttcggacactgcaaggcaattggcgctacaggagaggccatcaatctaatcgtgcaggctctgagcaacctgcctgatttggaggtcgcatccgcctcgtcagggcatccagtcgattggtacggcgttgtcacgtcgagtaagctgcatgagccccatagtttgaccgaagggatcaagctgtttcccgaggcgagtgacttcttgggcaagctcttttatcagatctcccagcatcggaattatgagcgggagatggctgggttgacggacaaggttccattttaa

SEQ ID NO: 43038 - protein, 749 aa, Ajellomyces capsulata
MTSKVEEGLQRVKELVENMQPGEQKVADLARDTTDVNGCLPFTTDHGVKVSNTDFWLRLASENQTGPLLLEDQIAREKIHRFDHERIPERVVHARGTGAFGHFKLFESAADVTSAGVLTDTSRTTPVFVRFSTVQGSKGSFDTVRDVRGFATKFYTEEGNWDLVGNNIPVFFIQDAVKFPDFVHAVKPEPHNEVPQGQTAHNNFWDFVYMHPEATHMFMWAMSDRAIPRSYRMMQGFGVNTFVLVNKQGKRHFVKFHWMPELGVHSLVPDESFKLGGQDPDFHRKDLMEAIDNKVYPKWKFGIQVLPEEKEHDFDFDILDPTKIWPESLIPVRYIGEMELNRNVDEFFPQTEQVAFCTAHIVPGIEFSGDPLLQGRNFSYFDTQITRLGVNWEELPINRPVCPVMNHNRDGAMRHKITQGTVNYWPNRFEACPPTKPEDGGFVTYPQKVEQSIKARMLSSKFREHINQAQLFYNSLSEYEKLHVNNAFCFELDHCDDPIVYNRLVSRISEIDHALAQAVAVKVGAPTPPRPGRDNPGQTTINLSQKYINDRQLSSPTIKGRRIAILIGDGYDSVAFGTVIAAVSAMGALPFIIGTKRQPIFADDEDRNHSKGVTPNHNYTSQRSTCFDATFIPGGSHIKELSQLGLIQHWVAEQFGHCKAIGATGEAINLIVQALSNLPDLEVASASSGHPVDWYGVVTSSKLHEPHSLTEGIKLFPEASDFLGKLFYQISQHRNYEREMAGLTDKVPF

SEQ ID NO: 43039 - DNA, 1479 bp, Raphanus sativus
  CDS (1)..(1479)
atggatccttacaagtatcgtccatcgagcgcgtacaacgctccgttctacacgacaaacggtggtgctccagtctccaacaacatctcctccctcaccatcggagaaagaggtccggttcttcttgaggactaccatttgatcgagaaggttgctaacttcacgagggagaggattcctgagagagtggttcacgccagaggaatcagtgctaagggtttctttgaggtcacccatgacatctccaacctcacctgtgctgatttcctcagagcccctggtgttcaaactcccgtcatcgtccgtttctccaccgtcgttcacgagcgtgccagccctgaaaccatgagagacattcgtggcttcgccgttaagttctacaccagagaggggaactttgatcttgttggtaacaacactcctgtcttcttcatccgtgacgggattcagttccctgatgttgtccacgccctgaagccgaacccgaaaacaaacatccaggagtactggaggatactggactacatgtcccacttaccagagagtttgctcacatggtgctggatgtttgatgacgttggtatcccacaagactataggcacatggaaggtttcggtgtccacacctacactctcgtttccaaatccggaaaagttctcttcgtcaagttccactggaaacctacttgcgggatcaagaatctcactgatgaagaggctaaggtggttggaggagccaatcacagccacgcgactaaggatctccatgatgctatttcgtctggtaactaccctgagtggaagcttttcatccagacaatggatcctgcggatgaggataagttcgatttcgacccgcttgatgtgaccaagatctggcctgaggatatcttgcctttgcagccggttggtcgcttggttctcaacaggaccattgacaacttctttaatgagactgagcagctcgcttttaaccctggtcttgtggttcctgggatctactactcagatgataagctgctccagtgtaggatctttgcgtatggtgacactcagagacatcgtcttggaccaaactacttgcagctgccggttaatgctccaaaatgtgctcaccacaacaatcaccatgaaggtttcatgaacttcatgcacagagatgaggagatcaattactacccatcaaagtttgaccccgtccgttgcgcagagaaggttcctatccctaacaaatcctacactggaatcagaacaaagtgtatcatcaagaaggagaacaacttcaaacaggctggagacagatacagatcctgggcaccagacaggcaagacaggtttgtgaagagatgggttgagatcctgtcagagcctcggctgactcatgagattcgcagcatctggatatcttactggtctcaggctgatgcgtcactgggacagaaacttgcaagccgtctgaacgtgaggccaagcatctag

SEQ ID NO: 43040 - protein, 492 aa, Raphanus sativus
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLVSKSGKVLFVKFHWKPTCGIKNLTDEEAKVVGGANHSHATKDLHDAISSGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPIPNKSYTGIRTKCIIKKENNFKQAGDRYRSWAPDRQDRFVKRWVEILSEPRLTHEIRSIWISYWSQADASLGQKLASRLNVRPSI

SEQ ID NO: 43041 - DNA, 1479 bp, Brassica juncea
  CDS (1)..(1479)
atggacccttacaagtatcgtccagcgagttcttacaactctcctttcttcaccaccaactttggtgctcctgtatggaacaacaactcctccatgaccgttggacccagaggtcccatccttcttgaggactaccatctcgttgagaagcttgctaactttgacagggagcgtattccagagcgtgtggttcacgctagaggagccagtgcaaagggtttctttgaggtcactcatgatatatctaacctcacttgtgctgacttcctcagagctccaggtgttcagactccagtcattgttcgtttctccactgtcatccatgagcgtggaagccccgaaaccttgagagaccctcgtggctttgcagtcaagttctacaccagagaggggaactttgatcttgtcggaaacaacttccctgtcttcttcatccgcgacggtatgaagttccctgacatggtccacgctctcaaaccaaacccaaaatcacacatccaagagaactggagagtccttgacttcttctcccaccaccctgagagcttaaacatgttcactttcctcttcgatgacatcggtatcccacaagactacagacacatggaaggctcaggtgtcaacacatacatgttgatcaacaaatccggcaaagctcactacgtcaagttccactggaaaccaacttgtggagtcaagtctttactagaagaagatgcaatccgcgttggtggaaccaaccacagtcacgccactcaggacttgtacgactccatcgctgctggtaactaccctgagtggaagctctttgttcagataatcgatccggcggatgaggacaggttcgactttgaccctctcgatgtcaccaagacctggcctgaggatatcttgcctctccagcccgttgggcgtatggtgttgaacaagaacattgataacttctttgcggagaacgagcagcttgctttctgccctgcgatcattgttccggggatacactactctgacgataagctgcttcaaacacgtgtcttctcctatgctgatactcagagacaccgtcttggacctaactatctgcagctaccggttaatgctccaaaatgtgctcaccacaacaaccaccatgaaggattcatgaatttcatgcacagggacgaggaggttaactacttcccttcgaggtatgacccggttcgccatgctgagaagtatccaactccaccagcaatctgctctggaaaacgtgagaggtgtattattgagaaggagaacaacttcaaggagcctggagagagataccgttcattcacaccagagaggcaagaacgtttcatcggtcgatggattgatgctctatcagaccctcgcatcacacatgaaatccgcagcatctggatatcttactggtctcaggctgataagtcactgggacagaagctggcaaaccgtctgaacgtgagaccaagcatctaa

SEQ ID NO: 43042 - protein, 492 aa, Brassica juncea
MDPYKYRPASSYNSPFFTTNFGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPTCGVKSLLEEDAIRVGGTNHSHATQDLYDSIAAGNYPEWKLFVQIIDPADEDRFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAICSGKRERCIIEKENNFKEPGERYRSFTPERQERFIGRWIDALSDPRITHEIRSIWISYWSQADKSLGQKLANRLNVRPSI

SEQ ID NO: 43043 - DNA, 1479 bp, Brassica juncea
  CDS (1)..(1479)
atggatccctacaagtatcgtccagcgagttcttacaactctccgttcttcaccaccaactctggtgctcctgtatggaacaacaactcctccatgaccgttggacccagaggtcctatccttcttgaggactaccatctcgttgagaagcttgctaacttcgacagggagcgtattccagagcgcgtggttcacgcaagaggagccagtgcaaagggtttcttcgaggtcactcatgatatatctaacctcacttgtgctgacttcctcagagctccaggtgttcagactccggtcattgtgcgtttctccactgtcatccatgagcgtggaagtcccgagaccttgagagaccctcgtggcttcgcagtcaagttctacaccagagagggaaactttgatcttgtcggaaacaacttccctgtcttcttcatccgcgacgggatgaagttccctgacatggtccacgctctcaaaccaaaccccaaatctcacatccaagagaactggagagtccttgacttcttctcccaccaccctgaaagcctcaacatgttcactttcctcttcgacgacatcggtatcccacaagactacagacacatggaaggctcaggtgtcaacacatacatgttgatcaacaaagccggcaaagctcactacgtgaagttccactggaaaccaacttgtggagtgaagtctctactagaagaagatgcaatccgcgttggaggaaccaaccacagccacgcgactcaggacttatacgactccatcgccgctggtaactaccctgagtggaagctctttgttcagataatcgacccagctgatgaagacaagttcgactttgaccctctcgatgtcaccaagacttggcctgaagatatcttgcctctccagcccgttgggcgtatggtgttgaacaagaacattgataacttctttgcggagaatgagcagcttgccttctgtcctgctatcattgttccggggatacactactctgacgataagctgcttcagacacgtgtcttctcttatgctgacactcagagacaccgtcttggacctaactacctccagctaccagttaatgctccaaagtgtgctcaccacaacaaccaccatgaaggcttcatgaatttcatgcacagggacgaggaggttaactacttcccttcgaggtatgacccggttcgccatgcagagaagtatccaactccacctgctgtctgctctggaaagcgtgagaggtgtattattgagaaagagaacaacttcaaggagcctggagagagataccgttcctttacaccagagaggcaagaacgtttcatcggtcgatggattgatgctctatcagaccctcgcatcacacatgagatccgcagcatctggatctcttactggtctcaggctgataagtcactgggacagaagctggcgagccgtctgaacgtgagaccaaacatctaa

SEQ ID NO: 43044 - protein, 492 aa, Brassica juncea
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKAGKAHYVKFHWKPTCGVKSLLEEDAIRVGGTNHSHATQDLYDSIAAGNYPEWKLFVQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAVCSGKRERCIIEKENNFKEPGERYRSFTPERQERFIGRWIDALSDPRITHEIRSIWISYWSQADKSLGQKLASRLNVRPNI

SEQ ID NO: 43045 - DNA, 1491 bp, Brassica juncea
  CDS (1)..(1491)
atggatccttacaagtatcggccggcgagttcttacaactctccattcttcaccaccaactctggtgctcctgtatggaacaacaactcctccatgaccgttggacccagaggtcctatccttcttgaggattaccatctcgtcgagaagcttgccaacttcgacagggagcgtattccagaacgtgtggttcacgcaagaggagccagtgcaaagggtttcttcgaggtcacgcatgatatatccaacctaacgtgtgcagacttccttagagctccaggtgtacagacaccggtcattgtccgtttctccaccgttatccatgaacgtggaagtcccgagaccttgagagaccctcgtggcttcgcagtcaagttctacaccagagaagggaactttgatcttgtcggaaacaacttccctgtcttcttcataagggacgggatgaagttccctgacatggtccacgctcttaaaccaaaccctaaatctcacatccaagaaaactggagagtccttgacttcttctcacaccaccctgagagcttgaacatgttcactttcctctttgacgacatcggtatcccgcaagattacagacacatggaaggctcaggtgtgaacacctacatgctcatcaacaaatccggcaaagctcactacgtgaagttccactggaaaccaacatgtggagtaaagtctcttttagaagaagatgcagtccgtgtaggaggaaccaaccacagtcacgccacacaggacttgtatgactccattgctgctggaaactaccctgagtggaagctctttatccaggtcattgatccagctgacgaagacaagttcgactttgacccactcgatgtcaccaagacctggcctgagaatcttttgcctctccaacccgttggtcgtatggtgttgaacaagaacattgacaacttctttgcggagaatgagcagcttgccttttgccctgctatcattgttcctgggatacattactcggacgacaagctgcttcagacgcgtgtcttctcttatgctgacactcagagacaccgccttggaccgaactaccttcagctgccagttaatgcacccaaatgtgctcatcacaacaatcaccatgaggggttcatgaacttcatgcacagggacgaggaggtcaactacttcccatcgaggtatgatcctgttcgtcatgctgagaagtatccaactccacctgctgtctgctctgggaaacgtgagagatgtgttattgagaaagagaacaacttcaaggagcctggagagagataccgttcctttacaccagagagttttgacttcaggcaagaacgtttcatccgtagatggattgaagccttatctgacccccgcatcacacatgaaatccgcagcatctggatctcttactggtctcaggctgacaaaactctgggacagaagcttgcaagccgtctgaacgtgagaccaagcatctaa

SEQ ID NO: 43046 - protein, 496 aa, Brassica juncea
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPTCGVKSLLEEDAVRVGGTNHSHATQDLYDSIAAGNYPEWKLFIQVIDPADEDKFDFDPLDVTKTWPENLLPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAVCSGKRERCVIEKENNFKEPGERYRSFTPESFDFRQERFIRRWIEALSDPRITHEIRSIWISYWSQADKTLGQKLASRLNVRPSI

SEQ ID NO: 43047 - DNA, 1479 bp, Oryza sativa
  CDS (1)..(1479)
atggatccctacaagcaccgcccgtcgagctcgttcaacggcccgctgtggagcaccaactccggcgcccccgtatggaacaacaacaactcgctcaccgtcggctcccgaggcccgatccttctggaggactaccacctggttgagaagctggccaacttcgacagggagcgtatcccggagcgcgtggtgcacgcccgcggggccagcgccaagggcttcttcgaggtcacccacgacatcacccacctcacctgcgccgacttcctccgcgccccgggcgtccagaccccggtcatcgtccgcttctccaccgtcatccacgagcgcggcagcccggagaccctccgcgacccgcgtgtgttcgccatcaagttctacacccgggagggcaactgggacctcgtcggcaacaacttccccgtcttcttcatccgcgacggcatgaagttcccggacatggtgcactcgctcaagcccaaccccaagtcgcacgtccaggagaactggcgcatcctcgacttcttctcccaccacccggagagcctccacatgttcaccttcctcttcgatgacatcggcatccccgccgactaccgccacatggacggctccggcgtcaacacctacacgctcgtcaaccgcgccggcaagtcgcactacgtcaagttccactggaagcccacctgcggcgtcaagtcgctgctcgacgacgaggccgtcaccgtcggcgggaccaaccacagccacgccacgcaggacctctacgactccatcgccgccggcaacttcccggagtggaagctgttcatccagaccatcgaccccgaccacgaggaccgcttcgacttcgacccgctcgacgtcaccaagacgtggcccgaggacatcgtcccgctgcagcccgtggggaggatggtgctcaaccgcaacatcgacaacttcttctcggagaacgagcagctggcgttctgccccgggatcatcgtgccggggatctactactccgacgacaagctgctgcagacgaggatcttctcctactccgacacgcagcgccaccgcctcggaccaaactacctgctgcttccgcccaacgcgcccaagtgcgcccaccacaacaaccactacgacggcttcatgaacttcatgcaccgcgacgaggaggtcgactacttcccatcccgctacgatcctgccaagcacgccccccgctaccccatcccctccgccaccctcaccggccgccgcgagaaggtggtgattgccaaggagaacaacttcaagcagccaggggagaggtaccgttcatgggatccggcaaggcaagaccggttcatcaagagatggatcgacgcactctctgaccctcgcctcacccacgagatcaggagcatctggctctcctactggtctcaggctgacaggtctctgggtcagaaactggcgagccgtctcagcgcgaagccgagcatgtaa

SEQ ID NO: 43048 - protein, 492 aa, Oryza sativa
MDPYKHRPSSSFNGPLWSTNSGAPVWNNNNSLTVGSRGPILLEDYHLVEKLANFDRERIPERVVHARGASAKGFFEVTHDITHLTCADFLRAPGVQTPVIVRFSTVIHERGSPETLRDPRVFAIKFYTREGNWDLVGNNFPVFFIRDGMKFPDMVHSLKPNPKSHVQENWRILDFFSHHPESLHMFTFLFDDIGIPADYRHMDGSGVNTYTLVNRAGKSHYVKFHWKPTCGVKSLLDDEAVTVGGTNHSHATQDLYDSIAAGNFPEWKLFIQTIDPDHEDRFDFDPLDVTKTWPEDIVPLQPVGRMVLNRNIDNFFSENEQLAFCPGIIVPGIYYSDDKLLQTRIFSYSDTQRHRLGPNYLLLPPNAPKCAHHNNHYDGFMNFMHRDEEVDYFPSRYDPAKHAPRYPIPSATLTGRREKVVIAKENNFKQPGERYRSWDPARQDRFIKRWIDALSDPRLTHEIRSIWLSYWSQADRSLGQKLASRLSAKPSM

SEQ ID NO: 43049 - DNA, 1479 bp, Oryza sativa
  CDS (1)..(1479)
atggatccctacaagggccgcccgtcgagctcgttcaacggcccgctgtggagcaccaactccggcgcccccgtatggaacaacaacaactcgctcaccgtcggctcccgaggcccgatccttctggaggactaccacctggttgagaagctggccaacttcgacagggagcgtatcccggagcgcgtggtgcacgcccgcggcgccagcgccaagggcttcttcgaggtcacccacgacatcacccacctcacctgcgccgacttcctccgcgccccgggcgtccagaccccggtcatcgtccgcttctccaccgtcatccacgagcgcggcagcccggagaccctccgcgacccgcgtggcttcgccatcaagttctacacccgggagggcaactgggacctcgtcggcaacaacttccccgtcttcttcatccgcgacggcatgaagttcccggacatggtgcactcgctcaagcccaaccccaagtcgcacgtccaggagaactggcgcatcctcgacttcttgtcccaccacccggagagcctccacatgttcaccttcctcttcgatgacatcggcatccccgccgactaccgccacatggacggctccggcgtcaacacctacacgctcgtcaaccgcgccggcaagtcgcactacgtcaagttccactggaagcccacctgcggcgtcaagtcgctgctcgacgacgaggccgtcaccgtcggcgggaccaaccacagccacgccacgcaggacctctacgactccatcgccgccggcaacttcccggagtggaagctgttcatccagaccatcgaccccgaccacgaggaccgcttcgacttcgacccgctcgacgtcaccaagacgtggcccgaggacatcgtcccgctgcagcccgtggggaggatggtgctcaaccgcaacatcgacaacttcttctcggagaacgagcagctggcgttctgcccgggatcatcgtgccggggatctactactccgacgacaagctgctgcagacgaggatcttctcctactccgacacgcagcgccaccggctgggaccaaaactacctggttgttccggccaacgcgcccaagtgcgcccaccacaacaaccactacgacggcttcatgaacttcatgcaccgcgacgaggaggtcgactacttcccatcccgctacgatcctgccaagcacgccccccgctaccccatcccctccgccaccctcaccggccgccgcgagaaggtggtgattgccaaggagaacaacttcaagcagccaggggagaggtaccgttcatgggatccggcaaggcaagaccggttcatcaagagatggatcgacgcactctctgaccctcgcctcacccacgagatcaggagcatctggctctcctactggtctcaggctgacaggtctctgggtcagaaactggcgagccgtctcagcgcgaagccgagcatgtaa

SEQ ID NO: 43050 - protein, 492 aa, Oryza sativa
MDPYKGRPSSSFNGPLWSTNSGAPVWNNNNSLTVGSRGPILLEDYHLVEKLANFDRERIPERVVHARGASAKGFFEVTHDITHLTCADFLRAPGVQTPVIVRFSTVIHERGSPETLRDPRGFAIKFYTREGNWDLVGNNFPVFFIRDGMKFPDMVHSLKPNPKSHVQENWRILDFLSHHPESLHMFTFLFDDIGIPADYRHMDGSGVNTYTLVNRAGKSHYVKFHWKPTCGVKSLLDDEAVTVGGTNHSHATQDLYDSIAAGNFPEWKLFIQTIDPDHEDRFDFDPLDVTKTWPEDIVPLQPVGRMVLNRNIDNFFSENEQLAFCPGSSCRGSTTPTTSCCRRGSSPTPTRSATGWDQNYLVVPANAPKCAHHNNHYDGFMNFMHRDEEVDYFPSRYDPAKHAPRYPIPSATLTGRREKVVIAKENNFKQPGERYRSWDPARQDRFIKRWIDALSDPRLTHEIRSIWLSYWSQADRSLGQKLASRLSAKPSM

SEQ ID NO: 43051 - DNA, 1452 bp, Streptomyces violaceus
  CDS (1)..(1452): transl_table=11
gtgacgcagggaccgctcaccacggaggccggcgcgccggtcgccgacaaccagaacagcgagacggcgggcgtaggcggtccggtcctcgtccaggaccagctgctgctcgagaagctcgcccacttcaaccgtgagcgcatcccggagcgcgtggtccacgcgcgcggtgcgggcgcctacggcaccttcacgctcacccgtgacgtctcgcggtggacgcgggccgccttcctctccgaggtcggcaagcggaccgagaccttcctgcgcttctccaccgtcgcgggcagcctcggcgcggccgacgcggtgcgcgatccgcgcggctgggcgctgaagttctacaccgaggagggcaactacgacctcgtcggcaacaacaccccggtgttcttcatcaaggacgccatcaagttccccgacttcatccacacccagaagcgcgacccgtacacgggctcgcaggaggcggacaacgtctgggacttctggggcctgtcgccggagtcgacccaccaggtgacctggctgttcggcgaccgcggcatcccggcctcgtaccgccacatgaacggctacggctcgcacacgtaccagtggaacaacgaggccggcgaggtcttctgggtcaagtaccacttcaagaccgaccaggggatcaagaacctcacgcaggacgaggccaaccggctggccggcgaggacccggactcgcaccagcgcgacctgcgcgaggccatcgagcgcggcgacttcccgacctggaccgtgcaggtccagatcatgcccgcggccgacgcggcgggctaccgcttcaaccccttcgacctcaccaaggtctggccgcacgaggactacccgccggtcgagatcggcaccctggagctcaaccgcaacccggagaacatcttcgccgaggtcgagcagagcatcttctccccggcgcacttcgtgcccggcatcgggccgtccccggacaagatgctccagggccgtctcttcgcgtacggcgacgcgcaccgctaccgcgtcggcatcaacgccgaccacctgccggtgaaccgcccgcacgccaccgaggcgcggacgcactcccgtgacggcttcctctacgacggccgccacaagggcgcgaagaactacgagcccaactccttcggcggaccggtccagacggaccgcccgctgtggcagcccaccccggtcaccggcgtcaccggcgaccacgcggccccgtcgcacgccgaggacgacgacttcacgcaggcgggcgacctctaccggctgatgtcggaggacgagaagggccgcctgatcgacaatctgtccggcttcatcgccaaggtctcgcgcgacgacatcgccgagcgcgcgatcggcaacttccgccgggcggacgaggacttcggcaagcggctggaggccgcggtccaggccctgcgcggctga

SEQ ID NO: 43052 - protein, 483 aa, Streptomyces violaceus
MTQGPLTTEAGAPVADNQNSETAGVGGPVLVQDQLLLEKLAHFNRERIPERVVHARGAGAYGTFTLTRDVSRWTRAAFLSEVGKRTETFLRFSTVAGSLGAADAVRDPRGWALKFYTEEGNYDLVGNNTPVFFIKDAIKFPDFIHTQKRDPYTGSQEADNVWDFWGLSPESTHQVTWLFGDRGIPASYRHMNGYGSHTYQWNNEAGEVFWVKYHFKTDQGIKNLTQDEANRLAGEDPDSHQRDLREAIERGDFPTWTVQVQIMPAADAAGYRFNPFDLTKVWPHEDYPPVEIGTLELNRNPENIFAEVEQSIFSPAHFVPGIGPSPDKMLQGRLFAYGDAHRYRVGINADHLPVNRPHATEARTHSRDGFLYDGRHKGAKNYEPNSFGGPVQTDRPLWQPTPVTGVTGDHAAPSHAEDDDFTQAGDLYRLMSEDEKGRLIDNLSGFIAKVSRDDIAERAIGNFRRADEDFGKRLEAAVQALRG

SEQ ID NO: 43053 - DNA, 1479 bp, Arabidopsis thaliana
  CDS (1)..(1479)
atggatccatacagggttcgtccttcaagcgctcatgattcccctttcttcactacaaactcgggtgctcctgtctggaacaacaactcttctttgactgtcggaactcgaggtccaatccttctggaggactatcatctgcttgagaaactcgctaactttgacagggagcggattcctgagagggttgttcatgccaggggagccagtgctaagggtttctttgaagtcactcatgacattacccaacttacttctgctgattttcttcgaggacctggtgttcagactcctgttatcgttcgtttctcaactgtcatccatgagcgtggcagtcccgagactctcagagatccccgtggttttgctgttaagttttacaccagagaggggaactttgatcttgttgggaacaacttccctgtattcttcgtccgtgatggaatgaaattccctgacatggtccatgcattgaaaccgaatcccaagtctcacattcaggagaactggaggatactggacttcttctcccaccacccagagagtttgcacatgttttcatttctctttgatgatctcggtatcccacaggactacaggcacatggaaggcgctggggtcaacacttacatgctaatcaacaaagctggaaaagctcactatgtgaaattccactggaagccgacttgtgggatcaaatgcctgtcggatgaggaagctatcagagttggaggagccaatcacagccatgccaccaaagatctctatgactcgatcgcagccgggaactatccgcagtggaatctcttcgttcaggtgatggatcctgcccatgaagacaaatttgacttcgatccgcttgatgtcacaaagatctggcctgaagatatcttgcctttacaacctgttggtcgcttggtcttgaacaaaaacatcgacaacttctttaatgagaacgaacagattgcattctgtcctgctcttgtggttccaggcatccactattcagatgataagctactccagacccggatcttctcctacgctgatagtcagagacaccgtcttggaccaaactatctgcaactacctgttaatgcccctaaatgtgctcaccacaacaatcaccatgatggttttatgaacttcatgcacagggatgaggaggtcaattacttcccttcaaggttggatccggttcgccatgccgaaaaataccctacaactcctattgtctgctctggaaatcgtgagaagtgcttcatcgggaaggagaacaacttcaagcaaccaggggagagataccggtcctgggattcagacaggcaagaacgattcgtgaagcgttttgttgaagcgctttcggagcctcgtgtcacgcacgaaatccgcagcatttggatctcttactggtctcaggcagacaaatctctgggacagaaactagcaactcgtcttaacgtgaggccaaacttctga

SEQ ID NO: 43054 - protein, 492 aa, Arabidopsis thaliana
MDPYRVRPSSAHDSPFFTTNSGAPVWNNNSSLTVGTRGPILLEDYHLLEKLANFDRERIPERVVHARGASAKGFFEVTHDITQLTSADFLRGPGVQTPVIVRFSTVIHERGSPETLRDPRGFAVKFYTREGNFDLVGNNFPVFFVRDGMKFPDMVHALKPNPKSHIQENWRILDFFSHHPESLHMFSFLFDDLGIPQDYRHMEGAGVNTYMLINKAGKAHYVKFHWKPTCGIKCLSDEEAIRVGGANHSHATKDLYDSIAAGNYPQWNLFVQVMDPAHEDKFDFDPLDVTKIWPEDILPLQPVGRLVLNKNIDNFFNENEQIAFCPALVVPGIHYSDDKLLQTRIFSYADSQRHRLGPNYLQLPVNAPKCAHHNNHHDGFMNFMHRDEEVNYFPSRLDPVRHAEKYPTTPIVCSGNREKCFIGKENNFKQPGERYRSWDSDRQERFVKRFVEALSEPRVTHEIRSIWISYWSQADKSLGQKLATRLNVRPNF

SEQ ID NO: 43055 - DNA, 1479 bp, Cucurbita pepo
  CDS (1)..(1479)
atggatccttacaggcaccgcccttcaagtgctttcaacgcccccttctggactaccaattctggtgctccagtatggaacaacaactcgtcgatgaccgttgggcccagaggtcccattctcctagaggattatcatctagtggagaaacttgctaactttgatagggagcggatcccagagcgggttgtccatgctagaggagctagtgcaaaagggttttttgaggtgactcatgatattaccaacctttcatgtgctgatttccttcgggcccctggagttcagacaccagttattgtacgtttttccactgttatccatgagcgtggcagccctgaaacactgagagatccccgaggttttgctgtgaagttctacaccagggagggtaattttgatctcgtgggcaacaacttccctgtatttttcatccgtgatggtatgaaatttaccagacatgtacatcctctcaaaccgaatcccaagtcccatatccaggagaattggaggatccttgacttcttttctcaccatccagaaagcttgaacatgttctcatttctatttgatgatattggcatcccacaagattacagacacatggacggttcaggtgttaacacttatactctgattaacaaggcagggaaggcacactatgtgaaatttcactggaggcctacctgtggagtcaagtctttgctggaggaagatgctatccgtgttggaggaagcaatcatagccacgctactcaggacctctatgattcaattgcagcaggcaactaccccgagtggaagcttttcattcagactattgaccctgatcatgaagacaaatatgactttgaccctctagatgtaaccaagacatggcctgaggatatcttgcccctgcagccagttggccgcatggttttgaataagaacatcgataacttctttgcagagaatgaacaactggctttttgtcctgccattatagttcctggagtctactattcagatgacaaattgcttcagaccaggatcttctcctatgctgatactcagaggcaccgtcttggaccaaactatcttcaactccctgctaatgcacccaagtgtgctcaccacaacaatcaccacgagggtttcatgaactttatgcaccgagatgaggaggtcaattacttcccttccagatttgatccttctcgtcacgccgagaggtaccctcacccacctgctgtctgctctggaaagcgtgagaggtgcataattgaaaaggagaacaacttcaaggagcctggagagagatacagatcttggacaccagacaggcaagaacgattcgtccgcagatgggttgatgctttgtccgacacccgagtcacccatgagatccgcagcatatggatttcatactggtctcaggcggataggtctcttggtcagaagcttgcatcccatctcaacgtgaggccaagcatttga

SEQ ID NO: 43056 - protein, 492 aa, Cucurbita pepo
MDPYRHRPSSAFNAPFWTTNSGAPVWNNNSSMTVGPRGPILLEDYHLVEKLANFDRERIPERVVHARGASAKGFFEVTHDITNLSCADFLRAPGVQTPVIVRFSTVIHERGSPETLRDPRGFAVKFYTREGNFDLVGNNFPVFFIRDGMKFTRHVHPLKPNPKSHIQENWRILDFFSHHPESLNMFSFLFDDIGIPQDYRHMDGSGVNTYTLINKAGKAHYVKFHWRPTCGVKSLLEEDAIRVGGSNHSHATQDLYDSIAAGNYPEWKLFIQTIDPDHEDKYDFDPLDVTKTWPEDILPLQPVGRMVLNKNIDNFFAENEQLAFCPAIIVPGVYYSDDKLLQTRIFSYADTQRHRLGPNYLQLPANAPKCAHHNNHHEGFMNFMHRDEEVNYFPSRFDPSRHAERYPHPPAVCSGKRERCIIEKENNFKEPGERYRSWTPDRQERFVRRWVDALSDTRVTHEIRSIWISYWSQADRSLGQKLASHLNVRPSI

SEQ ID NO: 43057 - DNA, 1479 bp, Gossypium hirsutum
  CDS (1)..(1479)
atggatccctacaagcaccgtccatcaagtgctttcaattcaccattctggactaccaattctggcgctccagtttggaataacaattcatctctcactgttggacccagaggtcaatatctccttgaggactatcatctggtggaaaagcttgccaactttgacagggagcggattccagaacgtgttgtccatgctaggggagcaagcgcaaagggtttcttcgaggttacccatgacatttctcaccttacatgtgctgattttctgcgagcacctggagttcaaacccctgttatcgtgcgattttcaaccgtcatccatgagcgtggaagccctgaaaccctcagggatcctcgtggttttgcagtgaagttctacacccgagagggtaattttgatcttgtgggaaacaatttcccagtcttctttattcgtgatggaatgaaattccctgatatggtccatgctcttaagcccaaccctaagtcccatattcaggagaattggaggatccttgatttcttctcacaccatcctgagagcttgcatatgtttactttcctctttgatgatttgggtgttccacaagattacagacacatggaaggttctggtgtaaacacatacactctgattaacaaggctggcaaagcacactatgtgaaattccactggaagcccacttgtggggtcaaatgcttgctggaagatgaggcaatcaaggttggaggagctaatcacagccatgccactcaggatctctatgactcaattgctgctggcaactatcctgagtggaagctcttcatccagacaattgatcctgaccatgaagataaatttgactttgaccctcttgatgtgactaagacctggcctgaggacatcttgcccctgcagcctgttggccgcttggttttgaataagaacattgacaacttcttcgccgaaaatgaacagcttgcattttgccctgccattgtggttcctggaatctactactcagatgataagttgctccagactcgtatattctcctactctgatacccagaggcacagacttgggccaaactatctgcaactcccagccaatgctcccaagtgtgctcatcacaacaatcaccacgaaggttttatgaatttcatgcacagggatgaggagataaattacttcccttcaaggtacgatcctgttcgtcatgcagagatgttccctatcccacctgctgtttgcactggaaggcgagagaagtgcatcattgagaaggagaacaacttcaaacagcccggagagagataccggtcctgggcagcagacaggcaagaacgattcatctgccgctgggttgatgccttgtctgatccacgtgtgactcatgaaattcgcagcatatggatctcatactggtctcaggctgataaatcagtgggtcagaagttagcatctctcctcaatgtgagacccagcatttag

SEQ ID NO: 43058 - protein, 492 aa, Gossypium hirsutum
MDPYKHRPSSAFNSPFWTTNSGAPVWNNNSSLTVGPRGQYLLEDYHLVEKLANFDRERIPERVVHARGASAKGFFEVTHDISHLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLHMFTFLFDDLGVPQDYRHMEGSGVNTYTLINKAGKAHYVKFHWKPTCGVKCLLEDEAIKVGGANHSHATQDLYDSIAAGNYPEWKLFIQTIDPDHEDKFDFDPLDVTKTWPEDILPLQPVGRLVLNKNIDNFFAENEQLAFCPAIVVPGIYYSDDKLLQTRIFSYSDTQRHRLGPNYLQLPANAPKCAHHNNHHEGFMNFMHRDEEINYFPSRYDPVRHAEMFPIPPAVCTGRREKCIIEKENNFKQPGERYRSWAADRQERFICRWVDALSDPRVTHEIRSIWISYWSQADKSVGQKLASLLNVRPSI

SEQ ID NO: 43059 - DNA, 1479 bp, Hordeum vulgare
  CDS (1)..(1479)
atggatccctacaagcaccggcccacgagcggggccaactccgcctactggaccaccaactccggcgcccccgtctggaacaacaacaacgccctcaccgtcggacaccgaggacctatcctccttgaggattaccatctgattgaaaagcttgcacaatttgaccgggaacgcatacctgaacgtgttgttcatgcacggggagccagtgcaaaggggttctttgaggtgactcatgatgtttctcagctcacatgtgctgactttctccgggctcctggggttcagaccccggttattgtccggttctctaccgttgtgcatgagcgtggaagccctgagaccctcagggatccacgtggttttgcagtgaagttctacaccagagagggtaactttgaccttgttgggaacaatatgcctgtgttttttatccgagatgggatgaagttccctgacatggtccatgctttcaagccaagtccgaagaccaacatgcaggagaactggagagtagttgacttcttttcgcaccacccggagagtctgcacatgttcaccttcctatttgacgatgttggcattccactcaactacaggcacatggacggttttggtgtcaacacctacaccttaatcagcagggatggaaaggctcacctggttaagttccattggaaacctacatgtggtgtgaagtgcctcttggatgatgaagctgttactgttggaggcacctgccacacccatgccacaaaggacttgactgattctattgcagctgggaattacccagaatggaagcttttcatccagaccattgatgctgatcacgaggatagatttgactttgaccctcttgatgtcaccaagacctggccagaggacatcatcccactgcaaccagttggacggatggtactgaacaagaacattgacaatttcttcgcggaaaatgaacagcttgctttctgcccagcagtcactgtccctggaatccactactctgatgataagctgctccagacaaggatcttctcatatgctgatacccaaaggcaccgtcttggtccaaactacttgatgctccccgtgaatgccccgaaatgtgctcaccacaacaaccatcatgatggcttaatgaatttcattcacagggatgaggaggtgaactacttcccttcaaggtttgatcctactcgtcatgctgaaaagtaccctatgcctccgcgtgttctatctggctgccgggagaagtgcattatcgacaaggagaacaatttcaagcaggctggtgagagatatcggtccttcgaccctgccaggcaagaccgtttcctccagcggtgggttgatgcgctcacggatgctcgtgtcacccatgaaatccagagcatctgggtctcatactggtcacagtgcgatgcgtccctcgggcagaagctggcgtcgcggctcaagattaagccgaacatgtaa

SEQ ID NO: 43060 - protein, 492 aa, Hordeum vulgare
MDPYKHRPTSGANSAYWTTNSGAPVWNNNNALTVGHRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRVVDFFSHHPESLHMFTFLFDDVGIPLNYRHMDGFGVNTYTLISRDGKAHLVKFHWKPTCGVKCLLDDEAVTVGGTCHTHATKDLTDSIAAGNYPEWKLFIQTIDADHEDRFDFDPLDVTKTWPEDIIPLQPVGRMVLNKNIDNFFAENEQLAFCPAVTVPGIHYSDDKLLQTRIFSYADTQRHRLGPNYLMLPVNAPKCAHHNNHHDGLMNFIHRDEEVNYFPSRFDPTRHAEKYPMPPRVLSGCREKCIIDKENNFKQAGERYRSFDPARQDRFLQRWVDALTDARVTHEIQSIWVSYWSQCDASLGQKLASRLKIKPNM

SEQ ID NO: 43061 - DNA, 1479 bp, Lycopersicon esculentum
  CDS (1)..(1479)
atggatccctctaagtatcgcccatcaagcgcatacgacacccctttcttgacaacaaatgctggtggtcctgtgtacaacaatgtttcttccttgactgttggacctagagggcctgttctgcttgaggattactatctaattgagaagctcgcgacatttgatcgcgagaagatacctgaacgtgttgttcatgctagaggtgctagtgctaagggattctttgaagttactcatgacatttctcatcttacttgtgctgattttctccgagctcctggcgctcaaacgcctgttatttgtcgattctctactgttgtccatgaacgtggaagccccgagtctatcagggacattcgtggttttgctgtcaagttctacaccagagagggtaactttgatcttgttggaaacaatgtccccgtgttctttaatcgtgatgctaagtcgttccctgacacgattcgtgcattgaaaccaaatccaaagtcacacattcaggagaactggaggatacttgatttcttctcgttccttcctgagagtttgcatacattcgccttcttctacgatgatgtttgtctcccaacggattacagacacatggaaggttttggcgttcacgcgtatcaattgattaacaaagaggggaaagcacattatgtgaagttccactggaagccaacttgtggtgtgaaatgtatgtctgaggaagaagctattagagtcggtggtactaatcatagccacgcgaccaaggatctttacgattcaattgctgctggaaactatcctgagtggaagctttttatccaaacaatggaccccgaggatgtagacaagttcgattttgatcctctggatgtaaccaagacatggcctgaggatctcttgccgttgatcccagttggtcgattggtgttgaacaggaacattgataacttcttcgcagagaatgaacaactcgcgtttaaccctggacatattgtccctggtatttactattccgaggataagcttctccagactaggatattcgcgtatgctgatactcagagacaccgtattggaccaaactatatgcagctcccagttaatgctcccaagtgtggtcatcacaacaatcatcgcgatggtgctatgaacatgacacatcgcgatgaagaggtggattatttgccctcgaggtttgatccttgtcgtcctgctgagcagtacccgattccttcttgtgtcttgaatggaaggcgtacaaattgtgtcattccgaaagaaaacaacttcaaacaggcaggggagaggtacagatcatgggaacctgacaggcaagacagatacatcaacaaatgggttgagtctttatccgatccacgagtcactcatgagattcgcagcatatggatatcatacttgtctcaggctgacaagtcctgtggtcagaaggtcgcttctcgtctcactgtgaagcctacaatgtga

SEQ ID NO: 43062 - protein, 492 aa, Lycopersicon esculentum
MDPSKYRPSSAYDTPFLTTNAGGPVYNNVSSLTVGPRGPVLLEDYYLIEKLATFDREKIPERVVHARGASAKGFFEVTHDISHLTCADFLRAPGAQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPTDYRHMEGFGVHAYQLINKEGKAHYVKFHWKPTCGVKCMSEEEAIRVGGTNHSHATKDLYDSIAAGNYPEWKLFIQTMDPEDVDKFDFDPLDVTKTWPEDLLPLIPVGRLVLNRNIDNFFAENEQLAFNPGHIVPGIYYSEDKLLQTRIFAYADTQRHRIGPNYMQLPVNAPKCGHHNNHRDGAMNMTHRDEEVDYLPSRFDPCRPAEQYPIPSCVLNGRRTNCVIPKENNFKQAGERYRSWEPDRQDRYINKWVESLSDPRVTHEIRSIWISYLSQADKSCGQKVASRLTVKPTM

SEQ ID NO: 43063 - DNA, 1479 bp, Ricinus communis
  CDS (1)..(1479)
atggatccctacaggaaccgtccatcaagtggttttaatacccctttctggactacaaattcgggtgctcctgtatggaataacaattcatccttgaccgttggatccagaggtccaatcctgcttgaagactatcatttgatagaaaaactagctaattttgatagagaacggatcccagagcgtgttgtgcatgctagaggagctagtgcaaagggtttctttgaggtcacccatgatgtctcacatctcacatgtgctgattttcttcgagctcctggagttcagacgcctgtcattgtgcgtttctctactgttattcatgaacgtggcagccctgaaaccctcagggatcctcgaggtttcgcagtgaagttttacaccagagagggtaattttgatcttgtgggaaacaatttccctgtctttttcatccgtgatggaatgaaattcccagatgtggtacatgcttttaagcccaaccccaagtctcaccttcaggagaattggaggatctttgacttcttatcccatgttcctgaaagcttgcacatgcttaccttcctcttggatgatttgggtattccacaagactacaggcacatggaaggctctggtgttaacacctatactctgatcaacaaggctggaaaagtacactatgtgaaatttcactggaagcctacttgtggtgtaaagtgtttgttggaaaatgaggccattaaggttggaggatccaatcatagtcatgccacccaggatctatatgattcaatttcggctggaaactatccagagtggaaactttacatccagataatggatcctgctcatgaagacaaatttgactttgatccacttgacgtgaccaaaacctggcccgaggatatcctacccctgcagccagttggccgcctggtcttgaataagaacattgataacttctttgctgagaatgagcagcttgcattttgccctggtattgtggttcctggtgtttcatattcagaggacaagttactccagactaggatcttttcatattctgatactcagaggcaccgtcttggaccaaactatttacagctccctgttaatgctccaaagtgtgctcatcacaataatcatcatgaaggtttcatgaatttcatgcatagggatgaggaggtcaattatttcccatccagatgcgatccagctcgcaatgctgagagtttccccgttccttctgctatctgcagtggaaagcgggagaagtgtgttattgagaaggagaacaatttcaagcagcctggtgagagatatcgatcttgggctcctgacaggcaagagcggttcctcaaccggttggttggaggcttatctgatcctcggatcacccatgagctgcgcactatctggatctcttactggattcagtgcgacaaatccctgggtcagaagctagcaactcgcctcaacgtgaagccaagcatttga

SEQ ID NO: 43064 - protein, 492 aa, Ricinus communis
MDPYRNRPSSGFNTPFWTTNSGAPVWNNNSSLTVGSRGPILLEDYHLIEKLANFDRERIPERVVHARGASAKGFFEVTHDVSHLTCADFLRAPGVQTPVIVRFSTVIHERGSPETLRDPRGFAVKFYTREGNFDLVGNNFPVFFIRDGMKFPDVVHAFKPNPKSHLQENWRIFDFLSHVPESLHMLTFLLDDLGIPQDYRHMEGSGVNTYTLINKAGKVHYVKFHWKPTCGVKCLLENEAIKVGGSNHSHATQDLYDSISAGNYPEWKLYIQIMDPAHEDKFDFDPLDVTKTWPEDILPLQPVGRLVLNKNIDNFFAENEQLAFCPGIVVPGVSYSEDKLLQTRIFSYSDTQRHRLGPNYLQLPVNAPKCAHHNNHHEGFMNFMHRDEEVNYFPSRCDPARNAESFPVPSAICSGKREKCVIEKENNFKQPGERYRSWAPDRQERFLNRLVGGLSDPRITHELRTIWISYWIQCDKSLGQKLATRLNVKPSI

SEQ ID NO: 43065 - DNA, 1479 bp, Solanum tuberosum
  CDS (1)..(1479)
atggatccgtctaagtatcgtccatcaagcgcatacgacacccctttcttgacaacaaatgctggtggtcctgtgtacaacaatgtttcttccttgactgttggacctagagggcctgttctgcttgaggattattatctaattgagaaacttgcgacttttgatcgcgaaaagatacctgagcgtgttgttcatgctagaggtgctagtgctaagggattctttgaagttactcatgacatttctcatcttacttgtgctgattttctccgagctcctggtgctcaaacgcctgttatttgtcgattctctactgttgtccatgaacgtggaagccccgagtcaatcagggatattcgcgggtttggtgtcaagttctacaacagagggggtaactttgatcttgttggaaacaatgtccccgtgttctttaatcgggatgctaagtcgttccctgacacgattcgtgcattgaaaccaaatccaaagtcacacattcaggaggactggaggacccttgatttcttctcgttccttcctgagagtttgcatacattcgccttcttctacgatgatgtttgtctcccaactgattacagacacatggaaggttttggcgtccacgcgtatcaattgattaacaaagaggggaaagcacattatgtgaagttccactggaagccaacttgtggtgtgaaatgtatgtctgaggaagaagctattagagtcggtggtactaatcatagccacgcgaccaaggatctttacgattcaattgcagctggaaactatcctgagtggaagcttttcatccaaacaatggaccctgaggatgtagacaagttcgattttgatcctctggatgtaaccaagacatggcctgaggatctcttgccgttgatcccagttggtcgattggtattgaacaggaacattgataacttctttgctgagaatgagcagctcgcgtttaaccctggacatatcgtccctggtatttactattccgaggataagcttctccagactaggatattcgcgtatgctgatactcagagacaccgtattggaccaaactatatgcagctcccagttaatgctcccaagtgtggtcatcacaacaatcatcgcgatggtgccatgaacatgacacatcgcgatgaagaggtggattatttcccctcgaggtttgatccatgtcgtcctgctgagcagtacccaatacctgcttgtgtcttgaatggaaggcgtaccaattgtgtcattccgaaagagaacaactccaaacaggcaggggagaggtacagatcctgggaatctgacaggcaagacagatacatcaacaaatgggttgagtctctatccgatccacgagtcactcatgagattcgcagcatatggatatcatacttgtctcaggctgacaagtcctgtggtcagaaggtcgcttctcgtctcactgtgaagcccacaatgtga

SEQ ID NO: 43066 - protein, 492 aa, Solanum tuberosum
MDPSKYRPSSAYDTPFLTTNAGGPVYNNVSSLTVGPRGPVLLEDYYLIEKLATFDREKIPERVVHARGASAKGFFEVTHDISHLTCADFLRAPGAQTPVICRFSTVVHERGSPESIRDIRGFGVKFYNRGGNFDLVGNNVPVFFNRDAKSFPDTIRALKPNPKSHIQEDWRTLDFFSFLPESLHTFAFFYDDVCLPTDYRHMEGFGVHAYQLINKEGKAHYVKFHWKPTCGVKCMSEEEAIRVGGTNHSHATKDLYDSIAAGNYPEWKLFIQTMDPEDVDKFDFDPLDVTKTWPEDLLPLIPVGRLVLNRNIDNFFAENEQLAFNPGHIVPGIYYSEDKLLQTRIFAYADTQRHRIGPNYMQLPVNAPKCGHHNNHRDGAMNMTHRDEEVDYFPSRFDPCRPAEQYPIPACVLNGRRTNCVIPKENNSKQAGERYRSWESDRQDRYINKWVESLSDPRVTHEIRSIWISYLSQADKSCGQKVASRLTVKPTM

SEQ ID NO: 43067 - DNA, 1479 bp, Glycine max
  CDS (1)..(1479)
atggatccctacaagaatcggccatcaagcgccttcaattctcccttctggactacaaattccggtgctcccatctggaacaataactcatcgctgactgttggatctagaggtccaattctgctggaggattaccatctggtggagaagcttgcaaactttgacagggaacggatccccgaacgtgttgtccacgctcgtggagctagcgcaaagggtttctttgaagtcacgcatgacatttctcacctcacatgtgccgatttccttcgagcccctggagttcagacccccctcatcgtccgtttctccactgttatccacgagcgtggcagccccgaaaccctcagggatcccagaggttttgctgtcaaattctacaccagagagggtaacttcgaccttgtgggaaacaacttccctgtcttcttcgtccgcgatggcctcaagtttcctgacatggttcatgccctcaaacccaaccccaagtcccacatccaggagaattggaggatcctcgatttcttctcccaccatcccgaaagccttcacatgttctccttcttattcgacgacgttggtatccctcaagattacaggcatatggatggcttcggtgtcaacacctacacccttatcaacaaggccggcaaagcactctatgtcaaatttcattggaagaccacctctggcgaaaagtctcttttggacgacgaggccatcagggttggaggatccaaccacagtcatgccacccaggacctttacgattcaattgctgctggaaactatcctgagtggaaactctacatccaaacattggatcccgaaaacgaagacaggcttgactttgacccccttgatgttactaagacctggcccgaggacgttttgcccctccagcctgttggccgcatggtcttgaataagaacattgataacttctttgccgagaatgaacaacttgcattttgccctgccattattgtacctggtgtatactactccgatgataaattgcttcaaactcgcgtattctcctatgctgatacccagagacacagacttggaccaaattatctgcagcttcctgctaatgcccctaagtgtgcccatcacaacaatcaccatgatggtttcatgaatttcatgcacagggatgaagaggtcaattacttcccttcaaggtatgatcctgtccgtcatgcggaaaaggtccccgttcctcctcgtatcctaggtgggaagcgtgaaaagtgcatgattgagaaggagaacaacttcaagcaacctggggagagataccgatcctggccctctgacaggcaagaaaggtttgtccgccgatgggttgatgctttgtctgacccacgtgtcacccatgaaatccgtagcatctggatatcatactggtctcaggctgatcgttctcttggacaaaagatagcatctcacctgaacttgaagccaagtatctaa

SEQ ID NO: 43068 - protein, 492 aa, Glycine max
MDPYKNRPSSAFNSPFWTTNSGAPIWNNNSSLTVGSRGPILLEDYHLVEKLANFDRERIPERVVHARGASAKGFFEVTHDISHLTCADFLRAPGVQTPLIVRFSTVIHERGSPETLRDPRGFAVKFYTREGNFDLVGNNFPVFFVRDGLKFPDMVHALKPNPKSHIQENWRILDFFSHHPESLHMFSFLFDDVGIPQDYRHMDGFGVNTYTLINKAGKALYVKFHWKTTSGEKSLLDDEAIRVGGSNHSHATQDLYDSIAAGNYPEWKLYIQTLDPENEDRLDFDPLDVTKTWPEDVLPLQPVGRMVLNKNIDNFFAENEQLAFCPAIIVPGVYYSDDKLLQTRVFSYADTQRHRLGPNYLQLPANAPKCAHHNNHHDGFMNFMHRDEEVNYFPSRYDPVRHAEKVPVPPRILGGKREKCMIEKENNFKQPGERYRSWPSDRQERFVRRWVDALSDPRVTHEIRSIWISYWSQADRSLGQKIASHLNLKPSI

SEQ ID NO: 43069 - DNA, 1479 bp, Nicotiana tabacum
  CDS (1)..(1479)
atggatctctctaagtttcgaccatcaagcgcatatgattcccctttcttgacaacaaatgctggtggtcctgtctacaacaacgtttcttccttgactgttggacctagagggcctgttcttcttgaggattatcacttaatagagaagctcgcgacttttgatcgtgagcggatacctgagcgtgttgttcatgctagaggtgccagtgcaaaaggtttctttgaagtcactcatgatatttctcatcttacctgtgctgattttctccgagcgcctggggttcaaacacctgttatttgccgtttctctactgtcgtccatgagcgtggaagccccgagtcccttagggacattcgtggttttgctgtcaaattttacaccagagagggtaactttgatctggttggaaacaacgtccccgtcttctttaatcgtgatgcaaaatcgttccctgacacgattcgtgcactgaaaccaaatccaaagtcacacattcaggaatactggaagatccttgatttcttctctttccttccggagagtttgcatacttttgcctggtttttcgatgatgtttgtctcccgacagattacagacacatggaaggttatggtgttcacgcctatcaattaatcaacaaggctgggaaagcacattatgtgaagtttcactggaaaccaacttgtggtgtcaagtgcatgtcggaggaagaagctattagggtcggaggtacaaatcatagccacgccaccaaggatctctacgattcgattgctgctggaaactatcccgagtggaaactttttatccaaattatggacactgaggatgtagacaaattcgactttgatcctcttgatgtaaccaagacctggcctgaggatatcttgccattgatgccagttggacgattggtacttaacaggaatatcgataacttctttgctgagaacgagcagctcgcgtttaaccctggccatattgtccctggtctttactattcggaggacaagcttctccagactaggatattcgcgtatgctgatactcagagacaccgtattggaccaaactatatgcagcttcctgttaatgctcccaagtgtgctcatcacaataatcaccgcgatggtgccatgaacttcatgcatcgcgatgaagaggtggattatttgccctcaaggttcgatccttgtcgtcatgctgaacagtacccaattccttctcgtgtcttgacaggaaggcgtgaaatgtgtgtcattgagaaagagaacaacttcaagcaggcaggagaaagatacagatcctgggaacctgacaggcaagacagatatgttagcaaatgggttgagcatttatccgatccacgagtcacttatgagatacgcagtatatggatatcatacctgtctcaggctgacaagtcttgtggtcagaaggtcgcttctcgtctcactttaaagcctacaatgtga

SEQ ID NO: 43070 - protein, 492 aa, Nicotiana tabacum
MDLSKFRPSSAYDSPFLTTNAGGPVYNNVSSLTVGPRGPVLLEDYHLIEKLATFDRERIPERVVHARGASAKGFFEVTHDISHLTCADFLRAPGVQTPVICRFSTVVHERGSPESLRDIRGFAVKFYTREGNFDLVGNNVPVFFNRDAKSFPDTIRALKPNPKSHIQEYWKILDFFSFLPESLHTFAWFFDDVCLPTDYRHMEGYGVHAYQLINKAGKAHYVKFHWKPTCGVKCMSEEEAIRVGGTNHSHATKDLYDSIAAGNYPEWKLFIQIMDTEDVDKFDFDPLDVTKTWPEDILPLMPVGRLVLNRNIDNFFAENEQLAFNPGHIVPGLYYSEDKLLQTRIFAYADTQRHRIGPNYMQLPVNAPKCAHHNNHRDGAMNFMHRDEEVDYLPSRFDPCRHAEQYPIPSRVLTGRREMCVIEKENNFKQAGERYRSWEPDRQDRYVSKWVEHLSDPRVTYEIRSIWISYLSQADKSCGQKVASRLTLKPTM

SEQ ID NO: 43071 - DNA, 1479 bp, Triticum aestivum
  CDS (1)..(1479)
atggacccctacaagtaccggccgtcgagctccttcaacgccccgatgtggagcaccaactccggcgcgcccgtctggaacaacgacaactccctcaccgtcggatcccgaggtccgatcctgctggaggactaccacctggtggagaagatcgccgacttcgaccgtgagcgcatcccggagcgggtggtacacgcccggggcgccacggccaagggcttcttcgaggtcacccacgacgtctcccacctgacctgcgccgacttcctccgcgcgccgggggtgcagacccccgtcatagtgcgcttctccaccgtgatccacgagcgcggctcccccgagacgctccgcgacccgcgcggcttcgccatcaagttctacacccgggagggcaactgggacctggtgggcaacaacttccccgtcttcttcatccgcgacggcatgaagttcccggacatggtgcacgcgctcaagcccaaccccaagacccacatccaggagaactggcggatcctcgacttcttctcccaccacccggagtcgctccacatgttcaccttcctcttcgacgacatcggcgtgcccgccgactaccgccacatggacggctccggcgtcaacacctacacgctggtgaaccgcgccggcaaggcgcactacgtcaagttccactggaagcccacctgcggcgtcaagtcgctgctggaggaggaggcggtcacggtgggcggcaccaaccacagccacgccaccaaggacctcaccgactccatcgccgccggcaactacccggagtggaccttctacatccagaccatcgacccggactatgaggagcggttcgacttcgacccgctggacgtgaccaagacgtggcccgaggacgtggtgccgctgcagcccgtggggcggctggtgctgaaccgcaacatcgacaacttcttctcggagaacgagcagctggccttctgccccgggatcatcgtccccggggtgtactactcggacgacaagctgctgcagacaaggatcttctcctactccgacacgcagcgccaccgtctggggcccaactacctgctgctgccggccaacgcgcccaagtgctcccaccacaacaaccactacgacgggctcatgaacttcatgcaccgcgacgaggaggtcgactacttcccctcaaggttcgaccccgccaagcacgcgccccgctaccccatcccctcccgcaccctcaacggccgccgcgagaagatggtgatcgagaaggagaacaacttcaagcagcccggggagaggtaccgctccatggacccggcaaggcaagagcgattcatcaacagatggatcgacgcgctgtcggacccccgcctcacccatgagatcaaggccatctggctctcctactggtctcaggctgacaagtctctcggccagaagctcgcgagccgtctcagctccaagccgagcatgtaa

SEQ ID NO: 43072 - protein, 492 aa, Triticum aestivum
MDPYKYRPSSSFNAPMWSTNSGAPVWNNDNSLTVGSRGPILLEDYHLVEKIADFDRERIPERVVHARGATAKGFFEVTHDVSHLTCADFLRAPGVQTPVIVRFSTVIHERGSPETLRDPRGFAIKFYTREGNWDLVGNNFPVFFIRDGMKFPDMVHALKPNPKTHIQENWRILDFFSHHPESLHMFTFLFDDIGVPADYRHMDGSGVNTYTLVNRAGKAHYVKFHWKPTCGVKSLLEEEAVTVGGTNHSHATKDLTDSIAAGNYPEWTFYIQTIDPDYEERFDFDPLDVTKTWPEDVVPLQPVGRLVLNRNIDNFFSENEQLAFCPGIIVPGVYYSDDKLLQTRIFSYSDTQRHRLGPNYLLLPANAPKCSHHNNHYDGLMNFMHRDEEVDYFPSRFDPAKHAPRYPIPSRTLNGRREKMVIEKENNFKQPGERYRSMDPARQERFINRWIDALSDPRLTHEIKAIWLSYWSQADKSLGQKLASRLSSKPSM

SEQ ID NO: 43073 - DNA, 1479 bp, Arabidopsis thaliana
  CDS (1)..(1479)
atggatccttacaagtatcgtccagctagttcttacaactctcccttcttcaccaccaactctggtgctcctgtatggaacaacaactcctccatgaccgttggacccagaggtcctatccttcttgaggattaccatctcgttgagaagcttgccaatttcgacagggaacggattccagagcgtgtggttcatgccagaggagccagtgctaaaggtttctttgaggtcactcatgatatctctaacctcacttgtgctgactttctccgagctcccggtgttcagactcctgtcattgtccggttctccaccgttatccatgagcgtggaagtcccgagaccttgagagaccctcgtggttttgcagtcaagttctacaccagagaggggaactttgatcttgttggaaacaactttcctgttttcttcatccgcgatgggatgaagttccctgacatggtccacgctcttaagccgaacccaaaatctcacatccaagagaactggagaatccttgacttcttctcccaccaccctgaaagtttgaacatgttcactttcctcttcgatgatatcggtatcccacaagattacaggcacatggatggttcaggtgtcaatacatacatgttgatcaacaaagctggcaaagctcactacgtgaagttccattggaaaccaacttgtggagtcaagtctcttttggaagaagatgcaattcgtgttggaggaaccaaccacagtcatgcgactcaagacttgtatgactctatagctgctggaaactaccctgaatggaagctctttatccaaatcattgatcctgctgatgaagacaagttcgactttgacccgctcgatgtgaccaagacctggcctgaggatatcttgcctcttcaacctgttggacgtatggtgttgaacaagaacattgacaacttctttgcagagaatgagcaacttgctttctgtcctgcaattattgtcccagggatacattactcagatgataagctgcttcaaacccgtgtcttctcctatgccgatactcagagacaccgtcttggaccaaactaccttcagctgccagtcaatgctccaaaatgtgctcaccacaacaaccaccatgagggattcatgaatttcatgcacagggacgaggaggttaactacttcccgtcgaggtatgaccaggttcgtcatgctgagaagtatccaactccgcctgctgtctgttctggaaaacgtgagaggtgcattattgagaaagagaacaacttcaaggagcctggagagagataccgtacctttacaccagagaggcaagaacgattcatccagagatggattgatgccctatccgacccacgcatcacgcatgaaatccgcagtatctggatctcttactggtctcaggctgataagtctttgggacagaagctggcaagccgtctgaacgtgagaccaagcatctaa

SEQ ID NO: 43074 - protein, 492 aa, Arabidopsis thaliana
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLNMFTFLFDDIGIPQDYRHMDGSGVNTYMLINKAGKAHYVKFHWKPTCGVKSLLEEDAIRVGGTNHSHATQDLYDSIAAGNYPEWKLFIQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDQVRHAEKYPTPPAVCSGKRERCIIEKENNFKEPGERYRTFTPERQERFIQRWIDALSDPRITHEIRSIWISYWSQADKSLGQKLASRLNVRPSI

SEQ ID NO: 43075 - DNA, 1479 bp, Cucurbita pepo
  CDS (1)..(1479)
atggatccctacaagtaccggccatccagcgcgtacaacacaccgttctgcacgacaaactccggtgcaccaatatggaacaacacggccgtgatgtccgtcggcgaaaggggccccatccttctagaagactaccaactcatcgaaaaaatcgccacgttcacacgcgaaagaatcccggagcgtgtagttcacgcgcgaggagccagcgccaaaggcttcttcgaagtaacccacgacgtctccgacctatcctgcgccgacttcctccgtgcaccgggcgtccaaacccccgtcatcgtccgcttctccaccgtcatccacgaacgggtcagccccgaaactgtccgcgacccacgtggcttcgccgtcaaattctacacgcgcgaaggcaacttcgacttagttggcaataacttccccgtctttttcgtacgcgacgccatgcaattccctgacgtcatccgcgcgtttaaaccaaatcccaaatcccatctccaagaatcttggagattcttggatttctgctcttaccaccctgaaagcctgctctccttcgcttggttctatgatgacgtgggcatccccattaactaccgccacatggagggcttcggcgtgcaagcctattccctaatcaacaaagctggtaaagcccggctcgttaaattccattggaaacccacttgtggggttaagagcatgctcgaggaggaagccattagagtcggcggctccaaccatagccacgccactcaagatctctatgagtccattgccgccgggaacttcccggagtggcggctttacattcaaaccattgattatgaagaccaaaacaattatgattttgagccgctcgacacgaccattgcttggccggaggatgtcgtgccgttgcgaccagtggggcggttggttttgaataagaatattgataatttctttgctgagaatgagatgttggcgttctccatgtcgttggtgccggggattcattactcggatgataagatgttgcaagctaggagctttgcttatgctgatactcaaaggcatcggcttggccctaattatcttcagctgccggttaatgctcctaagtgtcctcaccataataatcatcatgaagggtttatgaactttatgcatagagatgaggaggtgaattacttcccttcgagatacgatgcttgtcgccatgctgagaagtacccgatgccgcccaatgtgttgagcggaaaaagagaaaggtgtgtgattccaaaggagaatcataacttcaagcaagctggagacagataccgatcatgggcaccagacaggcaagaacggttcgtgaatcggttcgtagaagcgttatcggactcgaaagtgactcatgaggttcgtaacatatggatctcgtactggactcaggcagacaggtctctgggacaaaagatagcgtctcgtatgaatgcgagaccaaacatgtaa

SEQ ID NO: 43076 - protein, 492 aa, Cucurbita pepo
MDPYKYRPSSAYNTPFCTTNSGAPIWNNTAVMSVGERGPILLEDYQLIEKIATFTRERIPERVVHARGASAKGFFEVTHDVSDLSCADFLRAPGVQTPVIVRFSTVIHERVSPETVRDPRGFAVKFYTREGNFDLVGNNFPVFFVRDAMQFPDVIRAFKPNPKSHLQESWRFLDFCSYHPESLLSFAWFYDDVGIPINYRHMEGFGVQAYSLINKAGKARLVKFHWKPTCGVKSMLEEEAIRVGGSNHSHATQDLYESIAAGNFPEWRLYIQTIDYEDQNNYDFEPLDTTIAWPEDVVPLRPVGRLVLNKNIDNFFAENEMLAFSMSLVPGIHYSDDKMLQARSFAYADTQRHRLGPNYLQLPVNAPKCPHHNNHHEGFMNFMHRDEEVNYFPSRYDACRHAEKYPMPPNVLSGKRERCVIPKENHNFKQAGDRYRSWAPDRQERFVNRFVEALSDSKVTHEVRNIWISYWTQADRSLGQKIASRMNARPNM

SEQ ID NO: 43077 - DNA, 1479 bp, Gossypium hirsutum
  CDS (1)..(1479)
atggatccttacaagtttcgtccttctagttcctttgattccccgttctggactaccaattctggtgctccagtttggaacaataactcatcacttactgtgggagcaagaggtccaattctccttgaagactatcatttggtggagaagctagctaatttcgacagagaacgcatacctgaacgtgttgttcatgctagaggagccagtgcgaaagggttctttgaggtcactcatgatatatctcagctcacatgtgctgatttccttcgtgcccctggagtgcagaccccgctcattgttagattctccacggttattcatgaacgtggtagtcctgaaactttgagagacccccgaggtttcgctgtgaaattttacactcgagagggaaattttgatctcgtggggaacaatttccctgtgtttttcatccgtgacggaatgaagttccctgatatggtccatgctcttaaaccaaacccgaagtcccacattcaggaaaactggaggattctggacttcttttcgcaccatcccgaaagcttgcacatgttcaccttcctgtttgatgacatcggtgttccacaggattataggcacatggatggctctggtgttcatacctacacactaatcaacaaggctgggaagtcacactatgtgaaattccattggaaacccacttgtggtgtaaaatctttgttggaggatgaagccataagagtaggtggtgcgaatcacagtcatgccacacaagatctttatgactcgattgcagccggaaactaccctgaatggaaactgttcattcaaataatggatcctcttcatgaggataggtttgattttgacccacttgatgtaaccaagacatggccagaggacatcttcccattgcagccaatgggtcgaatggtgttaaacaagaacatcgataacttctttgctgagaacgagcaattagccttctgcccttccctcattgtccctggcatctattattcagatgataagttgcttcaaactagaatcttctcctattctgacactcaaaggcaccgtcttggaccaaattatctgcagcttccagctaatgctcccaaatgtgctcatcacaataatcaccatgaaggttttatgaattttatgcatagagatgaggaggtgaactacttcccttcgaggtacgatcctgttcgccatgctgagaagcaccctattcctagcaccgttttgagcggcaaaagagagaagtgcattattgggaaggagaacaactttaagcagcctggggaacgataccggtccttttcagctgacaggcaagaacggtttattaatcgctggattgatgccttgtctgatccaagggtcacacacgagatccgcagcatttggatctcatactggtctcaggctgacaaatctttgggtcaaaagattgcttctcgcctcaatgttagaccaagcatttga

SEQ ID NO: 43078 - protein, 492 aa, Gossypium hirsutum
MDPYKFRPSSSFDSPFWTTNSGAPVWNNNSSLTVGARGPILLEDYHLVEKLANFDRERIPERVVHARGASAKGFFEVTHDISQLTCADFLRAPGVQTPLIVRFSTVIHERGSPETLRDPRGFAVKFYTREGNFDLVGNNFPVFFIRDGMKFPDMVHALKPNPKSHIQENWRILDFFSHHPESLHMFTFLFDDIGVPQDYRHMDGSGVHTYTLINKAGKSHYVKFHWKPTCGVKSLLEDEAIRVGGANHSHATQDLYDSIAAGNYPEWKLFIQIMDPLHEDRFDFDPLDVTKTWPEDIFPLQPMGRMVLNKNIDNFFAENEQLAFCPSLIVPGIYYSDDKLLQTRIFSYSDTQRHRLGPNYLQLPANAPKCAHHNNHHEGFMNFMHRDEEVNYFPSRYDPVRHAEKHPIPSTVLSGKREKCIIGKENNFKQPGERYRSFSADRQERFINRWIDALSDPRVTHEIRSIWISYWSQADKSLGQKIASRLNVRPSI

SEQ ID NO: 43079 - DNA, 1485 bp, Hordeum vulgare
  CDS (1)..(1485)
atggatccctgcaagttccggccgtcgagcagcttcgacaccaagacgacgacgacgaacgccgggcagccggtgtggaacgacaacgaggcgctcacggtggggccgcgcggcccgatcctgctggaggactatcacctgctggagaagatcgcccacttcgcgcgggagcgcatcccggagcgcgtcgtgcacgcgcggggcgcctccgccaagggcttcttcgagtgcacccacgacgtcaccggcctcacctgcgccgacttcctccgcgcgcccggggcgcgcacgccggtcatcgtccgcttctccaccgtgatccacgagcgcggctcgccggagaccatccgtgacccgcgcgggttcgccgtcaagttttacacgcgcgagggcaactgggacctgctcggcaacaacttccccgtcttcttcatccgcgacggcatcaagttccccgacgtcatccacgccttcaagcccaacccaaagtcccacgtgcaggagtactggcgcgtcttcgacttcctctcccaccacccggagagcctccacaccttcttcttcctcttcgacgacgtcggcatccccaccgactaccgccacatggacggcttcggcgtcaacacctacaccttcgtctcccgcgccggcaagtcccactacgtcaagttccactggcgccccacctgcggcgtcagctgcctcatggacgacgaggcaaccctcgttggcggcaagaaccacagccacgccacgcaggacctctacgactccatcgacgccggcaacttccccgagtggaagctcttcgtgcaggtcatcgaccccgacgaagaggaccgcttcgacttcgacccgctcgacgacaccaagacatggccagaggacctcgtccccctccagcccgtgggccgcctcgtgctcgaccgcaacgtcgacaacttcttcaacgagaacgagcagctcgcgttcggccccggcctcgtcgtgcccgggatctactactccgacgacaagatgctgcagtgcagggtgttcgcatacgccgacacgcagcgctaccgcctggggccaaactacctgatgctccccgtcaacgcgcccaagtgcggcttcaagaacaaccactacgacggcgccatgaacttcatgcaccgcgatgaggaggtggactactacccgtctcgccacgcgccgctccggcatgccgagccggccagcttccccgtgccgacgaggcccgtggttggaaagagggagaagacgaggatcaagaaggagaacgacttcgtgcagcccggggagaggtaccgcagctgggcgcccgaccgccaggacaggttcgtgcgccgcttctccgacgcgctcgcgcaccccaaggtcagccacgagctgcgtgtcatctggatcgacttcctctccaagtgtgacaagtcgtgcgggatgaaggtggcgaaccgcctcaacgtgaagccaagcatgtga

SEQ ID NO: 43080 - protein, 494 aa, Hordeum vulgare
MDPCKFRPSSSFDTKTTTTNAGQPVWNDNEALTVGPRGPILLEDYHLLEKIAHFARERIPERVVHARGASAKGFFECTHDVTGLTCADFLRAPGARTPVIVRFSTVIHERGSPETIRDPRGFAVKFYTREGNWDLLGNNFPVFFIRDGIKFPDVIHAFKPNPKSHVQEYWRVFDFLSHHPESLHTFFFLFDDVGIPTDYRHMDGFGVNTYTFVSRAGKSHYVKFHWRPTCGVSCLMDDEATLVGGKNHSHATQDLYDSIDAGNFPEWKLFVQVIDPDEEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRHAEPASFPVPTRPVVGKREKTRIKKENDFVQPGERYRSWAPDRQDRFVRRFSDALAHPKVSHELRVIWIDFLSKCDKSCGMKVANRLNVKPSM

SEQ ID NO: 43081 - DNA, 1479 bp, Lycopersicon esculentum
  CDS (1)..(1479)
atggatccttacaagtaccgtccgtcaagtgctttcaattcacctttctgtaccactaattctggtgctcctgtttttaataacaattcatctcttacggttggtgcaagaggtcctgtgttgcttgaggattaccatttggtggagaaacttgccaactttgacagggaacgtattgcagaacgtgttgttcatgcccgaggtgctagtgccaaagggttttttgaagttactcatgacattgctcaccttacctgtgctgatttccttcgagctcctggtgtacagactccagtcattgtgagattctctactgttattcatgaaaggggtagtcctgaaactctgagggatcctcgtggttttgctgtcaagttttacaccagagagggaaactttgatctggtagggaacaacttccccgtcttcttcatccgtgatggaatgaagttccctgacatggtccatgctctgaagccaaatcctaagtcccatatccaggagaattggagggtccttgattttttctctcatcatcccgaaagcctgcacatgttcactttcctcttcgacgatattggtattccccaagattacaggcatatggacgggtctggtgtccacacattcacattgatcaacagggctggaaaatcaacttatgtgaagttccactggaagcccacatgtggtgtcaagtctttgttggaagaaaaggcaatccgagtcggaggagcaaatcacagccatgctactcaggacctctatgactctattgcagctggaaattatcctgaatggaaaccctccattcagattatgggtccagaacatgaagacaaatttgactttgatccacttgatgtgacaaaaacttggccagaggacatcttgcctttgcagccggtgggaagattagttctgaacaagaacattgataacttcctttatatgaatgagcagctagctttctgcccttctattgtggttccaggtgtttattactcagatgataagatgcttcaaactcgtattttctcctactctgatacccagaggtatcgacttggaccaaactatttgcaacttcctgctaatgctccaaagtgtgctcatcacaacaatcactatgatggctctatgaattttatgcacagggatgaggagatcgactacttcccttcaaggtatgatcaagttcgccatgctgaggtgtatcctattccttcaacagtttgcagtggcaaacgcgagaagtgtatcattcaaaaagagaacaatttcaagcaaccaggagaaaggtaccgctcattcacacccgacagacaagaacgctttattcgtcggtgggtggaggccttgtctgatcctcgtatcacttatgaaatacgcagcatttggatcacatactggtctcaggctgacaagtctttgggtcaaaagcttgcatctaggcttaatgtgagaccaagcatatga

SEQ ID NO: 43082 - protein, 492 aa, Lycopersicon esculentum
MDPYKYRPSSAFNSPFCTTNSGAPVFNNNSSLTVGARGPVLLEDYHLVEKLANFDRERIAERVVHARGASAKGFFEVTHDIAHLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLHMFTFLFDDIGIPQDYRHMDGSGVHTFTLINRAGKSTYVKFHWKPTCGVKSLLEEKAIRVGGANHSHATQDLYDSIAAGNYPEWKPSIQIMGPEHEDKFDFDPLDVTKTWPEDILPLQPVGRLVLNKNIDNFLYMNEQLAFCPSIVVPGVYYSDDKMLQTRIFSYSDTQRYRLGPNYLQLPANAPKCAHHNNHYDGSMNFMHRDEEIDYFPSRYDQVRHAEVYPIPSTVCSGKREKCIIQKENNFKQPGERYRSFTPDRQERFIRRWVEALSDPRITYEIRSIWITYWSQADKSLGQKLASRLNVRPSI

SEQ ID NO: 43083 - DNA, 1476 bp, Zea mays
  CDS (1)..(1476)
atggacccgtacaagcaccgcccgtcgagcgccttcaacgccccgtactggaccaccaactccggcgcccccgtgtggaacaacgacagctccctcaccgtaggcgcacgaggtcccatcctgctggaggactaccactgtgagaagctagccaacttcgaccgcgagcgcatcccggagcgcgtggtgcacgcgcgtggcgccagcgccaagggcttcttcgaggtgacccacgacatcacccacctgacgtgcgccgacttcctgcgcgcgcccggggtgcagacgcccgtcatcgtccgcttctccacggtcatccacgagcgcgggagccccgagacgctccgggacccgcgcgggttcgccgtcaagttctacacccgggagggcaactgggacctggtgggcaacaacttccccgtcttcttcatccgcgacggcatcaagttcccggacatggtgcacgcgctcaagcccaacccgcggacgcacatccaggacaactggcgcatcctcgacttcttctcgcaccacccggagagcctgcacatgttctccttcctcttcgacgacgtcggcatccccgccgactaccgccacatggacggatccggggtgcacacgtacacgctcgtcagccgcgccggcaccgtcacctacgtcaagttccactggcgccccacctgcggcgtgcgctcgctgatggacgacgaggccgtccgttgcggcgccaaccacagccacgccaccaaggacctcacggacgccatcgcggcggggaacttccccgagtggacgctctacatccagaccatggaccccgagatggaagaccgcctcgacgacctggacccgctggacgtgaccaagacgtggcccgaggacacgttcccgctgcagcccgtgggccgcctggtgctcaaccgcaacatcgacaacttcttcgcggagaacgagcagctggccttctgcccgggcctcatcgtccctggtatctactactccgacgacaagctgctgcagaccaggatcttctcctactccgacacgcagcgccaccgcctcggccccaactacctgctgctaccggccaacgcgcccaagtgcgcacaccacaacaaccactacgacggatccatgaacttcatgcaccgccacgaggaggtcgactacttcccctccaggtacgacgccgtcaggaacgcgccgaggtacccgatcccgaccgcccacatcgccggccgccgagagaagactgtgattagcaaggagaacaacttcaagcagcccggggagaggtaccgcgcgatggacccagcaaggcaagagcggttcataaccagatgggtcgacgcgctctccgacccccgcctcacccacgagatcaggaccatctggctctccaactggtctcaggccgacaggtctctgggccagaagctcgcgagccgcctcagcgccaagccgagcatgtaa

SEQ ID NO: 43084 - protein, 491 aa, Zea mays
MDPYKHRPSSAFNAPYWTTNSGAPVWNNDSSLTVGARGPILLEDYHCEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHHPESLHMFSFLFDDVGIPADYRHMDGSGVHTYTLVSRAGTVTYVKFHWRPTCGVRSLMDDEAVRCGANHSHATKDLTDAIAAGNFPEWTLYIQTMDPEMEDRLDDLDPLDVTKTWPEDTFPLQPVGRLVLNRNIDNFFAENEQLAFCPGLIVPGIYYSDDKLLQTRIFSYSDTQRHRLGPNYLLLPANAPKCAHHNNHYDGSMNFMHRHEEVDYFPSRYDAVRNAPRYPIPTAHIAGRREKTVISKENNFKQPGERYRAMDPARQERFITRWVDALSDPRLTHEIRTIWLSNWSQADRSLGQKLASRLSAKPSM

SEQ ID NO: 43085 - DNA, 1479 bp, Nicotiana plumbaginifolia
  CDS (1)..(1479)
atggatccctctaagtttcgaccatcaagcgcatatgactcccctttcttgacaacaaatgctggcggtcctgtctacaacaacgtttcttccttgactgttggacctagagggcctgtccttcttgaggattatcacttaattgagaagcttgctacttttgatcgtgagaggatacccgagcgtgttgtccacgctagaggtgccagtgctaaaggtttctttgaagtcactcatgatatttctcatctcacttgtgctgattttctccgtgctcctggtgttcaaacacctgttattgtccgcttctctactgtcgtccatgagcgtggaagccccgagtcccttagggacattcgcggttttgctgtcaaattttacaccagagagggtaactttgatctggttggaaacaacgttcctgtcttctttaatcgtgatgcaaaatcgttccctgacacgatccgtgcactgaaaccaaatccaaagtcacacattcaggaatactggaggatccttgatttcttctctttccttccagagagtttgcatacgttcgcctggttctttgatgatgtttgtctcccgataaattacagacacatggaaggttatggtgtccacgcctatcaattaatcaacaaggctggaaaagcacattatgtgaagtttcactggaagccaacttgtggtgtcaagtgcatgacagaggaagaagctattagggtcggaggtacaaatcatagtcacgccaccaaggatctgtacgattcgattgctgttggaaactatcccgagtggaaactctctatccacattatggaccctgaggatgttgaaagattcgactttgatcctcttgatgtaaccaagatctggcctgaggatatcttgccattgatgccagttggtcgattggtacttaacaggaatatcgataacttctttgctgagaacgagcagctcgcgtttaaccctggccatattgtccctggtctgtactattcggaggataagcttctccagacaaggatattcgcgtatgctgatactcagagacaccgtattggaccaaactatatgcagcttcctgttaatgctcccaagtgtgctcatcacaataatcaccgcgatggtgccatgaacttcatgcatcgcgatgaagaggtggattatttgccctcaaggttcgatccttgtcgtcatgctgaacagtacccaattccttctcgtgtcttgaatggaaggcgtgaaatgtgtgtcattgagaaagagaacaacttcaagcaggcaggagagagatacagatcctgggaacctgacaggcaagacagatacgttagcaaatgggttgagcatttatctgatccccgagtcacttatgagatacgcagtatatggatatcatacttgtctcaggctgacaagtcttgtggtcagaaggtcgcttctcgtctcactttaaagcctacaatgtga

SEQ ID NO: 43086 - protein, 492 aa, Nicotiana plumbaginifolia
MDPSKFRPSSAYDSPFLTTNAGGPVYNNVSSLTVGPRGPVLLEDYHLIEKLATFDRERIPERVVHARGASAKGFFEVTHDISHLTCADFLRAPGVQTPVIVRFSTVVHERGSPESLRDIRGFAVKFYTREGNFDLVGNNVPVFFNRDAKSFPDTIRALKPNPKSHIQEYWRILDFFSFLPESLHTFAWFFDDVCLPINYRHMEGYGVHAYQLINKAGKAHYVKFHWKPTCGVKCMTEEEAIRVGGTNHSHATKDLYDSIAVGNYPEWKLSIHIMDPEDVERFDFDPLDVTKIWPEDILPLMPVGRLVLNRNIDNFFAENEQLAFNPGHIVPGLYYSEDKLLQTRIFAYADTQRHRIGPNYMQLPVNAPKCAHHNNHRDGAMNFMHRDEEVDYLPSRFDPCRHAEQYPIPSRVLNGRREMCVIEKENNFKQAGERYRSWEPDRQDRYVSKWVEHLSDPRVTYEIRSIWISYLSQADKSCGQKVASRLTLKPTM

SEQ ID NO: 43087 - DNA, 1479 bp, Ricinus communis
  CDS (1)..(1479)
atggatccttacaagtttcgcccatcaagctctaatgacacgcccttttggactaccaatgccggtgatccagtttccaacaacaattcctccatgacagttggacccagaggtccaattcttctcgaggactatcatatgatagagaaacttgccaactttactagggaaaggattccagagcgtgttgtccatgctagaggaatgagtgctaagggtttctttgaggtcacccatgatgtcactgaccttacatgcgctgatttccttcgtgcccccggtgttcagactcctgtcattgtccgtttctccactgttattcatgagcgtggcagccctgaaaccctcagagaccctcgaggttttgctaccaagttttacaccagagagggtaactttgatatagtgggaaacaacttcccagttttcttcatccgcgatggaattaaattcccagacgtggtccatgcatttaagcccaaccctaagtctcacatccaggagtattggaggatctttgatttctgctcacaccatcctgaaagtttgagcactttcgcctggttctttgatgatgtcggcattcctcaagattatagacacatggaagggtttggtgttcacacctactgtctaatcaacaaggctggaaaagttacctatgtcaaatttcactggaaacccacttgcggtgtcaagtgtttgatggatgatgaggctattaaggtcggaggagccaatcacagtcatgctactcaggatttatatgattccattgctgctggcaattttcctgagtggaaactcatgatccagacaatggatcctgcggatgaagacaaattctcctttgatccacttgatatgaccaagatttggcctgaggatatgttccccttgcatccagttgggcgattggtcttgaacaggaacatcgataactggtttgctgagaatgagatgcttgcattcaaccctgctcatgtggttcctggagtttactactccaatgataagttattccagcttaggctatttgcctatagtgatactcagaggcaccgactaggaacaaactatctacagctccctgtcaatgctcctaagtgtccttatcacaacaatcattatgatggtttcatgaatttcatgcacagagatgaggaggttgattacttccaatccagatatgatccagtccgccatgctgagaaagtccccattcctaatgctatctgcagtggcaggcgtgagaagtgtgtgattgagaaggaggacaacttcaggcaacctggagacaggtatcgatcatgggcaccagacaggcaagaaagattcttatgcagattggttaatgccttatcagaaccgcgtatcacccatgaaatccgcagtatctgggtctcatggtggactcagtgtgacaaatctctgggtcagaagctagcatctcgtcttaatgtgagaccaaacatctga

SEQ ID NO: 43088 - protein, 492 aa, Ricinus communis
MDPYKFRPSSSNDTPFWTTNAGDPVSNNNSSMTVGPRGPILLEDYHMIEKLANFTRERIPERVVHARGMSAKGFFEVTHDVTDLTCADFLRAPGVQTPVIVRFSTVIHERGSPETLRDPRGFATKFYTREGNFDIVGNNFPVFFIRDGIKFPDVVHAFKPNPKSHIQEYWRIFDFCSHHPESLSTFAWFFDDVGIPQDYRHMEGFGVHTYCLINKAGKVTYVKFHWKPTCGVKCLMDDEAIKVGGANHSHATQDLYDSIAAGNFPEWKLMIQTMDPADEDKFSFDPLDMTKIWPEDMFPLHPVGRLVLNRNIDNWFAENEMLAFNPAHVVPGVYYSNDKLFQLRLFAYSDTQRHRLGTNYLQLPVNAPKCPYHNNHYDGFMNFMHRDEEVDYFQSRYDPVRHAEKVPIPNAICSGRREKCVIEKEDNFRQPGDRYRSWAPDRQERFLCRLVNALSEPRITHEIRSIWVSWWTQCDKSLGQKLASRLNVRPNI

SEQ ID NO: 43089 - DNA, 1479 bp, Triticum aestivum
  CDS (1)..(1479)
atggatccctacaagcaccggcccacgagcggggccaactccgcctactggaccaccaactccggcgcccccgtctggaacaacaacaacgccctcaccgtcggacaccgaggacctatcctccttgaggattaccatctgattgaaaagcttgcacaatttgaccgggaacgcatacctgaacgtgttgttcatgcacggggagccagtgcaaaggggttctttgaggtgactcatgatgtttctcagctcacatgtgctgactttctccgggctcctggggttcagaccccggttattgtccggttctctaccgttgtgcatgagcgtggaagccctgagaccctcagggatccacgtggttttgcagtgaagttctacaccagagagggtaactttgaccttgttgggaacaatatgcctgtgttttttatccgagatgggatgaagttccctgacatggtccatgctttcaagccaagttcgaagaccaacatgcaggagaactggagagtagttgacttcttttcgcaccacccggagagtctgcacatgttcaccttcctatttgacgatgttggcattccactcaactacaggcacatggacggttttggtgtcaacacctacaccttaatcagcagggatggaaaggctcacctggttaagttccattggaaacctacatgtggtgtgaagtgcctcttggatgatgaagctgttactgttggaggcacctgccacacccatgccacaaaggacttgactgattctattgcagctgggaattacccagaatggaagcttttcatccagaccattgatgctgatcacgaggatagatttgactttgaccctcttgatgtcaccaagacctggccagaggacatcatcccactgcaaccagttggacggatggtactgaacaagaacattgacaatttcttcgcggaaaatgaacagcttgctttctgcccagcagtcactgtccctggaatccactactctgatgataagctgctccagacaaggatcttctcatatgctgatacccaaaggcaccgtcttggtccaaactacttgatgctccccgtgaatgccccgaaatgtgctcaccacaacaaccatcatgatggcttaatgaatttcattcacagggatgaggaggtgaactacttcccttcaagggttgatcctactcgtcatgctgaaaaggaccctatgcctccgcgtgttctatctggctgccgggagaagtgcattatcgacaaggagaacaatttcaagcaggctggtgagagatatcggtccttcgaccctgccaggcaagaccgtttcctccagcggtgggttgatgcgctcacggatgctcgtgtcacccatgaaatccagagcatctgggtctcatactggtcacagtgcgatgcgtccctcgggcagaagctggcgtcgcggctcaagattaagccgaacatgtaa

SEQ ID NO: 43090 - protein, 492 aa, Triticum aestivum
MDPYKHRPTSGANSAYWTTNSGAPVWNNNNALTVGHRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSSKTNMQENWRVVDFFSHHPESLHMFTFLFDDVGIPLNYRHMDGFGVNTYTLISRDGKAHLVKFHWKPTCGVKCLLDDEAVTVGGTCHTHATKDLTDSIAAGNYPEWKLFIQTIDADHEDRFDFDPLDVTKTWPEDIIPLQPVGRMVLNKNIDNFFAENEQLAFCPAVTVPGIHYSDDKLLQTRIFSYADTQRHRLGPNYLMLPVNAPKCAHHNNHHDGLMNFIHRDEEVNYFPSRVDPTRHAEKDPMPPRVLSGCREKCIIDKENNFKQAGERYRSFDPARQDRFLQRWVDALTDARVTHEIQSIWVSYWSQCDASLGQKLASRLKIKPNM

SEQ ID NO: 43091 - DNA, 1479 bp, Arabidopsis thaliana
  CDS (1)..(1479)
atggatccttacaagtatcgtccttcaagcgcgtacaacgccccattctacaccacaaacggtggtgctccagtctccaacaacatctcttccctcaccatcggagaaagaggtccggttcttcttgaggattatcatttgatcgagaaggttgctaatttcaccagagagaggatccctgagagagtggttcatgctagaggaatcagtgctaagggtttctttgaagtcacccatgacatttcaaacctcacttgtgctgattttctcagagcccctggtgttcaaactccggttattgtccgtttctccaccgttgtccacgaacgtgccagtcctgaaaccatgagggatattcgtggttttgctgtcaagttttacaccagagagggaaactttgatcttgttgggaacaacactccggtgttcttcatccgtgatgggattcagttcccggatgttgtccacgcgttgaaacctaacccgaaaacaaacatccaagagtactggaggattctggactacatgtcccacttgcctgagagtttgctcacatggtgctggatgtttgatgatgttggtattccacaagattacaggcacatggagggtttcggtgtccacacctacactcttattgccaaatctggaaaagttctctttgtgaagttccactggaaaccaacttgtgggatcaagaatctgactgatgaagaggccaaggttgttggaggagccaatcacagccacgccactaaggatctccacgatgccattgcatctggcaactaccccgagtggaaacttttcatccagaccatggatcctgcagatgaggataagtttgactttgacccacttgatgtgaccaagatctggcctgaggatattttgcctctgcaaccggttggtcgcttggttctgaacaggaccattgacaatttcttcaatgaaactgagcagcttgcgttcaacccgggtcttgtggttcctggaatctactactcagacgacaagctgctccagtgtaggatctttgcttatggtgacactcagagacatcgccttggaccgaattatttgcagcttccagtcaatgctcccaaatgtgctcaccacaacaatcaccatgaaggttttatgaacttcatgcacagagatgaggagatcaattactacccctcaaagtttgatcctgtccgctgcgctgagaaagttcccacccctacaaactcctacactggaattcgaacaaagtgcgtcatcaagaaagagaacaacttcaaacaggctggagacaggtacagatcatgggcaccagacaggcaagacaggtttgttaagagatgggtggagattctatcggagccacgtctcacccacgagatccgcggcatctggatctcttactggtctcaggctgatcgatccttgggacagaaacttgcaagccgtctgaacgtgaggccaagcatctag

SEQ ID NO: 43092 - protein, 492 aa, Arabidopsis thaliana
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPTPTNSYTGIRTKCVIKKENNFKQAGDRYRSWAPDRQDRFVKRWVEILSEPRLTHEIRGIWISYWSQADRSLGQKLASRLNVRPSI

SEQ ID NO: 43093 - DNA, 1479 bp, Cucurbita pepo
  CDS (1)..(1479)
atggatccctacaagtaccgcccttcaagtgcctacaacacgcccttttgcaccaccaactccggtgcaccaatatggaacaacaccgccgtcatgtcggtcggagaacgaggtcccattcttttggaagactaccaactcattgaaaaaatcgcaaccttcacacgcgagcgtatcccggagcgtgttgtccaccgaagaggagccagtgccaagggattctttgaagtaacccatgacatttccaacctcacttgcgccgacttccttcgcgcccccggagtccaaaccccagtcatcgtccgcttctccaccgtcatccacgaacgcggtagccctgagaccctccgcgatccccgtggcttcgccgtcaaattctacacacgagaaggcaacttcgacttggtcggtaataacttcccggtcttcttcgtccgcgacgccatgcaattccccgacgtcatccgcgcgttcaaaccaaaccctaaatcccatctccaagaaccatggagatacctggatttctgttcttaccaccccgaaagtctgttgtcgtttgcttggttttacgacgacgtcggcatcccgatcaactaccgccacatggagggctttggcgtgcaagcttactccttaatcaacaaatccggcaaagcccggctcgtgaaattccattggaaacccacttgtggggttaaaagcatgatggaggaggaagccattagaattggtgggacgaaccacagccatgccactcaagatctatacgagtcaatagccgccgggaacttcccggagtggaggctctacattcaaaccattgattacgaggatcagaataagtatgattttgagccgttggatacgacgatcacttggccggaggatgtggtgccgttgcagccggtggggcggttggtgttgaacaagaacatagataatttctttgcggagaatgagatgttggcgttctccatgtcgttggtgcctgggattcattactccgatgataagatgttgcaagctaggagctttgcttatgctgatactcaaaggcatcgccttggccctaattaccttcagcttccggtcaatgctcccaagtgtccgcatcataataaccatcatgaggggtttatgaacttcatgcatagagatgaagaggtgaattactttccttctagatatgatccttgccggcatgctgagaagtttccgatgccgcccaatgtgttgaccggaaaaagagaaaggtgtgtgattccaaaggagaataacaacttcaagcaagctggggatagataccgatcatgggcaccggacaggcaagaccggttcgtgaagcggtttgtggaagcgttgtcggatccccgcgtgaccgatgaagttcgcaacatatggatctcttattggtctcaagctgataggtctctgggccaaaagatagcgtctcgactgaacgtgaggccgaacatctaa

SEQ ID NO: 43094 - protein, 492 aa, Cucurbita pepo
MDPYKYRPSSAYNTPFCTTNSGAPIWNNTAVMSVGERGPILLEDYQLIEKIATFTRERIPERVVHRRGASAKGFFEVTHDISNLTCADFLRAPGVQTPVIVRFSTVIHERGSPETLRDPRGFAVKFYTREGNFDLVGNNFPVFFVRDAMQFPDVIRAFKPNPKSHLQEPWRYLDFCSYHPESLLSFAWFYDDVGIPINYRHMEGFGVQAYSLINKSGKARLVKFHWKPTCGVKSMMEEEAIRIGGTNHSHATQDLYESIAAGNFPEWRLYIQTIDYEDQNKYDFEPLDTTITWPEDVVPLQPVGRLVLNKNIDNFFAENEMLAFSMSLVPGIHYSDDKMLQARSFAYADTQRHRLGPNYLQLPVNAPKCPHHNNHHEGFMNFMHRDEEVNYFPSRYDPCRHAEKFPMPPNVLTGKRERCVIPKENNNFKQAGDRYRSWAPDRQDRFVKRFVEALSDPRVTDEVRNIWISYWSQADRSLGQKIASRLNVRPNI

SEQ ID NO: 43095 - DNA, 1491 bp, Zea mays
  CDS (1)..(1491)
atgacaatggatcctaccaagttccgtccgtccagcagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggcgcgtccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgggtgttcgacttcctgtcgcacctccccgagagcctgcacaccttcttcttcctcttcgacgacgtgggcgtgccgtccgactaccgccacatggaagggttcggcgtgaacacgtacacgttcgtgagcgcggcggggaaggcgcagtacgtgaagttccactggaagccgacgtgcggcgtgcggtgcatcctgacggacgaggaggcggcgctggtcgggggacggaaccacagccacgcgacgcaggacctgtacgactccatcgcggcggggagcttcccggagtggacgctgtacgtgcaggtgatggacccggacacggaggagcagtacgacttcgacccgctggacgacaccaagacgtggccggaggacctgctgccgctccgccccgtggggaggctggtgctggacaggaacgtggacaacttcttcaacgagaacgagcagctggcgttcgggccggggctggtggtgccagggatctactactcggacgacaagatgctgcagtgccgggtgttcgcctacgccgacacgcagcgctacaggctgggtcccaactacctgatgctgcccgtcaacgcgccgcgctgcgcgcaccacaacaaccactacgacggcgccatgaacttcatgcaccgcgacgaggaggtggactactacccgtccaggcacgcgccgctgcggcaggcggcgccgcccacgccactgccgcccaggccggtcgcggggaggagggagaaggcaaccatacgcaagcccaacgacttcaagcagccaggggagaggtaccgctcctgggacgccgaccgacaggaccgattcgtgaggcgattcgccgactcgctcggacacccaaaggtcagccaggagctcaggtccatctggatagacctcctcgccaagtgcgacgcgtcgctggggatgaagattgccacccggctcaacatgaaggcaaacatgtga

SEQ ID NO: 43096 - protein, 496 aa, Zea mays
MTMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKANM

SEQ ID NO: 43097 - DNA, 2160 bp, Neurospora crassa
  CDS (1)..(2160)
atgcgtgtcaacgctcttctaccgttgagcggccttattggcactgctctagcggcatgcccctttgccgacccttctgctcttggtcgccgtgccgagggcggtgaggttgacgcccgtcagaggttgaaggaggttgaggttgacgacaacggccaattcatgacaacagatttcggcggcaacattgaggaacagttcagtctgaaggctggtggccggggctcgacattgcttgaggacttcatcttccgtcagaagctccagcacttcgaccatgagcgcattcccgagagagtcgttcatgcccgtggtgccggtgcccacggtatcttcaccagttatggcgactggtccaacatcaccgccgcctccttcctgggcgccaaggacaagcaaacaccggtcttcgtccgcttctctaccgttgccggttccaggggttccgccgacactgcccgtgatgttcacggcttcgccacgagattctataccgacgagggcaactttgatatcgtcggcaacaacattcccgtctttttcatccaggatgccatccgcttccccgaccttattcactccgtcaagcctagccccgacaatgaggttccccaagccgccaccgcccacgactccgcttgggacttcttcagctcccagccctccgctctccacaccctcttctgggccatgtctggcaacggtattccccgcagctaccgtcatatggatggtttcggtatccataccttccgtctggtgaccgaggacggcaagtccaagctcgtcaagtggcattggaagacgaaacagggaaaggccgctctcgtctgggaggaggctcaagtcctcgccggcaagaacgccgacttccaccgtcaggatctctgggacgctatcgagtccggaaacgccccttcatgggagctcgccgttcagcttattgacgaggacaaggcccaggcttacggcttcgaccttcttgatcccaccaagttccttcccgaggagttcgcccctctccaggttctcggtgagatgaccctcaaccgcaaccctatgaactacttcgccgagaccgagcagatctccttccagcccggccacattgttcgcggcgtcgacttcaccgaggatcccctgctgcagggtcgtctctacagctacctcgacacccagctcaaccgccacaggggccccaactttgagcagctccccatcaaccgccctgtctctggcgtccacaacaaccaccgcgacggtcaaggccaggcttggatccacaagaacatccaccactacagcccgtcttacctcaacaagggctaccctgcccaggccaaccagaccgtcggccgcggcttcttcactacccccggccgcaccgcgtctggcgtcctgaaccgcgagctcagcgccacctttgacgaccactacacccagccccggctcttcttcaactcgctcacccccgtcgagcagcagttcgtcatcaacgcgatccgcttcgaggccagccacgtcaccaacgagcaggtcaagaagaacgttctcgagcagcttaacaagatctccaacgacgtggccaagcgcgtggccgttgcgctcggcctcgaggcgccccagcccgacccgacctactaccacaacaatgtcacccgcggcgtttccatcttcaacgagagcctccccaccatcgccaccctccgcgtcggcgtcctctccaccaccaagggcggctccctcgacaaggccaaggccctcaaggagcagctcgagaaggacggcctcaaggtcaccgtcatcgccgagtaccttgccagcggtgtcgaccagacctactccgctgccgacgccaccgccttcgatgccgttgtcgtggccgagggcgctgagcgcgtcttcagcggcaagggcgccatgagccctcttttccctgctggccgtcctagccagattcttactgatggttaccgctggggtaagcccgttgctgccgtcggcagcgccaagaaggcgctccagagcatcggggtagaggagaaggaggccggtgtttatgccggtgctcaggacgaggttatcaagggcgtcgaggagggcctcaaggtgttcaagttccttgagcgtttcgccgttgatggcgatgatgaggagtaa

SEQ ID NO: 43098 - protein, 719 aa, Neurospora crassa
MRVNALLPLSGLIGTALAACPFADPSALGRRAEGGEVDARQRLKEVEVDDNGQFMTTDFGGNIEEQFSLKAGGRGSTLLEDFIFRQKLQHFDHERIPERVVHARGAGAHGIFTSYGDWSNITAASFLGAKDKQTPVFVRFSTVAGSRGSADTARDVHGFATRFYTDEGNFDIVGNNIPVFFIQDAIRFPDLIHSVKPSPDNEVPQAATAHDSAWDFFSSQPSALHTLFWAMSGNGIPRSYRHMDGFGIHTFRLVTEDGKSKLVKWHWKTKQGKAALVWEEAQVLAGKNADFHRQDLWDAIESGNAPSWELAVQLIDEDKAQAYGFDLLDPTKFLPEEFAPLQVLGEMTLNRNPMNYFAETEQISFQPGHIVRGVDFTEDPLLQGRLYSYLDTQLNRHRGPNFEQLPINRPVSGVHNNHRDGQGQAWIHKNIHHYSPSYLNKGYPAQANQTVGRGFFTTPGRTASGVLNRELSATFDDHYTQPRLFFNSLTPVEQQFVINAIRFEASHVTNEQVKKNVLEQLNKISNDVAKRVAVALGLEAPQPDPTYYHNNVTRGVSIFNESLPTIATLRVGVLSTTKGGSLDKAKALKEQLEKDGLKVTVIAEYLASGVDQTYSAADATAFDAVVVAEGAERVFSGKGAMSPLFPAGRPSQILTDGYRWGKPVAAVGSAKKALQSIGVEEKEAGVYAGAQDEVIKGVEEGLKVFKFLERFAVDGDDEE

SEQ ID NO: 43099 - DNA, 1479 bp, Nicotiana plumbaginifolia
  CDS (1)..(1479)
atggatccatacaagtatcgtccttcaagtgctaacaattcccccttctggacaactaattctggtgctcctgtgtggaacaacaactcttccatgactgttggaactagaggcccaattcttcttgaggattatcatctggtggagaagcttgccaattttgatcgtgaacgaattccggagcgcgttgttcatgccagaggtgccagtgccaagggtttctttgaggtcacacatgatattacccatcttacatgtgctgatttcctccgagctcctggggtccagacacctgttattgtgaggttctctactgttatccacgagcgtggaagccctgaaaccctcagggaccccagaggatttgctgtaaaattttacaccagagagggcaactttgatttggttggaaacaacttccccgtcttctttgtccgtgatgggatgaagttccctgacatggttcatgcactgaaaccaaatccaaagtcccacattcaggagaactggaggatccttgatttcttctctcatcatccagaaagtctgcatatgttctccttcctgtttgatgatctcggtgtcccacaagattacaggcacatggaaggttccggtgttaatacctacatgttgatcaacaaagctgggaaagcacattatgtgaaattccattggaagccaacttgtggagtcaagtgcttgttggaggaagaagctattaaggtaggaggagcgaatcatagtcacgccaccaaggatctctacgattcaattgctgctggaaactatccagagtggaaactgttcatccaaattatcgatcctgatcatgaagacagatttgactttgaccccctagatgtaaccaagacctggcctgaggacatcttgccattgcagccagttggtcgcttggtattgaataagaatatcgataacttctttgcagagaatgaacagcttgccttttggcctgccattgttgtccctggtgtttactgttcggatgacaagcttctccagactaggatattctcatattctgatgcccagagacaccgtcttgggccaaactatctgcagctcccagttaacgctcccaagtgtgctcatcacaataatcaccatgaaggtttcatgaatttcatgcaccgcgatgaagaggtcaactatttcccctcaaggtttgatccttgtcgtcatgcagaacagtatccaattcctccttgtgtcttgacaggaaaacgtgacaagtgcatcattgaaaaagagaacaacttcaagcagccgggagagagatacagatcttgggcaccggacaggcaagaaagatttatctgcagatgggttgatgctctatccgatcctcgagtcactcatgagatacgcagtatctggttttcatactggtcacaggctgacaaaactcttggtcagaagatcgcgtcccgtctcaatgtcaggcccacaatgtga

SEQ ID NO: 43100 - protein, 492 aa, Nicotiana plumbaginifolia
MDPYKYRPSSANNSPFWTTNSGAPVWNNNSSMTVGTRGPILLEDYHLVEKLANFDRERIPERVVHARGASAKGFFEVTHDITHLTCADFLRAPGVQTPVIVRFSTVIHERGSPETLRDPRGFAVKFYTREGNFDLVGNNFPVFFVRDGMKFPDMVHALKPNPKSHIQENWRILDFFSHHPESLHMFSFLFDDLGVPQDYRHMEGSGVNTYMLINKAGKAHYVKFHWKPTCGVKCLLEEEAIKVGGANHSHATKDLYDSIAAGNYPEWKLFIQIIDPDHEDRFDFDPLDVTKTWPEDILPLQPVGRLVLNKNIDNFFAENEQLAFWPAIVVPGVYCSDDKLLQTRIFSYSDAQRHRLGPNYLQLPVNAPKCAHHNNHHEGFMNFMHRDEEVNYFPSRFDPCRHAEQYPIPPCVLTGKRDKCIIEKENNFKQPGERYRSWAPDRQERFICRWVDALSDPRVTHEIRSIWFSYWSQADKTLGQKIASRLNVRPTM

SEQ ID NO: 43101 - DNA, 1479 bp, Glycine max
  CDS (1)..(1479)
atggatccctacaagaatcggccatcaagcgccttcaattctcccttctggactactaattccggtgctcccatctggaacaacaactcatcgctgactgttggatctagaggtccaattctgctggaagattaccatctggtggagaagcttgcaaactttgacagggaacggatccccgaacgtgttgtccatgctcgtggagctagcgcaaagggtttctttgaagtcacgcatgacatttctcacctcacatgtgccgatttcctccgagcccctggagttcagacccctctcatcgtccgtttctccactgttatccacgaacgtggcagccctgaaaccctcagggatcccagaggtttcgctgtgaaattctacactagagagggtaacttcgaccttgtgggaaacaacttccctgtcttcttcgtccgcgatggcctcaagtttcctgacatggtccatgctctcaaacccaaccccaagtcccacatccaggagaattggaggatcctcgatttcttctcccaccatcccgaaagccttcacatgttctccttcttattcgatgacgttggtatccctcaagattacaggcatatggatggttttggtgttaacacttacacccttatcaacaaggctggcaaagccgtctatgtcaaatttcattggaaaaccacctgtggcgaaaagtgtctcttggacgacgaggccattagggttggaggatcgaaccacagtcatgccacccaagacctttacgattcaattgctgctggaaactatcctgagtggaaactctacatccaaacattggatcccgaaaacgaagacaggcttgactttgacccccttgatgtaactaagacctggcctgaggacgttttgcccctccagcctgttggccgcatggtcttgaataagaacattgataacttctttgccgagaacgaacaacttgcattttgccctgcaattattgtacctggtgtatactactccgacgataaattgcttcagactcgcatattctcctatgctgatacccaaagacacagacttgggccaaattatctgcagcttcctgctaattcccccaagtgtgcccatcacaacaatcaccatgatggtttcatgaatttcatgcacagggatgaagaggtcaattacttcccttcaaggtatgatcctgtccgtcacgcggaaagggtccccgttcctccacgtaccctaggtgggaagcgtgaaaagtgcatgattgagaaggagaacaacttcaagcaacctggggagagataccgatcctggccctctgacaggcaagaaagatttgtccgccgatgggttgatgctttgtctgacccacgtgtcacccatgaaatccgcagcatctggatatcatactggtctcaggctgatcgttctcttggacaaaagatagcatctcacttgaacttgaagccaagtatctaa

SEQ ID NO: 43102 - protein, 492 aa, Glycine max
MDPYKNRPSSAFNSPFWTTNSGAPIWNNNSSLTVGSRGPILLEDYHLVEKLANFDRERIPERVVHARGASAKGFFEVTHDISHLTCADFLRAPGVQTPLIVRFSTVIHERGSPETLRDPRGFAVKFYTREGNFDLVGNNFPVFFVRDGLKFPDMVHALKPNPKSHIQENWRILDFFSHHPESLHMFSFLFDDVGIPQDYRHMDGFGVNTYTLINKAGKAVYVKFHWKTTCGEKCLLDDEAIRVGGSNHSHATQDLYDSIAAGNYPEWKLYIQTLDPENEDRLDFDPLDVTKTWPEDVLPLQPVGRMVLNKNIDNFFAENEQLAFCPAIIVPGVYYSDDKLLQTRIFSYADTQRHRLGPNYLQLPANSPKCAHHNNHHDGFMNFMHRDEEVNYFPSRYDPVRHAERVPVPPRTLGGKREKCMIEKENNFKQPGERYRSWPSDRQERFVRRWVDALSDPRVTHEIRSIWISYWSQADRSLGQKIASHLNLKPSI

SEQ ID NO: 43103 - DNA, 1479 bp, Glycine max
  CDS (1)..(1479)
atggatccctacaagcaccggccatccagcgccttcaattctcccttctggactacaaattctggtgctcctatttggaacaacaactcctctttaaccgttggagctagaggtccaattctgctggaggattatcatcttgtggagaagcttgcaaattttgatagggaacgtatcccagaacgtgttgtccatgccaggggcgctagtgcaaagggtttctttgaggtcacccatgacatttctcacctgacatgtgcagatttccttcgagcccctggagttcagacgcctgtaattgttcgtttctcaactgtcattcatgagcgtggtagccctgaaaccttgagggaccctcgaggttttgccgtgaagttttacaccagagaaggtaactttgaccttgttggaaacaaccttcccgtcttctttgtacgtgatggcatgaagtttccagatatggttcatgctcttaaacccaatcccaagaaccacatccaggagaattggaggatccttgacttcttctctcactttccagaaagccttcacatgttcacctttttatttgatgatttgggtgttccacaagattacaggcatatggatggttttggagttaacacatacacactgatcaacaaggctgggaaagcagtgtatgtgaaatttcactggaagaccactagtggtataaagtgtctattggaggaagaggccattaaggtgggaggagccaaccacagccatgccactcaagaccttcatgattcaattgctgctggtaactatcctgagtggaaactgttcgttcagacaatagatcctgagcatgaagacaaatttgactttgaccctcttgatgttactaagacttggcctgaggacattatacccttgcagcctgttggtcgcttggtcctgaataaaaacatagataatttctttgctgagaatgaacaacttgcattttgccctgccattgtggttcctggtgtatactactcagatgataagatgcttcagaccaggatattctcttatgctgattcacaaaggcacagacttggaccaaactatctgcaacttcctgctaatgctcccaagtgtgctcaccacaataatcatcatgaaggtttcatgaatttcattcacagggatgaggaggtcaattacttcccttcaaggtatgatcctgttcgtcatgcagaaaggttccccatacctcctgctatctgcagtggaaggcgtgaaaagtgtggaattgagaaggagaacaacttcaagcagcccggagagagataccggtcttgggcacctgacaggcaagatagatttgctcgccgatgggttgatgctttatctgacccacgggtcacccatgagatccgcagtgtctggatatcatactggtctcaggctgaccgttctctaggccaaaagatagcttctcatctcagcacgaggccaaatatttaa

SEQ ID NO: 43104 - protein, 492 aa, Glycine max
MDPYKHRPSSAFNSPFWTTNSGAPIWNNNSSLTVGARGPILLEDYHLVEKLANFDRERIPERVVHARGASAKGFFEVTHDISHLTCADFLRAPGVQTPVIVRFSTVIHERGSPETLRDPRGFAVKFYTREGNFDLVGNNLPVFFVRDGMKFPDMVHALKPNPKNHIQENWRILDFFSHFPESLHMFTFLFDDLGVPQDYRHMDGFGVNTYTLINKAGKAVYVKFHWKTTSGIKCLLEEEAIKVGGANHSHATQDLHDSIAAGNYPEWKLFVQTIDPEHEDKFDFDPLDVTKTWPEDIIPLQPVGRLVLNKNIDNFFAENEQLAFCPAIVVPGVYYSDDKMLQTRIFSYADSQRHRLGPNYLQLPANAPKCAHHNNHHEGFMNFIHRDEEVNYFPSRYDPVRHAERFPIPPAICSGRREKCGIEKENNFKQPGERYRSWAPDRQDRFARRWVDALSDPRVTHEIRSVWISYWSQADRSLGQKIASHLSTRPNI

SEQ ID NO: 43105 - DNA, 2250 bp, Aspergillus fumigatus
  CDS (1)..(2250)
atggccacaaagattgctggaggcttacacagagcgcaggaagtgcttcaaaacacatcctctaaaagcaagaaattggtcgatttagaaagagatacggccgatgcgcatacccagcagccattgactacggatcacggtgtacgagtcagcaacaccgatcaatggcttagagttacgaatgaccgccgaactggcccatccttgctggaggatcagattgccagagaaaagatccatcgctttgatcatgaacgtattcctgaaagagtagtccatgcgcgtggcactggcgcattcggaaacttcaagcttaaggagagcattgaagatctgacttatgccggtgtgttgacggatacatccagaaacacgccagtctttgttcgcttttcaaccgtccaaggaagtagaggtagcgctgatacagtccgcgatgttcgtgggttcgctgtcaagttctacaccgatgaaggcaactgggacattgttgggaacaacatccctgtgtttttcattcaagatgccgtcaagttcccagattttgtccatgctgtcaagccggagcctcacaacgaggtccctcaggcccaaacagcccacaacaacttctgggattttgtgtacttgcacccagaagccacccacatgttcatgtgggccatgtctgaccgcgccatcccccgatcctaccggatgatgcagggatttggtgtcaatacttttgctctcgtcaacaaagaaggaaagcgacactttgtcaagttccactggatcccccatctgggtgttcactctctcgtgtgggacgaagccttgaagctgggaggccaagaccctgatttccatcgcaaagacctgatggaggctatcgacaacaaggcgtatccgaaatgggacttcgcaatccaagtcattccagaggagaagcaggatgactttgagtttgacattttggatgccaccaagatctggcctgaaaaccttgtgccccttcgtgtgattggagagctcgagctgaaccgcaacgtcgacgaattcttccctcagaccgagcaggtcgcattctgcaccagccacatcgtccctggcattgacttcaccgacgatccacttctccaaggccgaaacttctcctacttcgacacccagatcagccgcctgggcatcaattgggaagagctgccaatcaaccgtccagtgtgccctgtgctcaaccacaaccgcgacggacagatgcgccatcgaatcacgcaaggcacggtcaactactggcccaaccgcttcgaagccgtgcccccgaccggcaccaagggctccggagtgggcggcgggttcacaacctacccccagcgggtggagggcatcaagaaccgcgccctcaacgacaaatttcgcgagcaccacaaccaagcccagctcttctacaactcaatgtccgagcacgagaagctccacatgaagaaggctttcagcttcgagctcgaccactgcgacgaccccaccgtctacgaacggctcgccggccatcgcctcgccgaaatcgacctcgagctcgcccagaaagtcgccgagatggtcggtgccccgatcccagccaaggccctcaagcagaaccacggccgacgcgccccgcacctctcccagactgagttcatccccaagaaccccaccatcgccagccgccgcatcgccattatcataggcgacggctacgaccccgtcgcttccaccggcttgaagaccgctatcaaggctgccagcgccctccccttcatcattggcaccaagcgctccgccatctacgcgacggaggacaagacctcctccaagggcatcattccggaccaccactacgacggccagcgctcaaccatgttcgacgcaaccttcatccccggcggcccgcacgtcgccaccctgcgccagaacgggcagatcaagtactggatatccgagaccttcggtcacctcaaggcgctgggtgctaccggcgaggctgtggatctcgtcaaggagacgctgagcggcacgctgcacgtccaggtggcgtcgtcgcagagccctgagcccgtcgagtggtatggtgttgtgactgcgggcgggaagcaaaagcccgagagctttaaggaaagcgtgcagattctcaagggcgcaacggactttgtgggcaagttcttctaccagatctcgcagcacaggaattatcagcgtgaattggacggtctggcatcgaccattgctttctag

SEQ ID NO: 43106 - protein, 749 aa, Aspergillus fumigatus
MATKIAGGLHRAQEVLQNTSSKSKKLVDLERDTADAHTQQPLTTDHGVRVSNTDQWLRVTNDRRTGPSLLEDQIAREKIHRFDHERIPERVVHARGTGAFGNFKLKESIEDLTYAGVLTDTSRNTPVFVRFSTVQGSRGSADTVRDVRGFAVKFYTDEGNWDIVGNNIPVFFIQDAVKFPDFVHAVKPEPHNEVPQAQTAHNNFWDFVYLHPEATHMFMWAMSDRAIPRSYRMMQGFGVNTFALVNKEGKRHFVKFHWIPHLGVHSLVWDEALKLGGQDPDFHRKDLMEAIDNKAYPKWDFAIQVIPEEKQDDFEFDILDATKIWPENLVPLRVIGELELNRNVDEFFPQTEQVAFCTSHIVPGIDFTDDPLLQGRNFSYFDTQISRLGINWEELPINRPVCPVLNHNRDGQMRHRITQGTVNYWPNRFEAVPPTGTKGSGVGGGFTTYPQRVEGIKNRALNDKFREHHNQAQLFYNSMSEHEKLHMKKAFSFELDHCDDPTVYERLAGHRLAEIDLELAQKVAEMVGAPIPAKALKQNHGRRAPHLSQTEFIPKNPTIASRRIAIIIGDGYDPVASTGLKTAIKAASALPFIIGTKRSAIYATEDKTSSKGIIPDHHYDGQRSTMFDATFIPGGPHVATLRQNGQIKYWISETFGHLKALGATGEAVDLVKETLSGTLHVQVASSQSPEPVEWYGVVTAGGKQKPESFKESVQILKGATDFVGKFFYQISQHRNYQRELDGLASTIAF

SEQ ID NO: 43107 - DNA, 1479 bp, Avicennia marina
  CDS (1)..(1479)
atggatccgtacaagtactgtccctccagttcgttcaatacaccccacacgacgaccaatgggggacacccggtgtataacgacaacagctctttgacggtgggaaccagaggcccagtcctccttgaagattaccaattgatagataagcttgcccattttactcgtgagaggatcccagagcgcgttgtccacgcacgaggtgccaccgccaagggcttctttgaggtcacccacgatgtttctcacctcacctgtgccgatttccttcgggcacctggtgttcagactcctcttatcgttcgattctccaccgtcatccacgagcgtggcagccctgaaactctgagggaccccagagggttcgctgtcaaattttacaccagagaggggaactttgatattgtggggaacaacttccccgtcttcttcattcgcgatgcgatcaaattccctgacgtgattcatgcttttaagccaaaccctaaatcccacatccaagagagctggagaatcttggacttctgctcccacttcccggagagtttgcttacctttgcttggttctacgacgatgtgggcattccgcaagattacaggcacatggagggcttcggtgtgcacagctacactctgatcaacaaggccgggaaagtcaattatgtgaaattccactggaagcctacttgtggcgtcaagtgtctgatggaggatgaagctgtcaggattggaggaactaatcacagtcacgccacccaggatctgtacgattcgattgccgctggaaactatccggaatggaagttatatttccagatcatggatcctgatcaggaagacagatttgattttgatcctctcgacacaaccaagatctggcctgaagacatcatacccctgattccagtggggcgcatggtgttgaataagaacatcgataacttctttgctgagaacgagatgcttgcattctcccctcacatgattgtccctggaattaacttttccaatgacaagatgctccagactcggatatttgcttacggcgacacgcagaggcaccgtctcgggccaaactacctgctgcttccagttaatgcaccgaaatgcgcctaccacaacaatcattacgacggtttcatgaatttcatgcacagggacgaggaggtggactatttcccttcgaagtatgaccctactcgccatgcggagaggcaccccattcctaatgcggtgattacaggaaggcgcgataggcgtgtcattgagaaggaagacaactttaagcaagctggagacagataccgttcctgggcaccagacaggcaagagaggttccttcgccgatgggtcgacgctttatctgaccccaggctcaccctcgaaatccgtagtatctgggtttcatactggtctcaggccgacaagtccttcggccagaaacttgcttcccgcctcaatgtaaggccgacaatgtga

SEQ ID NO: 43108 - protein, 492 aa, Avicennia marina
MDPYKYCPSSSFNTPHTTTNGGHPVYNDNSSLTVGTRGPVLLEDYQLIDKLAHFTRERIPERVVHARGATAKGFFEVTHDVSHLTCADFLRAPGVQTPLIVRFSTVIHERGSPETLRDPRGFAVKFYTREGNFDIVGNNFPVFFIRDAIKFPDVIHAFKPNPKSHIQESWRILDFCSHFPESLLTFAWFYDDVGIPQDYRHMEGFGVHSYTLINKAGKVNYVKFHWKPTCGVKCLMEDEAVRIGGTNHSHATQDLYDSIAAGNYPEWKLYFQIMDPDQEDRFDFDPLDTTKIWPEDIIPLIPVGRMVLNKNIDNFFAENEMLAFSPHMIVPGINFSNDKMLQTRIFAYGDTQRHRLGPNYLLLPVNAPKCAYHNNHYDGFMNFMHRDEEVDYFPSKYDPTRHAERHPIPNAVITGRRDRRVIEKEDNFKQAGDRYRSWAPDRQERFLRRWVDALSDPRLTLEIRSIWVSYWSQADKSFGQKLASRLNVRPTM

SEQ ID NO: 43109 - DNA, 1461 bp, Bacteroides fragilis
  CDS (1)..(1461): transl_table=11
atggaaaataaaaaactcacagcagctaatggtcgtcctatcgccgacaaccaaaacagccagacagcaggacctcgcgggcctattatgttacaagacccatggttgattgaaaaacttgctcatttcgaccgtgaagttatccctgaacgccgtatgcatgccaaaggctccggagcttacggtacatttaccgtcacacatgatatcaccaagtacacacgagcagctattttcagtcaagtaggcaagcaaacagaatgttttgtacgtttctccactgtagcaggagaacgcggagctgctgatgcagaacgcgatatccgaggatttgccatgaagttttatacagaagaaggaaactgggatttggtaggtaacaatactcccgtcttcttcttacgcgacccgctaaaatttcctgatttaaatcatgctgtaaaacgcgatccgcgcaacaacatgcgtagcgctaacaataattgggatttctggaccctgttacccgaggctcttcatcaggtaactatcaccatgagtccgcgtggcattccggcttcctatcgccacatgcacggattcggcagccatacttacagtttcctaaacgcagaaaacaaacgaatttgggttaagtttcatctaaagactatgcagggcattaaaaacctgactgatcaggaagctgaagcaatcatcgccaaagatcgtgaatcgcatcaacgtgacctatacgaaagcatcgaacggggtgatttcccaaaatggaagttccagattcagttgatgactgaagaagaagcagataactatcgtatcaatccgttcgaccttaccaaggtttggccacacaaagatttcccattgcaagatgtaggtattcttgaattgaaccgtaatccggaaaactattttgcagaagtagaacaatcggctttcaatccgatgaatattgttgaaggtatcggcttctctcccgacaagatgttgcaaggacgattattttcttatggtgatgcacaacgctaccgattgggtgtaaactcagagcagataccggtaaacaagccacgttgtccgttccacgccttccatcgtgacggagcaatgcgagtggacggaaactatggttcagccaaaggttatgaaccgaatagttatggcgaatggcaagactcgcctgagaaaaaagaaccgcctttaaaagttcacggagatgtattcaactataacgaacgtgaatatgatgacgattactacagtcagccgggtgatttgttccgactgatgcctgcggatgaacaacaattattgtttgaaaataccgcacgcgccatgggtgacgcagaattgttcatcaaacaacggcatgtacgcaactgctacaaagctgatccggcttatggcacaggagtagctcaagcattaggtattgatctggaagaagccttgaaagaataa

SEQ ID NO: 43110 - protein, 486 aa, Bacteroides fragilis
MENKKLTAANGRPIADNQNSQTAGPRGPIMLQDPWLIEKLAHFDREVIPERRMHAKGSGAYGTFTVTHDITKYTRAAIFSQVGKQTECFVRFSTVAGERGAADAERDIRGFAMKFYTEEGNWDLVGNNTPVFFLRDPLKFPDLNHAVKRDPRNNMRSANNNWDFWTLLPEALHQVTITMSPRGIPASYRHMHGFGSHTYSFLNAENKRIWVKFHLKTMQGIKNLTDQEAEAIIAKDRESHQRDLYESIERGDFPKWKFQIQLMTEEEADNYRINPFDLTKVWPHKDFPLQDVGILELNRNPENYFAEVEQSAFNPMNIVEGIGFSPDKMLQGRLFSYGDAQRYRLGVNSEQIPVNKPRCPFHAFHRDGAMRVDGNYGSAKGYEPNSYGEWQDSPEKKEPPLKVHGDVFNYNEREYDDDYYSQPGDLFRLMPADEQQLLFENTARAMGDAELFIKQRHVRNCYKADPAYGTGVAQALGIDLEEALKE

SEQ ID NO: 43111 - DNA, 1440 bp, Botrytis cinerea
  CDS (1)..(1440)
atggctcaaaccaatggcgtattgcaagaaccggccatcacaacgatgaacggtgctcccgttctaaagccagcatctacccaaagaattggcaatcagctcagagccactcttctacttcaagatatcaatctcttggaattgatccaacacatcacccatgagcgaattcctgagcgtgtcgtccatgccagaggtactagcgctcacggatactttgaggtcaccgatgacatatcagatgtcacatctgcggcttttctaaaccgggtcggaaaacaaaccgatatattttgtcggttctccaccgtagctggtcgagcagaatctgccgaaacggttcgggatactcgtggttttgcttttaaaatgtttaccgaggaaggtaacttagattggttgttccttagcactcctgtcttcccaattcgagatggagctaaattcccatctttcactcatgctactaagaagaatccacgaagtggcttacctgatcacaaggcattctgggactacttcactcacaaccaagaggggattcacttcctgatgttcctcttcagtgatcgagctacaccagtcgatttccaacatgccgatattttcagtatcaacacctacaagttcaccaaatcagacggttcattcacatatgtgaagatccatctcaagaccaaccaaggagtgaagaacttcacacaagatgaggctaatcaaaaggctggtgttgatccagacttccaaacccgtagtctttacgaggatatcgaaaatcaaaagtacccaacgtgggacgtttttgcacagatcattgaccctgtcaaggccgagaattatcacatcaatatcttcgacgcaaccaagacattcccattttccgagttccctcttcgcaagttcggtaaaattacactcaacaggaatgtggataatttcttcgctgagcaagagcaaagtgcttttagtccaacaaatctcgttcctggttgggctctaactccagatcctatcattcaaactcgtgctcttgcctacgcagatactcaaagatatcgtctcggagccaacttcgtccaattacctgtcaatgctccatacaaaaagccctttactcccctcattagggatggagctgcaactgtcaacggcaacttaggtggtaccccaaattacttcccatcatctttttacaatgttggagcagcgacacaatatgcacaacctgacgaagaacaattccaaggaacagttgtcaactttgagagtgaagtcgtcgatgcagactacgtgcagccaagaatcttctgggaaaagacactagctgaagagccaggtcaacaggataatcttatcagcaatgttgcgggtcatctaagcgcagtcactggagataaaggacttggaagttcgacaagcggtctatgcaatgttcggtaa

SEQ ID NO: 43112 - protein, 479 aa, Botrytis cinerea
MAQTNGVLQEPAITTMNGAPVLKPASTQRIGNQLRATLLLQDINLLELIQHITHERIPERVVHARGTSAHGYFEVTDDISDVTSAAFLNRVGKQTDIFCRFSTVAGRAESAETVRDTRGFAFKMFTEEGNLDWLFLSTPVFPIRDGAKFPSFTHATKKNPRSGLPDHKAFWDYFTHNQEGIHFLMFLFSDRATPVDFQHADIFSINTYKFTKSDGSFTYVKIHLKTNQGVKNFTQDEANQKAGVDPDFQTRSLYEDIENQKYPTWDVFAQIIDPVKAENYHINIFDATKTFPFSEFPLRKFGKITLNRNVDNFFAEQEQSAFSPTNLVPGWALTPDPIIQTRALAYADTQRYRLGANFVQLPVNAPYKKPFTPLIRDGAATVNGNLGGTPNYFPSSFYNVGAATQYAQPDEEQFQGTVVNFESEVVDADYVQPRIFWEKTLAEEPGQQDNLISNVAGHLSAVTGDKGLGSSTSGLCNVR

SEQ ID NO: 43113 - DNA, 1524 bp, Campylobacter jejuni
  CDS (1)..(1524): transl_table=11
atgaaaaaattaactaacgattttggaaacattatagccgataatcaaaattcattaagtgcaggcacaaaaggacctttacttatgcaagattatcttttgcttgaaaaacttgctcatcaaaatagagaaagaattccagaaagaaccgttcatgctaagggaagtggagcttatggcgaaataaaaatcactgctgatttatctgcttatactaaggcaaaaatatttcaaaaaggagaaataactcctctttttctacgcttttcaacagtagcaggtgaagcaggtgcagcagatgctgaacgcgatgtgagaggttttgctattaaattttacaccaaagaaggaaactgggacttggtaggaaataacactccgacattcttcatccgtgatgcttataaatttcctgatttcatccatactcaaaaaagagatccaagaactcatctaagaagtaataatgctgcttgggatttttggagtttatgtcctgaaagtttacatcaagtaaccattcttatgagagatagaggaattcctgcaagttatcgtcatatgcatggatttggaagccatacttatagttttattaatgataaaaatgaaagattttgggtgaaattccattttaaaacccaacaagggattaaaaatcttaccaaccaagaagctgccgagcttatagcaaaagatagagaaagtcatcaaagagatctctataatgctatagaaaataaagattttccaaaatggaaagttcaagttcaaattcttgctgaaaaagatatagaaaaacttggatttaatccttttgatttaacaaaaatttggcctcatagtcttgtgcctttgatggatataggcgaaatgattctaaacaaaaatcctcaaaattattttaatgaagttgaacaagctgcctttagtccaagcaatatcgttcctggaattggctttagccctgataaaatgttgcaagctagaattttttcatatcctgatgcacaaagatatagaataggaactaattatcatcttttgcccgtaaatcgtgcaaaaagcgaagtgaatacttacaatgtcgctggtgctatgaattttgatagttataaaaatgatgcagcttattatgaaccaaacagctatgataatagcccaaaagaagacaaaagctatcttgaacctgatttagtcttagaaggcgtagcacaaagatatgctccactagataatgacttttatactcaaccaagagctttatttaatcttatgaatgatgatcaaaaaactcaactttttcataatatcgccacttctatggagggagttgatgaaaaaattatcactagagctttagaacattttgaaaaaatttcacctgattatgcaaaaggaattaaaaaagctttccctatagtgagtcgtattagagcttggcgtaatcatggtcatcgatgtttcctgtgtgaaattgttatccgctcacaattccacacaacatacgagccggaagcataa

SEQ ID NO: 43114 - protein, 507 aa, Campylobacter jejuni
MKKLTNDFGNIIADNQNSLSAGTKGPLLMQDYLLLEKLAHQNRERIPERTVHAKGSGAYGEIKITADLSAYTKAKIFQKGEITPLFLRFSTVAGEAGAADAERDVRGFAIKFYTKEGNWDLVGNNTPTFFIRDAYKFPDFIHTQKRDPRTHLRSNNAAWDFWSLCPESLHQVTILMRDRGIPASYRHMHGFGSHTYSFINDKNERFWVKFHFKTQQGIKNLTNQEAAELIAKDRESHQRDLYNAIENKDFPKWKVQVQILAEKDIEKLGFNPFDLTKIWPHSLVPLMDIGEMILNKNPQNYFNEVEQAAFSPSNIVPGIGFSPDKMLQARIFSYPDAQRYRIGTNYHLLPVNRAKSEVNTYNVAGAMNFDSYKNDAAYYEPNSYDNSPKEDKSYLEPDLVLEGVAQRYAPLDNDFYTQPRALFNLMNDDQKTQLFHNIATSMEGVDEKIITRALEHFEKISPDYAKGIKKAFPIVSRIRAWRNHGHRCFLCEIVIRSQFHTTYEPEA

SEQ ID NO: 43115 - DNA, 1515 bp, Candida boidinii
  CDS (1)..(1515)
atgtctaatcctccaacttatacaacttctcaaggttgtccagtcagtgacgccttttccacccaacgtatctctggtacaaagatttcaatcaagactccagttggtccattattattacaagatttcaagtttcttgattctttagctcactttgatagagagcgtatcccagaaagagttgtccatgccaaaggtgctggtgcttatggtgtctttgaagttactgaagatatttcagatatttgttcagctaaattcttagatactgttggtaaaaagaccaaaattttcactagattctctactgttggtggtgaaaagggttcatccgattctgctagagatccaagaggttttgctactaaattctataccgaagaaggtaacttagatttagtttataacaatactccaattttctttattagagatccaactaaattcccacattttattcatactcaaaagagaaatccagctactaattgtaaagatgctaatatgttctgggattacttaactaacaatccagaatctttacatcaaattatgtacttattctcaaatagaggtactccaacttcttacagaaagatgaatggttattcaggtcatagttataaatggtacaatgctaaaggtgaatgggtttcgtcagttcatttcatctctaaccaaggtgttcacaatatgactgatgaagaagctggtgatttaagtggtaaagacccagatttccaaactatggatttatacaaggccattgaacaaggtgattacccatcatgggaatgttatgttcaaactatgactttagaagaagccaagaaacaaccattctcagtttacgatttaactaaagtttggccacataaagatttcccattaagacattttggtaaatttacattaaatgaaaatgcccaaaattattttgctgaagttgaacaagctgctttctctccatctcacactgttccaggtatggaaccatcaaatgatccagttttacaatccagattattctcttacccagatactcaccgtcacagattaggtgttaattactcccaaattccagttaactgcccaatgagagctgttttcgctccacaaattagagatggttcaatgatggttaacggtaacttaggtggtactccaaattatgccggtgcttacaactgcccggttcaatatcaagctccaattaaagcatctagtaagactccagaagaacaatacgaaggcgaaactttaagttatgactggactgaagtcaatgaatacgatttctaccaaccaggtagattctgggaagttttaggtaagactaaaggtgaacaagaagctttagttcataatgttgctaatcacgtttctggtgctgatgaatttatccaagaccgtgtctttgcttatttctcaaaagccaacccagttatcggtgatttaattagaaaagaagttttaaagaagagtccaagaggtgcttctaagaataaattttaa

SEQ ID NO: 43116 - protein, 504 aa, Candida boidinii
MSNPPTYTTSQGCPVSDAFSTQRISGTKISIKTPVGPLLLQDFKFLDSLAHFDRERIPERVVHAKGAGAYGVFEVTEDISDICSAKFLDTVGKKTKIFTRFSTVGGEKGSSDSARDPRGFATKFYTEEGNLDLVYNNTPIFFIRDPTKFPHFIHTQKRNPATNCKDANMFWDYLTNNPESLHQIMYLFSNRGTPTSYRKMNGYSGHSYKWYNAKGEWVSSVHFISNQGVHNMTDEEAGDLSGKDPDFQTMDLYKAIEQGDYPSWECYVQTMTLEEAKKQPFSVYDLTKVWPHKDFPLRHFGKFTLNENAQNYFAEVEQAAFSPSHTVPGMEPSNDPVLQSRLFSYPDTHRHRLGVNYSQIPVNCPMRAVFAPQIRDGSMMVNGNLGGTPNYAGAYNCPVQYQAPIKASSKTPEEQYEGETLSYDWTEVNEYDFYQPGRFWEVLGKTKGEQEALVHNVANHVSGADEFIQDRVFAYFSKANPVIGDLIRKEVLKKSPRGASKNKF

SEQ ID NO: 43117 - DNA, 1479 bp, Capsicum annuum
  CDS (1)..(1479)
atggatctctctaagtatcgcccatcaagtgcatatgattcccctttcttgacaacaaatgctggtggtcctgtctacaacaatgtatcttccttgactgttggacctagagggcctgttcttcttgaggattatcacttaattgagaagcttgcgacttttgttcgtgagcggatacctgagcgtgttgttcatgctagaggtgccagtgccaagggcttctttgaagtcactcatgatatttctcatcttacctgtgctgattttctccgagctcctggtgttcaaacacctgttatttgtcgcttctctactgtcgtccatgagcgtggaagccccgaatccatcagggatattcgcggttttgctgtcaaattttacaccagagagggtaactttgatcttgttggaaacaatgtccccgtcttctttaatcgtgatgcaaagtcattccctgacacgattcgtgcattgaaaccaaatccaaagtcacacattcaggaaaactggaggatccttgatttcttctctttcctcccggagagtttgcatacgtttgctttcttctacgatgatgtttgtctcccgacagattacagacacatggaaggttttggtgttcacgcttatcaattgatcaacaaagctggaaaagcacattatgtgaagttccactggaagccaacttgcggtgtcaagtccatgacggaggaagaagctattagggtcggaggtactaatcatagccacgccaccaaggatctctacgattcaattgctgctggaaactaccccgagtggaaactttttatccaaattatgaaccctgaggatgttgacaaattcgactttgaccctcttgacgtaaccaagacctggcctgaggatatcttgccattgatgccagttggtcgattggtattgaataggaacatcgataacttctttgcagagaacgagcagctcgcatttaaccctggacatattgtccctggtgtctactattcggaggataagcttctccagactaggatatttgcatatgctgatactcagagacaccgtattggaccaaactatatgcagctcccagttaacgctcccaagtgtgctcatcacaataatcaccgtgatggtgccatgaacttcatgcatcgcgatgaggaggtggattatttgccctcaaggtttgatccttgtcgtcctgccgagcagtacccaattccttcttgtgtcttgacaggaaggcgtgaaaagtgtgtcattccgaaagagaacaacttcaagcaggctggggagagatacagatcctgggcacctgacaggcaagacagatatatcaacaaatgggttgagtctttatccgatccccgagcaactcatgagatacgcagtatatggatatcatacttgtctcaggctgacaagtcttgtggtcagaaggtcgcttctcgtctcactgtgaagccaacaatgtga

SEQ ID NO: 43118 - protein, 492 aa, Capsicum annuum
MDLSKYRPSSAYDSPFLTTNAGGPVYNNVSSLTVGPRGPVLLEDYHLIEKLATFVRERIPERVVHARGASAKGFFEVTHDISHLTCADFLRAPGVQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPTDYRHMEGFGVHAYQLINKAGKAHYVKFHWKPTCGVKSMTEEEAIRVGGTNHSHATKDLYDSIAAGNYPEWKLFIQIMNPEDVDKFDFDPLDVTKTWPEDILPLMPVGRLVLNRNIDNFFAENEQLAFNPGHIVPGVYYSEDKLLQTRIFAYADTQRHRIGPNYMQLPVNAPKCAHHNNHRDGAMNFMHRDEEVDYLPSRFDPCRPAEQYPIPSCVLTGRREKCVIPKENNFKQAGERYRSWAPDRQDRYINKWVESLSDPRATHEIRSIWISYLSQADKSCGQKVASRLTVKPTM

SEQ ID NO: 43119 - DNA, 1611 bp, Deinococcus radiodurans
  CDS (1)..(1611): transl_table=11
atgagcgacgaaaacaacaagggcgtcggcacggcggtgcagggcgtgggcggtccccgcgacgggcgcaccgcccccggcgagcaaggcaccaccctgaccacccgccagggccaccccgttcacgacaaccagaacagccgcacggtgggcagccgtggcccgatgacgctggaaaactaccagttcatcgaaaagctctcgcacttcgaccgcgagcgcattcccgagcgtgtggtgcacgcccgcggcgtcggcgcccacggcgtgttcagagcgacgggcaaggtcggcgacgagccggtgagcaagtacacccgcgccaagctgtttcaggaagacggcaaggaaacgcccgtcttcgtgcgcttctcgacggtgggtcacggcacccactcgcccgaaacgctgcgtgacccgcgcgggttcgccgtcaagttctacaccgaagacggcaactgggacctcgtcggcaacaacctcaaaatcttcttcatccgtgacgcgctgaagttccccgacctgatccacagccagaagcccagcccgaccaccaacatccagtcgcaggagcgcatcttcgatttcttcgcgggctcccccgaagcgacccacatgattaccctgctgtactcgccctggggcattccggcgagctaccgcttcatgcagggcagcggcgtgaacacctacaagtgggtcaacgaccagggtgaaggcgtgctggtcaagtaccactgggaacccgtgcagggcgtgcgcaacctgacgcagatgcaggccgacgaggtgcaggcgaccaacttcaaccacgcgacccaggacctgcacgacgccatcgagcgcggcgactttccccagtgggacctgttcgtgcagatcatggaagacggcgagcaccccgaactcgactttgaccccctcgacgacaccaagatctggccccgcgagcagttcccctggcggcacgtcggccagatgacgctgaaccgcaaccccgaaaacgtgtttgccgaaaccgagcaggccgccttcgggaccggcgtgctggtggacggcctggacttcagcgacgacaagatgctccagggccgcaccttcagctactccgacacccagcgctaccgcgtcggccccaactacctgcaactgccgatcaacgcgcccaaaaagcacgtcgccaccaaccagcgcgacgggcagatggcctaccgggtggatacctttgagggccaggaccagcgtgtgaactacgagccgagccttctcagcggtcccaaggaagcgcctcgccgcgcccccgagcacaccccccgcgtggaaggcaacctcgtgcgcgccgccatcgaacgccccaaccccttcgggcaggccgggatgcagtaccgcaacttcgccgactgggagcgtgacgaactggtgagcaacctctccggcgctctggcgggcgtggacaagcgtattcaggacaagatgctcgaatacttcaccgccgccgacgccgactacggccagcgcgtgcgcgagggcattcaggccaaggaagccgagatgaagggccagaagcaggaagcccccgtctacggcaccgaggcgagcagcctgtactga

SEQ ID NO: 43120 - protein, 536 aa, Deinococcus radiodurans
MSDENNKGVGTAVQGVGGPRDGRTAPGEQGTTLTTRQGHPVHDNQNSRTVGSRGPMTLENYQFIEKLSHFDRERIPERVVHARGVGAHGVFRATGKVGDEPVSKYTRAKLFQEDGKETPVFVRFSTVGHGTHSPETLRDPRGFAVKFYTEDGNWDLVGNNLKIFFIRDALKFPDLIHSQKPSPTTNIQSQERIFDFFAGSPEATHMITLLYSPWGIPASYRFMQGSGVNTYKWVNDQGEGVLVKYHWEPVQGVRNLTQMQADEVQATNFNHATQDLHDAIERGDFPQWDLFVQIMEDGEHPELDFDPLDDTKIWPREQFPWRHVGQMTLNRNPENVFAETEQAAFGTGVLVDGLDFSDDKMLQGRTFSYSDTQRYRVGPNYLQLPINAPKKHVATNQRDGQMAYRVDTFEGQDQRVNYEPSLLSGPKEAPRRAPEHTPRVEGNLVRAAIERPNPFGQAGMQYRNFADWERDELVSNLSGALAGVDKRIQDKMLEYFTAADADYGQRVREGIQAKEAEMKGQKQEAPVYGTEASSLY

SEQ ID NO: 43121 - DNA, 2235 bp, Emericella nidulans
  CDS (1)..(2235)
atggctactagtatcaccgccggcctacaaaaggcccagcaagcagtgcaggacactgccaccaagaacaagaagattgtcgatattagccacgacacagtaaatgtccacacagaccaggagcagcgaacagattttggtgtcgcgatcaccgaccctgatcactggctgcgcgtcaccaacgagacgcactcgggcccctcgctgctagaagaccacatcgcgcgagagcgcatccatcgtttcgaccacgagcgcatccctgagcgcgttgttcatgcccgtggaacgggcgcctacggcaatttcaccctcaaggagagcatcgaagatttgacctatgctggagtgttaacggatacttcgcgcaacaccccggtgttcgtgcgtttctctactgtccagggcagccgggggagtgctgataccgttcgcgatgttcgcgggttcgctgtcaagttctacactgacgagggaaattgggatattgtcggcaacaacatccccgtcttcttcattcaggatgccatcaagttccctgactttgtccacgctgtcaagcccgagcctcacaacgaagtgccccaggcccagacggcccataacaatttctgggactttgtgtacttgcaccccgaagccacgcacatgttcatgtgggcgatgtctgaccgcgccatcccgcggtcctaccgtatgatgcagggtttcggtgttaacacgttctcgctggtcaacaaggagggtaagcgccactttgtcaaattccactggatccctcacctcggagtgcactcgctcgtctgggacgaggccctgaagctggcgggacaggatcccgacttccaccgcaaggacctgatggaggccatcgataacaaggcctatcccaagtgggactttgccatccaggccatccccgaggaggaccaggacaagttcgagtttgacatcttcgatgccaccaaggtctggccggaagagcaggtgcccctgcgtgtggtcggcgagctcgaactgaaccgcaacatcgacgagttcttccccgagactgaacaggtcgccttctgcactagccatatcgtgcctggtatcgacttctctgacgacccgcttctccagggccgcaacttctcatatcaggatacacaaattagtcgtctgggtgtgaactgggaagaaatacccatcaaccgacctgtctgcccgttcctcaaccataaccgggacggagctaaacgccaccgcatcaccaagggcacggtgaactattggcccaaccgcttcgaggccaaccctccagctagcgacaagggcttcaagtcgcacccagccccgattacaggccgcaagcgccgcgatctcacacccaagttcaaggaataccacaaccaggcgcagcttttctataactccctctccgaagtcgagaaggtgcacgtcaagaaggccttttccttcgagcttgaccactgtgacgacccgatcgtttacgagcggctcgcaggccagcgcctcgcagagatcgatctccccctggctcaagccgtggccgagatggtcggcgcgcccatccccacgaaggcactgcgtgataaccacggcaagacctccgtccgtctctcccagttcgacttcactcctaaggctcctggcattatcagccgtcgcattgccatcatcatcggtgacggctacgacaagatcgccttcaatggcatgaaggccgctattctcgccgctgcaagcgctccccttcgtcattggcaccaaacgtccgccatctacgcacagggcgaggataagaatagctctaagggtgtgattcccgaccacatgtatgacggcatgcgctccaccatgttcgacgcgaccttcatccccggcggctcgcacattgagactctccaaaagaacggccagattcggtactggattgccgagacattcgggcacctcaaggcgctcggtgccatgggcgaagccgcgcagctggtcaaggaagttctgggcaatgtgatgggcgtccaaattgccggtgcggactctgctgagcccgtcgaatggtatggtgttgttacagctcgtggaccagagagcgccgagagcctcagtgagggcttcaaggtgctcaaggacgccggtgatttcacaagcaagttcttttaccagatcagtcagcaccgcaactggcagcgtgagttggatggattggcttcgacggttgcgttctaa

SEQ ID NO: 43122 - protein, 744 aa, Emericella nidulans
MATSITAGLQKAQQAVQDTATKNKKIVDISHDTVNVHTDQEQRTDFGVAITDPDHWLRVTNETHSGPSLLEDHIARERIHRFDHERIPERVVHARGTGAYGNFTLKESIEDLTYAGVLTDTSRNTPVFVRFSTVQGSRGSADTVRDVRGFAVKFYTDEGNWDIVGNNIPVFFIQDAIKFPDFVHAVKPEPHNEVPQAQTAHNNFWDFVYLHPEATHMFMWAMSDRAIPRSYRMMQGFGVNTFSLVNKEGKRHFVKFHWIPHLGVHSLVWDEALKLAGQDPDFHRKDLMEAIDNKAYPKWDFAIQAIPEEDQDKFEFDIFDATKVWPEEQVPLRVVGELELNRNIDEFFPETEQVAFCTSHIVPGIDFSDDPLLQGRNFSYQDTQISRLGVNWEEIPINRPVCPFLNHNRDGAKRHRITKGTVNYWPNRFEANPPASDKGFKSHPAPITGRKRRDLTPKFKEYHNQAQLFYNSLSEVEKVHVKKAFSFELDHCDDPIVYERLAGQRLAEIDLPLAQAVAEMVGAPIPTKALRDNHGKTSVRLSQFDFTPKAPGIISRRIAIIIGDGYDKIAFNGMKAAILAAASAPLRHWHQTSAIYAQGEDKNSSKGVIPDHMYDGMRSTMFDATFIPGGSHIETLQKNGQIRYWIAETFGHLKALGAMGEAAQLVKEVLGNVMGVQIAGADSAEPVEWYGVVTARGPESAESLSEGFKVLKDAGDFTSKFFYQISQHRNWQRELDGLASTVAF

SEQ ID NO: 43123 - DNA, 2157 bp, Erysiphe graminis
  CDS (1)..(2157)
atgcgactttcactttggaacttacttggactttcaggtcttgtagtcgcgtcgtgcccttacatgagcggcgaagaccaggagtatcacatatctcatattcaagcaagaggaacagactccgagtttttagaccaattcaaggtcgaagactcaaactcataccttacaactgatgctggagggcctattcaggatgatgccagtttaaaggcaggagaaagagggcctacacttttagaggattttatttttcgccagaagattcagcactttgatcacgagcgggtaccagagcgcgctgttcacgcccggggtgcaggtgcctatggaacttttactagctatgcagactggactaatataaccgctgctagttttctcaattcaaaaggcaaagaaacaccggtttttgttcgtttctcgacggttgcgggatcccgtggatctgcggacacagtgcgtgatgtccacgggtttgccacacgattctacaccgacgaaggaaactttgatattgtgggaaataatattcctgtattttttattcaggatgccattctattcccagatcttgttcacgctgttaaacccagtccagactctgaaatccctcaagcagcgactggtcatgacagtgcttgggatttcttctctcaacagccatccactcttcacaccttattttgggcaatgtctggccatggtattcctcgatcttatcgtcacatggatgggtttggtgtccacacaatgcgtctagtcactgacgacggaaaaagcaagcttgtaaagtggcattggaagacaaagcaaggaaaggcaagtcttgtctgggaggaagctcaaattttggccgggaaaaatccagatttccatcgtcaagatctatgggatgacataaatgcaggaaatggaccagaatgggagctcggtgtacagattgtagacgaagaagatgtacaggcatttggcttcgatttgctagatcctacaaaatttcttcccgaggaactggttcccgtcaccatactaggaaaaatgaaactgacagacaatccaaccaactactttgcagaaactgaacaggttatgtttcagcctgggcacatagttcgcggcgtagacttttcagatgatccacttcttcaaggccgtatttactcgtatctcgatacacaattgaatcgtaatggaggcccaaattttgaacaactcccagtcaaccgtcctcgtaccaaggttcacaataacaaccgagatggtgctggtcaaatgtttatacacactaataaagccccttattcccctaattcgctatctggaggtaatccgaagcaggcaaatcaaactaaaggtcgtggattttttaccgcaccatctcgtaaagttgtgggctctcttcatcgtggtactgcttcttcattcgcagacgtgtggtctcaacctcgcatgttttacaattccctcattccttcagagcagcagtttcttgtgaacgcaattcgtttcgagatatctcaattaaagtcggatttgattaaaaaaaacacattgatgcaactgaatcgagtctctaatgatcttgctacccgtgtggcagcggttattggttataagccacttgatccatcaccagagttctacacaaatgcaacaaccgactacgtgaccatctttggcaagccgctaccgtctgtcgttggatttactgttggtatacttgcctccacatcttcttcaacttcaattagtcaagctgcgcagcttgcaacatcttttagctccaggggaattagggcagtgattgtaggggaatcacttttgtccggcactgatcaaacttacagttccgcggatgcaactgcttttgatgctgtagtagtcacgatgggtgctgaaactctctttggtccggttgctaaaccaaacacgcttttcccatctgggaggcctagccagattttgcatgatgcataccgatggggtaagccagttggtgctgtatcgaaagcttcggttgtcttagagcctctaccaggtaccaaaaatcaagggggtgtttatagagtggagtccgtaaatgaattagcgaccagtattgcaaaagggcttgagacatttaggttcgtggatcgcttccctctggactcttga

SEQ ID NO: 43124 - protein, 718 aa, Erysiphe graminis
MRLSLWNLLGLSGLVVASCPYMSGEDQEYHISHIQARGTDSEFLDQFKVEDSNSYLTTDAGGPIQDDASLKAGERGPTLLEDFIFRQKIQHFDHERVPERAVHARGAGAYGTFTSYADWTNITAASFLNSKGKETPVFVRFSTVAGSRGSADTVRDVHGFATRFYTDEGNFDIVGNNIPVFFIQDAILFPDLVHAVKPSPDSEIPQAATGHDSAWDFFSQQPSTLHTLFWAMSGHGIPRSYRHMDGFGVHTMRLVTDDGKSKLVKWHWKTKQGKASLVWEEAQILAGKNPDFHRQDLWDDINAGNGPEWELGVQIVDEEDVQAFGFDLLDPTKFLPEELVPVTILGKMKLTDNPTNYFAETEQVMFQPGHIVRGVDFSDDPLLQGRIYSYLDTQLNRNGGPNFEQLPVNRPRTKVHNNNRDGAGQMFIHTNKAPYSPNSLSGGNPKQANQTKGRGFFTAPSRKVVGSLHRGTASSFADVWSQPRMFYNSLIPSEQQFLVNAIRFEISQLKSDLIKKNTLMQLNRVSNDLATRVAAVIGYKPLDPSPEFYTNATTDYVTIFGKPLPSVVGFTVGILASTSSSTSISQAAQLATSFSSRGIRAVIVGESLLSGTDQTYSSADATAFDAVVVTMGAETLFGPVAKPNTLFPSGRPSQILHDAYRWGKPVGAVSKASVVLEPLPGTKNQGGVYRVESVNELATSIAKGLETFRFVDRFPLDS

SEQ ID NO: 43125 - DNA, 1479 bp, Helianthus annuus
  CDS (1)..(1479)
atggatccttacaagtaccgttcttcaagtgcctacaatgccccattctggaccaccaattccggtgctccggtttacaacaacaacaactcattgaccgttggaagcagaggtccaatccttctagaagattaccatttggtggagaagctagctaacttcgaccgtgagcgtatccctgaacgtgttgttcatgccagaggtgccagtgcaaagggattttttgaagtcacacatgacattactgccctcacatgtgctgattttctccgtgcccccggtgtccagactcctgttatcgttcgtttctctactgttatccatgaacgtggtagccccgaaaccctcagggaccctagaggtttcgcagtgaagttctacacccgagagggtaactttgatttggtgggaaacaatttcccggtgttctttattcgtgatggaatgaaatttcccgacatggttcactcgttgaaaccaaaccctaaatcgcacattcaagaagactggagaatcatggactttttctctcaccatcccgagagtttgcacatgttcacatttcttctagacgatatcggtgtgccacaagattaccgccacatggacggatccggtgtcaacacctacactttgatcaacaaagctggaaaagcatattacgtgaagttccactggaaaccaacatgtggcgtaaaaagtttgttggaagaagaagccatcaagatcggtggagcgaatcacagccatgctacacaagatctttacgattcgattgctgctggaaactaccccgagtggaagctttttatccagaccattgatccggatcacgaggatcggctcgactttgacccgcttgatgttaccaagacctggcctgaggatatctttccgttgcagcctgtgggtcgtctggttttgaacaagaatattgacaacttctttgctgagaatgaacagctggcattttgtcctgctatcattgttcctggaatctattattctgatgataagttgctgcaaacccgtattttctcgtattctgacactcagaggcaccgtcttggaccgaactatttgcagcttcctgcaaatgctcctaagtgtgctcatcataataatcactatgatggattcatgaatttcatgcacagagatgaggagatcgattacttcccttcaagatatgatcccgctcgtcatgctgagcagtaccctattcctcctgttaggttgtccggaaagcgtgataagtgtgtgattgagaaagaaaacaacttcaagcagccaggagagagatacagatccttttctccagacaggcaagaacgattcattaacagagttgtgggtggtttgtctgacccgcgtgtcacccatgaggtccgctcaatatgggtttcatactggtcccaggctgacaagtctctgggacagaagatagcttcccgcttgaatgtgaagccaaattactaa

SEQ ID NO: 43126 - protein, 492 aa, Helianthus annuus
MDPYKYRSSSAYNAPFWTTNSGAPVYNNNNSLTVGSRGPILLEDYHLVEKLANFDRERIPERVVHARGASAKGFFEVTHDITALTCADFLRAPGVQTPVIVRFSTVIHERGSPETLRDPRGFAVKFYTREGNFDLVGNNFPVFFIRDGMKFPDMVHSLKPNPKSHIQEDWRIMDFFSHHPESLHMFTFLLDDIGVPQDYRHMDGSGVNTYTLINKAGKAYYVKFHWKPTCGVKSLLEEEAIKIGGANHSHATQDLYDSIAAGNYPEWKLFIQTIDPDHEDRLDFDPLDVTKTWPEDIFPLQPVGRLVLNKNIDNFFAENEQLAFCPAIIVPGIYYSDDKLLQTRIFSYSDTQRHRLGPNYLQLPANAPKCAHHNNHYDGFMNFMHRDEEIDYFPSRYDPARHAEQYPIPPVRLSGKRDKCVIEKENNFKQPGERYRSFSPDRQERFINRVVGGLSDPRVTHEVRSIWVSYWSQADKSLGQKIASRLNVKPNY

SEQ ID NO: 43127 - DNA, 1518 bp, Helicobacter pylori
  CDS (1)..(1518): transl_table=11
atggttaataaagatgtgaaacaaaccactgcttttggcgctcccgtttgggatgacaacaatgtgattacggccggccctagaggtcctgttttattacaaagcacttggtttttggaaaagttagcggcgtttgacagagaaagaatccctgaaagggtggtgcatgctaaaggaagcggagcttatggcactttcactgtgactaaagacatcactaaatacactaaagcgaaaattttctctaaagtgggcaaaaaaaccgaatgcttcttcagattttctactgtggctggtgaaagaggcagtgcggatgcggtgagagaccctagaggttttgcgatgaagtattacactgaagaaggtaactgggatttagtggggaacaacacgcctgttttctttatccgtgatgcgatcaaattccctgatttcatccacactcaaaaacgagatcctcaaaccaatttgcctaaccatgacatggtatgggatttttggagtaatgttcctgaaagcttataccaagtaacatgggttatgagcgataggggtattcctaaatctttccgccacatggatggttttggcagccacactttcagtcttatcaacgcgaaaggcgaacgcttttgggtgaaattccactttcacaccatgcaaggcgttaagcatttgactaacgaagaagccgcagaagttaggaagtatgatccggattccaatcaaagggatttattcaatgcgatcgctagaggggatttcccaaaatggaaattaagcattcaagtgatgccagaagaagatgctaagaagtatcgattccatccgtttgatgtaactaaaatttggtatctccaagattatccattgatggaagtgggcattgtggagttgaataaaaatcctgaaaactatttcgcagaagtggaacaagcggcattcagtccggctaatgtcgttcctggaattggctatagccctgataggatgttacaagggcgcttgttctcttatggagacacacaccgctaccgcttaggcgttaattatcctcaaataccggttaataaaccaagatgcccattccactcttctagcagagatggttacatgcaaaacggatactacggctctttacaaaactatacgcctagctcattgcctggctataaagaagataagagcgcgagagatcctaagttcaacttagctcatattgagaaagagtttgaagtgtggaattgggattacagagctgatgatagcgattactacacccaaccaggtgattactaccgctcattgccagctgatgaaaaagaaaggttgcatgacactattggagagtctttagctcatgttacccataaggaaattgtggataaacaattggagcatttcaagaaagctgaccccaaatacgctgagggagttaaaaaagctcttgaaaaacaccaaaaaatgatgaaagacatgcatggaaaagacatgcaccacacaaaaaagaaaaagtaa

SEQ ID NO: 43128 - protein, 505 aa, Helicobacter pylori
MVNKDVKQTTAFGAPVWDDNNVITAGPRGPVLLQSTWFLEKLAAFDRERIPERVVHAKGSGAYGTFTVTKDITKYTKAKIFSKVGKKTECFFRFSTVAGERGSADAVRDPRGFAMKYYTEEGNWDLVGNNTPVFFIRDAIKFPDFIHTQKRDPQTNLPNHDMVWDFWSNVPESLYQVTWVMSDRGIPKSFRHMDGFGSHTFSLINAKGERFWVKFHFHTMQGVKHLTNEEAAEVRKYDPDSNQRDLFNAIARGDFPKWKLSIQVMPEEDAKKYRFHPFDVTKIWYLQDYPLMEVGIVELNKNPENYFAEVEQAAFSPANVVPGIGYSPDRMLQGRLFSYGDTHRYRLGVNYPQIPVNKPRCPFHSSSRDGYMQNGYYGSLQNYTPSSLPGYKEDKSARDPKFNLAHIEKEFEVWNWDYRADDSDYYTQPGDYYRSLPADEKERLHDTIGESLAHVTHKEIVDKQLEHFKKADPKYAEGVKKALEKHQKMMKDMHGKDMHHTKKKK

SEQ ID NO: 43129 - DNA, 1479 bp, Ipomoea batatas
  CDS (1)..(1479)
atggatccttcaaagtaccgtccatcaagtagcttcaacacacccttctgcactaccaactccggagctccggtatggaacaacacctgcgcactcaccgtcggcagcagaggaccaattctgctagaagattatcacttggtggagaaaattcaaaacttcactcgtgaaaggatcccagaacgagtggtgcatgccaggggtgcaagtgccaagggcttctttgaggtcactcatgacattacacacctcacctgcgccgacttcctccgtgcccccggcgttcagacacctctcatcgtccgcttctccactgtcatccatgagcgtggtagccccgaaactatcagagatccccgtggttttgccgtcaagatgtacacccgtggaggaaactgggatttggtgggcaacaatttcccggtgttctttatccgggacggaacgcagttcccggacgtgatccacgcgttcaagccaaacccgaaatcccacatccaggagaactggagaatcctggattacttatcccatctcccggagagtctcaacaccttcgcctggttctacgacgatgtcggtatccccaccgattaccgccacatggaaggcttcggcgtccacactttcaccatgatcaacaaggaaggcaaggccaattatgtaaaattccactggaaacccacctgcggcgtcaaatgtctgctggaagaggaggcgattaggatcggcggcgagaatcacagccacgccacccaggatttatacgagtccatcgccgccgggaattacccggagtggaagctttatatccaagtgatggacccggatcacgaggaccggttcgattttgacccgctggacacgaccaagatctggccggaagagttgattcctctgcagccggtggggagaatggtgttgaacaagaatattgataatttctttgcggagaatgagatgttggcgatggacccggcgcatattgtccccggaatatacttctccgatgataagatgctccaggctcgagtctttgcctacgccgacactcaccgccaccgccttggccccaactatatgctgcttccggttaatgcccccaagtgcgctcatcacaacaatagctatgatggttacatgaactttgtccacagggatgaagaggttgattactttccctcgaagtttgataacacacgtaacgctgagaggttcccaactccgttgcgtatcgtgacggggcaacgtgataagtgtgttattgagaaggagaacaacttcaagcaacctggagatagatacagatcctgggctccagacaggcaagatagattcatcaaccgatgggtcaaggccttgtctgagccccgagtcacccatgaaattcgcagcacttggatttcttacctcactcaggctgataggtctcttggacagaaggtggcttcccgtctgaacataagaccgacgatgtaa

SEQ ID NO: 43130 - protein, 492 aa, Ipomoea batatas
MDPSKYRPSSSFNTPFCTTNSGAPVWNNTCALTVGSRGPILLEDYHLVEKIQNFTRERIPERVVHARGASAKGFFEVTHDITHLTCADFLRAPGVQTPLIVRFSTVIHERGSPETIRDPRGFAVKMYTRGGNWDLVGNNFPVFFIRDGTQFPDVIHAFKPNPKSHIQENWRILDYLSHLPESLNTFAWFYDDVGIPTDYRHMEGFGVHTFTMINKEGKANYVKFHWKPTCGVKCLLEEEAIRIGGENHSHATQDLYESIAAGNYPEWKLYIQVMDPDHEDRFDFDPLDTTKIWPEELIPLQPVGRMVLNKNIDNFFAENEMLAMDPAHIVPGIYFSDDKMLQARVFAYADTHRHRLGPNYMLLPVNAPKCAHHNNSYDGYMNFVHRDEEVDYFPSKFDNTRNAERFPTPLRIVTGQRDKCVIEKENNFKQPGDRYRSWAPDRQDRFINRWVKALSEPRVTHEIRSTWISYLTQADRSLGQKVASRLNIRPTM

SEQ ID NO: 43131 - DNA, 1437 bp, Lactobacillus sakei
  CDS (1)..(1437): transl_table=11
atgacaaatcaactaacgactaacgaggggcaaccgtgggcggacaatcaacattcgcaaactgccggccaacgcggccccgtcttaatccaagattatcaattactcgaaaaactcgcccactttaaccgcgaacgcatccctgaacgggtggtgcatgccaaaggcgctggcgctaaaggctatttcaaggttaccaaggacatgagcgcatataccaaagccgctgttttcagtggcgtcggcaaaaaaacaccgcttatcactcgtttttctcaagtcgctggtgaagccggctatcccgatacataccgcgatgtccgcggtttcgccgttaaattctatacggaagaaggcaattacgatattgtcggcaataacacgccggtcttcttcgtcaatgatccactaaaattccccgatttcatccactctcaaaaacgtgatccccggacacatgcccgtagccaagatatgcaatgggatttctggtccctgtcacccgaatctgtccaccaagtcacgattctcatgagtgatcgcgggattcctgctagttaccggatgatgcacggctttggtagccacaccttcaaatgggttaacgcacaaggtgaacaattctgggttaaataccatttcaagacgaaccaaggtattcacaatctcagcaacgaactcgccgatgaactcgctggtaaggatactgattaccttcaaaatgatttattcgacgcaattgaaaccggcgattatccaagttggacggttgccgtccaactcgtcccttatgaagatggcttgaattatccccaagatatttttgatgttactaaagttatttcacaaaaggattatccattaatcgaaatcggtcaaatggtcctcgatgaaaatccaacgaataacttcgaagatatccaagaactggccttctcaccggctaacttagtccctgggattgaagcatcacccgacaaattacttcaaggtcgactatttggctataaggatgctgaacgttaccggcttggtgccaactacgagcaactccctgtcaaccgaccaaaagtccccgttcataattacgaacgtgacggtgcgatggcccaaaatcaagcaactggcgttaactacgaacccaacagtcaagatggacccactgaagtcccagcagctaagattcatggcgatcaactctctggtacaactggcaacttctctgccgatcccgattattactcagcagctggcaaactttaccggttattatcagccgatgaacaaacccgcttaatcgaaaatattcgcatgaatcttggtcaagtgactaaaccagaaattcaaattcgcgaagttaaacaattttaccaagctgatccagaatatggtcggcgcgtcgcaaccagcgttaaacttagatttagctcagtttga

SEQ ID NO: 43132 - protein, 478 aa, Lactobacillus sakei
MTNQLTTNEGQPWADNQHSQTAGQRGPVLIQDYQLLEKLAHFNRERIPERVVHAKGAGAKGYFKVTKDMSAYTKAAVFSGVGKKTPLITRFSQVAGEAGYPDTYRDVRGFAVKFYTEEGNYDIVGNNTPVFFVNDPLKFPDFIHSQKRDPRTHARSQDMQWDFWSLSPESVHQVTILMSDRGIPASYRMMHGFGSHTFKWVNAQGEQFWVKYHFKTNQGIHNLSNELADELAGKDTDYLQNDLFDAIETGDYPSWTVAVQLVPYEDGLNYPQDIFDVTKVISQKDYPLIEIGQMVLDENPTNNFEDIQELAFSPANLVPGIEASPDKLLQGRLFGYKDAERYRLGANYEQLPVNRPKVPVHNYERDGAMAQNQATGVNYEPNSQDGPTEVPAAKIHGDQLSGTTGNFSADPDYYSAAGKLYRLLSADEQTRLIENIRMNLGQVTKPEIQIREVKQFYQADPEYGRRVATSVKLRFSSV

SEQ ID NO: 43133 - DNA, 1467 bp, Listeria seeligeri
  CDS (1)..(1467): transl_table=11
atgaccgatagaagaaacttaacgacgaatcaaggagtgccgattggggacaaccaaaattcgatgacagcgggattaaaaggaccaactttgttagaagattatgtgttaattgagaaattggcgcattttgatagagaacgtgttccagaacgtgtggtgcatgctcgtggtgctggtgcgcacggcaaatttgtaacgaaaaaaagcatgaaaaaatatacgaaagcacaatttttacaagaagaaggaacagagacagaggtttttgcgcgtttttctacagtaatccatggtcaacattcaccagaaacgcttcgtgatccacgtggtttttcggttaaattttatacggaagaaggtaactatgactttgtcggtaacaacttacctgtattctttatccgtgatgctatcaagtttcctgacgtaattcactccttgaagccagatccacgtactaacattcaagatggcaatcgttactgggacttctttagtttaactccggaagcgacgacgatgattacttatttatttagcgatgaggggactccggcatcttaccgcgaaattcgtggttcaagcgtacatgcctttaaatggataaacgaagaaggtaagactgtttatgtaaaactacgctgggttccaaaagcaggaatcgtcaatctttcaactgatcaagcagcacaaattcaagcaaaagaatttaaccatgctagtcgcgatttgtatgaagcaattgagaatggtgattatccagagtgggatttatatgtgcaagtgctagatccaaaagacttggataattacgacttcaatccgcttgatgcaaccaaagactggtttgaagatgtatttccatacgagcatgttggaacaatgacattaaatcgtaatccggataatatttttgctgaaacagaatcagttggctttaatccaggtgtgcttgtgccggggatgttaccttctgaggaccgtgtactacaggggcgattgttctcttactctgatacgcaaagacaccgcgttggacctaactacttacaattaccaatcaacagcccaaaaactcctgttgataacaaccaacgtgatggacagatgccgtttaaacagcaaacaagttcgattaattatgaaccaaatagttatgatacagaaccaaaagaaaaccctgcatatatcgagcctgagcaagaaattcgtggggatatctctggccgactagtggcagaaaagccaaataactttggtcatgctaaagaagtttggaagcgttactcagatgcagaacgtgcggctcttgtgaaaaatattgtagacgattgggaaggtgtgcgcgaagatattaagattcgcaacttgcgcaatttctatcaagtagagccggaatttgcagaacgtgtggctgctggaactggaattaaccttgctgaacatgtgatagatttaaaataa

SEQ ID NO: 43134 - protein, 488 aa, Listeria seeligeri
MTDRRNLTTNQGVPIGDNQNSMTAGLKGPTLLEDYVLIEKLAHFDRERVPERVVHARGAGAHGKFVTKKSMKKYTKAQFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMITYLFSDEGTPASYREIRGSSVHAFKWINEEGKTVYVKLRWVPKAGIVNLSTDQAAQIQAKEFNHASRDLYEAIENGDYPEWDLYVQVLDPKDLDNYDFNPLDATKDWFEDVFPYEHVGTMTLNRNPDNIFAETESVGFNPGVLVPGMLPSEDRVLQGRLFSYSDTQRHRVGPNYLQLPINSPKTPVDNNQRDGQMPFKQQTSSINYEPNSYDTEPKENPAYIEPEQEIRGDISGRLVAEKPNNFGHAKEVWKRYSDAERAALVKNIVDDWEGVREDIKIRNLRNFYQVEPEFAERVAAGTGINLAEHVIDLK

SEQ ID NO: 43135 - DNA, 1518 bp, Methanosarcina barkeri
  CDS (1)..(1518): transl_table=11
atgggtgaaaagaattcttccaaggttctcaccactggttttggaataccggtgggggatgatcagaacagccttacagccggaaatagaggaccggttcttatgcaggatgttcatctgcttgataaacttagccatttcgaccatgaacgtatcccagagcgtgtagtacatgccaaaggtgcaggtgctggaggttactttgaagtcactgcagacgtgaccaaatataccaaagctaaatttctgtctgaaatcggtaaacgtactgaagtttttgtccgtttttccacagttggaggagagaagggatcggctgattccgctcgtgatccacgtggttttgccgtgaagttctacacagaagatggtaactacgatcttgtaggcaataatacccctgtgttttttattcgcgaccctttaaagtttcctgattttatccacacacaaaaacgtaacccagctacaaactgtaaagatccagatatgttctgggacttcctttccctgacacctgagtcaattcatcaggtcactattctcttctcagaccgcggtactcctgctacctatagaaacatgaatggttattctagccacacctataagtggtataatgaaaagggtgaatatttctgggtgcagtatcattttaagactgaccaggggataaagaacctgacccttgaagaagcagaaaaaatcggtggatcggatcccgaccacgcgacaagagacctgtatgaggctatcaagaaaggtgattatccctcctggactcttgaaatgcaaataatgactccggagcaggcagaagattaccggtttgacatcagggatataaccaaagtatggccccatggtgatttccctaccatgaaaataggcaagttggtgttgaatcgaaatccaacaaattatttcgctgaagtagaacaagcagcttttagtcctgcaaatcttgtgccaggcatcggtatttcacctgataaaatgctgcagggtagggttttttcttatcacgatactcatatccaccgtcttggtccaaattataatctaatacctgttaatgcaccaaagtactcacctgaaaatagttatcagcgtgatggattcatgcgtgttgatgctaacgggggcagtggacccaactattggccaaacagttttggaggaccttctcccgactctgtttatctggaacctccatttggagtatcaggactagcagctcgcacactctatacacatccaaatgatgactttgtacaggctggaaatttgtaccgtgacgttatgactgactacgatcgtgaaaaccttgtaggaaatatcgtatctcatctctctgccgcacagaagcgtatacagcttaggcagacagcattgttctttaaagctgatcgtgactatggaagccgtgtcgctaagggtcttgagcttgatattaaggaagttgagcgcctagctaatatgaccaatgaagagcgagcccgagcaactgagagataa

SEQ ID NO: 43136 - protein, 505 aa, Methanosarcina barkeri
MGEKNSSKVLTTGFGIPVGDDQNSLTAGNRGPVLMQDVHLLDKLSHFDHERIPERVVHAKGAGAGGYFEVTADVTKYTKAKFLSEIGKRTEVFVRFSTVGGEKGSADSARDPRGFAVKFYTEDGNYDLVGNNTPVFFIRDPLKFPDFIHTQKRNPATNCKDPDMFWDFLSLTPESIHQVTILFSDRGTPATYRNMNGYSSHTYKWYNEKGEYFWVQYHFKTDQGIKNLTLEEAEKIGGSDPDHATRDLYEAIKKGDYPSWTLEMQIMTPEQAEDYRFDIRDITKVWPHGDFPTMKIGKLVLNRNPTNYFAEVEQAAFSPANLVPGIGISPDKMLQGRVFSYHDTHIHRLGPNYNLIPVNAPKYSPENSYQRDGFMRVDANGGSGPNYWPNSFGGPSPDSVYLEPPFGVSGLAARTLYTHPNDDFVQAGNLYRDVMTDYDRENLVGNIVSHLSAAQKRIQLRQTALFFKADRDYGSRVAKGLELDIKEVERLANMTNEERARATER

SEQ ID NO: 43137 - DNA, 1512 bp, Micrococcus luteus
  CDS (1)..(1512): transl_table=11
atggagcaccagaagacgacgccgcacgcgaccggctcgacccgccagaacggcgccccggccgtcagcgaccgccagtccctgaccgtgggcagcgagggtcccatcgtcctgcacgacacccacctgctggagacccaccagcacttcaaccgcatgaacatcccggagcgccgcccgcacgccaagggctcgggcgcgttcggcgagttcgaggtgaccgaggacgtgtcgaagtacaccaaggccctcgtgttccagccgggcacgaagaccgagaccctcctgcgcttctccaccgtggccggcgagctcggctccccggacacctggcgcgacgtgcgcggcttcgcgctgcgcttctacaccgaggagggcaactacgacctcgtcggcaacaacaccccgatcttcttcctgcgcgaccccatgaagttcacccacttcatccgctcgcagaagcgcctgccggactccggcctgcgcgatgccaccatgcagtgggacttctggaccaacaaccccgagtcggcgcaccaggtgacctacctgatgggcccgcgcggcctgccccgcacctggcgtgagatgaacggctacggctcccacacctacctgtgggtcaacgcccagggtgagaagcactgggtgaagtaccacttcatctcccagcagggcgtgcacaacctctcgaacgacgaggccaccaagatcgccggcgagaacgccgacttccaccgccaggacctgttcgagtccatcgccaagggcgaccaccccaagtgggacctctacatccaggcgatcccctacgaggagggcaagacctaccggttcaaccccttcgacctgacgaagacgatctcccagaaggactacccgcgcatcaaggtcggcacgctgaccctgaaccgcaacccggagaaccacttcgcgcagatcgagtccgccgcgttcagcccgagcaacaccgtgccgggcatcggcctgtccccggaccgcatgctcctgggccgcgccttcgcgtaccacgacgcgcagctgtaccgcgtgggcgcccacgtgaaccagctgccggtgaaccgtcccaagaacgcggtgcacaactacgccttcgagggccagatgtggtacgaccacaccggcgaccgctccacctacgtgccgaactccaacggcgactcctggtcggacgagaccggcccggtggacgacggctgggaggccgacggcaccctgacccgtgaggcccaggcgctgcgcgcggacgacgacgacttcggccaggccggcaccctcgtccgcgaggtcttctcggaccaggagcgtgacgacttcgtggagaccgtggccggcgcgctgaagggtgtccgccaggacgtccaggcccgcgccttcgagtactggaagaacgtggacgccacgatcggccagcgcatcgaggacgaggtcaagcgccacgagggcgacggcatcccgggcgtcgaggccggcggcgaggcccgcatgtga

SEQ ID NO: 43138 - protein, 503 aa, Micrococcus luteus
MEHQKTTPHATGSTRQNGAPAVSDRQSLTVGSEGPIVLHDTHLLETHQHFNRMNIPERRPHAKGSGAFGEFEVTEDVSKYTKALVFQPGTKTETLLRFSTVAGELGSPDTWRDVRGFALRFYTEEGNYDLVGNNTPIFFLRDPMKFTHFIRSQKRLPDSGLRDATMQWDFWTNNPESAHQVTYLMGPRGLPRTWREMNGYGSHTYLWVNAQGEKHWVKYHFISQQGVHNLSNDEATKIAGENADFHRQDLFESIAKGDHPKWDLYIQAIPYEEGKTYRFNPFDLTKTISQKDYPRIKVGTLTLNRNPENHFAQIESAAFSPSNTVPGIGLSPDRMLLGRAFAYHDAQLYRVGAHVNQLPVNRPKNAVHNYAFEGQMWYDHTGDRSTYVPNSNGDSWSDETGPVDDGWEADGTLTREAQALRADDDDFGQAGTLVREVFSDQERDDFVETVAGALKGVRQDVQARAFEYWKNVDATIGQRIEDEVKRHEGDGIPGVEAGGEARM

SEQ ID NO: 43139 - DNA, 1503 bp, Neisseria gonorrhoeae
  CDS (1)..(1503): transl_table=11
atgactacctccaaatgccccgtaacccatctgaccatgaacaacggggcgcccgttgccgacaatcaaaacagcctgaccgccggcacgcgcggccccctgctgacgcaagatttgtggctgaatgaaaaactcgccgacttcgtgcgcgaagtcatccccgaacgccgtatgcacgccaaaggttcgggcgcgttcggtacgtttaccgtaacacgcgacatcaccaaatacacccgcgccaaaattttcagcgaagtcggcaaaaaaaccgagatgttcggccgtttggccaccgtggcgggcgagcgcggcgcagatgcgtatacgcgcgtccgcggttttgcgttgaaattctataccgaagaaggcaactgggatgtggtcggcaacaacacgcccgtgttctatcccgacctgcgcaaattccccgacctgaacaaagccgtcaaacgatccgcgcaccaatacagttccgccacaaacaactgggacttctgggcgctgctgcccgaagccctgcaccaagttaccatcgtgatgagcgaccggggcattcccgccagctaccgccatatgcacggcttcggttcgcatacctacagcctctggaacgaagcgggcgaacgtttttgggtgaaattccatttccgcagccagcaagggattaaaaacctgaccaacgaagaagctgcaaaaatcatcgccgacgaccgcgaaagccatcagcgcgacctgtacgaagccatcgagcgcggcgagttcccgaaatggacgatgtacatccaagtcatgcctgaagccgatgccgcaaaagtgccttatcatccgtttgacttgaccaaagtttggccgaaaaaagactatccgctgattgaagtggccgaattcgagttgaaccgcaatcccgaaaacttcttcgccgatgtggaacaatccgccttcgcaccgagcaacctcgttcccggtatcggcgcgagcccggataaaatgttgcaagcccgtttgttcaattacgccgacgcgcaacgttaccgcttgggtgtgaacttccgccaaatccccgtcaatcgtccgcgttgccctgttcacagcaaccagcgcgacggacaaggccgcgcgacggaactacggcagcctgcgcactacgaacccaacagcttcggccaatggagccaacaacccgacttcgccgaaccgcctttgaaaatcaacggcgacgcggcacactgggactaccgccaagacgatgacgactacttcagccaaccgcgcgccttgttcaacctgatgaacgacgcgcagaaacaggctttgtttgacaacaccgccgcagccatgggcgatgcgcccgacttcatcaaataccgccatatccgcaactgctaccgttgcgacccggcatacggtgaaggcggtagcaaagccctcggactgaccgtcgaagagccacaagccgcgcgcgcgaccgatcccgcgctgggtcagggaggtttgctgtaa

SEQ ID NO: 43140 - protein, 500 aa, Neisseria gonorrhoeae
MTTSKCPVTHLTMNNGAPVADNQNSLTAGTRGPLLTQDLWLNEKLADFVREVIPERRMHAKGSGAFGTFTVTRDITKYTRAKIFSEVGKKTEMFGRLATVAGERGADAYTRVRGFALKFYTEEGNWDVVGNNTPVFYPDLRKFPDLNKAVKRSAHQYSSATNNWDFWALLPEALHQVTIVMSDRGIPASYRHMHGFGSHTYSLWNEAGERFWVKFHFRSQQGIKNLTNEEAAKIIADDRESHQRDLYEAIERGEFPKWTMYIQVMPEADAAKVPYHPFDLTKVWPKKDYPLIEVAEFELNRNPENFFADVEQSAFAPSNLVPGIGASPDKMLQARLFNYADAQRYRLGVNFRQIPVNRPRCPVHSNQRDGQGRATELRQPAHYEPNSFGQWSQQPDFAEPPLKINGDAAHWDYRQDDDDYFSQPRALFNLMNDAQKQALFDNTAAAMGDAPDFIKYRHIRNCYRCDPAYGEGGSKALGLTVEEPQAARATDPALGQGGLL

SEQ ID NO: 43141 - DNA, 1449 bp, Onchocerca volvulus endobacterium
  CDS (1)..(1449): transl_table=11
atgagccagaataaaacccttactaccgccagcgggccacctgtcgcggataaccagaattcccgttccgccggcccacgcggcccgctgctgctcgacgactttcacctgatcgagaagctcgctcacttcaaccgtgaaaacattcctgagcgtcgtgtacacgccaaaggctcgggcgcttacggtaccttcaccgtcactcaagacatcacgcagtacaccagcgccaagctgttcgattctgtgggcaagcaaactccgactttcctgcgcttctccacggtgggtggcgagcgtggttcggctgatactgagcgcgacccgcgtggtttcgcgttgaagttctacaccgaagaaggcaactgggacatcgttggtaacaacaccccggtgttcttcatccgcgacccgctgaagtttcccgactttatccacacccaaaagcgcctgccgcaaagcaacctgaaaagtgcacagatgatgtgggacttctggtcgcactcccctgaggcgctgcaccaggtcaccatcctgttttcggaccgtggcatcccggacggctaccgtcacatgcacggcttcggcagtcacacctacagcttgattaacgccaaaggcgagcgtcactgggtgaagtggcactacaagaccaagcaaggtatcaagaacctggcgccggctgacgctgcacgcctggcgggtaccgaccctgattacgctcagcgcgatctgttcggtgctattgagcgtggtgacttcccgaaatggcgcgtgtgcattcagatcatgactgaggcccaggccaacgctcactacgaaaacccgttcgacgtgaccaagacctggtcgcagaaagagttcccgctgatcgaagtgggtgagctggaactgaaccgcaacccgctgaactacttcgctgaagttgaacaggcggctttcggtccaagcaacatggtcccgggtgttggcctgtcgccagaccgcatgctgcaagggcgcgtgttcgcttacgccgatgcccatcgctatcgcgtaggtaccaatcaccagcaactgccggtgaatgcgccacgcagcccagtcaacagctaccagcgtgatggttcgatggcattcggctccaatggtggtgcggcccccaattacgagccaaacagctacgccgatgcgccgaagcaggctcctcagtatgccgagccagccttggccctgagcggtgcggctgatcgttacgatcaccgcgaagataccgactactacagccatgccggtgcgctgttccgcctgatgaacgatgagcagaaagccctgctgatcaacaatatcgccggcgcaatggcgggtgtttccagcgacgtggtgcagcgccagttgcagtacttcttcaaggccgacccggcttatggagaagggatcgcatctgcactgggtgtatcgcttaactga

SEQ ID NO: 43142 - protein, 482 aa, Onchocerca volvulus endobacterium
MSQNKTLTTASGPPVADNQNSRSAGPRGPLLLDDFHLIEKLAHFNRENIPERRVHAKGSGAYGTFTVTQDITQYTSAKLFDSVGKQTPTFLRFSTVGGERGSADTERDPRGFALKFYTEEGNWDIVGNNTPVFFIRDPLKFPDFIHTQKRLPQSNLKSAQMMWDFWSHSPEALHQVTILFSDRGIPDGYRHMHGFGSHTYSLINAKGERHWVKWHYKTKQGIKNLAPADAARLAGTDPDYAQRDLFGAIERGDFPKWRVCIQIMTEAQANAHYENPFDVTKTWSQKEFPLIEVGELELNRNPLNYFAEVEQAAFGPSNMVPGVGLSPDRMLQGRVFAYADAHRYRVGTNHQQLPVNAPRSPVNSYQRDGSMAFGSNGGAAPNYEPNSYADAPKQAPQYAEPALALSGAADRYDHREDTDYYSHAGALFRLMNDEQKALLINNIAGAMAGVSSDVVQRQLQYFFKADPAYGEGIASALGVSLN

SEQ ID NO: 43143 - DNA, 1485 bp, Pisum sativum
  CDS (1)..(1485)
atggatccttacaagcatcgtccttctagcgctttcaattctcctttctggactacgaactccggtgctcctgtttggaataataactcttccctaaccgttggatctagaggtccaattctattggaagattatcatcttgtggaaaagcttgcccaatttgatagggaaaggatcccagaacgtgttgtccatgctaggggagcaagtgcaaagggtttctttgaagtcacacatgatatttcgcacctgacatgtgcagatttccttcgagcccctggtgttcagacacctgtcattgtgcgtttctcaactgtcattcatgaacgtggcagccctgaaaccttgagggatccccgaggttttgctgtgaaattttacaccagagagggtaactatgaccttgttggaaacaactttcccgtcttcttcgttcatgacggtatgaattttccagatatggtccatgctcttaaacccaatccccagacccacatccaggagaattggagaattcttgatttcttctacaactttccagaaagccttcacatgttctccttcctatttgatgatgtgggtgtcccacaagattataggcatatggatggttttggagttaacacatacaccctgatcaacaaggctggaaaatcggtgtatgtcaaatttcactggaagcccacctgtggtgtgaagtgtctattggaggaagaggccattcaggtgggaggatccaaccacagccatgctactaaagacctttatgactcaattgctgctggtaactatcctgagtggaaactttacattcaaacaatagatcctgctcatgaagacagatttgagtttgacccacttgatgtaactaagacttggcccgaggacatcataccccttcagcccgtaggtcgcatggtcttgaacaagaacatagataatttctttgctgagaatgaacagcttgcattttgtcctgccattatgctgcctggtatatattactcagatgacaagatgcttcaaactagggttttctcttatgctgattcacagaggcacagacttggaccgaactacctgcaacttcctgttaatgctcccaagtggtctcaccacaacaatcaccatgagggtttcatgaatgccattcacagggatgaggaggtcaattacttcccttcaaggcatgatactgttcgtcatgcagaaagggtccccattcctactactcatttatctgcaaggcgtgaaaagtgcaatattccgaaacagaatcacttcaagcaggctggagaaagataccgaacttgggcacctgacaggcaggaaagatttctccgcaggtgggtagaagctttatccgacaccgatccacgcatcacccatgaaatccgcagcatttgggtatcatactggtctcaggctgatcgttctcttgggcagaagttagcatctcatctgaacatgaggcctagcatttaa

SEQ ID NO: 43144 - protein, 494 aa, Pisum sativum
MDPYKHRPSSAFNSPFWTTNSGAPVWNNNSSLTVGSRGPILLEDYHLVEKLAQFDRERIPERVVHARGASAKGFFEVTHDISHLTCADFLRAPGVQTPVIVRFSTVIHERGSPETLRDPRGFAVKFYTREGNYDLVGNNFPVFFVHDGMNFPDMVHALKPNPQTHIQENWRILDFFYNFPESLHMFSFLFDDVGVPQDYRHMDGFGVNTYTLINKAGKSVYVKFHWKPTCGVKCLLEEEAIQVGGSNHSHATKDLYDSIAAGNYPEWKLYIQTIDPAHEDRFEFDPLDVTKTWPEDIIPLQPVGRMVLNKNIDNFFAENEQLAFCPAIMLPGIYYSDDKMLQTRVFSYADSQRHRLGPNYLQLPVNAPKWSHHNNHHEGFMNAIHRDEEVNYFPSRHDTVRHAERVPIPTTHLSARREKCNIPKQNHFKQAGERYRTWAPDRQERFLRRWVEALSDTDPRITHEIRSIWVSYWSQADRSLGQKLASHLNMRPSI

SEQ ID NO: 43145 - DNA, 1479 bp, Phaseolus aureus
  CDS (1)..(1479)
atggatccctacaagtaccggccatccagcgcttttaattctcccttctggactacaaattctggtgctcctgtttggaacaacaacaactctttaactgttggaactagaggtccaattctcctggaggattatcatcttgtggaaaagcttgcaaactttgacagggaacggatcccagaacgagttgtccatgccaggggagctagtgcaaagggtttctttgaggtcacacatgacgtttctcacctgacatgtgcagatttccttcgagcacctggagttcagacaccagtaattgtccgtttttcaactgtcatccatgagcgtggtagccctgaaactttgcgggaccctcgaggttttgctgtgaaattttacaccagagagggtaactttgatcttgttggaaacaaccttcccgtcttctttgtacgtgacggcatgaagtttccagatatggtccatgctcttaaacccaatcctaagaaccacatccaggagaattggaggatccttgacttcttctctcactttccggaaagccttcacatgttctcctttttatttgatgatttgggtgttccacaagattacaggcatatggatggttttggagttaacacatataccttgatcaacaaggctgggaaagcagtgtatgtgaaatttcactggaagaccacgagtggtgtgaagtgtctattggaggaagaagccattaaggtgggaggagccaaccatagccatgctacacaagaccttcatgattcgattgctgctggtaactatcctgagtggaaactattcattcagacaatagatcctgagcacgaagacaaatttgactttgaccctcttgatgtaaccaagacttggcccgaggacattatacccttgcagcctgttggtcgcttggtcctgaataagaacatagataacttctttgctgagaatgaacaacttgcattttgccctgccataatagttcctggtgtatattactctgatgataagatgcttcaaaccaggatattctcttatgctgattcacagaggcacaggcttggaccaaactatctgctacttcctgccaatgctcccaagtctgctcaccacaacaatcaccatgaaggtttcatgaatttcatccacagggatgaggaggtcaattacttcccctcaaggtatgatcctgttcgtcatgcagaaaagttccccatacctcctgctgtcttctctggaaggcgtgaaaagattgcaattgagaaggagaacaacttcaagcaggctggagagagattccgatcttgggcacctgacaggcaagatagatttatccgccgatgggttgatgctttatctgacccacgtgtcacccatgaaatccgcagtgtctggatatcatactggtctcaggctgaccgttctcttggccaaaagatagcatctcatctgaacatgaggccaaatatttaa

SEQ ID NO: 43146 - protein, 492 aa, Phaseolus aureus
MDPYKYRPSSAFNSPFWTTNSGAPVWNNNNSLTVGTRGPILLEDYHLVEKLANFDRERIPERVVHARGASAKGFFEVTHDVSHLTCADFLRAPGVQTPVIVRFSTVIHERGSPETLRDPRGFAVKFYTREGNFDLVGNNLPVFFVRDGMKFPDMVHALKPNPKNHIQENWRILDFFSHFPESLHMFSFLFDDLGVPQDYRHMDGFGVNTYTLINKAGKAVYVKFHWKTTSGVKCLLEEEAIKVGGANHSHATQDLHDSIAAGNYPEWKLFIQTIDPEHEDKFDFDPLDVTKTWPEDIIPLQPVGRLVLNKNIDNFFAENEQLAFCPAIIVPGVYYSDDKMLQTRIFSYADSQRHRLGPNYLLLPANAPKSAHHNNHHEGFMNFIHRDEEVNYFPSRYDPVRHAEKFPIPPAVFSGRREKIAIEKENNFKQAGERFRSWAPDRQDRFIRRWVDALSDPRVTHEIRSVWISYWSQADRSLGQKIASHLNMRPNI

SEQ ID NO: 43147 - DNA, 1524 bp, Pichia angusta
  CDS (1)..(1524)
atgtcaaacccccctgttttcactacttcgcaaggttgtcccgtgtcggatcccttcaccacccaacggatccctctggattccacgggctacaagtatgcccctccaattggtccattgctcttgcaggacttcaagctcattgacacactctcccactttgacagagaaagaattccagagagagtggtgcacgccaagggtgccggagcttacggtgtgtttgaagtgaccgacgacattaccgatgtttgcagtgccaagttcctcgacactgttggtaagaagacaagaattttcaccagattctccactgtgggtggagaaaaaggttctgcagacacagccagggacccaaggggatttgctaccaaattctacacagaagacggaaacttggaccttgtgtacaacaacacgccgatcttcttcatcagggacccaattaagttcccccactttattcacacgcagaagagaaacccggccaccaacttgaaggacccaaacatgttctgggactacctgacggccaatgacgagtctttgcaccaagtcatgtatttattctccaacagaggtacgcctgcctcgtacagaaccatgaacggctactctggccacacctacaaatggtacaattccaagggcgagtgggtgtatgtgcaggtccacttcattgccaaccaaggcgtgcacaatctgctcgacgaggaagctggaaggctggctggagaagatccagaccactccaccagagacttgtgggaagcaattgagaaaggagattatccatcgtgggagtgctacatccagaccatgacccttgagcagtccaagaagctgccattctctgtgtttgacttgaccaaggtctggccacacaaggacttcccgctgagacactttggcagattcactcttaatgagaatcctaagaattactatgctgaaacggagcagattgccttctctccttcgcacaccgttcctggaatggagccttcgaacgaccctgtcttgcaatcgagactgttttcgtacccagacacgcacagacacagacttggacctaactaccaccagatccctgtcaactgtccactgaaatcgggctcgttcaatcctatcaacagagacggtcctatgtgtgttgatggcaacttgggaggcacgccgaactacgcaaacgcttacaactgtcctattcagtacgctgtgagccctaaggcatctggcaataagccagacgaaaagtatactggagaagtggtcccataccactgggagcacactgattatgactacttccagccaaagatgttctggaaggttcttggcaggacgccaggcgaacaggagtcccttgtcaagaacgttgcaaaccatgtttctgctgctgacgagttcatccaggaccgtgtttacgaatacttctcgaaggccgagcctattattggagatctgatcagaaagaaggttcaggagctcaaaagaaaggcttcttctccatccaaaatataa

SEQ ID NO: 43148 - protein, 507 aa, Pichia angusta
MSNPPVFTTSQGCPVSDPFTTQRIPLDSTGYKYAPPIGPLLLQDFKLIDTLSHFDRERIPERVVHAKGAGAYGVFEVTDDITDVCSAKFLDTVGKKTRIFTRFSTVGGEKGSADTARDPRGFATKFYTEDGNLDLVYNNTPIFFIRDPIKFPHFIHTQKRNPATNLKDPNMFWDYLTANDESLHQVMYLFSNRGTPASYRTMNGYSGHTYKWYNSKGEWVYVQVHFIANQGVHNLLDEEAGRLAGEDPDHSTRDLWEAIEKGDYPSWECYIQTMTLEQSKKLPFSVFDLTKVWPHKDFPLRHFGRFTLNENPKNYYAETEQIAFSPSHTVPGMEPSNDPVLQSRLFSYPDTHRHRLGPNYHQIPVNCPLKSGSFNPINRDGPMCVDGNLGGTPNYANAYNCPIQYAVSPKASGNKPDEKYTGEVVPYHWEHTDYDYFQPKMFWKVLGRTPGEQESLVKNVANHVSAADEFIQDRVYEYFSKAEPIIGDLIRKKVQELKRKASSPSKI

SEQ ID NO: 43149 - DNA, 1485 bp, Rhizobium meliloti
  CDS (1)..(1485): transl_table=11
atgacagatcgtccgacgatcaccaccaccgccggggcgccggtgccggacaaccagaattcgctgacggcaggcccgcgtggcggcatcatgctgcaggattatcagctcatcgagaagctggcgcaccagaaccgcgagcgcattccggaacgcgtcgtccatgccaagggctggggtgctttcggctcgctgaagatcaccggcgacatctcgcaatacaccagggcgaagtgtctccagcccggcgcggaaacgccgatgctggcccgcttctcgaccgttgccggcgaacagggcgccgccgaccacgagcgcgacgtccgcggtttcgcgctgaaattctacaccgatgaaggcaactgggacctcgtcggcaacaatacgccggtcttcttcattcgcgatccctacaagttccccgacttcatccacacgcagaagcgtcatccgaagaccaatctccgttccgccactgccatgtgggactactggtccctgtcgccggaaagcctgcatcaggtgacgatcctgatgtccgaccgcggcctcccgcagacgccgatgcatatgaacggctacggctcgcacacctattccttctggaacgacgcgggcgaacgctattgggtcaagttccacttcaagacccagcagggccataagttcttcaccaacgaggaaggcgaggcggtcatcggcaagacccgcgagggctatcaggagtcactgttctacgccatcgagaacggcgagttcccgcgctggacggtgcaggtgcagatcatgccggagctcgacgtcgagaagacgccctacaacccgttcgacctgaccaaagtctggccgcatgccgactacccgccggtcgagatcggcgtgctggagctgaaccgcaacccggaaaactattttgccgagatcgagaacgcagccttctcgccctccaatatcgtgcccggcatcggcttctcgccggacaaggtgctgcaggcccgcatcttctcctatgcggacgcccaccgctaccgcctcggcacgcattacgagcacatcccggtcaaccagccgcgctgcccggttcaccactatcatcgcgatggtcagatgaacacctatggcggcattcgcaccggcaatccggacgcctattacgagcccaactccttcaatggcccggccgaacagccgctggccaaggaaccgccgctcagaatagacggcgacatgtcccgctacgaccaccgcgtcggcaatgacgactacgtccaggtgcgggcgctgttcggcctcttcgacgaagggcagaagtcgcgcctcttctccaacatcgcggccgccatgggcggcgtcccgggcgagatcatcgagcggcagctcattcatttcgcccgtgtccacccggaatacgaagcgggcgtccgccaggcactgaagaccgcccacggctacgaggcggacacgatcagcacggcggccgagtaa

SEQ ID NO: 43150 - protein, 494 aa, Rhizobium meliloti
MTDRPTITTTAGAPVPDNQNSLTAGPRGGIMLQDYQLIEKLAHQNRERIPERVVHAKGWGAFGSLKITGDISQYTRAKCLQPGAETPMLARFSTVAGEQGAADHERDVRGFALKFYTDEGNWDLVGNNTPVFFIRDPYKFPDFIHTQKRHPKTNLRSATAMWDYWSLSPESLHQVTILMSDRGLPQTPMHMNGYGSHTYSFWNDAGERYWVKFHFKTQQGHKFFTNEEGEAVIGKTREGYQESLFYAIENGEFPRWTVQVQIMPELDVEKTPYNPFDLTKVWPHADYPPVEIGVLELNRNPENYFAEIENAAFSPSNIVPGIGFSPDKVLQARIFSYADAHRYRLGTHYEHIPVNQPRCPVHHYHRDGQMNTYGGIRTGNPDAYYEPNSFNGPAEQPLAKEPPLRIDGDMSRYDHRVGNDDYVQVRALFGLFDEGQKSRLFSNIAAAMGGVPGEIIERQLIHFARVHPEYEAGVRQALKTAHGYEADTISTAAE

SEQ ID NO: 43151 - DNA, 1539 bp, Schizosaccharomyces pombe
  CDS (1)..(1539)
atgaactcgaaagactcaaataccgtccctgtttacaccaccaacaccggttgtcccatttttaaccctatggctgcggctcgtgtgggtaagggaggtcctgtcttacttcaagattcccatttaatcgacgtctttcaacactttgatcgcgagcgtattcctgaacgtgtcgtccatgcaaagggttccggtgcttttggtgaattcgaatgcaccgacgacattaccaagtataccaaacataccatgttttctaaggttggtaagaaaacccctatggttgctcgtttctccaccgtcggtggtgaaaggggtactcctgatactgctcgtgatcctcgtgggttcgcattaaagttctacaccgatgaaggtattttcgatatggttggaaacaatacccctgtcttcttccttcgtgatcccgctaaattccctctcttcatccatactcagaagcgtaaccctcaaaatgatatgaaggatgctactatgttttgggattacctttctcaaaacgcagagtccatccatcaagttatgattcttttctctgacttgggtggtaccccttatagctaccgtttcatggatggcttttccagtcatacctacaaatttgttaatgataagggtgaattctactattgcaaatggcatttcattactaatcaaggaaccaagggtttaacaaatgaagaagccgctgcattggatggatccaatcccgaccatgctcgtcaagatctattcgaagctattgaacgtggtgattaccccagttggacgctttacgttcaagttatgacccctcaggaggctgaaaaatatcgctacaacattttcgatcttactaaggtctggcctcataaggacgtaccaatgcaaagggttggacgctttaccttgaatcagaatcctaccaatttctttgcagatatcgagcaggctgggttctctccttctcatatggttcctggtattgaagtctcagcggatcctgttttgcaagtacgtacattttcctatcctgatacccaccgccatcgtttgggtgctaatttcgagcaaattcccgtcaattctcctaagtgtcctgtctttaactattctcgtgacggccctatgaatgtcaatggaaaccaaggaaattggccaaactatccatcctcaatccgaccacttgctaaagttcaatatgagcctgacgaaggtcacgaaaagtgggtaggtcaagttacttaccatatggacgaaattaccgacgttgattttgagcaacctagagcgttttggcaaaatgttttgggcaagaaacctggacagcaagataactttgttaagaacgttgccggtcacttgtctggtgctatatctcctgtacgtgaacgccaatacggtgtatttactcgtgttgattcagagcttggtcgccgtattcgtgaggctactgaagctgaagtgaagaagatggaagaaaaagcccccaagccaattaacaagggcgaaccccatatgttccaaggaagctcataa

SEQ ID NO: 43152 - protein, 512 aa, Schizosaccharomyces pombe
MNSKDSNTVPVYTTNTGCPIFNPMAAARVGKGGPVLLQDSHLIDVFQHFDRERIPERVVHAKGSGAFGEFECTDDITKYTKHTMFSKVGKKTPMVARFSTVGGERGTPDTARDPRGFALKFYTDEGIFDMVGNNTPVFFLRDPAKFPLFIHTQKRNPQNDMKDATMFWDYLSQNAESIHQVMILFSDLGGTPYSYRFMDGFSSHTYKFVNDKGEFYYCKWHFITNQGTKGLTNEEAAALDGSNPDHARQDLFEAIERGDYPSWTLYVQVMTPQEAEKYRYNIFDLTKVWPHKDVPMQRVGRFTLNQNPTNFFADIEQAGFSPSHMVPGIEVSADPVLQVRTFSYPDTHRHRLGANFEQIPVNSPKCPVFNYSRDGPMNVNGNQGNWPNYPSSIRPLAKVQYEPDEGHEKWVGQVTYHMDEITDVDFEQPRAFWQNVLGKKPGQQDNFVKNVAGHLSGAISPVRERQYGVFTRVDSELGRRIREATEAEVKKMEEKAPKPINKGEPHMFQGSS

SEQ ID NO: 43153 - DNA, 1479 bp, Soldanella alpina
  CDS (1)..(1479)
atggatccttacaagtaccgctcttcaagtgctttcaacactcctttctggaccacaaattcaggtgctccagtgtggaacaacaactcctcattgactgttggaaccagagggccaattttgcttgaggattaccatctagtggagaagcttgcaaattttgacagggagcgtatcccagaacgtgtcgtacatgctagaggagcaagtgctaagggctttttcgaggttacacatgacatttctcaccttacttgtgccgatttcctaagagctccaggtgtccagacgccagttattgttcgtttctccactgttattcatgaacgtggtagccctgagactcttagggaccctcgtggttttgcagtgaaattctacacaagagagggtaactttgacttggtgggaaacaatttcccagttttctttgttcgtgatggaatgaaatttcccgacatggtccatgctcttaagcccaaccccaagtcacacattcaggaaaattggagaatactcgacttcttctctcaccacccagagagtttgcatatgttcactttccttttcgacgatcttggtgttccgcaagattacaggcacatggaaggctcgggtgtgaatacatacacattaataaataaagctggaaaagctcaatatgttaagttccattggaaacctacatgtggagtgaaatgtttattagaagatgaggcaataaaggtcggaggcgcaaatcatagtcacgccacgaaggatctatacgactcgatatcagctggaaattatcctgaatggaaactctttattcagataatagagcctgatcatgaggataaattcgactttgatccacttgatgtgaccaaaacttggcctgaggatatcatacccttgatgcctgtgggtcgcttggtgttgaacaaaaatatcgataatttctttgcagaaaatgagcaattggcgttttgcccagctcttatagtgcctggtgtttattattcggacgataagctgctccaaactcggatattttcttatgctgatacccaaaggcaccgtcttggacctaattatctgcagcttccacctaatgcccctaagtgtgcccatcacaacaatcaccatgagggtcttatgaactttatgcacagagatgaggaggtgaactatttcccttcaaggttcgatccagtacgtcatgctgagaggcacccaatccctcctcctgtcttgaccggaaagcgcgacaggtgcatgattgagaaagagaacaatttcaagcagcctggagagagatacagaacctttgcaccagacaggcaagaacggtttgtctgcaggtgggttgatgctttatctgacccacgtgtcacccatgaaatccgcagcatctggatttcgtactggactcaggcggacaaatctctgggacagaaattagcatctcgcttgaatgtgaggccaaccatgtga

SEQ ID NO: 43154 - protein, 492 aa, Soldanella alpina
MDPYKYRSSSAFNTPFWTTNSGAPVWNNNSSLTVGTRGPILLEDYHLVEKLANFDRERIPERVVHARGASAKGFFEVTHDISHLTCADFLRAPGVQTPVIVRFSTVIHERGSPETLRDPRGFAVKFYTREGNFDLVGNNFPVFFVRDGMKFPDMVHALKPNPKSHIQENWRILDFFSHHPESLHMFTFLFDDLGVPQDYRHMEGSGVNTYTLINKAGKAQYVKFHWKPTCGVKCLLEDEAIKVGGANHSHATKDLYDSISAGNYPEWKLFIQIIEPDHEDKFDFDPLDVTKTWPEDIIPLMPVGRLVLNKNIDNFFAENEQLAFCPALIVPGVYYSDDKLLQTRIFSYADTQRHRLGPNYLQLPPNAPKCAHHNNHHEGLMNFMHRDEEVNYFPSRFDPVRHAERHPIPPPVLTGKRDRCMIEKENNFKQPGERYRTFAPDRQERFVCRWVDALSDPRVTHEIRSIWISYWTQADKSLGQKLASRLNVRPTM

SEQ ID NO: 43155 - DNA, 1479 bp, Solanum melongena
  CDS (1)..(1479)
atggatctctctaagtatcgcccttcaagcgcatacgacacccctttcttgacaacaaatgctgggggtcctgtgtacaacaatgtatcttccttgactgttggacctagagggcctgttctgcttgaggattatcatttaatagagaagcttgcgacttttgatcgcgagaggatacctgagcgtgttgttcatgctcgaggtgctagtgccaagggattctttgaagtcactcatgatgtttctcatcttacttgtgctgatttcctccgagctcctggcgttcaaacgcctgttatttgtcgcttctctactgttgttcatgaacgtggaagccccgagtctatcagggatattcgcggttttgctgtcaaattttacaccagagaggggaactttgatctggttggaaacaacgtccctgtcttctttaatcgcgatgcaaagtcattccctgacacgattcgtgcattgaaaccaaatccaaagtcacacattcaggaaaactggaggatccttgatttcttctctttccttccggagagtttgcatacgtttgcctttttctatgacgatgtttgtctaccgataaattacagacacatggaaggatttggggttcatgcttatcaattgatcaacaaagctgggaaagcacattatgtgaagtttcactggaagccaacttgtggtgtcaaaagcatgacggaggaagaagctattagagtcggaggtactaatcatagccacgcgaccaaggatctctacgattcaattgctgctggaaactatccagagtggaaactttttatccaaattatggaccctgaggatgtagacaaattcgactttgatcctctcgatgtaaccaagacatggcctgaggatatcttgcctttgatgccagttggtcgattggtgttgaatagaaacattgataacttctttgctgagaatgagcagctcgcgtttaaccctggtcatatcgtccctggtgtttactattcggaggataagcttcttcagactaggatatttgcatatgctgatactcagagacaccgtattgggccaaactatatgcagctcccagttaatgctcccaagtgtgctcatcacaacaatcatcgcgatggtgccatgaacttcatgcatcgcgatgaagaggtggattatttgccctcaaggtttgatccttgtcgtcctgctgagcagtacccaattccttcttgtgtcttgacaggaaggcgcgagaagtgtgtcattccgaaggagaacaacttcaaacaggcaggggagagataccgaacctgggaacctgacaggcaagatagatacatcaacaaatgggttgagtctttatccgatccacgagtcactcatgagattcgcagtatatggatatcatacttgtctcaggctgacaagtcctgtggtcagaaggtcgcttctcgtctactggtcaagcctacaatgtga

SEQ ID NO: 43156 - protein, 492 aa, Solanum melongena
MDLSKYRPSSAYDTPFLTTNAGGPVYNNVSSLTVGPRGPVLLEDYHLIEKLATFDRERIPERVVHARGASAKGFFEVTHDVSHLTCADFLRAPGVQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPINYRHMEGFGVHAYQLINKAGKAHYVKFHWKPTCGVKSMTEEEAIRVGGTNHSHATKDLYDSIAAGNYPEWKLFIQIMDPEDVDKFDFDPLDVTKTWPEDILPLMPVGRLVLNRNIDNFFAENEQLAFNPGHIVPGVYYSEDKLLQTRIFAYADTQRHRIGPNYMQLPVNAPKCAHHNNHRDGAMNFMHRDEEVDYLPSRFDPCRPAEQYPIPSCVLTGRREKCVIPKENNFKQAGERYRTWEPDRQDRYINKWVESLSDPRVTHEIRSIWISYLSQADKSCGQKVASRLLVKPTM

SEQ ID NO: 43157 - DNA, 1509 bp, Toxoplasma gondii
  CDS (1)..(1509)
atgactcaggttccgcccgtaacattccagcagtatggaccggttatcacgacctctgctgggaacccagtcgatgacaaccaaaactcggtaactgctggaccctacggccccgcgatcctgagtaacttccatctcatcgacaagctggcccacttcgatcgagaacgcattcccgagcgcgttgtgcatgccaagggcggtggcgcctttggctatttcgaggtcactcatgacatcaccagattctgcaaagcgaagctgttcgagaaaatcggaaagcggacgcctgtgtttgcacgtttttcgacggtggctggcgagtcggggagtgcggacaccaggcgcgacccgcgcggcttcgcactcaagttctacacggaggaggggaactgggacatggttggaaacaacactcctatctttttcgttcgagacgccataaagttccccgacttcattcatacgcagaagcggcatccgcaaacgcacctccacgacccgaacatggtgtgggatttcttctcgctcgttccggaaagtgtgcatcaagtgaccttcctgtacacggaccgtggcacaccggacggcttccgccatatgaatggctacgggagtcacacgttcaaattcatcaacaaagacaacgaagccttttatgtcaagtggcacttcaagacaaaccaaggaatcaagaacctgaacagacagcgcgcaaaagaactcgagagcgaagatcctgactacgcggttcgtgacctgttcaacgccattgccaagcgagagtttccctcttggaccttctgtattcaggtaatgcccttgaaagatgcagagacgtacaaatggaatgtctttgacgtgaccaaagtgtggccgcacggcgactacccactcatcccggtcggaaaactcgtgctggatcgcaacccagaaaactatttccaagacgtggaacaagcagcttttgcgccagctcatatggtgccagggattgaaccgagcgaagatcgcatgctgcagggacgcatgttctcctacatcgacactcatcggcacagacttggcgccaattaccatcagattcctgtgaaccgcccgtggaacgcccgtgggggcgactactccgtccgcgatggtccaatgtgcgtcgacgggaacaaagggtctcagctgaattacgaaccgaacagtgtggacggttttccaaaggaagacagaaatgctgctgtgtcgggaacgaccacagtgagtggcacggtcgcgtgccatcctcaagagcaccccaacagtgactttgagcagccagggaacttttatagaacggtcttgagtgagccggagagggaagcgctcattggcaacatcgccgagcatctcaggcaggcgagacgagatattcaagagcgacaggtgaagattttttacaagtgcgatccagagtatggcgagcgcgtcgctcgagccatcggtttgccgactgcggcgtgctacccagccaagatgtag

SEQ ID NO: 43158 - protein, 502 aa, Toxoplasma gondii
MTQVPPVTFQQYGPVITTSAGNPVDDNQNSVTAGPYGPAILSNFHLIDKLAHFDRERIPERVVHAKGGGAFGYFEVTHDITRFCKAKLFEKIGKRTPVFARFSTVAGESGSADTRRDPRGFALKFYTEEGNWDMVGNNTPIFFVRDAIKFPDFIHTQKRHPQTHLHDPNMVWDFFSLVPESVHQVTFLYTDRGTPDGFRHMNGYGSHTFKFINKDNEAFYVKWHFKTNQGIKNLNRQRAKELESEDPDYAVRDLFNAIAKREFPSWTFCIQVMPLKDAETYKWNVFDVTKVWPHGDYPLIPVGKLVLDRNPENYFQDVEQAAFAPAHMVPGIEPSEDRMLQGRMFSYIDTHRHRLGANYHQIPVNRPWNARGGDYSVRDGPMCVDGNKGSQLNYEPNSVDGFPKEDRNAAVSGTTTVSGTVACHPQEHPNSDFEQPGNFYRTVLSEPEREALIGNIAEHLRQARRDIQERQVKIFYKCDPEYGERVARAIGLPTAACYPAKM

SEQ ID NO: 43159 - DNA, 1449 bp, Vibrio fischeri
  CDS (1)..(1449): transl_table=11
atgagtaagaagttaacaacagcagcaggctgtcctgttgcacataaccaaaatgttcaaactgcgggtaaacgtggccctcaattattgcaagatgtgtggtttttagaaaaactggcgcattttgatcgtgaagttattcctgagcgtcgtatgcatgcgaaaggctctggtgcttacggtacatttacggttactcacgacattacgaaatatacgaaagcaaaattgttttctgaaattggtaaacaaaccgagttattcgcgcgtttcacaacggtagcgggtgagcgtggtgctgctgatgctgagcgtgatattcgtggttttgcattaaaattctacacagaagaaggtaactgggatttggttggtaataatacacccgtattcttcctacgtgatccactaaaattccctgatttaaaccacgcagtgaaacgcgatcctcgcacaaatatgcgaagcgctaaaaataactgggatttttggacatcactacctgaagcacttcatcaagtgaccatcgtaatgagtgatcgtggtattcctgcaacataccgtcatatgcatggttttggtagccacacgtttagttttattaatagcgataatgagcgtttttgggttaaattccactttaaatcacaacaaggcattaaaaacttgtcagatgctgaagctgcacaagtgattggtcaagatcgtgaaagtcatcaacgtgatttacttgaaagtattgataaccaagatttccctaaatggacactaaaagttcagatcatgccagaagcggatgcggcaacagtgccttacaatccgtttgatttaacaaaagtatggccacataaagattatcctttgattgaagtgggtgagtttgagttaaaccgtaatccgcaaaacttctttgctgaagtagagcaatcggcatttaaccctgcaaacgtagttcctggtattagcttctctccagataagatgctacaaggtcgtttatttgcatacggtgatgcacaacgctaccgtttaggtgtaaaccaccaacatattcctgtgaacgctcctcgttgtcctgttcacagctatcaccgtgatggtgctatgcgtgttgatggtaactttggcagcacgctaggttatgaaccaaataatgaaggccaatgggctgagcaacctgattttgcagaaccagcattaaatcttgatggtgcagctgcgcattgggatcaccgtgaagatgaagattacttctcacaaccgggtgatttattccgcttaatgaccgcagagcaacaagctatattgtttgataatactgctcgtaacttaaatggcgtaccaaaagagattcaacttcgtcatttaagacattgttataaagctgaccctgcttatggtgaaggtatcggtaaactgcttgatattgatgtaagcgaatttaattga

SEQ ID NO: 43160 - protein, 482 aa, Vibrio fischeri
MSKKLTTAAGCPVAHNQNVQTAGKRGPQLLQDVWFLEKLAHFDREVIPERRMHAKGSGAYGTFTVTHDITKYTKAKLFSEIGKQTELFARFTTVAGERGAADAERDIRGFALKFYTEEGNWDLVGNNTPVFFLRDPLKFPDLNHAVKRDPRTNMRSAKNNWDFWTSLPEALHQVTIVMSDRGIPATYRHMHGFGSHTFSFINSDNERFWVKFHFKSQQGIKNLSDAEAAQVIGQDRESHQRDLLESIDNQDFPKWTLKVQIMPEADAATVPYNPFDLTKVWPHKDYPLIEVGEFELNRNPQNFFAEVEQSAFNPANVVPGISFSPDKMLQGRLFAYGDAQRYRLGVNHQHIPVNAPRCPVHSYHRDGAMRVDGNFGSTLGYEPNNEGQWAEQPDFAEPALNLDGAAAHWDHREDEDYFSQPGDLFRLMTAEQQAILFDNTARNLNGVPKEIQLRHLRHCYKADPAYGEGIGKLLDIDVSEFN

SEQ ID NO: 43161 - DNA, 1548 bp, Saccharomyces cerevisiae
  CDS (1)..(1548)
atgtcgaaattgggacaagaaaaaaatgaagtaaattactctgatgtaagagaggatagagttgtgacaaactccactggtaatccaatcaatgaaccatttgtcacccaacgtattggggaacatggccctttgcttttgcaagattataacttaattgattctttggctcatttcaacagggaaaatattcctcaaaggaatccacatgctcatggttctggtgccttcggctattttgaagtaaccgatgacattactgatatctgcgggtctgctatgtttagtaaaattgggaaaagaacgaaatgtctaacaagattttcgactgtgggtggtgataaaggtagtgccgacacggttcgtgatccaagggggtttgccaccaaattctacactgaagaaggtaatttagattgggtctacaataatacaccggtattctttatcagagacccttccaagttccctcactttatccacacacagaagagaaacccacaaaccaacctaagggatgctgacatgttttgggatttcctcaccactcctgaaaatcaggtggccattcatcaagtaatgatccttttttcagaccgtggtacccctgccaactaccgtagtatgcatggttattctggtcatacctataaatggtccaataaaaacggagattggcattatgtgcaagttcatatcaaaaccgatcaaggaataaagaatttgaccatagaagaggctaccaaaattgcgggatccaatccagattactgccagcaggatttatttgaggctattcagaatggaaactatccttcctggacagtttatattcaaacaatgaccgaacgcgatgccaaaaaattaccattttcagtctttgatttgactaaagtatggcctcaggggcaattccctttacggcgtgtgggtaagattgttttgaacgagaatccactgaacttcttcgcacaggtggaacaagctgccttcgcccccagtaccacggttccttaccaagaagcaagcgctgatccagtattacaggcccgtttgttttcatatgcggatgctcatagatacaggctaggtcctaacttccatcaaatacccgtaaactgtccatatgcatctaaatttttcaatcccgctatcagagatggaccgatgaatgttaacggcaacttcggctcagaacctacatatttggccaacgataaatcgtacacgtatatccaacaggacagacccattcaacaacaccaagaggtatggaatgggccagctatcccttatcattgggcaacatccccaggtgatgtagatttcgtgcaagcaagaaatctctaccgcgttttgggtaaacaacctggacagcaaaagaacttggcatataacatcggcattcatgtagaaggcgcctgtcctcaaatacagcagcgcgtttatgatatgtttgctcgtgttgataagggactatctgaggcaattaaaaaagtagctgaggcaaaacatgcttctgagctttcgagtaactccaaattttga

SEQ ID NO: 43162 - protein, 515 aa, Saccharomyces cerevisiae
MSKLGQEKNEVNYSDVREDRVVTNSTGNPINEPFVTQRIGEHGPLLLQDYNLIDSLAHFNRENIPQRNPHAHGSGAFGYFEVTDDITDICGSAMFSKIGKRTKCLTRFSTVGGDKGSADTVRDPRGFATKFYTEEGNLDWVYNNTPVFFIRDPSKFPHFIHTQKRNPQTNLRDADMFWDFLTTPENQVAIHQVMILFSDRGTPANYRSMHGYSGHTYKWSNKNGDWHYVQVHIKTDQGIKNLTIEEATKIAGSNPDYCQQDLFEAIQNGNYPSWTVYIQTMTERDAKKLPFSVFDLTKVWPQGQFPLRRVGKIVLNENPLNFFAQVEQAAFAPSTTVPYQEASADPVLQARLFSYADAHRYRLGPNFHQIPVNCPYASKFFNPAIRDGPMNVNGNFGSEPTYLANDKSYTYIQQDRPIQQHQEVWNGPAIPYHWATSPGDVDFVQARNLYRVLGKQPGQQKNLAYNIGIHVEGACPQIQQRVYDMFARVDKGLSEAIKKVAEAKHASELSSNSKF

SEQ ID NO: 43163 - DNA, 2187 bp, Ajellomyces capsulata
  CDS (1)..(2187)
atgcggtcgctcaagcttatactcgcctcggcgagtgttgtttctgcaacttgtccctacatgtcaggggagatgcctaacagtcagaatggacccctcgatcgccgccatgacactctatccgaccctacggaccagtttcttagcaagttttacattgacgatgaacagtcggtgctaacaacggacgtgggtggtcccatcgaggaccaacacagcttgaaggctggaaatagaggcccaactctacttgaggattttatcttccgccagaagattcaacactttgatcatgagagggttcctgagcgcgccgtccatgctcgaggagctggtgcccatggcgtattcacatcctataataactggtcgaatatcacagccgcatccttcttgaacgcggcaggaaagcagacaccagtattcgtgcggttttctacagtcgctggtagcagaggcagtgttgactctgctcgcgatatccacggatttgcgacccgtctgtataccgatgaaggcaattttgatatcgtcggaaacaacgttccagtcttcttcattcaggacgctattcaattccctgatttgattcacgctgtcaagccgcaaccagacagtgaaattccccaggctgcaactgcacatgatacggcatgggatttcttcagccagcagcccagctcattgcatgccctcttctgggcaatgtcaggacatggaatccctcgctcaatgcgtcatgttgatgggtggggcgtccataccttccgacttgtcaccgatgagggcaactcgaccttggtcaagtttcgctggaagaccctccaaggaagagcgggcctggtatgggaagaggcacaggctcttggcggaaaaaatcccgacttccatcgacaagacctctgggatgccattgaatctggaaggtaccctgagtgggagctgggctttcaattggtgaatgaagcagatcaatccaagtttgatttcgatctattagatcccaccaaaatcatcccagaagaacttgttcctttcaccccaatcggaaaaatggtcttgaaccgaaacccaaaaaattattttgccgaaactgagcagatcatgttccaaccaggtcatgtagttcgcggaatcgatttcacggatgaccctttgcttcagggccgcttgtactcctaccttgacactcaattgaatcgccatggaggtcccaacttcgagcaactgccgatcaacagaccccgcatcccattccataacaacaatcgcgacggtgctggacaaatgttcatccctctaaacacggccgcatatacacccaactcaatgagcaacggattccctcaacaagccaaccggacccataacagaggattcttcaccgcacctgggcgtatggtaaatggaccactagtgcgcgagctcagcccgagcttcaacgacgtctggtcccaaccgcgtctcttctacaactcactcacggtcttcgagaagcaattcctcgtcaacgccatgcgcttcgaaaactcccacgtgcggagtgaaaccgtgcgtaagaacgtcatcatccagctgaaccgcgtcgacaacgacctcgcccgccgcgtcgcgctagctatcggcgtcgaacccccatccccggacccaaccttctaccacaacaagacaaccgtccccatcggcaccttcggcacgaatctcctgcggctcgacgggctgaaaatcgccctcctgacaagagacgacggtagcttcacgatcgcggagcagctccgggccgcgtttaacagcgccaacaacaaagtagatatcgtcctagtgggctcatcgcttgatccccaacgcggcgtgaacatgacctattccggcgccgacggctcgatcttcgatgccgtgatcgtcgtcggcggcctgctcacgagcgcctcaacgcaatacccaagaggtcgcccgctcaggattattacggatgcatacgcgtatggaaagcccgttggcgccgtcggtgacggtagcaatgaagcccttcgtgacgtccttatggccgctggtggggatgcgtcgaatgggctggaccagcccggtgtgtatatttccaacgatgtgagtgaggcctacgttagaagtgtcttggacggattgacggcatatcggttcttgaataggttcccgttggataggtaa

SEQ ID NO: 43164 - protein, 728 aa, Ajellomyces capsulata
MRSLKLILASASVVSATCPYMSGEMPNSQNGPLDRRHDTLSDPTDQFLSKFYIDDEQSVLTTDVGGPIEDQHSLKAGNRGPTLLEDFIFRQKIQHFDHERVPERAVHARGAGAHGVFTSYNNWSNITAASFLNAAGKQTPVFVRFSTVAGSRGSVDSARDIHGFATRLYTDEGNFDIVGNNVPVFFIQDAIQFPDLIHAVKPQPDSEIPQAATAHDTAWDFFSQQPSSLHALFWAMSGHGIPRSMRHVDGWGVHTFRLVTDEGNSTLVKFRWKTLQGRAGLVWEEAQALGGKNPDFHRQDLWDAIESGRYPEWELGFQLVNEADQSKFDFDLLDPTKIIPEELVPFTPIGKMVLNRNPKNYFAETEQIMFQPGHVVRGIDFTDDPLLQGRLYSYLDTQLNRHGGPNFEQLPINRPRIPFHNNNRDGAGQMFIPLNTAAYTPNSMSNGFPQQANRTHNRGFFTAPGRMVNGPLVRELSPSFNDVWSQPRLFYNSLTVFEKQFLVNAMRFENSHVRSETVRKNVIIQLNRVDNDLARRVALAIGVEPPSPDPTFYHNKTTVPIGTFGTNLLRLDGLKIALLTRDDGSFTIAEQLRAAFNSANNKVDIVLVGSSLDPQRGVNMTYSGADGSIFDAVIVVGGLLTSASTQYPRGRPLRIITDAYAYGKPVGAVGDGSNEALRDVLMAAGGDASNGLDQPGVYISNDVSEAYVRSVLDGLTAYRFLNRFPLDR

SEQ ID NO: 43165 - DNA, 2187 bp, Aspergillus fumigatus
  CDS (1)..(2187)
atgcgtctcacgttcatccccagcctcattggcgttgccaatgcggtatgtccctatatgaccggcgagctcaaccgtcgtgatgagatatccgatggcgacgctgccgcagccacagaggaattcttgtcccagtattatctcaacgacaatgatgccttcatgacgtccgatgtgggcggccctatcgaagatcagaatagtctcagtgccggagagcgtggtcccaccctgctcgaagatttcattttccgtcaaaagatacagcgtttcgaccatgaacgggtccccgagcgtgcggtccatgcccgtggtgccggcgcccatggagtcttcacttcatatggcgacttctcgaacatcactgcggcttctttcctggccaaggaaggcaagcaaacccctgtatttgtccgcttctcgacggtcgcaggaagcagaggcagttcggatctggcccgtgatgttcacggttttgccactcgtttctataccgacgagggcaatttcgatatcgttggaaacaatatccctgtattcttcatccaggatgctatcctcttccccgatctgatccacgccgtcaagcccagaggtgacaacgagatccctcaggctgcgactgctcatgactcggcctgggacttcttcagccagcagccaagcacgatgcacacactgctctgggctatgtctgggcatggcattcctcgttctttccgacatgttgatgggttcggtgtgcataccttccgattcgtgacagatgacggtgcatccaagctcgtcaaatttcactggaagtctttgcagggcaaggccagcatggtctgggaagaggcccagcagacctctggcaagaatcctgacttcatgcgtcaggatttgcacgatgcaatcgaggctggacgctatccggagtgggaactcggtgttcaaatcatggatgaggaggaccaactgcggttcggttttgacctcttggaccccacaaagatcgtgccagaggaattcgtgcccatcaccaagttgggcaagatgcaactgaaccgcaaccctcgcaactatttcgctgagaccgaacaagttatgttccaacctggtcacattgtccgtggtgttgacttcactgaagaccctctcctgcaaggccgtctgttttcgtacctggacactcagctgaaccgtcacggtggccccaactttgaacaactccccatcaaccaacctcgcgttcccgtgcacaacaacaaccgcgatggagcaggccaaatgttcattcccctcaaccctcacgcgtactcgcccaagacctccgtcaacggttccccaaaacaagccaaccagaccgtcggcgatggcttcttcacagctcctggacgtaccaccagtggcaagcttgtccgtgcggtcagctcaagctttgaggatgtctggtctcagccacggctcttctacaattctttggttcctgccgagaagcagttcgttattgacgccatccgcttcgaaaatgcaaacgttaaatctcccgtggtaaagaacaacgtcatcattcagttgaaccgcatcgataacgaccttgcacgacgcgttgcgcgcgctattggtgtcgccgagcctgagcccgacccgaccttctatcacaacaacaagactgccgatgtcggcacttttggaaccaagctgaagaagcttgatggcctcaaggtcggcgtcctgggttctgtccagcacccgggctcggttgagggagcttccaccctccgcgaccgtctgaaggacgacggtgtcgacgtggttcttgtcgcagagcgtctggccgacggtgttgaccagacctattctacttcagatgcaatccaatttgacgctgtggtcgttgccgccggtgcagagagtctcttcgcggcatcctcgtttaccggtgggtccgccaactcagctagtggtgcaagctctctgtaccccaccggtcggcccctgcagattctcattgacggattccggttcggcaagactgttggggcgctgggaagcggcacagctgctctccgcaacgcggggattgcaacgtctcgggacggcgtgtatgtggctcagtcagtcactgatgactttgccaatgatcttaaggagggccttagaacttttaagtttttggaccggtttcccgtggatcactag

SEQ ID NO: 43166 - protein, 728 aa, Aspergillus fumigatus
MRLTFIPSLIGVANAVCPYMTGELNRRDEISDGDAAAATEEFLSQYYLNDNDAFMTSDVGGPIEDQNSLSAGERGPTLLEDFIFRQKIQRFDHERVPERAVHARGAGAHGVFTSYGDFSNITAASFLAKEGKQTPVFVRFSTVAGSRGSSDLARDVHGFATRFYTDEGNFDIVGNNIPVFFIQDAILFPDLIHAVKPRGDNEIPQAATAHDSAWDFFSQQPSTMHTLLWAMSGHGIPRSFRHVDGFGVHTFRFVTDDGASKLVKFHWKSLQGKASMVWEEAQQTSGKNPDFMRQDLHDAIEAGRYPEWELGVQIMDEEDQLRFGFDLLDPTKIVPEEFVPITKLGKMQLNRNPRNYFAETEQVMFQPGHIVRGVDFTEDPLLQGRLFSYLDTQLNRHGGPNFEQLPINQPRVPVHNNNRDGAGQMFIPLNPHAYSPKTSVNGSPKQANQTVGDGFFTAPGRTTSGKLVRAVSSSFEDVWSQPRLFYNSLVPAEKQFVIDAIRFENANVKSPVVKNNVIIQLNRIDNDLARRVARAIGVAEPEPDPTFYHNNKTADVGTFGTKLKKLDGLKVGVLGSVQHPGSVEGASTLRDRLKDDGVDVVLVAERLADGVDQTYSTSDAIQFDAVVVAAGAESLFAASSFTGGSANSASGASSLYPTGRPLQILIDGFRFGKTVGALGSGTAALRNAGIATSRDGVYVAQSVTDDFANDLKEGLRTFKFLDRFPVDH

SEQ ID NO: 43167 - DNA, 2166 bp, Emericella nidulans
  CDS (1)..(2166)
atgcgagctctcggcctggtcggccttgttggcgtcgccaatgccgtctgtccgtatatgacaggcgagctcggccgtcgcgataccaaccccgatgctaccgaggccactgaggaatttctgtccgagtactaccttgacgacacggactcgtacctgacgactgacgtcggcggcccaattgaggaccagcagagtctcaaggccggtgcgcgcgggtctaccctgctggaagactttatcttccgtcagaagatccagcgattcgaccacgagcgggtccccgagcgtgccgtccatgctcggggtgcaggtgcccacggtgtcttcacctcgtacggcgacttctccaacatcaccgccgcctccttcctctctgctgagggtaaggagacccccgtcttcgtccggttctcgaccgtcgccggcagtcgtggcagttctgacctcgcccgcgatgtccacggtttcgccacccgcttttacactgacgagggcaactttgatatcgtcggtaacaacattcccgtctttttcatccaggatgccatccagttccccgacctgatccacgccgtcaagcccaagggcgatcgtgaaatcccgcaggctgccacggcccatgacgccgcctgggatttcttcagccagcagccctcgactcttcacaccctgctctgggccatggccggtcacggtatcccgcgttcgttccgccacgtcgatgggttcggtgtgcacactttccggctcgtcacggaggatggctccaccaagctcgtcaagttccactggaagaccctgcaaggtttggcaagtatggtctgggaggaagctcagcaaatttctggcaagaaccccgactacatgcgccaggatctgttcgagtcgattgaggctggccggtaccctgagtgggagcttaacgtgcaaatcatggacgaggaggaccagttgcgctttggcttcgaccttttcgaccctaccaagattgtccctgaggaatacgtcccattgaccccgctgggcaagatgaccctcaaccgcaacccccgcaactactttgccgagactgagcaggtcatgttccaacccggccacgtcgtgcgtggtgttgacttcaccgaggatccccttcttcagggacgtcttttcagctaccttgacacccagctcaaccgcaatggtggcccgaactttgagcagttgcccatcaaccagccgcgcgttgctattcacaacaacaaccgtgacggtgctggccagatgttcattccgctgaaccccgatgcgtacagccccaacacgctgaagggatcaaccctcaaacaggccaaccagactgcgggtcgcggattctttactgctcctgaccgtactgccaacggcaatcttgtgcgtgccaagagctccaccttcgatgatgcttggtcgcagccccggcttttctggaactctcttcttcccgccgagaagcagttcgtggtcaacgccattcgcttcgaaaacgccaatgtgaagagcgatgtcgtgaagaacaacgtcatcgttcagcttaatcgaatctcgaacgaccttgccacccgcgttgccaaggccatcggtgttgatgctcccgagcccgacaacacttactaccacgacaacacgacctccaacatcggtgcgtttggccaccgactccagagcttggctggcctgaagattgccgtacttgcttctgttgacgcagaggaatccttcagcgcggctactgctctgaaggccgagctctccaacgacaacctggacgtcattgtcgtcgctgaacgcttctccaacggcgtgaaccagacctactctgcctctgacgccattcagtttgacgccgtcgttgttgcccctggagcggagaagctcttcggtgccaagtccgcggccaactccagctcaaccctctaccctgccggccgtcccctcgaaatcctcgttgatgctttccgcttcggtaagccagtcgctgctcttggcagcggctccactgctttcgacaacgctggtatcaacaccgccgtcgagggcgtgtacgttgccgatgccgtggacgagagctttgccaacaacctcgaggagggtctgaccgtgttcaagttcttggatcgctttgccctggactcggatgaatag

SEQ ID NO: 43168 - protein, 721 aa, Emericella nidulans
MRALGLVGLVGVANAVCPYMTGELGRRDTNPDATEATEEFLSEYYLDDTDSYLTTDVGGPIEDQQSLKAGARGSTLLEDFIFRQKIQRFDHERVPERAVHARGAGAHGVFTSYGDFSNITAASFLSAEGKETPVFVRFSTVAGSRGSSDLARDVHGFATRFYTDEGNFDIVGNNIPVFFIQDAIQFPDLIHAVKPKGDREIPQAATAHDAAWDFFSQQPSTLHTLLWAMAGHGIPRSFRHVDGFGVHTFRLVTEDGSTKLVKFHWKTLQGLASMVWEEAQQISGKNPDYMRQDLFESIEAGRYPEWELNVQIMDEEDQLRFGFDLFDPTKIVPEEYVPLTPLGKMTLNRNPRNYFAETEQVMFQPGHVVRGVDFTEDPLLQGRLFSYLDTQLNRNGGPNFEQLPINQPRVAIHNNNRDGAGQMFIPLNPDAYSPNTLKGSTLKQANQTAGRGFFTAPDRTANGNLVRAKSSTFDDAWSQPRLFWNSLLPAEKQFVVNAIRFENANVKSDVVKNNVIVQLNRISNDLATRVAKAIGVDAPEPDNTYYHDNTTSNIGAFGHRLQSLAGLKIAVLASVDAEESFSAATALKAELSNDNLDVIVVAERFSNGVNQTYSASDAIQFDAVVVAPGAEKLFGAKSAANSSSTLYPAGRPLEILVDAFRFGKPVAALGSGSTAFDNAGINTAVEGVYVADAVDESFANNLEEGLTVFKFLDRFALDSDE

SEQ ID NO: 43169 - DNA, 1479 bp, Oryza sativa
  CDS (1)..(1479)
atggatccctacaagcatcgggcgtccagcgggagcaattccaccttctggaccaccaactccggcgcccccgtctggaacaacaactccgccctcaccgtcggagagcgaggccctatcctccttgaggactatcatctgattgaaaagcttgcacagtttgacagggagcgtatccctgaacgtgtcgttcatgcaaggggagccagtgccaagggattttttgaggttactcatgatatttctcacctcacatgtgctgattttctccgtgctcctggtgttcagaccccagttattgttcggttctccacagtcgtgcatgagcgtggaagccctgagacattgagggatccacgtggttttgctgtcaagttttacactagagagggtaattttgatcttgttgggaacaatatgcctggcttttttatccgagatgggatgaaattccctgacatggtccatgctttcaagccaagtccaaagaccaatatgcaggagaactggagaatagttgatttcttttcacaccacccagagagcctgcacatgttctccttcctctttgacgatgtaggcatcccactcaactacaggcacatggagggttttggtgtcaacacctacaccctaatcaataaggatggaaagcctcaccttgtcaaattccactggaagcctacctgtggtgtcaaatgcctgttggatgatgaagctgtgactgttggcggcacctgccacagccatgccacgaaggacttgactgattctattgcagcagggaattacccagagtggaagctttacatccagactattgatcctgatcatgaggacagatttgacttcgatcctcttgatgtcaccaagacatggccagaggatatcatccccctgcagccagttggacggatggtcctgaacaaaaacattgataacttctttgcagaaaatgaacagcttgctttctgcccagcgataattgtccctggaatccattactctgatgataagctgctccagacaagaattttctcctatgctgatacccaaaggcaccgtcttggcccaaactatttgatgcttcctgtgaatgcaccaaaatgtgcataccacaacaaccaccacgatggctccatgaatttcatgcacagggatgaagaggttaactacttcccttcaaggtttgatgctgcacgtcatgctgagaaggtccctattcctcctcgtgttctaacaggctgtcgggaaaagtgtgtcattgacaaggagaacaatttccaacaggctggtgagagataccggtcatttgaccctgccaggcaagatcgttttctccagcggtgggttgatgctctctcagatcctcgtattacacatgaactccgtggcatctggatctcctactggtcgcagtgtgatgcgtcccttgggcagaagctggcttcacgtctcaacctgaaaccaaacatgtag

SEQ ID NO: 43170 - protein, 492 aa, Oryza sativa
MDPYKHRASSGSNSTFWTTNSGAPVWNNNSALTVGERGPILLEDYHLIEKLAQFDRERIPERVVHARGASAKGFFEVTHDISHLTCADFLRAPGVQTPVIVRFSTVVHERGSPETLRDPRGFAVKFYTREGNFDLVGNNMPGFFIRDGMKFPDMVHAFKPSPKTNMQENWRIVDFFSHHPESLHMFSFLFDDVGIPLNYRHMEGFGVNTYTLINKDGKPHLVKFHWKPTCGVKCLLDDEAVTVGGTCHSHATKDLTDSIAAGNYPEWKLYIQTIDPDHEDRFDFDPLDVTKTWPEDIIPLQPVGRMVLNKNIDNFFAENEQLAFCPAIIVPGIHYSDDKLLQTRIFSYADTQRHRLGPNYLMLPVNAPKCAYHNNHHDGSMNFMHRDEEVNYFPSRFDAARHAEKVPIPPRVLTGCREKCVIDKENNFQQAGERYRSFDPARQDRFLQRWVDALSDPRITHELRGIWISYWSQCDASLGQKLASRLNLKPNM

SEQ ID NO: 43171 - DNA, 2061 bp, Bacillus subtilis
  CDS (1)..(2061): transl_table=11
atgagtgatgaccaaaacaaacgtgtaaatgaacactcaaaggacgagcagcttgagcagtacaggaccgataacagcgggaagaaaatgacgacaaaccaaggcttgcgagtgtcagaggatgagcactcgttaaaagccggggttcgcggcccgacgctgatggaggattttcatttccgggagaaaatgacgcactttgaccatgagaggattccggagcgcgttgtgcatgcgcgcggatttggcgtgcatggcttttttcaggtttacgaaccaatgacggaatacacacgggccaaatttcttcaggacccttcggtgaagacaccggtatttgtccgtttttctacggttgcgggttctaaaggctccgcagacacggtgcgggatgccagaggctttgcgacaaaattttatactgaagaaggaaactatgaccttgtgggaaataacattccggtgtttttcattcaggacgcaatcaaatttccggatttggttcacgcgtttaagcctgagccacacaatgaaatgcctcaggctgcgactgctcacgatacattttgggattttgtcgccaataaccctgagtctgcccacatggtgatgtggacgatgtctgacagaggcatcccgcgcagctacagaatgatggaaggcttcggcgttcacacgttccgttttgtcaatgaacaaggaaaggcacgtttcgtgaaatttcactggaagccggtgctcggcgtgcattctctcgtatgggatgaagcgcaaaaaattgccgggaaagatccagatttccaccgccgtgacctgtgggaaacaattgaaaacggcggcaaggttgaatacgagctcggcgtgcagatgattgatgaggaagatgaattcaagtttgattttgatattcttgacccaactaagctgtggccggaagagcttgtgccggtgaagatcattggaaaaatgacgctgaaccgcaatcaggataatgtgtttgcggaaacagaacaagtcgcattccacccgggaaatgtcgtgccgggcatcgattttaccaatgacccgctattgcaggggcggcttttcccttatacggatacacagctcatccgtcttggcggcccgaacttccatgagattccgattaaccggccggtctgtccattccataacaaccaatacgacggctatcaccggatgacgatcaataagggacctgtcgcttatcataaaaactcactgcaaaacaatgatccgtcgcctgcgacagctgaagaaggcggctacgtccactatcaggaaaaagtcgagggcaaaaaaatccgccagcgaagcgacagcttcaacgattattactcacaggcgaagcttttctggaacagcatgtctcctgtggagaaacagcacatcatttctgctttctgcttcgaggtcgggaaggttaaaagcaaagacgtacagcggcaggtcgttgatgtcttcagcaatgtcgatgcagatttagcagaagaaatcgccaaaggagtaggcgtggcggcgcccgcaaagcgtaaagcatctaaagaaaatcttacttcgcctgcgttaagccaagcccgtacagtgaaaaccgcctcaacaaggaaagtcgctgtactcgccggaaacggatttcatgaaaaagagctgcaaacagtactggaagccttaaagcaagaaggaatcacagtggatatcatcagtcaaaatctggggtatatgacaagcggcagcggacagcagcttgaggccagcggcacgttcctgacggttgattctgttctgtatgatgccgtctatgccgcaggaggactggagttaaaagacaacaaacaagcgatggcgtttatcagagaagcttacaatcactacaaggcgatcggtgcggcaaatgaaggaattgaccttcttcaatcctctgtcgggacaacagaggggctaggcatcgtaacggctaaagatgaacctgactacaccgctttcagcaaggcatttatcgatgcggttgctgctcatcgccattgggatagacgaatttga

SEQ ID NO: 43172 - protein, 686 aa, Bacillus subtilis
MSDDQNKRVNEHSKDEQLEQYRTDNSGKKMTTNQGLRVSEDEHSLKAGVRGPTLMEDFHFREKMTHFDHERIPERVVHARGFGVHGFFQVYEPMTEYTRAKFLQDPSVKTPVFVRFSTVAGSKGSADTVRDARGFATKFYTEEGNYDLVGNNIPVFFIQDAIKFPDLVHAFKPEPHNEMPQAATAHDTFWDFVANNPESAHMVMWTMSDRGIPRSYRMMEGFGVHTFRFVNEQGKARFVKFHWKPVLGVHSLVWDEAQKIAGKDPDFHRRDLWETIENGGKVEYELGVQMIDEEDEFKFDFDILDPTKLWPEELVPVKIIGKMTLNRNQDNVFAETEQVAFHPGNVVPGIDFTNDPLLQGRLFPYTDTQLIRLGGPNFHEIPINRPVCPFHNNQYDGYHRMTINKGPVAYHKNSLQNNDPSPATAEEGGYVHYQEKVEGKKIRQRSDSFNDYYSQAKLFWNSMSPVEKQHIISAFCFEVGKVKSKDVQRQVVDVFSNVDADLAEEIAKGVGVAAPAKRKASKENLTSPALSQARTVKTASTRKVAVLAGNGFHEKELQTVLEALKQEGITVDIISQNLGYMTSGSGQQLEASGTFLTVDSVLYDAVYAAGGLELKDNKQAMAFIREAYNHYKAIGAANEGIDLLQSSVGTTEGLGIVTAKDEPDYTAFSKAFIDAVAAHRHWDRRI

SEQ ID NO: 43173 - DNA, 2136 bp, Pseudomonas putida
  CDS (1)..(2136): transl_table=11
atgcccagcaagaaaacggacgcgcccaagcagagtgaagccgctggcacccagaccccggaccgggccaataccaatgccaagttgcagagcctggaaaccttccgcagcgacgctaccggccaggccctgcgcaccaaccagggcgtgaagattgccgacaaccagaacagcctcaaggctggcgcacgagggccgtcgctgctcgaagacttcatcatgcgcgagaagatcacccacttcgaccatgagcgcatcccggagcgcatcgtgcatgcccgtggtaccggggcgcacggctactttcagagttatggcaaccatgcggatctgaccaaagccggtttcctgcaagatcccgacaagatcacaccggtgtttgtacgcttttccaccgtgcagggtccccgtggttcgggggataccgtgcgtgatgtgcgcggtttcgcggtcaagttctataccgacgaaggtaacttcgacctggtcggcaacaacatgccggtcttcttcatccaggatgccatcaagttccccgattttgtgcatgcggtcaaacccgagccgcataacgagattcctaccggtggctcggcccacgatacgttctgggatttcgtttcgctggtgccggagtcggcccacatggtgatgtgggccatgtccgaccgggctatcccgcgcagcttgcgcatgatggaaggctttggcgtgcataccttccgcctgatcaacgccgagggcgtggccagtttcgtcaagttccactggaagccgcgccagggcgtgcattcgctgctgtgggacgaggcgcagaaactggcgggcaaggacactgacttccagcgccgtgacttgtgggaggcgatcgaaaacggcgattacccggaatgggaactcggcgtgcagatcgtgccggaggccgacgagcacaagttcgacttcgacttgttggacccgaccaagatcatcccggaagaactggtgcccgtaacgcccttgggcaagatggtgctgaaccgtaacccggacaatttctttgccgaggtcgaacaggtggcgttctgcccaggccatatcgtgcctggaatcgactttaccaatgacccactgctacagggccggctgttctcgtacaccgatacccagatcagccgcctgggcgggccgaacttccaccagatcccgatcaaccgcccggtagcgcctaaccacaacaaccagcgtgatgccctgcaccagcacgtcgtgcataaggggcgggcgtcctacgagccaaactcgatcgacggtggttggccaaaggaaaccccggcagcggcgcaggacggtggtttcgagagctaccaggagcgtatcgatgcgcacaagattcgtcagcgcagcgagtcgttcggtgatcacttctcgcaagcccggctgttcttccagagcatgagcccgaccgaacagcagcacatcatcaaggcttacagcttcgagttgggcaaagtggagcgcgaacatatccgcgcccgggaagtgaatgaaattctcgccaatatcgatttgaagctggcggcggcagttgcagccaacctgggcctgcctgcgccgaaagcgggtacggtgcaggtgaagggcagccagctggcgcaatcaccggccttgagccagatgaaccacccaggttcggtgggtatcaaggggcgcaagattgccgtgctggtggccaatggcgtggacgctgcaagcgtggacaaactgatcaaggccctggaagcgcacagtgcccggccgatgctgttggggccgacctcggcgccggtaaaggcgacggatggcaagcaactgccggtggaggcatcgatggaggggatgccatcgatcatgttcgacgggattgtcgtgccatcaggtaaggcttcgacggatgccttggcagccagcgggctagccaaacacttcttgctggaaggctacaagcacctgaaggctatggtgttgaccaaggaactggcgaccggcctgggacttaaggaagacaagggcttgctgctggcggatgaccaaaaagccgtggatgcctttgtcaaagcggttgaggggcatcgggtgtgggagcgggaagctgctgcggaggctgtgccggcctaa

SEQ ID NO: 43174 - protein, 711 aa, Pseudomonas putida
MPSKKTDAPKQSEAAGTQTPDRANTNAKLQSLETFRSDATGQALRTNQGVKIADNQNSLKAGARGPSLLEDFIMREKITHFDHERIPERIVHARGTGAHGYFQSYGNHADLTKAGFLQDPDKITPVFVRFSTVQGPRGSGDTVRDVRGFAVKFYTDEGNFDLVGNNMPVFFIQDAIKFPDFVHAVKPEPHNEIPTGGSAHDTFWDFVSLVPESAHMVMWAMSDRAIPRSLRMMEGFGVHTFRLINAEGVASFVKFHWKPRQGVHSLLWDEAQKLAGKDTDFQRRDLWEAIENGDYPEWELGVQIVPEADEHKFDFDLLDPTKIIPEELVPVTPLGKMVLNRNPDNFFAEVEQVAFCPGHIVPGIDFTNDPLLQGRLFSYTDTQISRLGGPNFHQIPINRPVAPNHNNQRDALHQHVVHKGRASYEPNSIDGGWPKETPAAAQDGGFESYQERIDAHKIRQRSESFGDHFSQARLFFQSMSPTEQQHIIKAYSFELGKVEREHIRAREVNEILANIDLKLAAAVAANLGLPAPKAGTVQVKGSQLAQSPALSQMNHPGSVGIKGRKIAVLVANGVDAASVDKLIKALEAHSARPMLLGPTSAPVKATDGKQLPVEASMEGMPSIMFDGIVVPSGKASTDALAASGLAKHFLLEGYKHLKAMVLTKELATGLGLKEDKGLLLADDQKAVDAFVKAVEGHRVWEREAAAEAVPA

SEQ ID NO: 43175 - DNA, 2118 bp, Rhizobium meliloti
  CDS (1)..(2118): transl_table=11
atggccaagaaaccctctgcgccgaacaatacgaaaccggccaccattcatgaccagaaagcgacacgcggcaacggtggagaacttcaccagatcgccgaaggcgacacgcccgtcctgacgaccgcccagggcggccccgtcgccgacgaccagaacagcctgcgcgccggcgaacgcggccctacgctcatcgaggatttccacttccgcgagaagatcttccacttcgatcacgagcgcattcccgagcgtgtcgtgcacgcccgcggctacggggtgcatggcttcttcgagacctacgaatcgcttgcagcctacacccgggcggatctgttccagcgcccgggcgagcgaacccccgccttcgtgcgtttctcgacggtcgccggaagcaagggctccttcgacctcgcccgcgacgttcgcggtttcgcggtcaagatctacaccaaggagggcaattgggacctcgtcggcaacaacatcccggtcttcttcatccaggacgcaatcaagtttcccgacgtcatacattcggtaaagcccgaaccggaccgggagtttccccaggcgcagtccgcccacgacaatttctgggacttcatcagcctgacgccggaaagcatgcacatgatcatgtgggtcatgtcggaccgggcgatcccgcgctccttccggttcatggaaggcttcggcgtccatacgtttcgtttcgtcaatgccaaggacgagtccactttcgtcaaattccattggaagccgaagctcgggctgcagtcggtcgtgtggaacgaggccgtgaagatcaacggtgccgatcctgacttccaccggcgcgacatgtggcaagccatccagtccggcaacttcccggaatgggacctgcatgtgcagcttttcgatcaggacttcgccgacaagttcgatttcgacattctcgatccgaccaagatcatcccggaggaagtgctgccgacgaagcctgtgggccggctggtgctcgatcgcatgccggagaatttcttcgccgaaaccgagcaggtcgccttcatgacgcagaacgtgccgccgggcatcgacttcagcgacgatccattgctgcaggggcgcaacttctcctatctggacacgcagctgaagcggctcggcagcccgaacttcacccatctgccgatcaacgcgccgaaatgtcccttccagcactttcagcaggacggccacatggccatgcgcaaccccgtcgggcgcgtgaactaccagcccaattcctggggcgagggcccgcgcgagtcgcccatgaaaggcttccgccattttccttccgaggagcaggggcccaagctgcgcatccgcgccgagagctttgccgaccattacagccaggcccggcagttcttcatcagccagacgccgcccgagcagcgccacatcgccgacgccctgaccttcgaattgagcaaggtggagacgccggtgatccgcgagcggatggtcgcgcatcttctcaacatcgatgaaaccttggggaaaaaggtcggccacgccctcggcctggagacgatgccgaagccggcggatgcggccgttgccacccgccaggacctcgacccgtcgccggccctcagcatcatccagcgtgggccgaagcgtttcgagggccgcaagctcgggatattggcgacggacggcgcggacggcgcgcttctcgacgccttgatagcggcggtcgagaaggagaaggcggccttcgagctgatcgcgccgaaagtcggcggcttcaccgcctccgacggaaaacgcatcgccgcccaccagatgctcgacggcggcccgtcggtactttacgacgcggtggtcctgcttccttccgcagaggccgtcacggatctgatcgacgtcgccaccgcgcgcgatttcgtggccgacgccttcgcccattgcaaatatatcggctatgccggcgccgccgttccccttctcgaaagggccggcattgcggaactgctcgatgagggaacgatcgaactcaccgacgctgcgagtgcggcagccttcctcacggagatcggtaaactgcgcgtctggggaagagaaccctcggtcaagctgaaatag

SEQ ID NO: 43176 - protein, 705 aa, Rhizobium meliloti
MAKKPSAPNNTKPATIHDQKATRGNGGELHQIAEGDTPVLTTAQGGPVADDQNSLRAGERGPTLIEDFHFREKIFHFDHERIPERVVHARGYGVHGFFETYESLAAYTRADLFQRPGERTPAFVRFSTVAGSKGSFDLARDVRGFAVKIYTKEGNWDLVGNNIPVFFIQDAIKFPDVIHSVKPEPDREFPQAQSAHDNFWDFISLTPESMHMIMWVMSDRAIPRSFRFMEGFGVHTFRFVNAKDESTFVKFHWKPKLGLQSVVWNEAVKINGADPDFHRRDMWQAIQSGNFPEWDLHVQLFDQDFADKFDFDILDPTKIIPEEVLPTKPVGRLVLDRMPENFFAETEQVAFMTQNVPPGIDFSDDPLLQGRNFSYLDTQLKRLGSPNFTHLPINAPKCPFQHFQQDGHMAMRNPVGRVNYQPNSWGEGPRESPMKGFRHFPSEEQGPKLRIRAESFADHYSQARQFFISQTPPEQRHIADALTFELSKVETPVIRERMVAHLLNIDETLGKKVGHALGLETMPKPADAAVATRQDLDPSPALSIIQRGPKRFEGRKLGILATDGADGALLDALIAAVEKEKAAFELIAPKVGGFTASDGKRIAAHQMLDGGPSVLYDAVVLLPSAEAVTDLIDVATARDFVADAFAHCKYIGYAGAAVPLLERAGIAELLDEGTIELTDAASAAAFLTEIGKLRVWGREPSVKLK

SEQ ID NO: 43177 - DNA, 2193 bp, Aspergillus niger
  CDS (1)..(2193)
atgcgtcatttctggcttttgccagctgttgctggtatcgctggggctcaatgcccctacctgtcgggtgaaatgagtttcacccaggagcaggacaatgctggcgataccattgaggtcacggagcagcccattgacaacaccctgtatgtcaatgacaccggtagctacatgactaccgactttggcactccgatctccgaccagaccagtctcaaggccgggccccgtggtcctaccctgttggaggactttatcttccgtcagaagcttcagcggttcgaccatgagcgtgtccccgagcgcgtcgtccacgcccgtggtgccggtgcatatggtactttcaaatcctacgccgactggtcgaacgtcacggctgccgatttcttgagtgccaacgataaggagacccctatgttctgtcgcttctctactgtggtcggtttccgtggtagtgttgacactgcgcgtgatgttcacggtcacgcttgtcggttctacactgacgagggtaactatgacatcgtcggtatcaatttcgcccccttcttcatccaggacgccatccagttccccgatcttgtccacgccatcaagcccatgcccaacaatgagatcccccaggccgctactgcacacacttccgcttgggacttcttcagccagcagagcactgccctccacagtgccttgtggctgatgtctggtaacggtattcctcgttctttccgccacatgaacggctacggagtccacagcttccgcttcgtcgctgccaatggcacttccaaggtggtgcgaacaccttggaagtcccaacagggtgttgccagtctggtgtgggatgaagctcaggccgctgctggtaagaacagtgactaccaccgccaggatctgtacaatgcgatgcccaatggccactacccgaaatacgagctccaagcccagatcatggatgaggctgacatgcttcgtttcggcttcgaccttctggatcccaccaagttggtccccgaggaggttgtcccttacactcctctcggaatgatggagctcaatgccaaccccaccaactactttgctgaagttgaacaggctggtttccaacccggtcacgtcgttcctggcattgacttcaccgacgaccccctgctgcaaggccgtctcttctcctacctcgacactcagttgacccgtcacggcggtcccaacttcgagcaaatccccgtcaaccgtcctcgcaagcccgttcacaacaacaaccgtgacggcttcggccagcagcagatccccaccaacaactgggcctacacccccaacagcatgagcaacggttaccccatgcaagccaaccagacccagggtcatggtttcttcaccgcgccctaccgctacgcttccggccatctcgtccgccagaccagcccgaccttcaatgaccactggtcccagcccgccatgttctggaactctctgatccccgctgagcagcagatggttgtcaacgccattgtctttgagaactccaaggttaacagcccccacgttcggaagaacgttgtcaaccagctgaacatggtcaacaacaacctcgccgtccgtgtcgctcgtggtcttggtctcgatgagccctcccccaacccgacttactacacctccaacaagacctccaacgtcggtaccttcggcaagcccctcctcagcatcgagggtctgcaggtcggcttcctggcctcgaactcccaccccgaatccatcaagcagggccaggccatggccgcgcagttctctgccgctggcgtcgacctgaacattgtcaccgaggcctacgccgatggtgtcaacaccacctacgccctgtctgatgccatcgactttgacgccctcatcatcgccgatggtgtgcagagcctcttcgcctcccccgctctcgctaaccagatgaactctaccgccacctctactctctaccctcctgccagacctttccagatcctggtcgattctttcaggtacggtaagcccgtggctgctgtcggcagtggcagtgttgcgctcaagaacgctggtattgattcctcccgctctggtgtgtacactggctcgagcgagacgacggagaagatcgccaaggaggtcttggagggactctacactttccgttttgtggaccggtttgcgctggatgagtaa

SEQ ID NO: 43178 - protein, 730 aa, Aspergillus niger
MRHFWLLPAVAGIAGAQCPYLSGEMSFTQEQDNAGDTIEVTEQPIDNTLYVNDTGSYMTTDFGTPISDQTSLKAGPRGPTLLEDFIFRQKLQRFDHERVPERVVHARGAGAYGTFKSYADWSNVTAADFLSANDKETPMFCRFSTVVGFRGSVDTARDVHGHACRFYTDEGNYDIVGINFAPFFIQDAIQFPDLVHAIKPMPNNEIPQAATAHTSAWDFFSQQSTALHSALWLMSGNGIPRSFRHMNGYGVHSFRFVAANGTSKVVRTPWKSQQGVASLVWDEAQAAAGKNSDYHRQDLYNAMPNGHYPKYELQAQIMDEADMLRFGFDLLDPTKLVPEEVVPYTPLGMMELNANPTNYFAEVEQAGFQPGHVVPGIDFTDDPLLQGRLFSYLDTQLTRHGGPNFEQIPVNRPRKPVHNNNRDGFGQQQIPTNNWAYTPNSMSNGYPMQANQTQGHGFFTAPYRYASGHLVRQTSPTFNDHWSQPAMFWNSLIPAEQQMVVNAIVFENSKVNSPHVRKNVVNQLNMVNNNLAVRVARGLGLDEPSPNPTYYTSNKTSNVGTFGKPLLSIEGLQVGFLASNSHPESIKQGQAMAAQFSAAGVDLNIVTEAYADGVNTTYALSDAIDFDALIIADGVQSLFASPALANQMNSTATSTLYPPARPFQILVDSFRYGKPVAAVGSGSVALKNAGIDSSRSGVYTGSSETTEKIAKEVLEGLYTFRFVDRFALDE

SEQ ID NO: 43179 - DNA, 1644 bp, Bacillus subtilis
  CDS (1)..(1644): transl_table=11
ttgaaagatgatcatcaaaacaagcagcaccaatcaaatgcccaagggagcgaggaagcgttttctcataagacatccgggaaaaacgagtcagaggataccttaacgaataggcaggggcatcctgttactgacaaccagaatgtgagaaccgtcgggaatagagggcctacaacacttgagaactatgattttctcgaaaagatcagccacttcgaccgggaacgcatcccagagcgggttgttcatgccaggggagcaggtgcacatggatattttgaagcgtacggaagcttcggagacgaaccgatttcaacatacacaagggccaagctctttcaggaaaaaggcaagaaaacaccggcatttgtccgtttttcaactgtgaatcatggaaaacactcgcctgaaacattgagagacccgcgcggttttgctgtaaagctatatacagaagacggaaactgggatttggtcggaaacaacctgaaaatcttttttatccgcgacccgctgaaatttccggatcttgtacacgcatttcagcctgatccagtgacaaacatccaggatggtgaacgtatcttcgatttcatttctcaatctcctgaagcgacacacatgatcaccttcttgttttcgccttggggcattccggccaactaccggcaaatgcagggttcaggcgtacatgcctataaatgggtgaatgaggagggcaaggccgttctcgtgaaataccattttgaaccgaagcagggcatccgcaacctgacacagaaggaagcagaagagattcaagggaaaaactttaaccatgccacacaggatctatatgacgcgattgaaaatggcgattatccagagtgggaagtatatgctcaaatcatgagcgatgatgagcatcctgaactggactttgatcctcttgatccaacaaaactgtggtataaagacgatttcccatggaaaccgatcggcaaattggttctgaacaaaaatccggaaaactaccatgcggaagtggagcaagcttcatttggaacgggagtgcttgtcgacgggcttgatttttcagacgacaaattgctccaggggcgtacgtttgcctactctgatacgcagcgctaccgtgtaggcgcaaattacctgcagcttccgatcaactcgccgaaaaagcatgtcgccaccaaccaggaaggcgggcaaatgcaatatcgggtcgatagagcagaaggacaaaacccgcacgtcaactacgagccatccattatgggcgggctgaaggaagcgaagcaagacggaaaagaccatacgccgcatgtcgaaggtgatgtaaagcgtgaagcgattgacagaacaaacaacttcggacaggctggagaaacgtaccggagatttactgaatttgagcggaacgaattgattacgaatttggtgaatacgctttctacgtgccgaaaagaaattcaggatcaaatgattgagaatttcacaaaagctgatcctgactacggaaaacgcgtagcagaagggctaaaaaaggtctccgaaaacaacagcaacgggccgatcggcacaactgaaacggaacaggctgcaaagcaggctgaacaggagagtcatccgtctgatccgtattaa

SEQ ID NO: 43180 - protein, 547 aa, Bacillus subtilis
MKDDHQNKQHQSNAQGSEEAFSHKTSGKNESEDTLTNRQGHPVTDNQNVRTVGNRGPTTLENYDFLEKISHFDRERIPERVVHARGAGAHGYFEAYGSFGDEPISTYTRAKLFQEKGKKTPAFVRFSTVNHGKHSPETLRDPRGFAVKLYTEDGNWDLVGNNLKIFFIRDPLKFPDLVHAFQPDPVTNIQDGERIFDFISQSPEATHMITFLFSPWGIPANYRQMQGSGVHAYKWVNEEGKAVLVKYHFEPKQGIRNLTQKEAEEIQGKNFNHATQDLYDAIENGDYPEWEVYAQIMSDDEHPELDFDPLDPTKLWYKDDFPWKPIGKLVLNKNPENYHAEVEQASFGTGVLVDGLDFSDDKLLQGRTFAYSDTQRYRVGANYLQLPINSPKKHVATNQEGGQMQYRVDRAEGQNPHVNYEPSIMGGLKEAKQDGKDHTPHVEGDVKREAIDRTNNFGQAGETYRRFTEFERNELITNLVNTLSTCRKEIQDQMIENFTKADPDYGKRVAEGLKKVSENNSNGPIGTTETEQAAKQAEQESHPSDPY

SEQ ID NO: 43181 - DNA, 25 bp, Artificial sequence
  (1)..(25): primer
atgtcgcaacataacgaaaagaacc

SEQ ID NO: 43182 - DNA, 27 bp, Artificial sequence
  (1)..(27): primer
ttaggcaggaattttgtcaatcttagg

SEQ ID NO: 43183 - protein, 587 aa, Artificial sequence
  Variant (3)..(4): xaa in position 3 to 4 is any amino acid
  Variant (6)..(6): xaa in position 6 is any amino acid
  Variant (9)..(16): xaa in position 9 to 16 is any amino acid
  Variant (17)..(17): xaa in position 17 is any or no amino acid
  Variant (19)..(19): xaa in position 19 is any amino acid
  Variant (20)..(30): xaa in position 20 to 30 is any or no amino acid
  Variant (33)..(33): xaa in position 33 is any amino acid
  Variant (36)..(36): xaa in position 36 is any amino acid
  Variant (38)..(40): xaa in position 38 to 40 is any amino acid
  Variant (41)..(41): xaa in position 41 is any or no amino acid
  Variant (45)..(46): xaa in position 45 to 46 is any amino acid
  Variant (48)..(49): xaa in position 48 to 49 is any amino acid
  Variant (56)..(56): xaa in position 56 is any amino acid
  Variant (62)..(63): xaa in position 62 to 63 is any amino acid
  Variant (65)..(65): xaa in position 65 is any amino acid
  Variant (67)..(67): xaa in position 67 is any amino acid
  Variant (69)..(73): xaa in position 69 to 73 is any amino acid
  Variant (74)..(78): xaa in position 74 to 78 is any or no amino acid
  Variant (81)..(82): xaa in position 81 to 82 is any amino acid
  Variant (84)..(84): xaa in position 84 is any amino acid
  Variant (86)..(90): xaa in position 86 to 90 is any amino acid
  Variant (91)..(91): xaa in position 91 is any or no amino acid
  Variant (93)..(93): xaa in position 93 is any amino acid
  Variant (94)..(94): xaa in position 94 is any or no amino acid
  Variant (96)..(96): xaa in position 96 is any amino acid
  Variant (98)..(99): xaa in position 98 to 99 is any amino acid
  Variant (105)..(108): xaa in position 105 to 108 is any amino acid
  Variant (111)..(111): xaa in position 111 is any amino acid
  Variant (113)..(114): xaa in position 113 to 114 is any amino acid
  Variant (117)..(117): xaa in position 117 is any amino acid
  Variant (122)..(122): xaa in position 122 is any amino acid
  Variant (127)..(127): xaa in position 127 is any amino acid
  Variant (138)..(138): xaa in position 138 is any amino acid
  Variant (144)..(144): xaa in position 144 is any or no amino acid
  Variant (146)..(146): xaa in position 146 is any amino acid
  Variant (152)..(152): xaa in position 152 is any amino acid
  Variant (153)..(168): xaa in position 153 to 168 is any or no amino acid
  Variant (172)..(172): xaa in position 172 is any amino acid
  Variant (174)..(175): xaa in position 174 to 175 is any amino acid
  Variant (177)..(179): xaa in position 177 to 179 is any amino acid
  Variant (181)..(186): xaa in position 181 to 186 is any amino acid
  Variant (187)..(203): xaa in position 187 to 203 is any or no amino acid
  Variant (206)..(206): xaa in position 206 is any amino acid
  Variant (208)..(209): xaa in position 208 to 209 is any amino acid
  Variant (213)..(213): xaa in position 213 is any amino acid
  Variant (215)..(221): xaa in position 215 to 221 is any amino acid
  Variant (222)..(223): xaa in position 222 to 223 is any or no amino acid
  Variant (225)..(225): xaa in position 225 is any amino acid
  Variant (227)..(227): xaa in position 227 is any or no amino acid
  Variant (230)..(231): xaa in position 230 to 231 is any amino acid
  Variant (234)..(234): xaa in position 234 is any amino acid
  Variant (236)..(236): xaa in position 236 is any amino acid
  Variant (238)..(238): xaa in position 238 is any amino acid
  Variant (239)..(240): xaa in position 239 to 240 is any or no amino acid
  Variant (242)..(243): xaa in position 242 to 243 is any amino acid
  Variant (246)..(247): xaa in position 246 to 247 is any amino acid
  Variant (250)..(251): xaa in position 250 to 251 is any amino acid
  Variant (252)..(252): xaa in position 252 is any or no amino acid
  Variant (254)..(256): xaa in position 254 to 256 is any amino acid
  Variant (263)..(266): xaa in position 263 to 266 is any amino acid
  Variant (269)..(270): xaa in position 269 to 270 is any amino acid
  Variant (272)..(274): xaa in position 272 to 274 is any amino acid
  Variant (275)..(275): xaa in position 275 is any or no amino acid
  Variant (278)..(279): xaa in position 278 to 279 is any amino acid
  Variant (281)..(281): xaa in position 281 is any amino acid
  Variant (283)..(290): xaa in position 283 to 290 is any amino acid
  Variant (294)..(294): xaa in position 294 is any amino acid
  Variant (297)..(298): xaa in position 297 to 298 is any amino acid
  Variant (300)..(300): xaa in position 300 is any amino acid
  Variant (303)..(303): xaa in position 303 is any amino acid
  Variant (305)..(305): xaa in position 305 is any amino acid
  Variant (307)..(307): xaa in position 307 is any amino acid
  Variant (310)..(310): xaa in position 310 is any amino acid
  Variant (312)..(320): xaa in position 312 to 320 is any amino acid
  Variant (321)..(322): xaa in position 321 to 322 is any or no amino acid
  Variant (324)..(325): xaa in position 324 to 325 is any amino acid
  Variant (326)..(326): xaa in position 326 is any or no amino acid
  Variant (328)..(328): xaa in position 328 is any amino acid
  Variant (331)..(332): xaa in position 331 to 332 is any amino acid
  Variant (334)..(335): xaa in position 334 to 335 is any amino acid
  Variant (336)..(337): xaa in position 336 to 337 is any or no amino acid
  Variant (340)..(341): xaa in position 340 to 341 is any amino acid
  Variant (344)..(344): xaa in position 344 is any amino acid
  Variant (346)..(346): xaa in position 346 is any amino acid
  Variant (351)..(352): xaa in position 351 to 352 is any amino acid
  Variant (353)..(353): xaa in position 353 is any or no amino acid
  Variant (357)..(357): xaa in position 357 is any amino acid
  Variant (359)..(359): xaa in position 359 is any amino acid
  Variant (362)..(362): xaa in position 362 is any amino acid
  Variant (365)..(365): xaa in position 365 is any amino acid
  Variant (367)..(367): xaa in position 367 is any amino acid
  Variant (368)..(369): xaa in position 368 to 369 is any or no amino acid
  Variant (375)..(376): xaa in position 375 to 376 is any amino acid
  Variant (378)..(378): xaa in position 378 is any amino acid
  Variant (380)..(380): xaa in position 380 is any amino acid
  Variant (384)..(385): xaa in position 384 to 385 is any or no amino acid
  Variant (391)..(391): xaa in position 391 is any amino acid
  Variant (393)..(396): xaa in position 393 to 396 is any amino acid
  Variant (400)..(400): xaa in position 400 is any amino acid
  Variant (401)..(402): xaa in position 401 to 402 is any or no amino acid
  Variant (405)..(406): xaa in position 405 to 406 is any amino acid
  Variant (411)..(411): xaa in position 411 is any amino acid
  Variant (413)..(421): xaa in position 413 to 421 is any amino acid
  Variant (422)..(430): xaa in position 422 to 430 is any or no amino acid
  Variant (433)..(439): xaa in position 433 to 439 is any amino acid
  Variant (440)..(455): xaa in position 440 to 455 is any or no amino acid
  Variant (457)..(457): xaa in position 457 is any or no amino acid
  Variant (459)..(470): xaa in position 459 to 470 is any amino acid
  Variant (471)..(513): xaa in position 471 to 513 is any or no amino acid
  Variant (515)..(515): xaa in position 515 is any amino acid
  Variant (517)..(520): xaa in position 517 to 520 is any amino acid
  Variant (522)..(539): xaa in position 522 to 539 is any amino acid
  Variant (540)..(552): xaa in position 540 to 552 is any or no amino acid
  Variant (554)..(562): xaa in position 554 to 562 is any amino acid
  Variant (563)..(579): xaa in position 563 to 579 is any or no amino acid
  Variant (581)..(582): xaa in position 581 to 582 is any amino acid
  Variant (584)..(586): xaa in position 584 to 586 is any amino acid
TTXXGXPVXXXXXXXXXGXXXXXXXXXXXXGPXLLXDXXXXEKLXXFXXERIPERXVHARGXXAXGXFXXXXXXXXXXISXXTXAXXXXXXGXXTXVXXRFSTVXXXXGSXDXXRDXRGFAXKFYTXEGNWDLVGNNXPVFFIXDXIKFPDXXXXXXXXXXXXXXXXXIHAXKXXPXXXIXXXXXXXXXXXXXXXXXXXXXXXDFXSXXPESXHXXXXXXXXXDXGXIPXXYRXMXGXXXGXXTYXXINXXXGXXXYVKFHWXXXXGVXXLXXXXEAXXVXGXXXXXXXXDLYXAIXXGXYPXWXLXIQXMXXXXXXXXXXXFXXXDXTKXXPXXXXPLXXVGXMXLNRNXXXNFFXEXEQXAFXPXXXIVPGIXXSXDXLLQXXRLFSYXDXXXXRLGXXXNYXXLPVNXPXXXXXXXXXXXXXXXXXXDGXXXXXXXXXXXXXXXXXXXXXXXYXPXXXXXXXXXXXXXXXXXXXXXXXXXXXXXXXXXXXXXXXXXXXXXXXXXXXXXXXFXQXXXXYXXXXXXXXXXXXXXXXXXXXXXXXXXXXXXXLXXXXXXXXXXXXXXXXXXXXXXXXXXGXXVXXXL

SEQ ID NO: 43184 - protein, 39 aa, Artificial sequence
  Variant (3)..(3): xaa in position 3 is any amino acid
  Variant (4)..(4): xaa in position 4 is any or no amino acid
  Variant (6)..(6): xaa in position 6 is any amino acid
  Variant (7)..(7): xaa in position 7 is any or no amino acid
  Variant (9)..(12): xaa in position 9 to 12 is any amino acid
  Variant (13)..(13): xaa in position 13 is Asp, Glu or Gln
  Variant (14)..(14): xaa in position 14 is any amino acid
  Variant (15)..(15): xaa in position 15 is Phe, Ile, Leu, Met or Val
  Variant (16)..(17): xaa in position 16 to 17 is any amino acid
  Variant (19)..(19): xaa in position 19 is any amino acid
  Variant (20)..(20): xaa in position 20 is His or Arg
  Variant (22)..(23): xaa in position 22 to 23 is any amino acid
  Variant (27)..(28): xaa in position 27 to 28 is any amino acid
  Variant (31)..(31): xaa in position 31 is any amino acid
  Variant (33)..(33): xaa in position 33 is any amino acid
  Variant (34)..(34): xaa in position 34 is Ala, Gly, Ser or Thr
  Variant (36)..(36): xaa in position 36 is any amino acid
  Variant (38)..(38): xaa in position 38 is any amino acid
  Variant (39)..(39): xaa in position 39 is Phe or Leu
GPXXLXXDXXXXXXXXXFXXEXXPERXXHAXGXXAXGXX

SEQ ID NO: 43185 - protein, 51 aa, Artificial sequence
  Variant (2)..(3): xaa in position 2 to 3 is any or no amino acid
  Variant (5)..(5): xaa in position 5 is Gln, Ser or Thr
  Variant (7)..(10): xaa in position 7 to 10 is any amino acid
  Variant (12)..(13): xaa in position 12 to 13 is any amino acid
  Variant (14)..(14): xaa in position 14 is Asp or Glu
  Variant (15)..(16): xaa in position 15 to 16 is any amino acid
  Variant (19)..(19): xaa in position 19 is any amino acid
  Variant (20)..(20): xaa in position 20 is His or Arg
  Variant (23)..(23): xaa in position 23 is Ala or Ser
  Variant (24)..(24): xaa in position 24 is any amino acid
  Variant (25)..(25): xaa in position 25 is Lys or Arg
  Variant (26)..(26): xaa in position 26 is any amino acid
  Variant (29)..(29): xaa in position 29 is any amino acid
  Variant (30)..(30): xaa in position 30 is Ala, Asp, Glu, Gly or Gln
  Variant (32)..(33): xaa in position 32 to 33 is any amino acid
  Variant (35)..(37): xaa in position 35 to 37 is any amino acid
  Variant (40)..(40): xaa in position 40 is any amino acid
  Variant (42)..(42): xaa in position 42 is any amino acid
  Variant (45)..(46): xaa in position 45 to 46 is any amino acid
  Variant (48)..(48): xaa in position 48 is Ala, Gly, Pro or Ser
  Variant (49)..(50): xaa in position 49 to 50 is any amino acid
FXXSXVXXXXGXXXXXRDXXGFXXXXYTXXGXXDXXXNNXPXFFXXDXXXF

SEQ ID NO: 43186 - protein, 39 aa, Artificial sequence
  Variant (2)..(3): xaa in position 2 to 3 is any amino acid
  Variant (4)..(4): xaa in position 4 is Ala, Ser or Thr
  Variant (5)..(8): xaa in position 5 to 8 is any amino acid
  Variant (9)..(9): xaa in position 9 is Ala, Asp, Asn, Ser or Thr
  Variant (10)..(17): xaa in position 10 to 17 is any amino acid
  Variant (19)..(19): xaa in position 19 is any amino acid
  Variant (21)..(25): xaa in position 21 to 25 is any amino acid
  Variant (27)..(34): xaa in position 27 to 34 is any amino acid
  Variant (35)..(38): xaa in position 35 to 38 is any or no amino acid
GXXXXXXXXXXXXXXXXKXHXXXXXGXXXXXXXXXXXXA

SEQ ID NO: 43187 - protein, 19 aa, Artificial sequence
  Variant (3)..(3): xaa in position 3 is any amino acid
  Variant (4)..(4): xaa in position 4 is Asp, Glu or Asn
  Variant (5)..(5): xaa in position 5 is Ala, Asn or Ser
  Variant (7)..(11): xaa in position 7 to 11 is any amino acid
  Variant (13)..(13): xaa in position 13 is any amino acid
  Variant (15)..(18): xaa in position 15 to 18 is any amino acid
DLXXXIXXXXXPXWXXXXQ

SEQ ID NO: 43188 - protein, 36 aa, Artificial sequence
  Variant (2)..(2): xaa in position 2 is any amino acid
  Variant (4)..(11): xaa in position 4 to 11 is any amino acid
  Variant (13)..(15): xaa in position 13 to 15 is any amino acid
  Variant (16)..(16): xaa in position 16 is Phe, Ile, Leu or Val
  Variant (18)..(18): xaa in position 18 is any amino acid
  Variant (19)..(20): xaa in position 19 to 20 is any or no amino acid
  Variant (22)..(26): xaa in position 22 to 26 is any amino acid
  Variant (27)..(28): xaa in position 27 to 28 is any or no amino acid
  Variant (30)..(30): xaa in position 30 is any amino acid
  Variant (32)..(32): xaa in position 32 is any amino acid
  Variant (33)..(33): xaa in position 33 is Asp, Glu or Gln
  Variant (34)..(34): xaa in position 34 is any amino acid
DXTXXXXXXXXPXXXXGXXXLXXXXXXXNXFXXXEQ

SEQ ID NO: 43189 - protein, 39 aa, Artificial sequence
  Variant (2)..(2): xaa in position 2 is Ile, Leu or Val
  Variant (3)..(4): xaa in position 3 to 4 is any amino acid
  Variant (5)..(5): xaa in position 5 is Ser or Thr
  Variant (6)..(6): xaa in position 6 is any amino acid
  Variant (8)..(8): xaa in position 8 is any amino acid
  Variant (9)..(9): xaa in position 9 is any or no amino acid
  Variant (11)..(11): xaa in position 11 is any or no amino acid
  Variant (13)..(13): xaa in position 13 is any amino acid
  Variant (15)..(15): xaa in position 15 is any amino acid
  Variant (17)..(17): xaa in position 17 is Ala, Asn or Ser
  Variant (19)..(19): xaa in position 19 is any amino acid
  Variant (21)..(21): xaa in position 21 is Ala, Gln, Ser or Thr
  Variant (22)..(24): xaa in position 22 to 24 is any amino acid
  Variant (26)..(26): xaa in position 26 is any amino acid
  Variant (28)..(28): xaa in position 28 is any amino acid
  Variant (29)..(29): xaa in position 29 is any or no amino acid
  Variant (31)..(33): xaa in position 31 to 33 is any amino acid
  Variant (34)..(34): xaa in position 34 is Ile or Leu
  Variant (36)..(36): xaa in position 36 is any amino acid
  Variant (38)..(38): xaa in position 38 is any amino acid
  Variant (39)..(39): xaa in position 39 is Ala, Pro or Ser
GXXXXXDXXLXQXRXFXYXDXXXXRXGXXNXXXXPXNXX

SEQ ID NO: 43190 - DNA, 785 bp, Escherichia coli K12; identical to SEQ ID NO: 3693
  CDS (86)..(781)

SEQ ID NO: 43191 - protein, 231 aa, Escherichia coli K12; identical to SEQ ID NO: 3694

SEQ ID NO: 43192 - DNA, 1005 bp, Nostoc sp. PCC 7120; identical to SEQ ID NO: 3695
  CDS (1)..(1005)

SEQ ID NO: 43193 - protein, 334 aa, Nostoc sp. PCC 7120; identical to SEQ ID NO: 3696

SEQ ID NO: 43194 - DNA, 642 bp, Salmonella enterica subsp. enterica serovar Typhi; identical to SEQ ID NO: 3697
  CDS (1)..(642)

SEQ ID NO: 43195 - protein, 213 aa, Salmonella enterica subsp. enterica serovar Typhi; identical to SEQ ID NO: 3698

SEQ ID NO: 43196 - DNA, 942 bp, Nostoc sp. PCC 7120; identical to SEQ ID NO: 3699
  CDS (1)..(942)

SEQ ID NO: 43197 - protein, 313 aa, Nostoc sp. PCC 7120; identical to SEQ ID NO: 3700

SEQ ID NO: 43198 - DNA, 642 bp, Yersinia pestis; identical to SEQ ID NO: 3701
  CDS (1)..(642)

SEQ ID NO: 43199 - protein, 213 aa, Yersinia pestis; identical to SEQ ID NO: 3702

SEQ ID NO: 43200 - DNA, 1668 bp, Thermotoga maritima; identical to SEQ ID NO: 3703
  CDS (1)..(1668)

SEQ ID NO: 43201 - protein, 555 aa, Thermotoga maritima; identical to SEQ ID NO: 3704

SEQ ID NO: 43202 - DNA, 2056 bp, Arabidopsis thaliana (mouse-ear cress); identical to SEQ ID NO: 3705
  CDS (1)..(2025)

SEQ ID NO: 43203 - protein, 674 aa, Arabidopsis thaliana (mouse-ear cress); identical to SEQ ID NO: 3706

SEQ ID NO: 43204 - DNA, 624 bp, Staphylococcus aureus; identical to SEQ ID NO: 3707
  CDS (1)..(624)

SEQ ID NO: 43205 - protein, 207 aa, Staphylococcus aureus; identical to SEQ ID NO: 3708

SEQ ID NO: 43206 - DNA, 639 bp, Streptococcus pneumoniae; identical to SEQ ID NO: 3709
  CDS (1)..(639)

SEQ ID NO: 43207 - protein, 212 aa, Streptococcus pneumoniae; identical to SEQ ID NO: 3710

SEQ ID NO: 43208 - DNA, 642 bp, Mycoplasma genitalium; identical to SEQ ID NO: 3711
  CDS (1)..(642): transl_table=4

SEQ ID NO: 43209 - protein, 213 aa, Mycoplasma genitalium; identical to SEQ ID NO: 3712

SEQ ID NO: 43210 - DNA, 636 bp, Bacillus halodurans; identical to SEQ ID NO: 3713
  CDS (1)..(636)

SEQ ID NO: 43211 - protein, 211 aa, Bacillus halodurans; identical to SEQ ID NO: 3714

SEQ ID NO: 43212 - DNA, 1668 bp, Treponema pallidum subsp. pallidum (syphilis spirochete); identical to SEQ ID NO: 3715
  CDS (1)..(1668)

SEQ ID NO: 43213 - protein, 555 aa, Treponema pallidum subsp. pallidum (syphilis spirochete); identical to SEQ ID NO: 3716

SEQ ID NO: 43214 - DNA, 669 bp, Chlamydophila pneumoniae, Chlamydia pneumoniae; identical to SEQ ID NO: 3717
  CDS (1)..(669)

SEQ ID NO: 43215 - protein, 222 aa, Chlamydophila pneumoniae, Chlamydia pneumoniae; identical to SEQ ID NO: 3718

SEQ ID NO: 43216 - DNA, 621 bp, Lactococcus lactis subsp. lactis; identical to SEQ ID NO: 3719
  CDS (1)..(621)

SEQ ID NO: 43217 - protein, 206 aa, Lactococcus lactis subsp. lactis; identical to SEQ ID NO: 3720

SEQ ID NO: 43218 - DNA, 633 bp, Deinococcus radiodurans; identical to SEQ ID NO: 3721
  CDS (1)..(633)

SEQ ID NO: 43219 - protein, 210 aa, Deinococcus radiodurans; identical to SEQ ID NO: 3722

SEQ ID NO: 43220 - DNA, 1932 bp, Arabidopsis thaliana (mouse-ear cress); identical to SEQ ID NO: 3723
  CDS (1)..(1932)

SEQ ID NO: 43221 - protein, 643 aa, Arabidopsis thaliana (mouse-ear cress); identical to SEQ ID NO: 3724

SEQ ID NO: 43222 - DNA, 636 bp, Bacillus subtilis; identical to SEQ ID NO: 3725
  CDS (1)..(636)

SEQ ID NO: 43223 - protein, 211 aa, Bacillus subtilis; identical to SEQ ID NO: 3726

SEQ ID NO: 43224 - DNA, 624 bp, Borrelia burgdorferi (Lyme disease spirochete); identical to SEQ ID NO: 3727
  CDS (1)..(624)

SEQ ID NO: 43225 - protein, 207 aa, Borrelia burgdorferi (Lyme disease spirochete); identical to SEQ ID NO: 3728

SEQ ID NO: 43226 - DNA, 624 bp, Ureaplasma urealyticum; identical to SEQ ID NO: 3729
  CDS (1)..(624): transl_table=4

SEQ ID NO: 43227 - protein, 207 aa, Ureaplasma urealyticum; identical to SEQ ID NO: 3730

SEQ ID NO: 43228 - DNA, 642 bp, Haemophilus influenzae; identical to SEQ ID NO: 3731
  CDS (1)..(642)

SEQ ID NO: 43229 - protein, 213 aa, Haemophilus influenzae; identical to SEQ ID NO: 3732

SEQ ID NO: 43230 - DNA, 1470 bp, Spinacia oleracea (spinach); identical to SEQ ID NO: 3733
  CDS (49)..(1257)

SEQ ID NO: 43231 - protein, 402 aa, Spinacia oleracea (spinach); identical to SEQ ID NO: 3734

SEQ ID NO: 43232 - DNA, 1533 bp, Triticum sp. (wheat); identical to SEQ ID NO: 3735
  CDS (65)..(1279)

SEQ ID NO: 43233 - protein, 404 aa, Triticum sp. (wheat); identical to SEQ ID NO: 3736

SEQ ID NO: 43234 - DNA, 1240 bp, Arabidopsis thaliana (mouse-ear cress); identical to SEQ ID NO: 3737
  CDS (1)..(1188)

SEQ ID NO: 43235 - protein, 395 aa, Arabidopsis thaliana (mouse-ear cress); identical to SEQ ID NO: 3738

SEQ ID NO: 43236 - DNA, 2077 bp, Saccharomyces cerevisiae; identical to SEQ ID NO: 3739
  CDS (482)..(1987)

SEQ ID NO: 43237 - protein, 501 aa, Saccharomyces cerevisiae; identical to SEQ ID NO: 3740

SEQ ID NO: 43238 - DNA, 642 bp, Mycoplasma pneumoniae; identical to SEQ ID NO: 3741
  CDS (1)..(642): transl_table=4

SEQ ID NO: 43239 - protein, 213 aa, Mycoplasma pneumoniae; identical to SEQ ID NO: 3742

SEQ ID NO: 43240 - DNA, 1245 bp, Chlamydomonas reinhardtii; identical to SEQ ID NO: 3743
  CDS (28)..(1155)

SEQ ID NO: 43241 - protein, 375 aa, Chlamydomonas reinhardtii; identical to SEQ ID NO: 3744

SEQ ID NO: 43242 - DNA, 1520 bp, Mesembryanthemum crystallinum (common ice plant); identical to SEQ ID NO: 3745
  CDS (127)..(1320)

SEQ ID NO: 43243 - protein, 397 aa, Mesembryanthemum crystallinum (common ice plant); identical to SEQ ID NO: 3746

SEQ ID NO: 43244 - DNA, 690 bp, Caenorhabditis elegans; identical to SEQ ID NO: 3747
  CDS (1)..(690)

SEQ ID NO: 43245 - protein, 229 aa, Caenorhabditis elegans; identical to SEQ ID NO: 3748

SEQ ID NO: 43246 - DNA, 1668 bp, Caenorhabditis elegans; identical to SEQ ID NO: 3749
  CDS (1)..(1668)

SEQ ID NO: 43247 - protein, 555 aa, Caenorhabditis elegans; identical to SEQ ID NO: 3750

SEQ ID NO: 43248 - DNA, 1365 bp, Schizosaccharomyces pombe; identical to SEQ ID NO: 3751
  CDS (1)..(1365)

SEQ ID NO: 43249 - protein, 454 aa, Schizosaccharomyces pombe; identical to SEQ ID NO: 3752

SEQ ID NO: 43250 - DNA, 1647 bp, Homo sapiens; identical to SEQ ID NO: 3753
  CDS (1)..(1647)

SEQ ID NO: 43251 - protein, 548 aa, Homo sapiens; identical to SEQ ID NO: 3754

SEQ ID NO: 43252 - DNA, 738 bp, Debaryomyces hansenii; identical to SEQ ID NO: 3755
  CDS (1)..(738)

SEQ ID NO: 43253 - protein, 245 aa, Debaryomyces hansenii; identical to SEQ ID NO: 3756

SEQ ID NO: 43254 - DNA, 1521 bp, Debaryomyces hansenii; identical to SEQ ID NO: 3757
  CDS (1)..(1521)

SEQ ID NO: 43255 - protein, 506 aa, Debaryomyces hansenii; identical to SEQ ID NO: 3758

SEQ ID NO: 43256 - DNA, 1353 bp, Yarrowia lipolytica; identical to SEQ ID NO: 3759
  CDS (1)..(1353)

SEQ ID NO: 43257 - protein, 450 aa, Yarrowia lipolytica; identical to SEQ ID NO: 3760

SEQ ID NO: 43258 - DNA, 1380 bp, Kluyveromyces lactis; identical to SEQ ID NO: 3761
  CDS (1)..(1380)

SEQ ID NO: 43259 - protein, 459 aa, Kluyveromyces lactis; identical to SEQ ID NO: 3762

SEQ ID NO: 43260 - DNA, 642 bp, Erwinia carotovora subsp; identical to SEQ ID NO: 3763
  CDS (1)..(642)

SEQ ID NO: 43261 - protein, 213 aa, Erwinia carotovora subsp; identical to SEQ ID NO: 3764

SEQ ID NO: 43262 - DNA, 627 bp, Mesoplasma florum L1; identical to SEQ ID NO: 3765
  CDS (1)..(627)

SEQ ID NO: 43263 - protein, 208 aa, Mesoplasma florum L1; identical to SEQ ID NO: 3766

SEQ ID NO: 43264 - DNA, 1431 bp, Candida glabrata; identical to SEQ ID NO: 3767
  CDS (1)..(1431)

SEQ ID NO: 43265 - protein, 476 aa, Candida glabrata; identical to SEQ ID NO: 3768

SEQ ID NO: 43266 - DNA, 639 bp, Bacillus thuringiensis serovar konkukian str; identical to SEQ ID NO: 3769
  CDS (1)..(639)

SEQ ID NO: 43267 - protein, 212 aa, Bacillus thuringiensis serovar konkukian str; identical to SEQ ID NO: 3770

SEQ ID NO: 43268 - DNA, 834 bp, Homo sapiens; identical to SEQ ID NO: 3771
  CDS (1)..(834)

SEQ ID NO: 43269 - protein, 277 aa, Homo sapiens [sequence omitted]

SEQ ID NO: 43270 - DNA, 1965 bp, Oryza sativa; identical to SEQ ID NO: 3773
  CDS (257)..(1726)

SEQ ID NO: 43271 - protein, 489 aa, Oryza sativa; identical to SEQ ID NO: 3774

SEQ ID NO: 43272 - DNA, 747 bp, Photobacterium profundum; identical to SEQ ID NO: 3775
  CDS (1)..(747)

SEQ ID NO: 43273 - protein, 248 aa, Photobacterium profundum; identical to SEQ ID NO: 3776

SEQ ID NO: 43274 - DNA, 621 bp, Bdellovibrio bacteriovorus; identical to SEQ ID NO: 3777
  CDS (1)..(621)

SEQ ID NO: 43275 - protein, 206 aa, Bdellovibrio bacteriovorus; identical to SEQ ID NO: 3778

SEQ ID NO: 43276 - DNA, 624 bp, Bdellovibrio bacteriovorus; identical to SEQ ID NO: 3779
  CDS (1)..(624)

SEQ ID NO: 43277 - protein, 207 aa, Bdellovibrio bacteriovorus; identical to SEQ ID NO: 3780

SEQ ID NO: 43278 - DNA, 618 bp, Mycoplasma mycoides; identical to SEQ ID NO: 3781
  CDS (1)..(618)

SEQ ID NO: 43279 - protein, 205 aa, Mycoplasma mycoides; identical to SEQ ID NO: 3782

SEQ ID NO: 43280 - DNA, 2638 bp, Oryza sativa; identical to SEQ ID NO: 3783
  CDS (248)..(2206)

SEQ ID NO: 43281 - protein, 652 aa, Oryza sativa; identical to SEQ ID NO: 3784

SEQ ID NO: 43282 - DNA, 1494 bp, Oryza sativa; identical to SEQ ID NO: 3785
  CDS (20)..(1231)

SEQ ID NO: 43283 - protein, 403 aa, Oryza sativa; identical to SEQ ID NO: 3786

SEQ ID NO: 43284 - DNA, 1824 bp, Homo sapiens; identical to SEQ ID NO: 3787
  CDS (45)..(1232)

SEQ ID NO: 43285 - protein, 395 aa, Homo sapiens [sequence omitted]

SEQ ID NO: 43286 - DNA, 630 bp, Listeria monocytogenes; identical to SEQ ID NO: 3789
  CDS (1)..(630)

SEQ ID NO: 43287 - protein, 209 aa, Listeria monocytogenes; identical to SEQ ID NO: 3790

SEQ ID NO: 43288 - DNA, 636 bp, Thermus thermophilus; identical to SEQ ID NO: 3791
  CDS (1)..(636)

SEQ ID NO: 43289 - protein, 211 aa, Thermus thermophilus; identical to SEQ ID NO: 3792

SEQ ID NO: 43290 - DNA, 1653 bp, Treponema denticola; identical to SEQ ID NO: 3793
  CDS (1)..(1653)

SEQ ID NO: 43291 - protein, 550 aa, Treponema denticola; identical to SEQ ID NO: 3794

SEQ ID NO: 43292 - DNA, 636 bp, Lactobacillus johnsonii; identical to SEQ ID NO: 3795
  CDS (1)..(636)

SEQ ID NO: 43293 - protein, 211 aa, Lactobacillus johnsonii; identical to SEQ ID NO: 3796

SEQ ID NO: 43294 - DNA, 1497 bp, Ashbya gossypii; identical to SEQ ID NO: 3797
  CDS (1)..(1497)

SEQ ID NO: 43295 - protein, 498 aa, Ashbya gossypii; identical to SEQ ID NO: 3798

SEQ ID NO: 43296 - DNA, 651 bp, Vibrio vulnificus; identical to SEQ ID NO: 3799
  CDS (1)..(651)

SEQ ID NO: 43297 - protein, 216 aa, Vibrio vulnificus; identical to SEQ ID NO: 3800

SEQ ID NO: 43298 - DNA, 630 bp, Porphyromonas gingivalis; identical to SEQ ID NO: 3801
  CDS (1)..(630)

SEQ ID NO: 43299 - protein, 209 aa, Porphyromonas gingivalis; identical to SEQ ID NO: 3802

SEQ ID NO: 43300 - DNA, 642 bp, Photorhabdus luminescens; identical to SEQ ID NO: 3803
  CDS (1)..(642)

SEQ ID NO: 43301 - protein, 213 aa, Photorhabdus luminescens; identical to SEQ ID NO: 3804

SEQ ID NO: 43302 - DNA, 645 bp, Mycoplasma gallisepticum; identical to SEQ ID NO: 3805
  CDS (1)..(645): transl_table=4

SEQ ID NO: 43303 - protein, 214 aa, Mycoplasma gallisepticum; identical to SEQ ID NO: 3806

SEQ ID NO: 43304 - DNA, 930 bp, Gloeobacter violaceus; identical to SEQ ID NO: 3807
  CDS (1)..(930)

SEQ ID NO: 43305 - protein, 309 aa, Gloeobacter violaceus; identical to SEQ ID NO: 3808

SEQ ID NO: 43306 - DNA, 996 bp, Gloeobacter violaceus; identical to SEQ ID NO: 3809
  CDS (1)..(996)

SEQ ID NO: 43307 - protein, 331 aa, Gloeobacter violaceus; identical to SEQ ID NO: 3810

SEQ ID NO: 43308 - DNA, 1038 bp, Gloeobacter violaceus; identical to SEQ ID NO: 3811
  CDS (1)..(1038)

SEQ ID NO: 43309 - protein, 345 aa, Gloeobacter violaceus; identical to SEQ ID NO: 3812

SEQ ID NO: 43310 - DNA, 615 bp, Chromobacterium violaceum; identical to SEQ ID NO: 3813
  CDS (1)..(615)

SEQ ID NO: 43311 - protein, 204 aa, Chromobacterium violaceum; identical to SEQ ID NO: 3814

SEQ ID NO: 43312 - DNA, 2049 bp, Giardia lamblia ATCC 50803; identical to SEQ ID NO: 3815
  CDS (1)..(2049)

SEQ ID NO: 43313 - protein, 682 aa, Giardia lamblia ATCC 50803; identical to SEQ ID NO: 3816

SEQ ID NO: 43314 - DNA, 1425 bp, Neurospora crassa; identical to SEQ ID NO: 3817
  CDS (1)..(1425)

SEQ ID NO: 43315 - protein, 474 aa, Neurospora crassa; identical to SEQ ID NO: 3818

SEQ ID NO: 43316 - DNA, 612 bp, Synechococcus sp; identical to SEQ ID NO: 3819
  CDS (1)..(612)

SEQ ID NO: 43317 - protein, 203 aa, Synechococcus sp; identical to SEQ ID NO: 3820

SEQ ID NO: 43318 - DNA, 654 bp, Haemophilus ducreyi; identical to SEQ ID NO: 3821
  CDS (1)..(654)

SEQ ID NO: 43319 - protein, 217 aa, Haemophilus ducreyi; identical to SEQ ID NO: 3822

SEQ ID NO: 43320 - DNA, 1609 bp, Chlorarachnion sp; identical to SEQ ID NO: 3823
  CDS (10)..(1464)

SEQ ID NO: 43321 - protein, 484 aa, Chlorarachnion sp; identical to SEQ ID NO: 3824

SEQ ID NO: 43322 - DNA, 630 bp, Enterococcus faecalis; identical to SEQ ID NO: 3825
  CDS (1)..(630)

SEQ ID NO: 43323 - protein, 209 aa, Enterococcus faecalis; identical to SEQ ID NO: 3826

SEQ ID NO: 43324 - DNA, 648 bp, Coxiella burnetii; identical to SEQ ID NO: 3827
  CDS (1)..(648)

SEQ ID NO: 43325 - protein, 215 aa, Coxiella burnetii; identical to SEQ ID NO: 3828

SEQ ID NO: 43326 - DNA, 1659 bp, Clostridium tetani; identical to SEQ ID NO: 3829
  CDS (1)..(1659)

SEQ ID NO: 43327 - protein, 552 aa, Clostridium tetani; identical to SEQ ID NO: 3830

SEQ ID NO: 43328 - DNA, 1674 bp, Bacteroides thetaiotaomicron; identical to SEQ ID NO: 3831
  CDS (1)..(1674)

SEQ ID NO: 43329 - protein, 557 aa, Bacteroides thetaiotaomicron; identical to SEQ ID NO: 3832

SEQ ID NO: 43330 - DNA, 618 bp, Bacteroides thetaiotaomicron; identical to SEQ ID NO: 3833
  CDS (1)..(618)

SEQ ID NO: 43331 - protein, 205 aa, Bacteroides thetaiotaomicron; identical to SEQ ID NO: 3834

SEQ ID NO: 43332 - DNA, 630 bp, Streptococcus agalactiae; identical to SEQ ID NO: 3835
  CDS (1)..(630)

SEQ ID NO: 43333 - protein, 209 aa, Streptococcus agalactiae; identical to SEQ ID NO: 3836

SEQ ID NO: 43334 - DNA, 1524 bp, Galdieria sulphuraria; identical to SEQ ID NO: 3837
  CDS (77)..(1423)

SEQ ID NO: 43335 - protein, 448 aa, Galdieria sulphuraria; identical to SEQ ID NO: 3838

SEQ ID NO: 43336 - DNA, 1005 bp, Synechococcus vulcanus; identical to SEQ ID NO: 3839
  CDS (1)..(1005)

SEQ ID NO: 43337 - protein, 334 aa, Synechococcus vulcanus; identical to SEQ ID NO: 3840

SEQ ID NO: 43338 - DNA, 1831 bp, Arabidopsis thaliana; identical to SEQ ID NO: 3841
  CDS (116)..(1525)

SEQ ID NO: 43339 - protein, 469 aa, Arabidopsis thaliana; identical to SEQ ID NO: 3842

SEQ ID NO: 43340 - DNA, 1875 bp, Homo sapiens; identical to SEQ ID NO: 3843
  CDS (14)..(1273)

SEQ ID NO: 43341 - protein, 419 aa, Homo sapiens; identical to SEQ ID NO: 3844

SEQ ID NO: 43342 - DNA, 1644 bp, Thermoanaerobacter tengcongensis; identical to SEQ ID NO: 3845
  CDS (1)..(1644)

SEQ ID NO: 43343 - protein, 547 aa, Thermoanaerobacter tengcongensis; identical to SEQ ID NO: 3846

SEQ ID NO: 43344 - DNA, 1665 bp, Clostridium perfringens; identical to SEQ ID NO: 3847
  CDS (1)..(1665)

SEQ ID NO: 43345 - protein, 554 aa, Clostridium perfringens; identical to SEQ ID NO: 3848

SEQ ID NO: 43346 - DNA, 1258 bp, Odontella sinensis; identical to SEQ ID NO: 3849
  CDS (23)..(1213)

SEQ ID NO: 43347 - protein, 396 aa, Odontella sinensis; identical to SEQ ID NO: 3850

SEQ ID NO: 43348 - DNA, 606 bp, Homo sapiens; identical to SEQ ID NO: 3851
  CDS (1)..(606)

SEQ ID NO: 43349 - protein, 201 aa, Homo sapiens [sequence omitted]

SEQ ID NO: 43350 - DNA, 1299 bp, Vaucheria litorea; identical to SEQ ID NO: 3853
  CDS (8)..(1225)

SEQ ID NO: 43351 - protein, 405 aa, Vaucheria litorea; identical to SEQ ID NO: 3854

SEQ ID NO: 43352 - DNA, 1711 bp, Cryptosporidium parvum; identical to SEQ ID NO: 3855
  CDS (290)..(1549)

SEQ ID NO: 43353 - protein, 419 aa, Cryptosporidium parvum; identical to SEQ ID NO: 3856

SEQ ID NO: 43354 - DNA, 1492 bp, Arabidopsis thaliana; identical to SEQ ID NO: 3857
  CDS (1)..(1461)

SEQ ID NO: 43355 - protein, 486 aa, Arabidopsis thaliana; identical to SEQ ID NO: 3858

SEQ ID NO: 43356 - DNA, 1480 bp, Dictyostelium discoideum; identical to SEQ ID NO: 3859
  CDS (1)..(1479)

SEQ ID NO: 43357 - protein, 492 aa, Dictyostelium discoideum; identical to SEQ ID NO: 3860

SEQ ID NO: 43358 - DNA, 1545 bp, Synechococcus sp; identical to SEQ ID NO: 3861
  CDS (267)..(1268)

SEQ ID NO: 43359 - protein, 333 aa, Synechococcus sp; identical to SEQ ID NO: 3862

SEQ ID NO: 43360 - DNA, 1452 bp, Arabidopsis thaliana; identical to SEQ ID NO: 3863
  CDS (1)..(1452)

SEQ ID NO: 43361 - protein, 483 aa, Arabidopsis thaliana; identical to SEQ ID NO: 3864

SEQ ID NO: 43362 - DNA, 1398 bp, Arabidopsis thaliana; identical to SEQ ID NO: 3865
  CDS (1)..(1398)

SEQ ID NO: 43363 - protein, 465 aa, Arabidopsis thaliana; identical to SEQ ID NO: 3866

SEQ ID NO: 43364 - DNA, 1856 bp, Drosophila melanogaster; identical to SEQ ID NO: 3867
  CDS (77)..(1762)

SEQ ID NO: 43365 - protein, 561 aa, Drosophila melanogaster; identical to SEQ ID NO: 3868

SEQ ID NO: 43366 - DNA, 1869 bp, Synechocystis sp; identical to SEQ ID NO: 3869
  CDS (233)..(1231)

SEQ ID NO: 43367 - protein, 332 aa, Synechocystis sp; identical to SEQ ID NO: 3870

SEQ ID NO: 43368 - DNA, 834 bp, Mus musculus; identical to SEQ ID NO: 3871
  CDS (1)..(834)

SEQ ID NO: 43369 - protein, 277 aa, Mus musculus; identical to SEQ ID NO: 3872

SEQ ID NO: 43370 - DNA, 1200 bp, Homo sapiens; identical to SEQ ID NO: 3873
  CDS (180)..(965)

SEQ ID NO: 43371 - protein, 261 aa, Homo sapiens; identical to SEQ ID NO: 3874

SEQ ID NO: 43372 - DNA, 822 bp, Drosophila melanogaster; identical to SEQ ID NO: 3875
  CDS (40)..(822)

SEQ ID NO: 43373 - protein, 260 aa, Drosophila melanogaster; identical to SEQ ID NO: 3876

SEQ ID NO: 43374 - DNA, 1823 bp, Mus musculus; identical to SEQ ID NO: 3877
  CDS (6)..(1652)

SEQ ID NO: 43375 - protein, 548 aa, Mus musculus; identical to SEQ ID NO: 3878

SEQ ID NO: 43376 - DNA, 627 bp, Clostridium perfringens; identical to SEQ ID NO: 3879
  CDS (1)..(627)

SEQ ID NO: 43377 - protein, 208 aa, Clostridium perfringens; identical to SEQ ID NO: 3880

SEQ ID NO: 43378 - DNA, 630 bp, Clostridium tetani; identical to SEQ ID NO: 3881
  CDS (1)..(630)

SEQ ID NO: 43379 - protein, 209 aa, Clostridium tetani; identical to SEQ ID NO: 3882

SEQ ID NO: 43380 - DNA, 678 bp, Halobacterium sp; identical to SEQ ID NO: 3883
  CDS (1)..(678)

SEQ ID NO: 43381 - protein, 225 aa, Halobacterium sp; identical to SEQ ID NO: 3884

SEQ ID NO: 43382 - DNA, 630 bp, Lactobacillus plantarum; identical to SEQ ID NO: 3885
  CDS (1)..(630)

SEQ ID NO: 43383 - protein, 209 aa, Lactobacillus plantarum; identical to SEQ ID NO: 3886

SEQ ID NO: 43384 - DNA, 633 bp, Oceanobacillus iheyensis; identical to SEQ ID NO: 3887
  CDS (1)..(633)

SEQ ID NO: 43385 - protein, 210 aa, Oceanobacillus iheyensis; identical to SEQ ID NO: 3888

SEQ ID NO: 43386 - DNA, 651 bp, Pasteurella multocida; identical to SEQ ID NO: 3889
  CDS (1)..(651)

SEQ ID NO: 43387 - protein, 216 aa, Pasteurella multocida; identical to SEQ ID NO: 3890

SEQ ID NO: 43388 - DNA, 639 bp, Shewanella oneidensis; identical to SEQ ID NO: 3891
  CDS (1)..(639)

SEQ ID NO: 43389 - protein, 212 aa, Shewanella oneidensis; identical to SEQ ID NO: 3892

SEQ ID NO: 43390 - DNA, 624 bp, Staphylococcus epidermidis; identical to SEQ ID NO: 3893
  CDS (1)..(624)

SEQ ID NO: 43391 - protein, 207 aa, Staphylococcus epidermidis; identical to SEQ ID NO: 3894

SEQ ID NO: 43392 - DNA, 627 bp, Streptococcus pyogenes; identical to SEQ ID NO: 3895
  CDS (1)..(627)

SEQ ID NO: 43393 - protein, 208 aa, Streptococcus pyogenes; identical to SEQ ID NO: 3896

SEQ ID NO: 43394 - DNA, 642 bp, Vibrio cholerae; identical to SEQ ID NO: 3897
  CDS (1)..(642)

SEQ ID NO: 43395 - protein, 213 aa, Vibrio cholerae; identical to SEQ ID NO: 3898

SEQ ID NO: 43396 - DNA, 642 bp, Vibrio parahaemolyticus; identical to SEQ ID NO: 3899
  CDS (1)..(642)

SEQ ID NO: 43397 - protein, 213 aa, Vibrio parahaemolyticus; identical to SEQ ID NO: 3900

SEQ ID NO: 43398 - DNA, 816 bp, Xenopus laevis; identical to SEQ ID NO: 3901
  CDS (1)..(816)

SEQ ID NO: 43399 - protein, 271 aa, Xenopus laevis; identical to SEQ ID NO: 3902

SEQ ID NO: 43400 - DNA, 21 bp, Artificial sequence
  (1)..(21): primer
atggcgcttcgtcgccccctt

SEQ ID NO: 43401 - DNA, 27 bp, Artificial sequence
  (1)..(27): primer
ttattcaaagaactgacttattttcgc

SEQ ID NO: 43402 - protein, 242 aa, Artificial sequence; identical to SEQ ID NO: 20857
  Variant (5)..(5): xaa in position 5 is any amino acid
  Variant (7)..(7): xaa in position 7 is any amino acid
  Variant (15)..(18): xaa in position 15 to 18 is any amino acid
  Variant (20)..(26): xaa in position 20 to 26 is any amino acid
  Variant (27)..(51): xaa in position 27 to 51 is any or no amino acid
  Variant (54)..(55): xaa in position 54 to 55 is any amino acid
  Variant (57)..(57): xaa in position 57 is any amino acid
  Variant (60)..(68): xaa in position 60 to 68 is any amino acid
  Variant (69)..(76): xaa in position 69 to 76 is any or no amino acid
  Variant (79)..(79): xaa in position 79 is any amino acid
  Variant (81)..(81): xaa in position 81 is any amino acid
  Variant (83)..(83): xaa in position 83 is any amino acid
  Variant (85)..(86): xaa in position 85 to 86 is any amino acid
  Variant (89)..(91): xaa in position 89 to 91 is any amino acid
  Variant (93)..(94): xaa in position 93 to 94 is any amino acid
  Variant (96)..(97): xaa in position 96 to 97 is any amino acid
  Variant (99)..(100): xaa in position 99 to 100 is any amino acid
  Variant (102)..(103): xaa in position 102 to 103 is any amino acid
  Variant (105)..(105): xaa in position 105 is any amino acid
  Variant (107)..(114): xaa in position 107 to 114 is any amino acid
  Variant (115)..(121): xaa in position 115 to 121 is any or no amino acid
  Variant (123)..(123): xaa in position 123 is any amino acid
  Variant (124)..(126): xaa in position 124 to 126 is any or no amino acid
  Variant (134)..(140): xaa in position 134 to 140 is any amino acid
  Variant (141)..(143): xaa in position 141 to 143 is any or no amino acid
  Variant (145)..(151): xaa in position 145 to 151 is any amino acid
  Variant (155)..(167): xaa in position 155 to 167 is any or no amino acid
  Variant (169)..(171): xaa in position 169 to 171 is any amino acid
  Variant (173)..(176): xaa in position 173 to 176 is any amino acid
  Variant (180)..(180): xaa in position 180 is any amino acid
  Variant (183)..(192): xaa in position 183 to 192 is any amino acid
  Variant (193)..(195): xaa in position 193 to 195 is any or no amino acid
  Variant (197)..(202): xaa in position 197 to 202 is any amino acid
  Variant (206)..(209): xaa in position 206 to 209 is any amino acid
  Variant (212)..(212): xaa in position 212 is any amino acid
  Variant (214)..(217): xaa in position 214 to 217 is any amino acid
  Variant (223)..(226): xaa in position 223 to 226 is any amino acid
  Variant (227)..(232): xaa in position 227 to 232 is any or no amino acid
  Variant (234)..(241): xaa in position 234 to 241 is any amino acid

SEQ ID NO: 43403 - protein, 58 aa, Artificial sequence; identical to SEQ ID NO: 6166
  Variant (1)..(1): xaa in position 1 is Ile, Val, Leu or Ala
  Variant (2)..(2): xaa in position 2 is Ile, Val or Leu
  Variant (3)..(3): xaa in position 3 is any amino acid
  Variant (4)..(4): xaa in position 4 is Ile, Val or Leu
  Variant (5)..(5): xaa in position 5 is any amino acid
  Variant (6)..(6): xaa in position 6 is Gly or Ala
  Variant (7)..(7): xaa in position 7 is any amino acid
  Variant (8)..(8): xaa in position 8 is Ser, Thr or Ala
  Variant (9)..(9): xaa in position 9 is Gly, Ala or Ser
  Variant (10)..(10): xaa in position 10 is Ser, Cys, Ala or Gly
  Variant (13)..(13): xaa in position 13 is Thr or Ser
  Variant (14)..(18): xaa in position 14 to 18 is any amino acid
  Variant (19)..(19): xaa in position 19 is Ile, Leu, Val or Met
  Variant (20)..(27): xaa in position 20 to 27 is any amino acid
  Variant (28)..(52): xaa in position 28 to 52 is any or no amino acid
  Variant (53)..(53): xaa in position 53 is Ile, Leu or Val
  Variant (54)..(55): xaa in position 54 to 55 is any amino acid
  Variant (57)..(57): xaa in position 57 is any amino acid
  Variant (58)..(58): xaa in position 58 is Tyr or Phe

SEQ ID NO: 43404 - protein, 74 aa, Artificial sequence; identical to SEQ ID NO: 6167
  Variant (1)..(1): xaa in position 1 is Ala, Ser, Val, Glu or Cys
  Variant (2)..(10): xaa in position 2 to 10 is any amino acid
  Variant (11)..(11): xaa in position 11 is Leu, Ile, Val or Met
  Variant (12)..(13): xaa in position 12 to 13 is any amino acid
  Variant (14)..(14): xaa in position 14 is Leu or Ile
  Variant (15)..(19): xaa in position 15 to 19 is any amino acid
  Variant (20)..(20): xaa in position 20 is Val, Ile, Leu, Thr or Tyr
  Variant (21)..(22): xaa in position 21 to 22 is any amino acid
  Variant (24)..(24): xaa in position 24 is any amino acid
  Variant (26)..(34): xaa in position 26 to 34 is any amino acid
  Variant (35)..(46): xaa in position 35 to 46 is any or no amino acid
  Variant (47)..(47): xaa in position 47 is Val, Ile or Phe
  Variant (48)..(48): xaa in position 48 is Ile, Val, Leu or Phe
  Variant (49)..(49): xaa in position 49 is Ile, Val or Leu
  Variant (50)..(50): xaa in position 50 is any amino acid
  Variant (51)..(51): xaa in position 51 is Glu or Asp
  Variant (53)..(53): xaa in position 53 is Ile or Leu
  Variant (54)..(54): xaa in position 54 is Leu, His, Tyr, Phe or Met
  Variant (55)..(59): xaa in position 55 to 59 is any amino acid
  Variant (60)..(63): xaa in position 60 to 63 is any or no amino acid
  Variant (64)..(64): xaa in position 64 is Leu, Ile, Val or Met
  Variant (65)..(71): xaa in position 65 to 71 is any amino acid
  Variant (72)..(72): xaa in position 72 is Ile, Val or Leu
  Variant (73)..(73): xaa in position 73 is Phe, Tyr or Ser
  Variant (74)..(74): xaa in position 74 is Val, Met, Leu, Ile or Phe

SEQ ID NO: 43405 - protein, 44 aa, Artificial sequence; identical to SEQ ID NO: 6168
  Variant (1)..(1): xaa in position 1 is Arg or Lys
  Variant (2)..(2): xaa in position 2 is Ile, Val, Leu or Met
  Variant (3)..(3): xaa in position 3 is any amino acid
  Variant (6)..(29): xaa in position 6 to 29 is any amino acid
  Variant (30)..(32): xaa in position 30 to 32 is any or no amino acid
  Variant (33)..(33): xaa in position 33 is Phe, Tyr, Trp or Asn
  Variant (34)..(34): xaa in position 34 is Ile, Val or Cys
  Variant (35)..(35): xaa in position 35 is any amino acid
  Variant (36)..(36): xaa in position 36 is Pro or Lys
  Variant (37)..(40): xaa in position 37 to 40 is any amino acid
  Variant (42)..(43): xaa in position 42 to 43 is any amino acid
  Variant (44)..(44): xaa in position 44 is Ile, Val, Leu, Met or Lys

SEQ ID NO: 43406 - DNA, 1518 bp, Escherichia coli; identical to SEQ ID NO: 30163
  CDS (1)..(1518)

SEQ ID NO: 43407 - protein, 505 aa, Escherichia coli; identical to SEQ ID NO: 30164

SEQ ID NO: 43408 - DNA, 1374 bp, Archaeoglobus fulgidus DSM 4304; identical to SEQ ID NO: 30165
  CDS (1)..(1374): transl_table=11

SEQ ID NO: 43409 - protein, 457 aa, Archaeoglobus fulgidus DSM 4304; identical to SEQ ID NO: 30166

SEQ ID NO: 43410 - DNA, 1452 bp, Mesorhizobium loti MAFF303099; identical to SEQ ID NO: 30167
  CDS (1)..(1452): transl_table=11

SEQ ID NO: 43411 - protein, 483 aa, Mesorhizobium loti MAFF303099; identical to SEQ ID NO: 30168

SEQ ID NO: 43412 - DNA, 1425 bp, Thermoplasma volcanium GSS1; identical to SEQ ID NO: 30169
  CDS (1)..(1425): transl_table=11

SEQ ID NO: 43413 - protein, 474 aa, Thermoplasma volcanium GSS1; identical to SEQ ID NO: 30170

SEQ ID NO: 43414 - DNA, 1701 bp, Arabidopsis thaliana; identical to SEQ ID NO: 30171
  CDS (1)..(1701)

SEQ ID NO: 43415 - protein, 566 aa, Arabidopsis thaliana; identical to SEQ ID NO: 30172

SEQ ID NO: 43416 - DNA, 1686 bp, Arabidopsis thaliana; identical to SEQ ID NO: 30173
  CDS (1)..(1686)

SEQ ID NO: 43417 - protein, 561 aa, Arabidopsis thaliana; identical to SEQ ID NO: 30174

SEQ ID NO: 43418 - DNA, 1599 bp, Arabidopsis thaliana; identical to SEQ ID NO: 30175
  CDS (1)..(1599)

SEQ ID NO: 43419 - protein, 532 aa, Arabidopsis thaliana; identical to SEQ ID NO: 30176

SEQ ID NO: 43420 - DNA, 1398 bp, Aquifex aeolicus VF5; identical to SEQ ID NO: 30177
  CDS (1)..(1398): transl_table=11

SEQ ID NO: 43421 - protein, 465 aa, Aquifex aeolicus VF5; identical to SEQ ID NO: 30178

SEQ ID NO: 43422 - DNA, 1296 bp, Thermotoga maritima MSB8; identical to SEQ ID NO: 30179
  CDS (1)..(1296): transl_table=11

SEQ ID NO: 43423 - protein, 431 aa, Thermotoga maritima MSB8; identical to SEQ ID NO: 30180

SEQ ID NO: 43424 - DNA, 1422 bp, Bacillus halodurans C-125; identical to SEQ ID NO: 30181
  CDS (1)..(1422): transl_table=11

SEQ ID NO: 43425 - protein, 473 aa, Bacillus halodurans C-125; identical to SEQ ID NO: 30182

SEQ ID NO: 43426 - DNA, 1515 bp, Pasteurella multocida subsp. multocida str. Pm70; identical to SEQ ID NO: 30183
  CDS (1)..(1515): transl_table=11

SEQ ID NO: 43427 - protein, 504 aa, Pasteurella multocida subsp. multocida str. Pm70; identical to SEQ ID NO: 30184

SEQ ID NO: 43428 - DNA, 1416 bp, Methanocaldococcus jannaschii DSM 2661; identical to SEQ ID NO: 30185
  CDS (1)..(1416): transl_table=11

SEQ ID NO: 43429 - protein, 471 aa, Methanocaldococcus jannaschii DSM 2661; identical to SEQ ID NO: 30186

SEQ ID NO: 43430 - DNA, 1506 bp, Pseudomonas aeruginosa PAO1; identical to SEQ ID NO: 30187
  CDS (1)..(1506): transl_table=11

SEQ ID NO: 43431 - protein, 501 aa, Pseudomonas aeruginosa PAO1; identical to SEQ ID NO: 30188

SEQ ID NO: 43432 - DNA, 1500 bp, Lactococcus lactis subsp. lactis Il1403; identical to SEQ ID NO: 30189
  CDS (1)..(1500): transl_table=11

SEQ ID NO: 43433 - protein, 499 aa, Lactococcus lactis subsp. lactis Il1403; identical to SEQ ID NO: 30190

SEQ ID NO: 43434 - DNA, 1545 bp, Neisseria meningitidis MC58; identical to SEQ ID NO: 30191
  CDS (1)..(1545): transl_table=11

SEQ ID NO: 43435 - protein, 514 aa, Neisseria meningitidis MC58; identical to SEQ ID NO: 30192

SEQ ID NO: 43436 - DNA, 1473 bp, Halobacterium sp. NRC-1; identical to SEQ ID NO: 30193
  CDS (1)..(1473): transl_table=11

SEQ ID NO: 43437 - protein, 490 aa, Halobacterium sp. NRC-1; identical to SEQ ID NO: 30194

SEQ ID NO: 43438 - DNA, 1338 bp, Campylobacter jejuni subsp. jejuni NCTC 11168; identical to SEQ ID NO: 30195
  CDS (1)..(1338): transl_table=11

SEQ ID NO: 43439 - protein, 445 aa, Campylobacter jejuni subsp. jejuni NCTC 11168; identical to SEQ ID NO: 30196

SEQ ID NO: 43440 - DNA, 1545 bp, Neisseria meningitidis Z2491; identical to SEQ ID NO: 30197
  CDS (1)..(1545): transl_table=11

SEQ ID NO: 43441 - protein, 514 aa, Neisseria meningitidis Z2491; identical to SEQ ID NO: 30198

SEQ ID NO: 43442 - DNA, 1434 bp, Deinococcus radiodurans R1; identical to SEQ ID NO: 30199
  CDS (1)..(1434): transl_table=11

SEQ ID NO: 43443 - protein, 477 aa, Deinococcus radiodurans R1; identical to SEQ ID NO: 30200

SEQ ID NO: 43444 - DNA, 1458 bp, Xylella fastidiosa 9a5c; identical to SEQ ID NO: 30201
  CDS (1)..(1458): transl_table=11

SEQ ID NO: 43445 - protein, 485 aa, Xylella fastidiosa 9a5c; identical to SEQ ID NO: 30202

SEQ ID NO: 43446 - DNA, 1353 bp, Sulfolobus solfataricus P2; identical to SEQ ID NO: 30203
  CDS (1)..(1353): transl_table=11

SEQ ID NO: 43447 - protein, 450 aa, Sulfolobus solfataricus P2; identical to SEQ ID NO: 30204

SEQ ID NO: 43448 - DNA, 1215 bp, Sulfolobus solfataricus P2; identical to SEQ ID NO: 30205
  CDS (1)..(1215): transl_table=11

SEQ ID NO: 43449 - protein, 404 aa, Sulfolobus solfataricus P2; identical to SEQ ID NO: 30206

SEQ ID NO: 43450 - DNA, 1428 bp, Clostridium acetobutylicum ATCC 824; identical to SEQ ID NO: 30207
  CDS (1)..(1428): transl_table=11

SEQ ID NO: 43451 - protein, 475 aa, Clostridium acetobutylicum ATCC 824; identical to SEQ ID NO: 30208

SEQ ID NO: 43452 - DNA, 1443 bp, Streptococcus pneumoniae R6; identical to SEQ ID NO: 30209
  CDS (1)..(1443): transl_table=11

SEQ ID NO: 43453 - protein, 480 aa, Streptococcus pneumoniae R6; identical to SEQ ID NO: 30210

SEQ ID NO: 43454 - DNA, 1332 bp, Sulfolobus tokodaii str. 7; identical to SEQ ID NO: 30211
  CDS (1)..(1332): transl_table=11

SEQ ID NO: 43455 - protein, 443 aa, Sulfolobus tokodaii str. 7; identical to SEQ ID NO: 30212

SEQ ID NO: 43456 - DNA, 1491 bp, Sinorhizobium meliloti 1021; identical to SEQ ID NO: 30213
  CDS (1)..(1491): transl_table=11

SEQ ID NO: 43457 - protein, 496 aa, Sinorhizobium meliloti 1021; identical to SEQ ID NO: 30214

SEQ ID NO: 43458 - DNA, 1425 bp, Thermoplasma acidophilum DSM 1728; identical to SEQ ID NO: 30215
  CDS (1)..(1425): transl_table=11

SEQ ID NO: 43459 - protein, 474 aa, Thermoplasma acidophilum DSM 1728; identical to SEQ ID NO: 30216

SEQ ID NO: 43460 - DNA, 1503 bp, Caulobacter crescentus CB15; identical to SEQ ID NO: 30217
  CDS (1)..(1503): transl_table=11

SEQ ID NO: 43461 - protein, 500 aa, Caulobacter crescentus CB15; identical to SEQ ID NO: 30218

SEQ ID NO: 43462 - DNA, 1518 bp, Haemophilus influenzae Rd KW20; identical to SEQ ID NO: 30219
  CDS (1)..(1518): transl_table=11

SEQ ID NO: 43463 - protein, 505 aa, Haemophilus influenzae Rd KW20; identical to SEQ ID NO: 30220

SEQ ID NO: 43464 - DNA, 1428 bp, Listeria monocytogenes EGD-e; identical to SEQ ID NO: 30221
  CDS (1)..(1428): transl_table=11

SEQ ID NO: 43465 - protein, 475 aa, Listeria monocytogenes EGD-e; identical to SEQ ID NO: 30222

SEQ ID NO: 43466 - DNA, 1428 bp, Listeria innocua Clip11262; identical to SEQ ID NO: 30223
  CDS (1)..(1428): transl_table=11

SEQ ID NO: 43467 - protein, 475 aa, Listeria innocua Clip11262; identical to SEQ ID NO: 30224

SEQ ID NO: 43468 - DNA, 1500 bp, Nostoc sp. PCC 7120; identical to SEQ ID NO: 30225
  CDS (1)..(1500): transl_table=11

SEQ ID NO: 43469 - protein, 499 aa, Nostoc sp. PCC 7120; identical to SEQ ID NO: 30226

SEQ ID NO: 43470 - DNA, 1443 bp, Caenorhabditis elegans; identical to SEQ ID NO: 30227
  CDS (1)..(1443)

SEQ ID NO: 43471 - protein, 480 aa, Caenorhabditis elegans; identical to SEQ ID NO: 30228

SEQ ID NO: 43472 - DNA, 1536 bp, Ralstonia solanacearum GMI1000; identical to SEQ ID NO: 30229
  CDS (1)..(1536): transl_table=11

SEQ ID NO: 43473 - protein, 511 aa, Ralstonia solanacearum GMI1000; identical to SEQ ID NO: 30230

SEQ ID NO: 43474 - DNA, 1644 bp, Drosophila melanogaster; identical to SEQ ID NO: 30231
  CDS (1)..(1644)

SEQ ID NO: 43475 - protein, 547 aa, Drosophila melanogaster; identical to SEQ ID NO: 30232

SEQ ID NO: 43476 - DNA, 1509 bp, Agrobacterium tumefaciens str. C58; identical to SEQ ID NO: 30233
  CDS (1)..(1509): transl_table=11

SEQ ID NO: 43477 - protein, 502 aa, Agrobacterium tumefaciens str. C58; identical to SEQ ID NO: 30234

SEQ ID NO: 43478 - DNA, 1551 bp, Brucella melitensis 16M; identical to SEQ ID NO: 30235
  CDS (1)..(1551): transl_table=11

SEQ ID NO: 43479 - protein, 516 aa, Brucella melitensis 16M; identical to SEQ ID NO: 30236

SEQ ID NO: 43480 - DNA, 1263 bp, Pyrobaculum aerophilum str. IM2; identical to SEQ ID NO: 30237
  CDS (1)..(1263): transl_table=11

SEQ ID NO: 43481 - protein, 420 aa, Pyrobaculum aerophilum str. IM2; identical to SEQ ID NO: 30238

SEQ ID NO: 43482 - DNA, 1446 bp, Clostridium perfringens str. 13; identical to SEQ ID NO: 30239
  CDS (1)..(1446): transl_table=11

SEQ ID NO: 43483 - protein, 481 aa, Clostridium perfringens str. 13; identical to SEQ ID NO: 30240

SEQ ID NO: 43484 - DNA, 1350 bp, Pyrococcus furiosus DSM 3638; identical to SEQ ID NO: 30241
  CDS (1)..(1350): transl_table=11

SEQ ID NO: 43485 - protein, 449 aa, Pyrococcus furiosus DSM 3638; identical to SEQ ID NO: 30242

SEQ ID NO: 43486 - DNA, 1347 bp, Fusobacterium nucleatum subsp. nucleatum ATCC 25586; identical to SEQ ID NO: 30243
  CDS (1)..(1347): transl_table=11

SEQ ID NO: 43487 - protein, 448 aa, Fusobacterium nucleatum subsp. nucleatum ATCC 25586; identical to SEQ ID NO: 30244

SEQ ID NO: 43488 - DNA, 1455 bp, Streptococcus pyogenes MGAS8232; identical to SEQ ID NO: 30245
  CDS (1)..(1455): transl_table=11

SEQ ID NO: 43489 - protein, 484 aa, Streptococcus pyogenes MGAS8232; identical to SEQ ID NO: 30246

SEQ ID NO: 43490 - DNA, 1356 bp, Methanopyrus kandleri AV19; identical to SEQ ID NO: 30247
  CDS (1)..(1356): transl_table=11

SEQ ID NO: 43491 - protein, 451 aa, Methanopyrus kandleri AV19; identical to SEQ ID NO: 30248

SEQ ID NO: 43492 - DNA, 1455 bp, Methanosarcina acetivorans C2A; identical to SEQ ID NO: 30249
  CDS (1)..(1455): transl_table=11

SEQ ID NO: 43493 - protein, 484 aa, Methanosarcina acetivorans C2A; identical to SEQ ID NO: 30250

SEQ ID NO: 43494 - DNA, 1398 bp, Thermoanaerobacter tengcongensis MB4; identical to SEQ ID NO: 30251
  CDS (1)..(1398): transl_table=11

SEQ ID NO: 43495 - protein, 465 aa, Thermoanaerobacter tengcongensis MB4; identical to SEQ ID NO: 30252

SEQ ID NO: 43496 - DNA, 1593 bp, Streptomyces coelicolor A3(2); identical to SEQ ID NO: 30253
  CDS (1)..(1593): transl_table=11

SEQ ID NO: 43497 - protein, 530 aa, Streptomyces coelicolor A3(2); identical to SEQ ID NO: 30254

SEQ ID NO: 43498 - DNA, 1458 bp, Methanosarcina mazei Go1; identical to SEQ ID NO: 30255
  CDS (1)..(1458): transl_table=11

SEQ ID NO: 43499 - protein, 485 aa, Methanosarcina mazei Go1; identical to SEQ ID NO: 30256

SEQ ID NO: 43500 - DNA, 1467 bp, Xanthomonas axonopodis pv. citri str. 306; identical to SEQ ID NO: 30257
  CDS (1)..(1467): transl_table=11

SEQ ID NO: 43501 - protein, 488 aa, Xanthomonas axonopodis pv. citri str. 306; identical to SEQ ID NO: 30258

SEQ ID NO: 43502 - DNA, 1494 bp, Chlorobium tepidum TLS; identical to SEQ ID NO: 30259
  CDS (1)..(1494): transl_table=11

SEQ ID NO: 43503 - protein, 497 aa, Chlorobium tepidum TLS; identical to SEQ ID NO: 30260

SEQ ID NO: 43504 - DNA, 1449 bp, Thermosynechococcus elongatus BP-1; identical to SEQ ID NO: 30261
  CDS (1)..(1449): transl_table=11

SEQ ID NO: 43505 - protein, 482 aa, Thermosynechococcus elongatus BP-1; identical to SEQ ID NO: 30262

SEQ ID NO: 43506 - DNA, 1455 bp, Streptococcus agalactiae 2603V/R; identical to SEQ ID NO: 30263
  CDS (1)..(1455): transl_table=11

SEQ ID NO: 43507 - protein, 484 aa, Streptococcus agalactiae 2603V/R; identical to SEQ ID NO: 30264

SEQ ID NO: 43508 - DNA, 1407 bp, Oceanobacillus iheyensis HTE831; identical to SEQ ID NO: 30265
  CDS (1)..(1407): transl_table=11

SEQ ID NO: 43509 - protein, 468 aa, Oceanobacillus iheyensis HTE831; identical to SEQ ID NO: 30266

SEQ ID NO: 43510 - DNA, 1512 bp, Bifidobacterium longum NCC2705; identical to SEQ ID NO: 30267
  CDS (1)..(1512): transl_table=11

SEQ ID NO: 43511 - protein, 503 aa, Bifidobacterium longum NCC2705; identical to SEQ ID NO: 30268

SEQ ID NO: 43512 - DNA, 1515 bp, Shewanella oneidensis MR-1; identical to SEQ ID NO: 30269
  CDS (1)..(1515): transl_table=11

SEQ ID NO: 43513 - protein, 504 aa, Shewanella oneidensis MR-1; identical to SEQ ID NO: 30270

SEQ ID NO: 43514 - DNA, 1440 bp, Streptococcus mutans UA159; identical to SEQ ID NO: 30271
  CDS (1)..(1440): transl_table=11

SEQ ID NO: 43515 - protein, 479 aa, Streptococcus mutans UA159; identical to SEQ ID NO: 30272

SEQ ID NO: 43516 - DNA, 1413 bp, Drosophila melanogaster; identical to SEQ ID NO: 30273
  CDS (1)..(1413)

SEQ ID NO: 43517 - protein, 470 aa, Drosophila melanogaster; identical to SEQ ID NO: 30274

SEQ ID NO: 43518 - DNA, 1455 bp, Streptococcus agalactiae NEM316; identical to SEQ ID NO: 30275
  CDS (1)..(1455): transl_table=11

SEQ ID NO: 43519 - protein, 484 aa, Streptococcus agalactiae NEM316; identical to SEQ ID NO: 30276

SEQ ID NO: 43520 - DNA, 1533 bp, Corynebacterium efficiens YS-314; identical to SEQ ID NO: 30277
  CDS (1)..(1533): transl_table=11

SEQ ID NO: 43521 - protein, 510 aa, Corynebacterium efficiens YS-314; identical to SEQ ID NO: 30278

SEQ ID NO: 43522 - DNA, 1506 bp, Pseudomonas putida KT2440; identical to SEQ ID NO: 30279
  CDS (1)..(1506): transl_table=11

SEQ ID NO: 43523 - protein, 501 aa, Pseudomonas putida KT2440; identical to SEQ ID NO: 30280

SEQ ID NO: 43524 - DNA, 1524 bp, Bradyrhizobium japonicum USDA 110; identical to SEQ ID NO: 30281
  CDS (1)..(1524): transl_table=11

SEQ ID NO: 43525 - protein, 507 aa, Bradyrhizobium japonicum USDA 110; identical to SEQ ID NO: 30282

SEQ ID NO: 43526 - DNA, 1458 bp, Xylella fastidiosa Temecula1; identical to SEQ ID NO: 30283
  CDS (1)..(1458): transl_table=11

SEQ ID NO: 43527 - protein, 485 aa, Xylella fastidiosa Temecula1; identical to SEQ ID NO: 30284

SEQ ID NO: 43528 - DNA, 1398 bp, Clostridium tetani E88; identical to SEQ ID NO: 30285
  CDS (1)..(1398): transl_table=11

SEQ ID NO: 43529 - protein, 465 aa, Clostridium tetani E88; identical to SEQ ID NO: 30286

SEQ ID NO: 43530 - DNA, 1455 bp, Lactobacillus plantarum WCFS1; identical to SEQ ID NO: 30287
  CDS (1)..(1455): transl_table=11

SEQ ID NO: 43531 - protein, 484 aa, Lactobacillus plantarum WCFS1; identical to SEQ ID NO: 30288

SEQ ID NO: 43532 - DNA, 1515 bp, Tropheryma whipplei str. Twist; identical to SEQ ID NO: 30289
  CDS (1)..(1515): transl_table=11

SEQ ID NO: 43533 - protein, 504 aa, Tropheryma whipplei str. Twist; identical to SEQ ID NO: 30290

SEQ ID NO: 43534 - DNA, 1461 bp, Tropheryma whipplei TW08/27; identical to SEQ ID NO: 30291
  CDS (1)..(1461): transl_table=11

SEQ ID NO: 43535 - protein, 486 aa, Tropheryma whipplei TW08/27; identical to SEQ ID NO: 30292

SEQ ID NO: 43536 - DNA, 1509 bp, Pseudomonas syringae pv. tomato str. DC3000; identical to SEQ ID NO: 30293
  CDS (1)..(1509): transl_table=11

SEQ ID NO: 43537 - protein, 502 aa, Pseudomonas syringae pv. tomato str. DC3000; identical to SEQ ID NO: 30294

SEQ ID NO: 43538 - DNA, 1410 bp, Bacteroides thetaiotaomicron VPI-5482; identical to SEQ ID NO: 30295
  CDS (1)..(1410): transl_table=11

SEQ ID NO: 43539 - protein, 469 aa, Bacteroides thetaiotaomicron VPI-5482; identical to SEQ ID NO: 30296

SEQ ID NO: 43540 - DNA, 1440 bp, Enterococcus faecalis V583; identical to SEQ ID NO: 30297
  CDS (1)..(1440): transl_table=11

SEQ ID NO: 43541 - protein, 479 aa, Enterococcus faecalis V583; identical to SEQ ID NO: 30298

SEQ ID NO: 43542 - DNA, 1521 bp, Coxiella burnetii RSA 493; identical to SEQ ID NO: 30299
  CDS (1)..(1521): transl_table=11

SEQ ID NO: 43543 - protein, 506 aa, Coxiella burnetii RSA 493; identical to SEQ ID NO: 30300

SEQ ID NO: 43544 - DNA, 1581 bp, Streptomyces avermitilis MA-4680; identical to SEQ ID NO: 30301
  CDS (1)..(1581): transl_table=11

SEQ ID NO: 43545 - protein, 526 aa, Streptomyces avermitilis MA-4680; identical to SEQ ID NO: 30302

SEQ ID NO: 43546 - DNA, 1416 bp, Bacillus cereus ATCC 14579; identical to SEQ ID NO: 30303
  CDS (1)..(1416): transl_table=11

SEQ ID NO: 43547 - protein, 471 aa, Bacillus cereus ATCC 14579; identical to SEQ ID NO: 30304

SEQ ID NO: 43548 - DNA, 1518 bp, Nitrosomonas europaea ATCC 19718; identical to SEQ ID NO: 30305
  CDS (1)..(1518): transl_table=11

SEQ ID NO: 43549 - protein, 505 aa, Nitrosomonas europaea ATCC 19718; identical to SEQ ID NO: 30306

SEQ ID NO: 43550 - DNA, 1425 bp, Helicobacter hepaticus ATCC 51449; identical to SEQ ID NO: 30307
  CDS (1)..(1425): transl_table=11

SEQ ID NO: 43551 - protein, 474 aa, Helicobacter hepaticus ATCC 51449; identical to SEQ ID NO: 30308

SEQ ID NO: 43552 - DNA, 1614 bp, Rhodopirellula baltica SH 1; identical to SEQ ID NO: 30309
  CDS (1)..(1614): transl_table=11

SEQ ID NO: 43553 - protein, 537 aa, Rhodopirellula baltica SH 1; identical to SEQ ID NO: 30310

SEQ ID NO: 43554 - DNA, 1413 bp, Wigglesworthia glossinidia endosymbiont of Glossina brevipalpis; identical to SEQ ID NO: 30311
  CDS (1)..(1413): transl_table=11

SEQ ID NO: 43555 - protein, 470 aa, Wigglesworthia glossinidia endosymbiont of Glossina brevipalpis; identical to SEQ ID NO: 30312

SEQ ID NO: 43556 - DNA, 1458 bp, Prochlorococcus marinus subsp. marinus str. CCMP1375; identical to SEQ ID NO: 30313
  CDS (1)..(1458): transl_table=11

SEQ ID NO: 43557 - protein, 485 aa, Prochlorococcus marinus subsp. marinus str. CCMP1375; identical to SEQ ID NO: 30314

SEQ ID NO: 43558 - DNA, 1521 bp, Bordetella parapertussis 12822; identical to SEQ ID NO: 30315
  CDS (1)..(1521): transl_table=11

SEQ ID NO: 43559 - protein, 506 aa, Bordetella parapertussis 12822; identical to SEQ ID NO: 30316

SEQ ID NO: 43560 - DNA, 1521 bp, Bordetella bronchiseptica RB50; identical to SEQ ID NO: 30317
  CDS (1)..(1521): transl_table=11

SEQ ID NO: 43561 - protein, 506 aa, Bordetella bronchiseptica RB50; identical to SEQ ID NO: 30318

SEQ ID NO: 43562 - DNA, 1461 bp, Prochlorococcus marinus subsp. pastoris str. CCMP1986; identical to SEQ ID NO: 30319
  CDS (1)..(1461): transl_table=11

SEQ ID NO: 43563 - protein, 486 aa, Prochlorococcus marinus subsp. pastoris str. CCMP1986; identical to SEQ ID NO: 30320

SEQ ID NO: 43564 - DNA, 1458 bp, Prochlorococcus marinus str. MIT 9313; identical to SEQ ID NO: 30321
  CDS (1)..(1458): transl_table=11

SEQ ID NO: 43565 - protein, 485 aa, Prochlorococcus marinus str. MIT 9313; identical to SEQ ID NO: 30322

SEQ ID NO: 43566 - DNA, 1506 bp, Synechococcus sp. WH 8102; identical to SEQ ID NO: 30323
  CDS (1)..(1506): transl_table=11

SEQ ID NO: 43567 - protein, 501 aa, Synechococcus sp. WH 8102; identical to SEQ ID NO: 30324

SEQ ID NO: 43568 - DNA, 1377 bp, Wolinella succinogenes DSM 1740; identical to SEQ ID NO: 30325
  CDS (1)..(1377): transl_table=11

SEQ ID NO: 43569 - protein, 458 aa, Wolinella succinogenes DSM 1740; identical to SEQ ID NO: 30326

SEQ ID NO: 43570 - DNA, 1437 bp, Gloeobacter violaceus PCC 7421; identical to SEQ ID NO: 30327
  CDS (1)..(1437): transl_table=11

SEQ ID NO: 43571 - protein, 478 aa, Gloeobacter violaceus PCC 7421; identical to SEQ ID NO: 30328

SEQ ID NO: 43572 - DNA, 1518 bp, Photorhabdus luminescens subsp. laumondii TTO1; identical to SEQ ID NO: 30329
  CDS (1)..(1518): transl_table=11

SEQ ID NO: 43573 - protein, 505 aa, Photorhabdus luminescens subsp. laumondii TTO1; identical to SEQ ID NO: 30330

SEQ ID NO: 43574 - DNA, 1515 bp, Vibrio vulnificus YJ016; identical to SEQ ID NO: 30331
  CDS (1)..(1515): transl_table=11

SEQ ID NO: 43575 - protein, 504 aa, Vibrio vulnificus YJ016; identical to SEQ ID NO: 30332

SEQ ID NO: 43576 - DNA, 1482 bp, Corynebacterium diphtheriae NCTC 13129; identical to SEQ ID NO: 30333
  CDS (1)..(1482): transl_table=11

SEQ ID NO: 43577 - protein, 493 aa, Corynebacterium diphtheriae NCTC 13129; identical to SEQ ID NO: 30334

SEQ ID NO: 43578 - DNA, 1530 bp, Rhodopseudomonas palustris CGA009; identical to SEQ ID NO: 30335
  CDS (1)..(1530): transl_table=11

SEQ ID NO: 43579 - protein, 509 aa, Rhodopseudomonas palustris CGA009; identical to SEQ ID NO: 30336

SEQ ID NO: 43580 - DNA, 1404 bp, Geobacter sulfurreducens PCA; identical to SEQ ID NO: 30337
  CDS (1)..(1404): transl_table=11

SEQ ID NO: 43581 - protein, 467 aa, Geobacter sulfurreducens PCA; identical to SEQ ID NO: 30338

SEQ ID NO: 43582 - DNA, 1656 bp, Mycobacterium avium subsp. paratuberculosis K-10; identical to SEQ ID NO: 30339
  CDS (1)..(1656): transl_table=11

SEQ ID NO: 43583 - protein, 551 aa, Mycobacterium avium subsp. paratuberculosis K-10; identical to SEQ ID NO: 30340

SEQ ID NO: 43584 - DNA, 1386 bp, Wolbachia endosymbiont of Drosophila melanogaster; identical to SEQ ID NO: 30341
  CDS (1)..(1386): transl_table=11

SEQ ID NO: 43585 - protein, 461 aa, Wolbachia endosymbiont of Drosophila melanogaster; identical to SEQ ID NO: 30342

SEQ ID NO: 43586 - DNA, 1464 bp, Treponema denticola ATCC 35405; identical to SEQ ID NO: 30343
  CDS (1)..(1464): transl_table=11

SEQ ID NO: 43587 - protein, 487 aa, Treponema denticola ATCC 35405; identical to SEQ ID NO: 30344

SEQ ID NO: 43588 - DNA, 1416 bp, Bacillus cereus ATCC 10987; identical to SEQ ID NO: 30345
  CDS (1)..(1416): transl_table=11

SEQ ID NO: 43589 - protein, 471 aa, Bacillus cereus ATCC 10987; identical to SEQ ID NO: 30346

SEQ ID NO: 43590 - DNA, 1533 bp, Eremothecium gossypii; identical to SEQ ID NO: 30347
  CDS (1)..(1533)

SEQ ID NO: 43591 - protein, 510 aa, Eremothecium gossypii; identical to SEQ ID NO: 30348

SEQ ID NO: 43592 - DNA, 1380 bp, Methanococcus maripaludis S2; identical to SEQ ID NO: 30349
  CDS (1)..(1380): transl_table=11

SEQ ID NO: 43593 - protein, 459 aa, Methanococcus maripaludis S2; identical to SEQ ID NO: 30350

SEQ ID NO: 43594 - DNA, 1527 bp, Xenopus tropicalis; identical to SEQ ID NO: 30351
  CDS (1)..(1527)

SEQ ID NO: 43595 - protein, 508 aa, Xenopus tropicalis; identical to SEQ ID NO: 30352

SEQ ID NO: 43596 - DNA, 1641 bp, Neurospora crassa; identical to SEQ ID NO: 30353
  CDS (1)..(1641)

SEQ ID NO: 43597 - protein, 546 aa, Neurospora crassa; identical to SEQ ID NO: 30354

SEQ ID NO: 43598 - DNA, 1578 bp, Apis mellifera; identical to SEQ ID NO: 30355
  CDS (1)..(1578)

SEQ ID NO: 43599 - protein, 525 aa, Apis mellifera; identical to SEQ ID NO: 30356

SEQ ID NO: 43600 - DNA, 1473 bp, Leptospira interrogans serovar Copenhageni str. Fiocruz L1-130; identical to SEQ ID NO: 30357
  CDS (1)..(1473): transl_table=11

SEQ ID NO: 43601 - protein, 490 aa, Leptospira interrogans serovar Copenhageni str. Fiocruz L1-130; identical to SEQ ID NO: 30358

SEQ ID NO: 43602 - DNA, 1392 bp, Thermus thermophilus HB27; identical to SEQ ID NO: 30359
  CDS (1)..(1392): transl_table=11

SEQ ID NO: 43603 - protein, 463 aa, Thermus thermophilus HB27; identical to SEQ ID NO: 30360

SEQ ID NO: 43604 - DNA, 1389 bp, Desulfovibrio vulgaris subsp. vulgaris str. Hildenborough; identical to SEQ ID NO: 30361
  CDS (1)..(1389): transl_table=11

SEQ ID NO: 43605 - protein, 462 aa, Desulfovibrio vulgaris subsp. vulgaris str. Hildenborough; identical to SEQ ID NO: 30362

SEQ ID NO: 43606 - DNA, 1428 bp, Listeria monocytogenes str. 4b F2365; identical to SEQ ID NO: 30363
  CDS (1)..(1428): transl_table=11

SEQ ID NO: 43607 - protein, 475 aa, Listeria monocytogenes str. 4b F2365; identical to SEQ ID NO: 30364

SEQ ID NO: 43608 - DNA, 1383 bp, Picrophilus torridus DSM 9790; identical to SEQ ID NO: 30365
  CDS (1)..(1383): transl_table=11

SEQ ID NO: 43609 - protein, 460 aa, Picrophilus torridus DSM 9790; identical to SEQ ID NO: 30366

SEQ ID NO: 43610 - DNA, 1416 bp, Bacillus anthracis str. Sterne; identical to SEQ ID NO: 30367
  CDS (1)..(1416): transl_table=11

SEQ ID NO: 43611 - protein, 471 aa, Bacillus anthracis str. Sterne; identical to SEQ ID NO: 30368

SEQ ID NO: 43612 - DNA, 1533 bp, Bartonella quintana str. Toulouse; identical to SEQ ID NO: 30369
  CDS (1)..(1533): transl_table=11

SEQ ID NO: 43613 - protein, 510 aa, Bartonella quintana str. Toulouse; identical to SEQ ID NO: 30370

SEQ ID NO: 43614 - DNA, 1527 bp, Bartonella henselae str. Houston-1; identical to SEQ ID NO: 30371
  CDS (1)..(1527): transl_table=11

SEQ ID NO: 43615 - protein, 508 aa, Bartonella henselae str. Houston-1; identical to SEQ ID NO: 30372

SEQ ID NO: 43616 - DNA, 1485 bp, Staphylococcus aureus subsp. aureus MRSA252; identical to SEQ ID NO: 30373
  CDS (1)..(1485): transl_table=11

SEQ ID NO: 43617 - protein, 494 aa, Staphylococcus aureus subsp. aureus MRSA252; identical to SEQ ID NO: 30374

SEQ ID NO: 43618 - DNA, 1539 bp, Acinetobacter sp. ADP1; identical to SEQ ID NO: 30375
  CDS (1)..(1539): transl_table=11

SEQ ID NO: 43619 - protein, 512 aa, Acinetobacter sp. ADP1; identical to SEQ ID NO: 30376

SEQ ID NO: 43620 - DNA, 1518 bp, Erwinia carotovora subsp. atroseptica SCRI1043; identical to SEQ ID NO: 30377
  CDS (1)..(1518): transl_table=11

SEQ ID NO: 43621 - protein, 505 aa, Erwinia carotovora subsp. atroseptica SCRI1043; identical to SEQ ID NO: 30378

SEQ ID NO: 43622 - DNA, 1488 bp, Propionibacterium acnes KPA171202; identical to SEQ ID NO: 30379
  CDS (1)..(1488): transl_table=11

SEQ ID NO: 43623 - protein, 495 aa, Propionibacterium acnes KPA171202; identical to SEQ ID NO: 30380

SEQ ID NO: 43624 - DNA, 1455 bp, Streptococcus pyogenes MGAS10394; identical to SEQ ID NO: 30381
  CDS (1)..(1455): transl_table=11

SEQ ID NO: 43625 - protein, 484 aa, Streptococcus pyogenes MGAS10394; identical to SEQ ID NO: 30382

SEQ ID NO: 43626 - DNA, 1560 bp, Leifsonia xyli subsp. xyli str. CTCB07; identical to SEQ ID NO: 30383
  CDS (1)..(1560): transl_table=11

SEQ ID NO: 43627 - protein, 519 aa, Leifsonia xyli subsp. xyli str. CTCB07; identical to SEQ ID NO: 30384

SEQ ID NO: 43628 - DNA, 1440 bp, Desulfotalea psychrophila LSv54; identical to SEQ ID NO: 30385
  CDS (1)..(1440): transl_table=11

SEQ ID NO: 43629 - protein, 479 aa, Desulfotalea psychrophila LSv54; identical to SEQ ID NO: 30386

SEQ ID NO: 43630 - DNA, 1518 bp, Yersinia pseudotuberculosis IP 32953; identical to SEQ ID NO: 30387
  CDS (1)..(1518): transl_table=11

SEQ ID NO: 43631 - protein, 505 aa, Yersinia pseudotuberculosis IP 32953; identical to SEQ ID NO: 30388

SEQ ID NO: 43632 - DNA, 1488 bp, Symbiobacterium thermophilum IAM 14863; identical to SEQ ID NO: 30389
  CDS (1)..(1488): transl_table=11

SEQ ID NO: 43633 - protein, 495 aa, Symbiobacterium thermophilum IAM 14863; identical to SEQ ID NO: 30390

SEQ ID NO: 43634 - DNA, 1431 bp, Bacillus licheniformis ATCC 14580; identical to SEQ ID NO: 30391
  CDS (1)..(1431): transl_table=11

SEQ ID NO: 43635 - protein, 476 aa, Bacillus licheniformis ATCC 14580; identical to SEQ ID NO: 30392

SEQ ID NO: 43636 - DNA, 1512 bp, Mannheimia succiniciproducens MBEL55E; identical to SEQ ID NO: 30393
  CDS (1)..(1512): transl_table=11

SEQ ID NO: 43637 - protein, 503 aa, Mannheimia succiniciproducens MBEL55E; identical to SEQ ID NO: 30394

SEQ ID NO: 43638 - DNA, 1485 bp, Bacillus licheniformis ATCC 14580; identical to SEQ ID NO: 30395
  CDS (1)..(1485): transl_table=11

SEQ ID NO: 43639 - protein, 494 aa, Bacillus licheniformis ATCC 14580; identical to SEQ ID NO: 30396

SEQ ID NO: 43640 - DNA, 1500 bp, Legionella pneumophila subsp. pneumophila str. Philadelphia 1; identical to SEQ ID NO: 30397
  CDS (1)..(1500): transl_table=11

SEQ ID NO: 43641 - protein, 499 aa, Legionella pneumophila subsp. pneumophila str. Philadelphia 1; identical to SEQ ID NO: 30398

SEQ ID NO: 43642 - DNA, 1407 bp, Bacteroides fragilis YCH46; identical to SEQ ID NO: 30399
  CDS (1)..(1407): transl_table=11

SEQ ID NO: 43643 - protein, 468 aa, Bacteroides fragilis YCH46; identical to SEQ ID NO: 30400

SEQ ID NO: 43644 - DNA, 1884 bp, Bacteroides fragilis YCH46; identical to SEQ ID NO: 30401
  CDS (1)..(1884): transl_table=11

SEQ ID NO: 43645 - protein, 627 aa, Bacteroides fragilis YCH46; identical to SEQ ID NO: 30402

SEQ ID NO: 43646 - DNA, 1536 bp, Burkholderia mallei ATCC 23344; identical to SEQ ID NO: 30403
  CDS (1)..(1536): transl_table=11

SEQ ID NO: 43647 - protein, 511 aa, Burkholderia mallei ATCC 23344; identical to SEQ ID NO: 30404

SEQ ID NO: 43648 - DNA, 1536 bp, Burkholderia pseudomallei K96243; identical to SEQ ID NO: 30405
  CDS (1)..(1536): transl_table=11

SEQ ID NO: 43649 - protein, 511 aa, Burkholderia pseudomallei K96243; identical to SEQ ID NO: 30406

SEQ ID NO: 43650 - DNA, 1509 bp, Methylococcus capsulatus str. Bath; identical to SEQ ID NO: 30407
  CDS (1)..(1509): transl_table=11

SEQ ID NO: 43651 - protein, 502 aa, Methylococcus capsulatus str. Bath; identical to SEQ ID NO: 30408

SEQ ID NO: 43652 - DNA, 1500 bp, Nocardia farcinica IFM 10152; identical to SEQ ID NO: 30409
  CDS (1)..(1500): transl_table=11

SEQ ID NO: 43653 - protein, 499 aa, Nocardia farcinica IFM 10152; identical to SEQ ID NO: 30410

SEQ ID NO: 43654 - DNA, 1500 bp, Legionella pneumophila str. Paris; identical to SEQ ID NO: 30411
  CDS (1)..(1500): transl_table=11

SEQ ID NO: 43655 - protein, 499 aa, Legionella pneumophila str. Paris; identical to SEQ ID NO: 30412

SEQ ID NO: 43656 - DNA, 1500 bp, Legionella pneumophila str. Lens; identical to SEQ ID NO: 30413
  CDS (1)..(1500): transl_table=11

SEQ ID NO: 43657 - protein, 499 aa, Legionella pneumophila str. Lens; identical to SEQ ID NO: 30414

SEQ ID NO: 43658 - DNA, 1518 bp, Photobacterium profundum SS9; identical to SEQ ID NO: 30415
  CDS (1)..(1518): transl_table=11

SEQ ID NO: 43659 - protein, 505 aa, Photobacterium profundum SS9; identical to SEQ ID NO: 30416

SEQ ID NO: 43660 - DNA, 1443 bp, Haloarcula marismortui ATCC 43049; identical to SEQ ID NO: 30417
  CDS (1)..(1443): transl_table=11

SEQ ID NO: 43661 - protein, 480 aa, Haloarcula marismortui ATCC 43049; identical to SEQ ID NO: 30418

SEQ ID NO: 43662 - DNA, 1440 bp, Streptococcus thermophilus LMG 18311; identical to SEQ ID NO: 30419
  CDS (1)..(1440): transl_table=11

SEQ ID NO: 43663 - protein, 479 aa, Streptococcus thermophilus LMG 18311; identical to SEQ ID NO: 30420

SEQ ID NO: 43664 - DNA, 1413 bp, Geobacillus kaustophilus HTA426; identical to SEQ ID NO: 30421
  CDS (1)..(1413): transl_table=11

SEQ ID NO: 43665 - protein, 470 aa, Geobacillus kaustophilus HTA426; identical to SEQ ID NO: 30422

SEQ ID NO: 43666 - DNA, 1410 bp, Anaplasma marginale str. St. Maries; identical to SEQ ID NO: 30423
  CDS (1)..(1410): transl_table=11

SEQ ID NO: 43667 - protein, 469 aa, Anaplasma marginale str. St. Maries; identical to SEQ ID NO: 30424

SEQ ID NO: 43668 - DNA, 1518 bp, Idiomarina loihiensis L2TR; identical to SEQ ID NO: 30425
  CDS (1)..(1518): transl_table=11

SEQ ID NO: 43669 - protein, 505 aa, Idiomarina loihiensis L2TR; identical to SEQ ID NO: 30426

SEQ ID NO: 43670 - DNA, 1527 bp, Azoarcus sp. EbN1; identical to SEQ ID NO: 30427
  CDS (1)..(1527): transl_table=11

SEQ ID NO: 43671 - protein, 508 aa, Azoarcus sp. EbN1; identical to SEQ ID NO: 30428

SEQ ID NO: 43672 - DNA, 1527 bp, Zymomonas mobilis subsp. mobilis ZM4; identical to SEQ ID NO: 30429
  CDS (1)..(1527): transl_table=11

SEQ ID NO: 43673 - protein, 508 aa, Zymomonas mobilis subsp. mobilis ZM4; identical to SEQ ID NO: 30430

SEQ ID NO: 43674 - DNA, 1473 bp, Silicibacter pomeroyi DSS-3; identical to SEQ ID NO: 30431
  CDS (1)..(1473): transl_table=11

SEQ ID NO: 43675 - protein, 490 aa, Silicibacter pomeroyi DSS-3; identical to SEQ ID NO: 30432

SEQ ID NO: 43676 - DNA, 1491 bp, Francisella tularensis subsp. tularensis SCHU S4; identical to SEQ ID NO: 30433
  CDS (1)..(1491): transl_table=11

SEQ ID NO: 43677 - protein, 496 aa, Francisella tularensis subsp. tularensis SCHU S4; identical to SEQ ID NO: 30434

SEQ ID NO: 43678 - DNA, 1413 bp, Bacillus clausii KSM-K16; identical to SEQ ID NO: 30435
  CDS (1)..(1413): transl_table=11

SEQ ID NO: 43679 - protein, 470 aa, Bacillus clausii KSM-K16; identical to SEQ ID NO: 30436

SEQ ID NO: 43680 - DNA, 1338 bp, Campylobacter jejuni RM1221; identical to SEQ ID NO: 30437
  CDS (1)..(1338): transl_table=11

SEQ ID NO: 43681 - protein, 445 aa, Campylobacter jejuni RM1221; identical to SEQ ID NO: 30438

SEQ ID NO: 43682 - DNA, 1401 bp, Ehrlichia ruminantium str. Welgevonden; identical to SEQ ID NO: 30439
  CDS (1)..(1401): transl_table=11

SEQ ID NO: 43683 - protein, 466 aa, Ehrlichia ruminantium str. Welgevonden; identical to SEQ ID NO: 30440

SEQ ID NO: 43684 - DNA, 1419 bp, Dehalococcoides ethenogenes 195; identical to SEQ ID NO: 30441
  CDS (1)..(1419): transl_table=11

SEQ ID NO: 43685 - protein, 472 aa, Dehalococcoides ethenogenes 195; identical to SEQ ID NO: 30442

SEQ ID NO: 43686 - DNA, 1350 bp, Thermococcus kodakarensis KOD1; identical to SEQ ID NO: 30443
  CDS (1)..(1350): transl_table=11

SEQ ID NO: 43687 - protein, 449 aa, Thermococcus kodakarensis KOD1; identical to SEQ ID NO: 30444

SEQ ID NO: 43688 - DNA, 1482 bp, Gluconobacter oxydans 621H; identical to SEQ ID NO: 30445
  CDS (1)..(1482): transl_table=11

SEQ ID NO: 43689 - protein, 493 aa, Gluconobacter oxydans 621H; identical to SEQ ID NO: 30446

SEQ ID NO: 43690 - DNA, 1467 bp, Lactobacillus acidophilus NCFM; identical to SEQ ID NO: 30447
  CDS (1)..(1467): transl_table=11

SEQ ID NO: 43691 - protein, 488 aa, Lactobacillus acidophilus NCFM; identical to SEQ ID NO: 30448

SEQ ID NO: 43692 - DNA, 1401 bp, Ehrlichia ruminantium str. Gardel; identical to SEQ ID NO: 30449
  CDS (1)..(1401): transl_table=11

SEQ ID NO: 43693 - protein, 466 aa, Ehrlichia ruminantium str. Gardel; identical to SEQ ID NO: 30450

SEQ ID NO: 43694 - DNA, 1386 bp, Wolbachia endosymbiont strain TRS of Brugia malayi; identical to SEQ ID NO: 30451
  CDS (1)..(1386): transl_table=11

SEQ ID NO: 43695 - protein, 461 aa, Wolbachia endosymbiont strain TRS of Brugia malayi; identical to SEQ ID NO: 30452

SEQ ID NO: 43696 - DNA, 1467 bp, Xanthomonas oryzae pv. oryzae KACC10331; identical to SEQ ID NO: 30453
  CDS (1)..(1467): transl_table=11

SEQ ID NO: 43697 - protein, 488 aa, Xanthomonas oryzae pv. oryzae KACC10331; identical to SEQ ID NO: 30454

SEQ ID NO: 43698 - DNA, 1515 bp, Vibrio fischeri ES114; identical to SEQ ID NO: 30455
  CDS (1)..(1515): transl_table=11

SEQ ID NO: 43699 - protein, 504 aa, Vibrio fischeri ES114; identical to SEQ ID NO: 30456

SEQ ID NO: 43700 - DNA, 1545 bp, Neisseria gonorrhoeae FA 1090; identical to SEQ ID NO: 30457
  CDS (1)..(1545): transl_table=11

SEQ ID NO: 43701 - protein, 514 aa, Neisseria gonorrhoeae FA 1090; identical to SEQ ID NO: 30458

SEQ ID NO: 43702 - DNA, 1458 bp, Brucella abortus biovar 1 str. 9-941; identical to SEQ ID NO: 30459
  CDS (1)..(1458): transl_table=11

SEQ ID NO: 43703 - protein, 485 aa, Brucella abortus biovar 1 str. 9-941; identical to SEQ ID NO: 30460

SEQ ID NO: 43704 - DNA, 1485 bp, Corynebacterium glutamicum ATCC 13032; identical to SEQ ID NO: 30461
  CDS (1)..(1485): transl_table=11

SEQ ID NO: 43705 - protein, 494 aa, Corynebacterium glutamicum ATCC 13032; identical to SEQ ID NO: 30462

SEQ ID NO: 43706 - DNA, 1509 bp, Pseudomonas syringae pv. syringae B728a; identical to SEQ ID NO: 30463
  CDS (1)..(1509): transl_table=11

SEQ ID NO: 43707 - protein, 502 aa, Pseudomonas syringae pv. syringae B728a; identical to SEQ ID NO: 30464

SEQ ID NO: 43708 - DNA, 1518 bp, Haemophilus influenzae 86-028NP; identical to SEQ ID NO: 30465
  CDS (1)..(1518): transl_table=11

SEQ ID NO: 43709 - protein, 505 aa, Haemophilus influenzae 86-028NP; identical to SEQ ID NO: 30466

SEQ ID NO: 43710 - DNA, 1488 bp, Corynebacterium jeikeium K411; identical to SEQ ID NO: 30467
  CDS (1)..(1488): transl_table=11

SEQ ID NO: 43711 - protein, 495 aa, Corynebacterium jeikeium K411; identical to SEQ ID NO: 30468

SEQ ID NO: 43712 - DNA, 1485 bp, Staphylococcus haemolyticus JCSC1435; identical to SEQ ID NO: 30469
  CDS (1)..(1485): transl_table=11

SEQ ID NO: 43713 - protein, 494 aa, Staphylococcus haemolyticus JCSC1435; identical to SEQ ID NO: 30470

SEQ ID NO: 43714 - DNA, 1335 bp, Sulfolobus acidocaldarius DSM 639; identical to SEQ ID NO: 30471
  CDS (1)..(1335): transl_table=11

SEQ ID NO: 43715 - protein, 444 aa, Sulfolobus acidocaldarius DSM 639; identical to SEQ ID NO: 30472

SEQ ID NO: 43716 - DNA, 1215 bp, Sulfolobus acidocaldarius DSM 639; identical to SEQ ID NO: 30473
  CDS (1)..(1215): transl_table=11

SEQ ID NO: 43717 - protein, 404 aa, Sulfolobus acidocaldarius DSM 639; identical to SEQ ID NO: 30474

SEQ ID NO: 43718 - DNA, 1506 bp, Pseudomonas fluorescens Pf-5; identical to SEQ ID NO: 30475
  CDS (1)..(1506): transl_table=11

SEQ ID NO: 43719 - protein, 501 aa, Pseudomonas fluorescens Pf-5; identical to SEQ ID NO: 30476

SEQ ID NO: 43720 - DNA, 1536 bp, Psychrobacter arcticum 273-4; identical to SEQ ID NO: 30477
  CDS (1)..(1536): transl_table=11

SEQ ID NO: 43721 - protein, 511 aa, Psychrobacter arcticum 273-4; identical to SEQ ID NO: 30478

SEQ ID NO: 43722 - DNA, 1482 bp, Candidatus Pelagibacter ubique HTCC1062; identical to SEQ ID NO: 30479
  CDS (1)..(1482): transl_table=11

SEQ ID NO: 43723 - protein, 493 aa, Candidatus Pelagibacter ubique HTCC1062; identical to SEQ ID NO: 30480

SEQ ID NO: 43724 - DNA, 1518 bp, Colwellia psychrerythraea 34H; identical to SEQ ID NO: 30481
  CDS (1)..(1518): transl_table=11

SEQ ID NO: 43725 - protein, 505 aa, Colwellia psychrerythraea 34H; identical to SEQ ID NO: 30482

SEQ ID NO: 43726 - DNA, 1509 bp, Pseudomonas syringae pv. phaseolicola 1448A; identical to SEQ ID NO: 30483
  CDS (1)..(1509): transl_table=11

SEQ ID NO: 43727 - protein, 502 aa, Pseudomonas syringae pv. phaseolicola 1448A; identical to SEQ ID NO: 30484

SEQ ID NO: 43728 - DNA, 1512 bp, Streptococcus pyogenes MGAS6180; identical to SEQ ID NO: 30485
  CDS (1)..(1512): transl_table=11

SEQ ID NO: 43729 - protein, 503 aa, Streptococcus pyogenes MGAS6180; identical to SEQ ID NO: 30486

SEQ ID NO: 43730 - DNA, 1455 bp, Streptococcus pyogenes MGAS5005; identical to SEQ ID NO: 30487
  CDS (1)..(1455): transl_table=11

SEQ ID NO: 43731 - protein, 484 aa, Streptococcus pyogenes MGAS5005; identical to SEQ ID NO: 30488

SEQ ID NO: 43732 - DNA, 1518 bp, Dechloromonas aromatica RCB; identical to SEQ ID NO: 30489
  CDS (1)..(1518): transl_table=11

SEQ ID NO: 43733 - protein, 505 aa, Dechloromonas aromatica RCB; identical to SEQ ID NO: 30490

SEQ ID NO: 43734 - DNA, 1455 bp, Thermobifida fusca YX; identical to SEQ ID NO: 30491
  CDS (1)..(1455): transl_table=11

SEQ ID NO: 43735 - protein, 484 aa, Thermobifida fusca YX; identical to SEQ ID NO: 30492

SEQ ID NO: 43736 - DNA, 1527 bp, Ralstonia eutropha JMP134; identical to SEQ ID NO: 30493
  CDS (1)..(1527): transl_table=11

SEQ ID NO: 43737 - protein, 508 aa, Ralstonia eutropha JMP134; identical to SEQ ID NO: 30494

SEQ ID NO: 43738 - DNA, 1488 bp, Staphylococcus saprophyticus subsp. saprophyticus ATCC 15305; identical to SEQ ID NO: 30495
  CDS (1)..(1488): transl_table=11

SEQ ID NO: 43739 - protein, 495 aa, Staphylococcus saprophyticus subsp. saprophyticus ATCC 15305; identical to SEQ ID NO: 30496

SEQ ID NO: 43740 - DNA, 1389 bp, Ehrlichia canis str. Jake; identical to SEQ ID NO: 30497
  CDS (1)..(1389): transl_table=11

SEQ ID NO: 43741 - protein, 462 aa, Ehrlichia canis str. Jake; identical to SEQ ID NO: 30498

SEQ ID NO: 43742 - DNA, 1434 bp, Methanosarcina barkeri str. fusaro; identical to SEQ ID NO: 30499
  CDS (1)..(1434): transl_table=11

SEQ ID NO: 43743 - protein, 477 aa, Methanosarcina barkeri str. fusaro; identical to SEQ ID NO: 30500

SEQ ID NO: 43744 - DNA, 1419 bp, Dehalococcoides sp. CBDB1; identical to SEQ ID NO: 30501
  CDS (1)..(1419): transl_table=11

SEQ ID NO: 43745 - protein, 472 aa, Dehalococcoides sp. CBDB1; identical to SEQ ID NO: 30502

SEQ ID NO: 43746 - DNA, 1521 bp, Thiobacillus denitrificans ATCC 25259; identical to SEQ ID NO: 30503
  CDS (1)..(1521): transl_table=11

SEQ ID NO: 43747 - protein, 506 aa, Thiobacillus denitrificans ATCC 25259; identical to SEQ ID NO: 30504

SEQ ID NO: 43748 - DNA, 1518 bp, Haemophilus influenzae R2866; identical to SEQ ID NO: 30505
  CDS (1)..(1518)

SEQ ID NO: 43749 - protein, 505 aa, Haemophilus influenzae R2866; identical to SEQ ID NO: 30506

SEQ ID NO: 43750 - DNA, 1515 bp, Microbulbifer degradans 2-40; identical to SEQ ID NO: 30507
  CDS (1)..(1515)

SEQ ID NO: 43751 - protein, 504 aa, Microbulbifer degradans 2-40; identical to SEQ ID NO: 30508

SEQ ID NO: 43752 - DNA, 1341 bp, Campylobacter upsaliensis RM3195; identical to SEQ ID NO: 30509
  CDS (1)..(1341): transl_table=11

SEQ ID NO: 43753 - protein, 446 aa, Campylobacter upsaliensis RM3195; identical to SEQ ID NO: 30510

SEQ ID NO: 43754 - DNA, 1521 bp, Lactococcus lactis subsp. cremoris SK11; identical to SEQ ID NO: 30511
  CDS (1)..(1521)

SEQ ID NO: 43755 - protein, 506 aa, Lactococcus lactis subsp. cremoris SK11; identical to SEQ ID NO: 30512

SEQ ID NO: 43756 - DNA, 1023 bp, Chromohalobacter salexigens DSM 3043; identical to SEQ ID NO: 30513
  CDS (1)..(1023): transl_table=11

SEQ ID NO: 43757 - protein, 340 aa, Chromohalobacter salexigens DSM 3043; identical to SEQ ID NO: 30514

SEQ ID NO: 43758 - DNA, 1515 bp, Shewanella amazonensis SB2B; identical to SEQ ID NO: 30515
  CDS (1)..(1515): transl_table=11

SEQ ID NO: 43759 - protein, 504 aa, Shewanella amazonensis SB2B; identical to SEQ ID NO: 30516

SEQ ID NO: 43760 - DNA, 1497 bp, Prosthecochloris aestuarii DSM 271; identical to SEQ ID NO: 30517
  CDS (1)..(1497): transl_table=11

SEQ ID NO: 43761 - protein, 498 aa, Prosthecochloris aestuarii DSM 271; identical to SEQ ID NO: 30518

SEQ ID NO: 43762 - DNA, 1515 bp, Shewanella frigidimarina NCIMB 400; identical to SEQ ID NO: 30519
  CDS (1)..(1515): transl_table=11

SEQ ID NO: 43763 - protein, 504 aa, Shewanella frigidimarina NCIMB 400; identical to SEQ ID NO: 30520

SEQ ID NO: 43764 - DNA, 1704 bp, Vigna unguiculata; identical to SEQ ID NO: 30521
  CDS (1)..(1704)

SEQ ID NO: 43765 - protein, 567 aa, Vigna unguiculata; identical to SEQ ID NO: 30522

SEQ ID NO: 43766 - DNA, 1473 bp, Corynebacterium ammoniagenes; identical to SEQ ID NO: 30523
  CDS (1)..(1473): transl_table=11

SEQ ID NO: 43767 - protein, 490 aa, Corynebacterium ammoniagenes; identical to SEQ ID NO: 30524

SEQ ID NO: 43768 - DNA, 1536 bp, Arabidopsis thaliana; identical to SEQ ID NO: 30525
  CDS (1)..(1536)

SEQ ID NO: 43769 - protein, 511 aa, Arabidopsis thaliana; identical to SEQ ID NO: 30526

SEQ ID NO: 43770 - DNA, 1835 bp, Mus musculus; identical to SEQ ID NO: 30527
  CDS (120)..(1673)

SEQ ID NO: 43771 - protein, 517 aa, Mus musculus; identical to SEQ ID NO: 30528

SEQ ID NO: 43772 - DNA, 1677 bp, Mus musculus; identical to SEQ ID NO: 30529
  CDS (1)..(1677)

SEQ ID NO: 43773 - protein, 558 aa, Mus musculus; identical to SEQ ID NO: 30530

SEQ ID NO: 43774 - DNA, 1554 bp, Mus musculus; identical to SEQ ID NO: 30531
  CDS (1)..(1554)

SEQ ID NO: 43775 - protein, 517 aa, Mus musculus; identical to SEQ ID NO: 30532

SEQ ID NO: 43776 - DNA, 1554 bp, Homo sapiens; identical to SEQ ID NO: 30533
  CDS (1)..(1554)

SEQ ID NO: 43777 - protein, 517 aa, Homo sapiens; identical to SEQ ID NO: 30534

SEQ ID NO: 43778 - DNA, 1686 bp, Arabidopsis thaliana; identical to SEQ ID NO: 30535
  CDS (1)..(1686)

SEQ ID NO: 43779 - protein, 561 aa, Arabidopsis thaliana; identical to SEQ ID NO: 30536

SEQ ID NO: 43780 - DNA, 1527 bp, Brachydanio rerio; identical to SEQ ID NO: 30537
  CDS (1)..(1527)

SEQ ID NO: 43781 - protein, 508 aa, Brachydanio rerio; identical to SEQ ID NO: 30538

SEQ ID NO: 43782 - DNA, 1722 bp, Nicotiana tabacum; identical to SEQ ID NO: 30539
  CDS (1)..(1722)

SEQ ID NO: 43783 - protein, 573 aa, Nicotiana tabacum; identical to SEQ ID NO: 30540

SEQ ID NO: 43784 - DNA, 1641 bp, Neurospora crassa; identical to SEQ ID NO: 30541
  CDS (1)..(1641)

SEQ ID NO: 43785 - protein, 546 aa, Neurospora crassa; identical to SEQ ID NO: 30542

SEQ ID NO: 43786 - DNA, 1620 bp, Drosophila virilis; identical to SEQ ID NO: 30543
  CDS (1)..(1620)

SEQ ID NO: 43787 - protein, 539 aa, Drosophila virilis; identical to SEQ ID NO: 30544

SEQ ID NO: 43788 - DNA, 1635 bp, Drosophila virilis; identical to SEQ ID NO: 30545
  CDS (1)..(1635)

SEQ ID NO: 43789 - protein, 544 aa, Drosophila virilis; identical to SEQ ID NO: 30546

SEQ ID NO: 43790 - DNA, 1470 bp, Thermoplasma volcanium; identical to SEQ ID NO: 30547
  CDS (1)..(1470): transl_table=11

SEQ ID NO: 43791 - protein, 489 aa, Thermoplasma volcanium; identical to SEQ ID NO: 30548

SEQ ID NO: 43792 - DNA, 1536 bp, Mycobacterium smegmatis; identical to SEQ ID NO: 30549
  CDS (1)..(1536): transl_table=11

SEQ ID NO: 43793 - protein, 511 aa, Mycobacterium smegmatis; identical to SEQ ID NO: 30550

SEQ ID NO: 43794 - DNA, 1527 bp, Zymomonas mobilis; identical to SEQ ID NO: 30551
  CDS (1)..(1527): transl_table=11

SEQ ID NO: 43795 - protein, 508 aa, Zymomonas mobilis; identical to SEQ ID NO: 30552

SEQ ID NO: 43796 - DNA, 1473 bp, Corynebacterium ammoniagenes; identical to SEQ ID NO: 30553
  CDS (1)..(1473): transl_table=11

SEQ ID NO: 43797 - protein, 490 aa, Corynebacterium ammoniagenes; identical to SEQ ID NO: 30554

SEQ ID NO: 43798 - DNA, 1521 bp, Lactococcus lactis; identical to SEQ ID NO: 30555
  CDS (1)..(1521): transl_table=11

SEQ ID NO: 43799 - protein, 506 aa, Lactococcus lactis; identical to SEQ ID NO: 30556

SEQ ID NO: 43800 - DNA, 1374 bp, Archaeoglobus fulgidus; identical to SEQ ID NO: 30165
  CDS (1)..(1374)

SEQ ID NO: 43801 - protein, 457 aa, Archaeoglobus fulgidus; identical to SEQ ID NO: 30166

SEQ ID NO: 43802 - DNA, 1431 bp, Bacillus subtilis; identical to SEQ ID NO: 30559
  CDS (1)..(1431): transl_table=11

SEQ ID NO: 43803 - protein, 476 aa, Bacillus subtilis; identical to SEQ ID NO: 30560

SEQ ID NO: 43804 - DNA, 1533 bp, Gallus gallus; identical to SEQ ID NO: 30561
  CDS (1)..(1533)

SEQ ID NO: 43805 - protein, 510 aa, Gallus gallus; identical to SEQ ID NO: 30562

SEQ ID NO: 43806 - DNA, 1641 bp, Drosophila melanogaster; identical to SEQ ID NO: 30563
  CDS (1)..(1641)

SEQ ID NO: 43807 - protein, 546 aa, Drosophila melanogaster; identical to SEQ ID NO: 30564

SEQ ID NO: 43808 - DNA, 1518 bp, Haemophilus influenzae; identical to SEQ ID NO: 30219
  CDS (1)..(1518)

SEQ ID NO: 43809 - protein, 505 aa, Haemophilus influenzae; identical to SEQ ID NO: 30220

SEQ ID NO: 43810 - DNA, 1554 bp, Homo sapiens; identical to SEQ ID NO: 30567
  CDS (1)..(1554)

SEQ ID NO: 43811 - protein, 517 aa, Homo sapiens; identical to SEQ ID NO: 30568

SEQ ID NO: 43812 - DNA, 1416 bp, Methanococcus jannaschii; identical to SEQ ID NO: 30185
  CDS (1)..(1416)

SEQ ID NO: 43813 - protein, 471 aa, Methanococcus jannaschii; identical to SEQ ID NO: 30186

SEQ ID NO: 43814 - DNA, 1425 bp, Methanobacterium thermoautotrophicum; identical to SEQ ID NO: 30571
  CDS (1)..(1425): transl_table=11

SEQ ID NO: 43815 - protein, 474 aa, Methanobacterium thermoautotrophicum; identical to SEQ ID NO: 30572

SEQ ID NO: 43816 - DNA, 1584 bp, Mycobacterium bovis; identical to SEQ ID NO: 30573
  CDS (1)..(1584): transl_table=11

SEQ ID NO: 43817 - protein, 527 aa, Mycobacterium bovis; identical to SEQ ID NO: 30574

SEQ ID NO: 43818 - DNA, 1671 bp, Mycobacterium leprae; identical to SEQ ID NO: 30575
  CDS (1)..(1671): transl_table=11

SEQ ID NO: 43819 - protein, 556 aa, Mycobacterium leprae; identical to SEQ ID NO: 30576

SEQ ID NO: 43820 - DNA, 1344 bp, Pyrococcus abyssi; identical to SEQ ID NO: 30577
  CDS (1)..(1344): transl_table=11

SEQ ID NO: 43821 - protein, 447 aa, Pyrococcus abyssi; identical to SEQ ID NO: 30578

SEQ ID NO: 43822 - DNA, 1350 bp, Pyrococcus horikoshii; identical to SEQ ID NO: 30579
  CDS (1)..(1350): transl_table=11

SEQ ID NO: 43823 - protein, 449 aa, Pyrococcus horikoshii; identical to SEQ ID NO: 30580

SEQ ID NO: 43824 - DNA, 1554 bp, Rattus norvegicus; identical to SEQ ID NO: 30581
  CDS (1)..(1554)

SEQ ID NO: 43825 - protein, 517 aa, Rattus norvegicus; identical to SEQ ID NO: 30582

SEQ ID NO: 43826 - DNA, 1497 bp, Rhizobium etli; identical to SEQ ID NO: 30583
  CDS (1)..(1497): transl_table=11

SEQ ID NO: 43827 - protein, 498 aa, Rhizobium etli; identical to SEQ ID NO: 30584

SEQ ID NO: 43828 - DNA, 1533 bp, Saccharomyces kluyveri; identical to SEQ ID NO: 30585
  CDS (1)..(1533)

SEQ ID NO: 43829 - protein, 510 aa, Saccharomyces kluyveri; identical to SEQ ID NO: 30586

SEQ ID NO: 43830 - DNA, 1602 bp, Schizosaccharomyces pombe; identical to SEQ ID NO: 30587
  CDS (1)..(1602)

SEQ ID NO: 43831 - protein, 533 aa, Schizosaccharomyces pombe; identical to SEQ ID NO: 30588

SEQ ID NO: 43832 - DNA, 1710 bp, Glycine max; identical to SEQ ID NO: 30589
  CDS (1)..(1710)

SEQ ID NO: 43833 - protein, 569 aa, Glycine max; identical to SEQ ID NO: 30590

SEQ ID NO: 43834 - DNA, 1485 bp, Staphylococcus aureus; identical to SEQ ID NO: 30591
  CDS (1)..(1485): transl_table=11

SEQ ID NO: 43835 - protein, 494 aa, Staphylococcus aureus; identical to SEQ ID NO: 30592

SEQ ID NO: 43836 - DNA, 1482 bp, Synechococcus sp; identical to SEQ ID NO: 30593
  CDS (1)..(1482): transl_table=11

SEQ ID NO: 43837 - protein, 493 aa, Synechococcus sp; identical to SEQ ID NO: 30594

SEQ ID NO: 43838 - DNA, 1488 bp, Synechocystis sp; identical to SEQ ID NO: 30595
  CDS (1)..(1488): transl_table=11

SEQ ID NO: 43839 - protein, 495 aa, Synechocystis sp; identical to SEQ ID NO: 30596

SEQ ID NO: 43840 - DNA, 1533 bp, Saccharomyces cerevisiae; identical to SEQ ID NO: 30597
  CDS (1)..(1533)

SEQ ID NO: 43841 - protein, 510 aa, Saccharomyces cerevisiae; identical to SEQ ID NO: 30598

SEQ ID NO: 43842 - DNA, 23 bp, Artificial sequence
  (1)..(23): primer
atgtgcggtattgtcggtatcgc

SEQ ID NO: 43843 - DNA, 27 bp, Artificial sequence
  (1)..(27): primer
ttatccttcgttatgcatttcgagatt

SEQ ID NO: 43844 - protein, 641 aa, Artificial sequence; identical to SEQ ID NO: 30601
  Variant (4)..(4): xaa in position 4 is any amino acid
  Variant (7)..(17): xaa in position 7 to 17 is any amino acid
  Variant (18)..(33): xaa in position 18 to 33 is any or no amino acid
  Variant (36)..(37): xaa in position 36 to 37 is any amino acid
  Variant (45)..(45): xaa in position 45 is any amino acid
  Variant (49)..(55): xaa in position 49 to 55 is any amino acid
  Variant (56)..(67): xaa in position 56 to 67 is any or no amino acid
  Variant (69)..(70): xaa in position 69 to 70 is any amino acid
  Variant (74)..(75): xaa in position 74 to 75 is any amino acid
  Variant (78)..(79): xaa in position 78 to 79 is any amino acid
  Variant (80)..(88): xaa in position 80 to 88 is any or no amino acid
  Variant (90)..(103): xaa in position 90 to 103 is any or no amino acid
  Variant (105)..(105): xaa in position 105 is any or no amino acid
  Variant (107)..(108): xaa in position 107 to 108 is any or no amino acid
  Variant (113)..(113): xaa in position 113 is any amino acid
  Variant (116)..(116): xaa in position 116 is any amino acid
  Variant (118)..(118): xaa in position 118 is any amino acid
  Variant (120)..(123): xaa in position 120 to 123 is any amino acid
  Variant (124)..(129): xaa in position 124 to 129 is any or no amino acid
  Variant (132)..(139): xaa in position 132 to 139 is any or no amino acid
  Variant (141)..(142): xaa in position 141 to 142 is any or no amino acid
  Variant (144)..(144): xaa in position 144 is any or no amino acid
  Variant (146)..(146): xaa in position 146 is any or no amino acid
  Variant (152)..(152): xaa in position 152 is any or no amino acid
  Variant (154)..(155): xaa in position 154 to 155 is any amino acid
  Variant (156)..(156): xaa in position 156 is any or no amino acid
  Variant (158)..(163): xaa in position 158 to 163 is any or no amino acid
  Variant (165)..(180): xaa in position 165 to 180 is any or no amino acid
  Variant (182)..(184): xaa in position 182 to 184 is any or no amino acid
  Variant (191)..(192): xaa in position 191 to 192 is any amino acid
  Variant (194)..(205): xaa in position 194 to 205 is any amino acid
  Variant (206)..(228): xaa in position 206 to 228 is any or no amino acid
  Variant (233)..(235): xaa in position 233 to 235 is any amino acid
  Variant (236)..(236): xaa in position 236 is any or no amino acid
  Variant (238)..(241): xaa in position 238 to 241 is any amino acid
  Variant (243)..(243): xaa in position 243 is any amino acid
  Variant (245)..(245): xaa in position 245 is any amino acid
  Variant (249)..(249): xaa in position 249 is any amino acid
  Variant (251)..(251): xaa in position 251 is any amino acid
  Variant (255)..(255): xaa in position 255 is any amino acid
  Variant (258)..(261): xaa in position 258 to 261 is any amino acid
  Variant (262)..(277): xaa in position 262 to 277 is any or no amino acid
  Variant (285)..(285): xaa in position 285 is any amino acid
  Variant (287)..(288): xaa in position 287 to 288 is any amino acid
  Variant (289)..(289): xaa in position 289 is any or no amino acid
  Variant (291)..(293): xaa in position 291 to 293 is any amino acid
  Variant (294)..(299): xaa in position 294 to 299 is any or no amino acid
  Variant (303)..(303): xaa in position 303 is any amino acid
  Variant (307)..(307): xaa in position 307 is any amino acid
  Variant (309)..(309): xaa in position 309 is any amino acid
  Variant (311)..(326): xaa in position 311 to 326 is any amino acid
  Variant (327)..(343): xaa in position 327 to 343 is any or no amino acid
  Variant (345)..(345): xaa in position 345 is any amino acid
  Variant (357)..(357): xaa in position 357 is any or no amino acid
  Variant (359)..(361): xaa in position 359 to 361 is any amino acid
  Variant (362)..(362): xaa in position 362 is any or no amino acid
  Variant (365)..(366): xaa in position 365 to 366 is any amino acid
  Variant (368)..(370): xaa in position 368 to 370 is any amino acid
  Variant (372)..(373): xaa in position 372 to 373 is any amino acid
  Variant (376)..(382): xaa in position 376 to 382 is any amino acid
  Variant (383)..(390): xaa in position 383 to 390 is any or no amino acid
  Variant (395)..(395): xaa in position 395 is any amino acid
  Variant (400)..(402): xaa in position 400 to 402 is any amino acid
  Variant (406)..(407): xaa in position 406 to 407 is any amino acid
  Variant (409)..(412): xaa in position 409 to 412 is any amino acid
  Variant (414)..(414): xaa in position 414 is any amino acid
  Variant (415)..(443): xaa in position 415 to 443 is any or no amino acid
  Variant (445)..(446): xaa in position 445 to 446 is any amino acid
  Variant (448)..(448): xaa in position 448 is any amino acid
  Variant (452)..(452): xaa in position 452 is any amino acid
  Variant (460)..(460): xaa in position 460 is any amino acid
  Variant (462)..(463): xaa in position 462 to 463 is any or no amino acid
  Variant (465)..(466): xaa in position 465 to 466 is any or no amino acid
  Variant (468)..(470): xaa in position 468 to 470 is any amino acid
  Variant (473)..(473): xaa in position 473 is any amino acid
  Variant (475)..(477): xaa in position 475 to 477 is any amino acid
  Variant (479)..(483): xaa in position 479 to 483 is any amino acid
  Variant (484)..(484): xaa in position 484 is any or no amino acid
  Variant (486)..(486): xaa in position 486 is any amino acid
  Variant (500)..(502): xaa in position 500 to 502 is any amino acid
  Variant (505)..(505): xaa in position 505 is any amino acid
  Variant (507)..(507): xaa in position 507 is any amino acid
  Variant (509)..(509): xaa in position 509 is any amino acid
  Variant (512)..(512): xaa in position 512 is any or no amino acid
  Variant (514)..(515): xaa in position 514 to 515 is any amino acid
  Variant (518)..(520): xaa in position 518 to 520 is any amino acid
  Variant (524)..(524): xaa in position 524 is any amino acid
  Variant (526)..(527): xaa in position 526 to 527 is any amino acid
  Variant (529)..(530): xaa in position 529 to 530 is any amino acid
  Variant (535)..(540): xaa in position 535 to 540 is any amino acid
  Variant (544)..(550): xaa in position 544 to 550 is any amino acid
  Variant (551)..(577): xaa in position 551 to 577 is any or no amino acid
  Variant (579)..(581): xaa in position 579 to 581 is any amino acid
  Variant (584)..(584): xaa in position 584 is any amino acid
  Variant (586)..(586): xaa in position 586 is any amino acid
  Variant (588)..(588): xaa in position 588 is any amino acid
  Variant (590)..(591): xaa in position 590 to 591 is any amino acid
  Variant (593)..(594): xaa in position 593 to 594 is any amino acid
  Variant (596)..(597): xaa in position 596 to 597 is any amino acid
  Variant (600)..(608): xaa in position 600 to 608 is any amino acid
  Variant (609)..(638): xaa in position 609 to 638 is any or no amino acid
  Variant (640)..(640): xaa in position 640 is any amino acid

SEQ ID NO: 43845 - protein, 15 aa, Artificial sequence
  Variant (2)..(3): xaa in position 2 to 3 is any or no amino acid
  Variant (5)..(5): xaa in position 5 is any or no amino acid
  Variant (11)..(11): xaa in position 11 is Asp or Glu
  Variant (12)..(12): xaa in position 12 is Ala, Gly or Ser
  Variant (13)..(13): xaa in position 13 is Ala, Ser or Thr
LXXLXQHRGQXXXGI

SEQ ID NO: 43846 - protein, 41 aa, Artificial sequence; identical to SEQ ID NO: 30603
  Variant (3)..(3): xaa in position 3 is Ala, Pro or Ser
  Variant (5)..(5): xaa in position 5 is Ala, Gln, Ser or Thr
  Variant (7)..(13): xaa in position 7 to 13 is any amino acid
  Variant (14)..(14): xaa in position 14 is any or no amino acid
  Variant (17)..(28): xaa in position 17 to 28 is any amino acid
  Variant (29)..(30): xaa in position 29 to 30 is any or no amino acid
  Variant (34)..(34): xaa in position 34 is Asp, Glu or Asn
  Variant (35)..(35): xaa in position 35 is Phe, Ile or Leu
  Variant (36)..(36): xaa in position 36 is any amino acid
  Variant (38)..(40): xaa in position 38 to 40 is any amino acid
  Variant (41)..(41): xaa in position 41 is Ile, Leu or Val

SEQ ID NO: 43847 - protein, 41 aa, Artificial sequence; identical to SEQ ID NO: 30603
  Variant (3)..(3): xaa in position 3 is Ala, Pro or Ser
  Variant (5)..(5): xaa in position 5 is Ala, Gln, Ser or Thr
  Variant (7)..(13): xaa in position 7 to 13 is any amino acid
  Variant (14)..(14): xaa in position 14 is any or no amino acid
  Variant (17)..(28): xaa in position 17 to 28 is any amino acid
  Variant (29)..(30): xaa in position 29 to 30 is any or no amino acid
  Variant (34)..(34): xaa in position 34 is Asp, Glu or Asn
  Variant (35)..(35): xaa in position 35 is Phe, Ile or Leu
  Variant (36)..(36): xaa in position 36 is any amino acid
  Variant (38)..(40): xaa in position 38 to 40 is any amino acid
  Variant (41)..(41): xaa in position 41 is Ile, Leu or Val

SEQ ID NO: 43848 - protein, 20 aa, Artificial sequence
  Variant (3)..(3): xaa in position 3 is Ser or Thr
  Variant (4)..(4): xaa in position 4 is any amino acid
  Variant (5)..(5): xaa in position 5 is Ala, Gly, Ser or Val
  Variant (6)..(6): xaa in position 6 is Phe, Ile, Leu or Val
  Variant (7)..(14): xaa in position 7 to 14 is any amino acid
  Variant (16)..(16): xaa in position 16 is Asp, Glu, Asn, Gln, Ser or Thr
  Variant (17)..(17): xaa in position 17 is Phe, Ile, Leu or Val
  Variant (18)..(19): xaa in position 18 to 19 is any amino acid
SEXXXXXXXXXXXXRXXXXG

SEQ ID NO: 43849 - protein, 28 aa, Artificial sequence
  Variant (2)..(2): xaa in position 2 is any amino acid
  Variant (3)..(3): xaa in position 3 is Ile or Val
  Variant (5)..(5): xaa in position 5 is Phe or Leu
  Variant (6)..(6): xaa in position 6 is Ala or Ser
  Variant (11)..(11): xaa in position 11 is any amino acid
  Variant (12)..(12): xaa in position 12 is Phe, Ile, Leu, Met or Val
  Variant (13)..(16): xaa in position 13 to 16 is any amino acid
  Variant (17)..(17): xaa in position 17 is Ile, Leu or Val
  Variant (18)..(20): xaa in position 18 to 20 is any amino acid
  Variant (22)..(24): xaa in position 22 to 24 is any amino acid
  Variant (26)..(27): xaa in position 26 to 27 is any amino acid
EXXYXXRPDSXXXXXXXXXXRXXXGXXL

SEQ ID NO: 43850 - protein, 86 aa, Artificial sequence; identical to SEQ ID NO: 30607
  Variant (5)..(5): xaa in position 5 is any amino acid
  Variant (7)..(8): xaa in position 7 to 8 is any amino acid
  Variant (9)..(10): xaa in position 9 to 10 is any or no amino acid
  Variant (12)..(14): xaa in position 12 to 14 is any amino acid
  Variant (15)..(15): xaa in position 15 is Ile or Val
  Variant (16)..(17): xaa in position 16 to 17 is any amino acid
  Variant (19)..(19): xaa in position 19 is any amino acid
  Variant (20)..(20): xaa in position 20 is Gly, Asn, Ser or Thr
  Variant (21)..(21): xaa in position 21 is Ala, Pro, Thr or Val
  Variant (22)..(25): xaa in position 22 to 25 is any amino acid
  Variant (26)..(26): xaa in position 26 is Phe, Ile, Leu or Val
  Variant (27)..(30): xaa in position 27 to 30 is any amino acid
  Variant (31)..(31): xaa in position 31 is Ile, Leu or Val
  Variant (32)..(32): xaa in position 32 is any amino acid
  Variant (33)..(33): xaa in position 33 is Ile, Leu, Met or Val
  Variant (34)..(34): xaa in position 34 is Ile or Val
  Variant (42)..(42): xaa in position 42 is Asn or Thr
  Variant (44)..(46): xaa in position 44 to 46 is any amino acid
  Variant (47)..(47): xaa in position 47 is Ile, Leu or Val
  Variant (48)..(48): xaa in position 48 is Ile, Leu, Met or Val
  Variant (49)..(54): xaa in position 49 to 54 is any amino acid
  Variant (57)..(58): xaa in position 57 to 58 is any amino acid
  Variant (59)..(59): xaa in position 59 is Ile, Leu or Val
  Variant (60)..(63): xaa in position 60 to 63 is any amino acid
  Variant (64)..(64): xaa in position 64 is Ala, Cys, Gly, Ser, Thr or Val
  Variant (65)..(65): xaa in position 65 is any amino acid
  Variant (67)..(74): xaa in position 67 to 74 is any amino acid
  Variant (76)..(83): xaa in position 76 to 83 is any amino acid
  Variant (84)..(84): xaa in position 84 is Phe or Leu
  Variant (85)..(85): xaa in position 85 is Ile, Leu, Met or Val
  Variant (86)..(86): xaa in position 86 is Ala, Cys, Gly or Ser

SEQ ID NO: 43851 - DNA, 930 bp, Escherichia coli K12; identical to SEQ ID NO: 6852
  CDS (1)..(930)

SEQ ID NO: 43852 - protein, 309 aa, Escherichia coli K12; identical to SEQ ID NO: 6853

SEQ ID NO: 43853 - DNA, 1032 bp, Haemophilus influenzae; identical to SEQ ID NO: 6854
  CDS (1)..(1032)

SEQ ID NO: 43854 - protein, 343 aa, Haemophilus influenzae; identical to SEQ ID NO: 6855

SEQ ID NO: 43855 - DNA, 1089 bp, Xylella fastidiosa; identical to SEQ ID NO: 6856
  CDS (1)..(1089)

SEQ ID NO: 43856 - protein, 362 aa, Xylella fastidiosa; identical to SEQ ID NO: 6857

SEQ ID NO: 43857 - DNA, 924 bp, Pseudomonas aeruginosa; identical to SEQ ID NO: 6858
  CDS (1)..(924)

SEQ ID NO: 43858 - protein, 307 aa, Pseudomonas aeruginosa; identical to SEQ ID NO: 6859

SEQ ID NO: 43859 - DNA, 882 bp, Brucella melitensis; identical to SEQ ID NO: 6860
  CDS (1)..(882)

SEQ ID NO: 43860 - protein, 293 aa, Brucella melitensis; identical to SEQ ID NO: 6861

SEQ ID NO: 43861 - DNA, 870 bp, Listeria monocytogenes; identical to SEQ ID NO: 6862
  CDS (1)..(870)

SEQ ID NO: 43862 - protein, 289 aa, Listeria monocytogenes; identical to SEQ ID NO: 6863

SEQ ID NO: 43863 - DNA, 870 bp, Listeria innocua; identical to SEQ ID NO: 6864
  CDS (1)..(870)

SEQ ID NO: 43864 - protein, 289 aa, Listeria innocua; identical to SEQ ID NO: 6865

SEQ ID NO: 43865 - DNA, 882 bp, Agrobacterium tumefaciens; identical to SEQ ID NO: 6866
  CDS (1)..(882)

SEQ ID NO: 43866 - protein, 293 aa, Agrobacterium tumefaciens; identical to SEQ ID NO: 6867

SEQ ID NO: 43867 - DNA, 1020 bp, Listeria innocua; identical to SEQ ID NO: 6868
  CDS (1)..(1020)

SEQ ID NO: 43868 - protein, 339 aa, Listeria innocua; identical to SEQ ID NO: 6869

SEQ ID NO: 43869 - DNA, 927 bp, Yersinia pestis; identical to SEQ ID NO: 6870
  CDS (1)..(927)

SEQ ID NO: 43870 - protein, 308 aa, Yersinia pestis; identical to SEQ ID NO: 6871

SEQ ID NO: 43871 - DNA, 927 bp, Halobacterium sp. NRC-1; identical to SEQ ID NO: 6872
  CDS (1)..(927)

SEQ ID NO: 43872 - protein, 308 aa, Halobacterium sp. NRC-1; identical to SEQ ID NO: 6873

SEQ ID NO: 43873 - DNA, 849 bp, Staphylococcus aureus; identical to SEQ ID NO: 6874
  CDS (1)..(849)

SEQ ID NO: 43874 - protein, 282 aa, Staphylococcus aureus; identical to SEQ ID NO: 6875

SEQ ID NO: 43875 - DNA, 936 bp, Aquifex aeolicus; identical to SEQ ID NO: 6876
  CDS (1)..(936)

SEQ ID NO: 43876 - protein, 311 aa, Aquifex aeolicus; identical to SEQ ID NO: 6877

SEQ ID NO: 43877 - DNA, 873 bp, Rickettsia prowazekii; identical to SEQ ID NO: 6878
  CDS (1)..(873)

SEQ ID NO: 43878 - protein, 290 aa, Rickettsia prowazekii; identical to SEQ ID NO: 6879

SEQ ID NO: 43879 - DNA, 822 bp, Thermotoga maritima; identical to SEQ ID NO: 6880
  CDS (1)..(822)

SEQ ID NO: 43880 - protein, 273 aa, Thermotoga maritima; identical to SEQ ID NO: 6881

SEQ ID NO: 43881 - DNA, 1077 bp, Deinococcus radiodurans; identical to SEQ ID NO: 6882
  CDS (1)..(1077)

SEQ ID NO: 43882 - protein, 358 aa, Deinococcus radiodurans; identical to SEQ ID NO: 6883

SEQ ID NO: 43883 - DNA, 852 bp, Bacillus halodurans; identical to SEQ ID NO: 6884
  CDS (1)..(852)

SEQ ID NO: 43884 - protein, 283 aa, Bacillus halodurans; identical to SEQ ID NO: 6885

SEQ ID NO: 43885 - DNA, 1104 bp, Arabidopsis thaliana (mouse-ear cress); identical to SEQ ID NO: 6886
  CDS (1)..(1104)

SEQ ID NO: 43886 - protein, 367 aa, Arabidopsis thaliana (mouse-ear cress); identical to SEQ ID NO: 6887

SEQ ID NO: 43887 - DNA, 1092 bp, Helicobacter pylori; identical to SEQ ID NO: 6888
  CDS (28)..(1050)

SEQ ID NO: 43888 - protein, 340 aa, Helicobacter pylori; identical to SEQ ID NO: 6889

SEQ ID NO: 43889 - DNA, 1023 bp, Helicobacter pylori; identical to SEQ ID NO: 6890
  CDS (1)..(1023)

SEQ ID NO: 43890 - protein, 340 aa, Helicobacter pylori; identical to SEQ ID NO: 6891

SEQ ID NO: 43891 - DNA, 999 bp, Neisseria meningitidis; identical to SEQ ID NO: 6892
  CDS (1)..(999)

SEQ ID NO: 43892 - protein, 332 aa, Neisseria meningitidis; identical to SEQ ID NO: 6893

SEQ ID NO: 43893 - DNA, 915 bp, Campylobacter jejuni; identical to SEQ ID NO: 6894
  CDS (1)..(915)

SEQ ID NO: 43894 - protein, 304 aa, Campylobacter jejuni; identical to SEQ ID NO: 6895

SEQ ID NO: 43895 - DNA, 999 bp, Neisseria meningitidis; identical to SEQ ID NO: 6896
  CDS (1)..(999)

SEQ ID NO: 43896 - protein, 332 aa, Neisseria meningitidis; identical to SEQ ID NO: 6897

SEQ ID NO: 43897 - DNA, 888 bp, Bacillus halodurans; identical to SEQ ID NO: 6898
  CDS (1)..(888)

SEQ ID NO: 43898 - protein, 295 aa, Bacillus halodurans; identical to SEQ ID NO: 6899

SEQ ID NO: 43899 - DNA, 1077 bp, Bacillus halodurans; identical to SEQ ID NO: 6900
  CDS (1)..(1077)

SEQ ID NO: 43900 - protein, 358 aa, Bacillus halodurans; identical to SEQ ID NO: 6901

SEQ ID NO: 43901 - DNA, 858 bp, Halobacterium sp. NRC-1; identical to SEQ ID NO: 6902
  CDS (1)..(858)

SEQ ID NO: 43902 - protein, 285 aa, Halobacterium sp. NRC-1; identical to SEQ ID NO: 6903

SEQ ID NO: 43903 - DNA, 1077 bp, Staphylococcus aureus; identical to SEQ ID NO: 6904
  CDS (1)..(1077)

SEQ ID NO: 43904 - protein, 358 aa, Staphylococcus aureus; identical to SEQ ID NO: 6905

SEQ ID NO: 43905 - DNA, 1196 bp, Arabidopsis thaliana (mouse-ear cress); identical to SEQ ID NO: 6906
  CDS (9)..(1079)

SEQ ID NO: 43906 - protein, 356 aa, Arabidopsis thaliana (mouse-ear cress); identical to SEQ ID NO: 6907

SEQ ID NO: 43907 - DNA, 1026 bp, Clostridium acetobutylicum; identical to SEQ ID NO: 6908
  CDS (1)..(1026)

SEQ ID NO: 43908 - protein, 341 aa, Clostridium acetobutylicum; identical to SEQ ID NO: 6909

SEQ ID NO: 43909 - DNA, 873 bp, Archaeoglobus fulgidus; identical to SEQ ID NO: 6910
  CDS (1)..(873)

SEQ ID NO: 43910 - protein, 290 aa, Archaeoglobus fulgidus; identical to SEQ ID NO: 6911

SEQ ID NO: 43911 - DNA, 849 bp, Bacillus subtilis; identical to SEQ ID NO: 6912
  CDS (1)..(849)

SEQ ID NO: 43912 - protein, 282 aa, Bacillus subtilis; identical to SEQ ID NO: 6913

SEQ ID NO: 43913 - DNA, 1023 bp, Streptococcus pneumoniae; identical to SEQ ID NO: 6914
  CDS (1)..(1023)

SEQ ID NO: 43914 - protein, 340 aa, Streptococcus pneumoniae; identical to SEQ ID NO: 6915

SEQ ID NO: 43915 - DNA, 867 bp, Methanococcus jannaschii; identical to SEQ ID NO: 6916
  CDS (1)..(867)

SEQ ID NO: 43916 - protein, 288 aa, Methanococcus jannaschii; identical to SEQ ID NO: 6917

SEQ ID NO: 43917 - DNA, 960 bp, Vibrio cholerae; identical to SEQ ID NO: 6918
  CDS (1)..(960)

SEQ ID NO: 43918 - protein, 319 aa, Vibrio cholerae; identical to SEQ ID NO: 6919

SEQ ID NO: 43919 - DNA, 891 bp, Caulobacter crescentus; identical to SEQ ID NO: 6920
  CDS (1)..(891)

SEQ ID NO: 43920 - protein, 296 aa, Caulobacter crescentus; identical to SEQ ID NO: 6921

SEQ ID NO: 43921 - DNA, 1071 bp, Bacillus subtilis; identical to SEQ ID NO: 6922
  CDS (1)..(1071)

SEQ ID NO: 43922 - protein, 356 aa, Bacillus subtilis; identical to SEQ ID NO: 6923

SEQ ID NO: 43923 - DNA, 1182 bp, Saccharomyces cerevisiae; identical to SEQ ID NO: 6924
  CDS (1)..(1182)

SEQ ID NO: 43924 - protein, 393 aa, Saccharomyces cerevisiae; identical to SEQ ID NO: 6925

SEQ ID NO: 43925 - DNA, 1131 bp, Saccharomyces cerevisiae; identical to SEQ ID NO: 6926
  CDS (1)..(1131)

SEQ ID NO: 43926 - protein, 376 aa, Saccharomyces cerevisiae; identical to SEQ ID NO: 6927

SEQ ID NO: 43927 - DNA, 1092 bp, Bacillus subtilis; identical to SEQ ID NO: 6928
  CDS (1)..(1092)

SEQ ID NO: 43928 - protein, 363 aa, Bacillus subtilis; identical to SEQ ID NO: 6929

SEQ ID NO: 43929 - DNA, 918 bp, Synechocystis sp; identical to SEQ ID NO: 6930
  CDS (1)..(918)

SEQ ID NO: 43930 - protein, 305 aa, Synechocystis sp; identical to SEQ ID NO: 6931

SEQ ID NO: 43931 - DNA, 1155 bp, Arabidopsis thaliana (mouse-ear cress); identical to SEQ ID NO: 6932
  CDS (1)..(1155)

SEQ ID NO: 43932 - protein, 384 aa, Arabidopsis thaliana (mouse-ear cress); identical to SEQ ID NO: 6933

SEQ ID NO: 43933 - DNA, 1167 bp, Arabidopsis thaliana (mouse-ear cress); identical to SEQ ID NO: 6934
  CDS (211)..(1167)

SEQ ID NO: 43934 - protein, 318 aa, Arabidopsis thaliana (mouse-ear cress); identical to SEQ ID NO: 6935

SEQ ID NO: 43935 - DNA, 4266 bp, Arabidopsis thaliana (mouse-ear cress); identical to SEQ ID NO: 6936
  CDS (1)..(4266)

SEQ ID NO: 43936 - protein, 1421 aa, Arabidopsis thaliana (mouse-ear cress); identical to SEQ ID NO: 6937

SEQ ID NO: 43937 - DNA, 1182 bp, Caenorhabditis elegans; identical to SEQ ID NO: 6938
  CDS (1)..(1182)

SEQ ID NO: 43938 - protein, 393 aa, Caenorhabditis elegans; identical to SEQ ID NO: 6939

SEQ ID NO: 43939 - DNA, 1089 bp, Streptomyces coelicolor; identical to SEQ ID NO: 6940
  CDS (1)..(1089)

SEQ ID NO: 43940 - protein, 362 aa, Streptomyces coelicolor; identical to SEQ ID NO: 6941

SEQ ID NO: 43941 - DNA, 1143 bp, Schizosaccharomyces pombe; identical to SEQ ID NO: 6942
  CDS (1)..(1143)

SEQ ID NO: 43942 - protein, 380 aa, Schizosaccharomyces pombe; identical to SEQ ID NO: 6943

SEQ ID NO: 43943 - DNA, 1107 bp, Mycobacterium leprae; identical to SEQ ID NO: 6944
  CDS (1)..(1107)

SEQ ID NO: 43944 - protein, 368 aa, Mycobacterium leprae; identical to SEQ ID NO: 6945

SEQ ID NO: 43945 - DNA, 1065 bp, Arabidopsis thaliana (mouse-ear cress); identical to SEQ ID NO: 6946
  CDS (1)..(1065)

SEQ ID NO: 43946 - protein, 354 aa, Arabidopsis thaliana (mouse-ear cress); identical to SEQ ID NO: 6947

SEQ ID NO: 43947 - DNA, 1062 bp, Mus musculus; identical to SEQ ID NO: 6948
  CDS (1)..(1062)

SEQ ID NO: 43948 - protein, 353 aa, Mus musculus; identical to SEQ ID NO: 6949

SEQ ID NO: 43949 - DNA, 876 bp, Symbiobacterium thermophilum; identical to SEQ ID NO: 6950
  CDS (1)..(876)

SEQ ID NO: 43950 - protein, 291 aa, Symbiobacterium thermophilum; identical to SEQ ID NO: 6951

SEQ ID NO: 43951 - DNA, 846 bp, Symbiobacterium thermophilum; identical to SEQ ID NO: 6952
  CDS (1)..(846)

SEQ ID NO: 43952 - protein, 281 aa, Symbiobacterium thermophilum; identical to SEQ ID NO: 6953

SEQ ID NO: 43953 - DNA, 1092 bp, Propionibacterium acnes; identical to SEQ ID NO: 6954
  CDS (1)..(1092)

SEQ ID NO: 43954 - protein, 363 aa, Propionibacterium acnes; identical to SEQ ID NO: 6955

SEQ ID NO: 43955 - DNA, 1134 bp, Leifsonia xyli; identical to SEQ ID NO: 6956
  CDS (1)..(1134)

SEQ ID NO: 43956 - protein, 377 aa, Leifsonia xyli; identical to SEQ ID NO: 6957

SEQ ID NO: 43957 - DNA, 1083 bp, Desulfotalea psychrophila; identical to SEQ ID NO: 6958
  CDS (1)..(1083)

SEQ ID NO: 43958 - protein, 360 aa, Desulfotalea psychrophila; identical to SEQ ID NO: 6959

SEQ ID NO: 43959 - DNA, 852 bp, Desulfotalea psychrophila; identical to SEQ ID NO: 6960
  CDS (1)..(852)

SEQ ID NO: 43960 - protein, 283 aa, Desulfotalea psychrophila; identical to SEQ ID NO: 6961

SEQ ID NO: 43961 - DNA, 1104 bp, Debaryomyces hansenii CBS767; identical to SEQ ID NO: 6962
  CDS (1)..(1104)

SEQ ID NO: 43962 - protein, 367 aa, Debaryomyces hansenii CBS767; identical to SEQ ID NO: 6963

SEQ ID NO: 43963 - DNA, 1167 bp, Yarrowia lipolytica CLIB99; identical to SEQ ID NO: 6964
  CDS (1)..(1167)

SEQ ID NO: 43964 - protein, 388 aa, Yarrowia lipolytica CLIB99; identical to SEQ ID NO: 6965

SEQ ID NO: 43965 - DNA, 918 bp, Erwinia carotovora; identical to SEQ ID NO: 6966
  CDS (1)..(918)

SEQ ID NO: 43966 - protein, 305 aa, Erwinia carotovora; identical to SEQ ID NO: 6967

SEQ ID NO: 43967 - DNA, 936 bp, Acinetobacter sp; identical to SEQ ID NO: 6968
  CDS (1)..(936)

SEQ ID NO: 43968 - protein, 311 aa, Acinetobacter sp; identical to SEQ ID NO: 6969

SEQ ID NO: 43969 - DNA, 1116 bp, Candida glabrata CBS138; identical to SEQ ID NO: 6970
  CDS (1)..(1116)

SEQ ID NO: 43970 - protein, 371 aa, Candida glabrata CBS138; identical to SEQ ID NO: 6971

SEQ ID NO: 43971 - DNA, 1188 bp, Candida glabrata CBS138; identical to SEQ ID NO: 6972
  CDS (1)..(1188)

SEQ ID NO: 43972 - protein, 395 aa, Candida glabrata CBS138; identical to SEQ ID NO: 6973

SEQ ID NO: 43973 - DNA, 1107 bp, Bartonella henselae; identical to SEQ ID NO: 6974
  CDS (1)..(1107)

SEQ ID NO: 43974 - protein, 368 aa, Bartonella henselae; identical to SEQ ID NO: 6975

SEQ ID NO: 43975 - DNA, 1077 bp, Staphylococcus aureus; identical to SEQ ID NO: 6976
  CDS (1)..(1077)

SEQ ID NO: 43976 - protein, 358 aa, Staphylococcus aureus; identical to SEQ ID NO: 6977

SEQ ID NO: 43977 - DNA, 885 bp, Bacillus thuringiensis; identical to SEQ ID NO: 6978
  CDS (1)..(885)

SEQ ID NO: 43978 - protein, 294 aa, Bacillus thuringiensis; identical to SEQ ID NO: 6979

SEQ ID NO: 43979 - DNA, 876 bp, Bacillus thuringiensis; identical to SEQ ID NO: 6980
  CDS (1)..(876)

SEQ ID NO: 43980 - protein, 291 aa, Bacillus thuringiensis; identical to SEQ ID NO: 6981

SEQ ID NO: 43981 - DNA, 873 bp, Bacillus thuringiensis; identical to SEQ ID NO: 6982
  CDS (1)..(873)

SEQ ID NO: 43982 - protein, 290 aa, Bacillus thuringiensis; identical to SEQ ID NO: 6983

SEQ ID NO: 43983 - DNA, 939 bp, Photobacterium profundum; identical to SEQ ID NO: 6984
  CDS (1)..(939)

SEQ ID NO: 43984 - protein, 312 aa, Photobacterium profundum; identical to SEQ ID NO: 6985

SEQ ID NO: 43985 - DNA, 864 bp, Methanococcus maripaludis; identical to SEQ ID NO: 6986
  CDS (1)..(864)

SEQ ID NO: 43986 - protein, 287 aa, Methanococcus maripaludis; identical to SEQ ID NO: 6987

SEQ ID NO: 43987 - DNA, 975 bp, Bdellovibrio bacteriovorus; identical to SEQ ID NO: 6988
  CDS (1)..(975)

SEQ ID NO: 43988 - protein, 324 aa, Bdellovibrio bacteriovorus; identical to SEQ ID NO: 6989

SEQ ID NO: 43989 - DNA, 1068 bp, Bdellovibrio bacteriovorus; identical to SEQ ID NO: 6990
  CDS (1)..(1068)

SEQ ID NO: 43990 - protein, 355 aa, Bdellovibrio bacteriovorus; identical to SEQ ID NO: 6991

SEQ ID NO: 43991 - DNA, 885 bp, Rhodopseudomonas palustris; identical to SEQ ID NO: 6992
  CDS (1)..(885)

SEQ ID NO: 43992 - protein, 294 aa, Rhodopseudomonas palustris; identical to SEQ ID NO: 6993

SEQ ID NO: 43993 - DNA, 1113 bp, Rhodopseudomonas palustris; identical to SEQ ID NO: 6994
  CDS (1)..(1113)

SEQ ID NO: 43994 - protein, 370 aa, Rhodopseudomonas palustris; identical to SEQ ID NO: 6995

SEQ ID NO: 43995 - DNA, 1116 bp, Corynebacterium diphtheriae; identical to SEQ ID NO: 6996
  CDS (1)..(1116)

SEQ ID NO: 43996 - protein, 371 aa, Corynebacterium diphtheriae; identical to SEQ ID NO: 6997

SEQ ID NO: 43997 - DNA, 2014 bp, Brachydanio rerio; identical to SEQ ID NO: 6998
  CDS (20)..(1177)

SEQ ID NO: 43998 - protein, 385 aa, Brachydanio rerio; identical to SEQ ID NO: 6999

SEQ ID NO: 43999 - DNA, 915 bp, uncultured crenarchaeote; identical to SEQ ID NO: 7000
  CDS (1)..(915)

SEQ ID NO: 44000 - protein, 304 aa, uncultured crenarchaeote; identical to SEQ ID NO: 7001

SEQ ID NO: 44001 - DNA, 1194 bp, Hordeum vulgare; identical to SEQ ID NO: 7002
  CDS (1)..(1194)

SEQ ID NO: 44002 - protein, 397 aa, Hordeum vulgare; identical to SEQ ID NO: 7003

SEQ ID NO: 44003 - DNA, 870 bp, Listeria monocytogenes; identical to SEQ ID NO: 7004
  CDS (1)..(870)

SEQ ID NO: 44004 - protein, 289 aa, Listeria monocytogenes; identical to SEQ ID NO: 7005

SEQ ID NO: 44005 - DNA, 1020 bp, Listeria monocytogenes; identical to SEQ ID NO: 7006
  CDS (1)..(1020)

SEQ ID NO: 44006 - protein, 339 aa, Listeria monocytogenes; identical to SEQ ID NO: 7007

SEQ ID NO: 44007 - DNA, 930 bp, Desulfovibrio vulgaris; identical to SEQ ID NO: 7008
  CDS (1)..(930)

SEQ ID NO: 44008 - protein, 309 aa, Desulfovibrio vulgaris; identical to SEQ ID NO: 7009

SEQ ID NO: 44009 - DNA, 957 bp, Thermus thermophilus; identical to SEQ ID NO: 7010
  CDS (1)..(957)

SEQ ID NO: 44010 - protein, 318 aa, Thermus thermophilus; identical to SEQ ID NO: 7011

SEQ ID NO: 44011 - DNA, 957 bp, Leptospira interrogans; identical to SEQ ID NO: 7012
  CDS (1)..(957)

SEQ ID NO: 44012 - protein, 318 aa, Leptospira interrogans; identical to SEQ ID NO: 7013

SEQ ID NO: 44013 - DNA, 873 bp, Bacillus cereus; identical to SEQ ID NO: 7014
  CDS (1)..(873)

SEQ ID NO: 44014 - protein, 290 aa, Bacillus cereus; identical to SEQ ID NO: 7015

SEQ ID NO: 44015 - DNA, 876 bp, Bacillus cereus; identical to SEQ ID NO: 7016
  CDS (1)..(876)

SEQ ID NO: 44016 - protein, 291 aa, Bacillus cereus; identical to SEQ ID NO: 7017

SEQ ID NO: 44017 - DNA, 900 bp, Bacillus cereus; identical to SEQ ID NO: 7018
  CDS (1)..(900)

SEQ ID NO: 44018 - protein, 299 aa, Bacillus cereus; identical to SEQ ID NO: 7019

SEQ ID NO: 44019 - DNA, 897 bp, Bacillus cereus; identical to SEQ ID NO: 7020
  CDS (1)..(897)

SEQ ID NO: 44020 - protein, 298 aa, Bacillus cereus; identical to SEQ ID NO: 7021

SEQ ID NO: 44021 - DNA, 873 bp, Bacillus cereus; identical to SEQ ID NO: 7022
  CDS (1)..(873)

SEQ ID NO: 44022 - protein, 290 aa, Bacillus cereus; identical to SEQ ID NO: 7023

SEQ ID NO: 44023 - DNA, 1116 bp, Mycobacterium paratuberculosis; identical to SEQ ID NO: 7024
  CDS (1)..(1116)

SEQ ID NO: 44024 - protein, 371 aa, Mycobacterium paratuberculosis; identical to SEQ ID NO: 7025

SEQ ID NO: 44025 - DNA, 1074 bp, Geobacter sulfurreducens; identical to SEQ ID NO: 7026
  CDS (1)..(1074)

SEQ ID NO: 44026 - protein, 357 aa, Geobacter sulfurreducens; identical to SEQ ID NO: 7027

SEQ ID NO: 44027 - DNA, 897 bp, Nanoarchaeum equitans; identical to SEQ ID NO: 7028
  CDS (1)..(897)

SEQ ID NO: 44028 - protein, 298 aa, Nanoarchaeum equitans; identical to SEQ ID NO: 7029

SEQ ID NO: 44029 - DNA, 1140 bp, Corynebacterium glutamicum; identical to SEQ ID NO: 7030
  CDS (1)..(1140)

SEQ ID NO: 44030 - protein, 379 aa, Corynebacterium glutamicum; identical to SEQ ID NO: 7031

SEQ ID NO: 44031 - DNA, 1300 bp, Lactococcus lactis; identical to SEQ ID NO: 7032
  CDS (154)..(1176)

SEQ ID NO: 44032 - protein, 340 aa, Lactococcus lactis; identical to SEQ ID NO: 7033

SEQ ID NO: 44033 - DNA, 918 bp, Wolinella succinogenes; identical to SEQ ID NO: 7034
  CDS (1)..(918)

SEQ ID NO: 44034 - protein, 305 aa, Wolinella succinogenes; identical to SEQ ID NO: 7035

SEQ ID NO: 44035 - DNA, 939 bp, Vibrio vulnificus; identical to SEQ ID NO: 7036
  CDS (1)..(939)

SEQ ID NO: 44036 - protein, 312 aa, Vibrio vulnificus; identical to SEQ ID NO: 7037

SEQ ID NO: 44037 - DNA, 1020 bp, Porphyromonas gingivalis; identical to SEQ ID NO: 7038
  CDS (1)..(1020)

SEQ ID NO: 44038 - protein, 339 aa, Porphyromonas gingivalis; identical to SEQ ID NO: 7039

SEQ ID NO: 44039 - DNA, 927 bp, Photorhabdus luminescens; identical to SEQ ID NO: 7040
  CDS (1)..(927)

SEQ ID NO: 44040 - protein, 308 aa, Photorhabdus luminescens; identical to SEQ ID NO: 7041

SEQ ID NO: 44041 - DNA, 948 bp, Photorhabdus luminescens; identical to SEQ ID NO: 7042
  CDS (1)..(948)

SEQ ID NO: 44042 - protein, 315 aa, Photorhabdus luminescens; identical to SEQ ID NO: 7043

SEQ ID NO: 44043 - DNA, 876 bp, Gloeobacter violaceus; identical to SEQ ID NO: 7044
  CDS (1)..(876)

SEQ ID NO: 44044 - protein, 291 aa, Gloeobacter violaceus; identical to SEQ ID NO: 7045

SEQ ID NO: 44045 - DNA, 960 bp, Gloeobacter violaceus; identical to SEQ ID NO: 7046
  CDS (1)..(960)

SEQ ID NO: 44046 - protein, 319 aa, Gloeobacter violaceus; identical to SEQ ID NO: 7047

SEQ ID NO: 44047 - DNA, 924 bp, Chromobacterium violaceum; identical to SEQ ID NO: 7048
  CDS (1)..(924)

SEQ ID NO: 44048 - protein, 307 aa, Chromobacterium violaceum; identical to SEQ ID NO: 7049

SEQ ID NO: 44049 - DNA, 1284 bp, Neurospora crassa; identical to SEQ ID NO: 7050
  CDS (1)..(1284)

SEQ ID NO: 44050 - protein, 427 aa, Neurospora crassa; identical to SEQ ID NO: 7051

SEQ ID NO: 44051 - DNA, 1242 bp, Neurospora crassa; identical to SEQ ID NO: 7052
  CDS (1)..(1242)

SEQ ID NO: 44052 - protein, 413 aa, Neurospora crassa; identical to SEQ ID NO: 7053

SEQ ID NO: 44053 - DNA, 915 bp, Prochlorococcus marinus subsp; identical to SEQ ID NO: 7054
  CDS (1)..(915)

SEQ ID NO: 44054 - protein, 304 aa, Prochlorococcus marinus subsp; identical to SEQ ID NO: 7055

SEQ ID NO: 44055 - DNA, 921 bp, Prochlorococcus marinus; identical to SEQ ID NO: 7056
  CDS (1)..(921)

SEQ ID NO: 44056 - protein, 306 aa, Prochlorococcus marinus; identical to SEQ ID NO: 7057

SEQ ID NO: 44057 - DNA, 1107 bp, Mycobacterium bovis; identical to SEQ ID NO: 7058
  CDS (1)..(1107)

SEQ ID NO: 44058 - protein, 368 aa, Mycobacterium bovis; identical to SEQ ID NO: 7059

SEQ ID NO: 44059 - DNA, 915 bp, Synechococcus sp; identical to SEQ ID NO: 7060
  CDS (1)..(915)

SEQ ID NO: 44060 - protein, 304 aa, Synechococcus sp; identical to SEQ ID NO: 7061

SEQ ID NO: 44061 - DNA, 858 bp, Rhodopirellula baltica; identical to SEQ ID NO: 7062
  CDS (1)..(858)

SEQ ID NO: 44062 - protein, 285 aa, Rhodopirellula baltica; identical to SEQ ID NO: 7063

SEQ ID NO: 44063 - DNA, 915 bp, Prochlorococcus marinus; identical to SEQ ID NO: 7064
  CDS (1)..(915)

SEQ ID NO: 44064 - protein, 304 aa, Prochlorococcus marinus; identical to SEQ ID NO: 7065

SEQ ID NO: 44065 - DNA, 933 bp, Helicobacter hepaticus; identical to SEQ ID NO: 7066
  CDS (1)..(933)

SEQ ID NO: 44066 - protein, 310 aa, Helicobacter hepaticus; identical to SEQ ID NO: 7067

SEQ ID NO: 44067 - DNA, 924 bp, Candidatus Blochmannia floridanus; identical to SEQ ID NO: 7068
  CDS (1)..(924)

SEQ ID NO: 44068 - protein, 307 aa, Candidatus Blochmannia floridanus; identical to SEQ ID NO: 7069

SEQ ID NO: 44069 - DNA, 921 bp, Bordetella parapertussis; identical to SEQ ID NO: 7070
  CDS (1)..(921)

SEQ ID NO: 44070 - protein, 306 aa, Bordetella parapertussis; identical to SEQ ID NO: 7071

SEQ ID NO: 44071 - DNA, 903 bp, Bordetella parapertussis; identical to SEQ ID NO: 7072
  CDS (1)..(903)

SEQ ID NO: 44072 - protein, 300 aa, Bordetella parapertussis; identical to SEQ ID NO: 7073

SEQ ID NO: 44073 - DNA, 945 bp, Bordetella bronchiseptica; identical to SEQ ID NO: 7074
  CDS (1)..(945)

SEQ ID NO: 44074 - protein, 314 aa, Bordetella bronchiseptica; identical to SEQ ID NO: 7075

SEQ ID NO: 44075 - DNA, 1233 bp, Oryza sativa; identical to SEQ ID NO: 7076
  CDS (1)..(1233)

SEQ ID NO: 44076 - protein, 410 aa, Oryza sativa; identical to SEQ ID NO: 7077

SEQ ID NO: 44077 - DNA, 1104 bp, Trypanosoma brucei; identical to SEQ ID NO: 7078
  CDS (1)..(1104)

SEQ ID NO: 44078 - protein, 367 aa, Trypanosoma brucei; identical to SEQ ID NO: 7079

SEQ ID NO: 44079 - DNA, 1104 bp, Trypanosoma brucei; identical to SEQ ID NO: 7080
  CDS (1)..(1104)

SEQ ID NO: 44080 - protein, 367 aa, Trypanosoma brucei; identical to SEQ ID NO: 7081

SEQ ID NO: 44081 - DNA, 879 bp, Bacillus cereus; identical to SEQ ID NO: 7082
  CDS (1)..(879)

SEQ ID NO: 44082 - protein, 292 aa, Bacillus cereus; identical to SEQ ID NO: 7083

SEQ ID NO: 44083 - DNA, 873 bp, Bacillus cereus; identical to SEQ ID NO: 7084
  CDS (1)..(873)

SEQ ID NO: 44084 - protein, 290 aa, Bacillus cereus; identical to SEQ ID NO: 7085

SEQ ID NO: 44085 - DNA, 873 bp, Bacillus anthracis; identical to SEQ ID NO: 7086
  CDS (1)..(873)

SEQ ID NO: 44086 - protein, 290 aa, Bacillus anthracis; identical to SEQ ID NO: 7087

SEQ ID NO: 44087 - DNA, 822 bp, Streptomyces avermitilis; identical to SEQ ID NO: 7088
  CDS (1)..(822)

SEQ ID NO: 44088 - protein, 273 aa, Streptomyces avermitilis; identical to SEQ ID NO: 7089

SEQ ID NO: 44089 - DNA, 1089 bp, Streptomyces avermitilis; identical to SEQ ID NO: 7090
  CDS (1)..(1089)

SEQ ID NO: 44090 - protein, 362 aa, Streptomyces avermitilis; identical to SEQ ID NO: 7091

SEQ ID NO: 44091 - DNA, 924 bp, Nitrosomonas europaea; identical to SEQ ID NO: 7092
  CDS (1)..(924)

SEQ ID NO: 44092 - protein, 307 aa, Nitrosomonas europaea; identical to SEQ ID NO: 7093

SEQ ID NO: 44093 - DNA, 861 bp, Nitrosomonas europaea; identical to SEQ ID NO: 7094
  CDS (1)..(861)

SEQ ID NO: 44094 - protein, 286 aa, Nitrosomonas europaea; identical to SEQ ID NO: 7095

SEQ ID NO: 44095 - DNA, 1020 bp, Enterococcus faecalis; identical to SEQ ID NO: 7096
  CDS (1)..(1020)

SEQ ID NO: 44096 - protein, 339 aa, Enterococcus faecalis; identical to SEQ ID NO: 7097

SEQ ID NO: 44097 - DNA, 846 bp, Coxiella burnetii; identical to SEQ ID NO: 7098
  CDS (1)..(846)

SEQ ID NO: 44098 - protein, 281 aa, Coxiella burnetii; identical to SEQ ID NO: 7099

SEQ ID NO: 44099 - DNA, 1086 bp, Tropheryma whipplei; identical to SEQ ID NO: 7100
  CDS (1)..(1086)

SEQ ID NO: 44100 - protein, 361 aa, Tropheryma whipplei; identical to SEQ ID NO: 7101

SEQ ID NO: 44101 - DNA, 837 bp, Legionella pneumophila; identical to SEQ ID NO: 7102
  CDS (1)..(837)

SEQ ID NO: 44102 - protein, 278 aa, Legionella pneumophila; identical to SEQ ID NO: 7103

SEQ ID NO: 44103 - DNA, 921 bp, Bacillus cereus; identical to SEQ ID NO: 7104
  CDS (1)..(921)

SEQ ID NO: 44104 - protein, 306 aa, Bacillus cereus; identical to SEQ ID NO: 7105

SEQ ID NO: 44105 - DNA, 897 bp, Bacillus cereus; identical to SEQ ID NO: 7106
  CDS (1)..(897)

SEQ ID NO: 44106 - protein, 298 aa, Bacillus cereus; identical to SEQ ID NO: 7107

SEQ ID NO: 44107 - DNA, 876 bp, Bacillus cereus; identical to SEQ ID NO: 7108
  CDS (1)..(876)

SEQ ID NO: 44108 - protein, 291 aa, Bacillus cereus; identical to SEQ ID NO: 7109

SEQ ID NO: 44109 - DNA, 900 bp, Bacillus cereus; identical to SEQ ID NO: 7110
  CDS (1)..(900)

SEQ ID NO: 44110 - protein, 299 aa, Bacillus cereus; identical to SEQ ID NO: 7111

SEQ ID NO: 44111 - DNA, 1861 bp, Cicer arietinum; identical to SEQ ID NO: 7112
  CDS (5)..(1660)

SEQ ID NO: 44112 - protein, 551 aa, Cicer arietinum; identical to SEQ ID NO: 7113

SEQ ID NO: 44113 - DNA, 1229 bp, Giardia lamblia; identical to SEQ ID NO: 7114
  CDS (72)..(1139)

SEQ ID NO: 44114 - protein, 355 aa, Giardia lamblia; identical to SEQ ID NO: 7115

SEQ ID NO: 44115 - DNA, 1089 bp, Xylella fastidiosa; identical to SEQ ID NO: 7116
  CDS (1)..(1089)

SEQ ID NO: 44116 - protein, 362 aa, Xylella fastidiosa; identical to SEQ ID NO: 7117

SEQ ID NO: 44117 - DNA, 939 bp, Vibrio parahaemolyticus; identical to SEQ ID NO: 7118
  CDS (1)..(939)

SEQ ID NO: 44118 - protein, 312 aa, Vibrio parahaemolyticus; identical to SEQ ID NO: 7119

SEQ ID NO: 44119 - DNA, 1035 bp, Pseudomonas syringae; identical to SEQ ID NO: 7120
  CDS (16)..(1035)

SEQ ID NO: 44120 - protein, 339 aa, Pseudomonas syringae; identical to SEQ ID NO: 7121

SEQ ID NO: 44121 - DNA, 1122 bp, Pseudomonas putida; identical to SEQ ID NO: 7122
  CDS (103)..(1122)

SEQ ID NO: 44122 - protein, 339 aa, Pseudomonas putida; identical to SEQ ID NO: 7123

SEQ ID NO: 44123 - DNA, 1029 bp, Lactobacillus plantarum; identical to SEQ ID NO: 7124
  CDS (1)..(1029)

SEQ ID NO: 44124 - protein, 342 aa, Lactobacillus plantarum; identical to SEQ ID NO: 7125

SEQ ID NO: 44125 - DNA, 822 bp, Clostridium tetani; identical to SEQ ID NO: 7126
  CDS (1)..(822)

SEQ ID NO: 44126 - protein, 273 aa, Clostridium tetani; identical to SEQ ID NO: 7127

SEQ ID NO: 44127 - DNA, 1083 bp, Bradyrhizobium japonicum; identical to SEQ ID NO: 7128
  CDS (1)..(1083)

SEQ ID NO: 44128 - protein, 360 aa, Bradyrhizobium japonicum; identical to SEQ ID NO: 7129

SEQ ID NO: 44129 - DNA, 888 bp, Bradyrhizobium japonicum; identical to SEQ ID NO: 7130
  CDS (1)..(888)

SEQ ID NO: 44130 - protein, 295 aa, Bradyrhizobium japonicum; identical to SEQ ID NO: 7131

SEQ ID NO: 44131 - DNA, 1056 bp, Bradyrhizobium japonicum; identical to SEQ ID NO: 7132
  CDS (1)..(1056)

SEQ ID NO: 44132 - protein, 351 aa, Bradyrhizobium japonicum; identical to SEQ ID NO: 7133

SEQ ID NO: 44133 - DNA, 1020 bp, Bacteroides thetaiotaomicron; identical to SEQ ID NO: 7134
  CDS (1)..(1020)

SEQ ID NO: 44134 - protein, 339 aa, Bacteroides thetaiotaomicron; identical to SEQ ID NO: 7135

SEQ ID NO: 44135 - DNA, 867 bp, Oceanobacillus iheyensis; identical to SEQ ID NO: 7136
  CDS (1)..(867)

SEQ ID NO: 44136 - protein, 288 aa, Oceanobacillus iheyensis; identical to SEQ ID NO: 7137

SEQ ID NO: 44137 - DNA, 861 bp, Synechococcus elongatus; identical to SEQ ID NO: 7138
  CDS (1)..(861)

SEQ ID NO: 44138 - protein, 286 aa, Synechococcus elongatus; identical to SEQ ID NO: 7139

SEQ ID NO: 44139 - DNA, 912 bp, Synechococcus elongatus; identical to SEQ ID NO: 7140
  CDS (1)..(912)

SEQ ID NO: 44140 - protein, 303 aa, Synechococcus elongatus; identical to SEQ ID NO: 7141

SEQ ID NO: 44141 - DNA, 1026 bp, Streptococcus mutans; identical to SEQ ID NO: 7142
  CDS (1)..(1026)

SEQ ID NO: 44142 - protein, 341 aa, Streptococcus mutans; identical to SEQ ID NO: 7143

SEQ ID NO: 44143 - DNA, 1023 bp, Streptococcus agalactiae; identical to SEQ ID NO: 7144
  CDS (1)..(1023)

SEQ ID NO: 44144 - protein, 340 aa, Streptococcus agalactiae; identical to SEQ ID NO: 7145

SEQ ID NO: 44145 - DNA, 1092 bp, Shewanella oneidensis; identical to SEQ ID NO: 7146
  CDS (1)..(1092)

SEQ ID NO: 44146 - protein, 363 aa, Shewanella oneidensis; identical to SEQ ID NO: 7147

SEQ ID NO: 44147 - DNA, 1095 bp, Oceanobacillus iheyensis; identical to SEQ ID NO: 7148
  CDS (1)..(1095)

SEQ ID NO: 44148 - protein, 364 aa, Oceanobacillus iheyensis; identical to SEQ ID NO: 7149

SEQ ID NO: 44149 - DNA, 1236 bp, Corynebacterium efficiens; identical to SEQ ID NO: 7150
  CDS (1)..(1236)

SEQ ID NO: 44150 - protein, 411 aa, Corynebacterium efficiens; identical to SEQ ID NO: 7151

SEQ ID NO: 44151 - DNA, 1128 bp, Bifidobacterium longum; identical to SEQ ID NO: 7152
  CDS (1)..(1128)

SEQ ID NO: 44152 - protein, 375 aa, Bifidobacterium longum; identical to SEQ ID NO: 7153

SEQ ID NO: 44153 - DNA, 1248 bp, Oryza sativa; identical to SEQ ID NO: 7154
  CDS (1)..(1248)

SEQ ID NO: 44154 - protein, 415 aa, Oryza sativa; identical to SEQ ID NO: 7155

SEQ ID NO: 44155 - DNA, 1472 bp, Oryza sativa; identical to SEQ ID NO: 7156
  CDS (60)..(1277)

SEQ ID NO: 44156 - protein, 405 aa, Oryza sativa; identical to SEQ ID NO: 7157

SEQ ID NO: 44157 - DNA, 912 bp, Chlorobium tepidum; identical to SEQ ID NO: 7158
  CDS (1)..(912)

SEQ ID NO: 44158 - protein, 303 aa, Chlorobium tepidum; identical to SEQ ID NO: 7159

SEQ ID NO: 44159 - DNA, 960 bp, Rhizobium loti; identical to SEQ ID NO: 7160
  CDS (1)..(960)

SEQ ID NO: 44160 - protein, 319 aa, Rhizobium loti; identical to SEQ ID NO: 7161

SEQ ID NO: 44161 - DNA, 1023 bp, Streptococcus pyogenes; identical to SEQ ID NO: 7162
  CDS (1)..(1023)

SEQ ID NO: 44162 - protein, 340 aa, Streptococcus pyogenes; identical to SEQ ID NO: 7163

SEQ ID NO: 44163 - DNA, 1086 bp, Xanthomonas campestris; identical to SEQ ID NO: 7164
  CDS (1)..(1086)

SEQ ID NO: 44164 - protein, 361 aa, Xanthomonas campestris; identical to SEQ ID NO: 7165

SEQ ID NO: 44165 - DNA, 1086 bp, Xanthomonas axonopodis; identical to SEQ ID NO: 7166
  CDS (1)..(1086)

SEQ ID NO: 44166 - protein, 361 aa, Xanthomonas axonopodis; identical to SEQ ID NO: 7167

SEQ ID NO: 44167 - DNA, 885 bp, Methanosarcina mazei; identical to SEQ ID NO: 7168
  CDS (1)..(885)

SEQ ID NO: 44168 - protein, 294 aa, Methanosarcina mazei; identical to SEQ ID NO: 7169

SEQ ID NO: 44169 - DNA, 876 bp, Thermoanaerobacter tengcongensis; identical to SEQ ID NO: 7170
  CDS (1)..(876)

SEQ ID NO: 44170 - protein, 291 aa, Thermoanaerobacter tengcongensis; identical to SEQ ID NO: 7171

SEQ ID NO: 44171 - DNA, 885 bp, Methanosarcina acetivorans; identical to SEQ ID NO: 7172
  CDS (1)..(885)

SEQ ID NO: 44172 - protein, 294 aa, Methanosarcina acetivorans; identical to SEQ ID NO: 7173

SEQ ID NO: 44173 - DNA, 888 bp, Methanopyrus kandleri; identical to SEQ ID NO: 7174
  CDS (1)..(888)

SEQ ID NO: 44174 - protein, 295 aa, Methanopyrus kandleri; identical to SEQ ID NO: 7175

SEQ ID NO: 44175 - DNA, 1065 bp, Ralstonia solanacearum; identical to SEQ ID NO: 7176
  CDS (1)..(1065)

SEQ ID NO: 44176 - protein, 354 aa, Ralstonia solanacearum; identical to SEQ ID NO: 7177

SEQ ID NO: 44177 - DNA, 1026 bp, Clostridium perfringens; identical to SEQ ID NO: 7178
  CDS (1)..(1026)

SEQ ID NO: 44178 - protein, 341 aa, Clostridium perfringens; identical to SEQ ID NO: 7179

SEQ ID NO: 44179 - DNA, 930 bp, Ralstonia solanacearum; identical to SEQ ID NO: 7180
  CDS (1)..(930)

SEQ ID NO: 44180 - protein, 309 aa, Ralstonia solanacearum; identical to SEQ ID NO: 7181

SEQ ID NO: 44181 - DNA, 912 bp, Pyrobaculum aerophilum; identical to SEQ ID NO: 7182
  CDS (1)..(912)

SEQ ID NO: 44182 - protein, 303 aa, Pyrobaculum aerophilum; identical to SEQ ID NO: 7183

SEQ ID NO: 44183 - DNA, 864 bp, Rhizobium meliloti; identical to SEQ ID NO: 7184
  CDS (1)..(864)

SEQ ID NO: 44184 - protein, 287 aa, Rhizobium meliloti; identical to SEQ ID NO: 7185

SEQ ID NO: 44185 - DNA, 936 bp, Rhizobium meliloti; identical to SEQ ID NO: 7186
  CDS (1)..(936)

SEQ ID NO: 44186 - protein, 311 aa, Rhizobium meliloti; identical to SEQ ID NO: 7187

SEQ ID NO: 44187 - DNA, 1098 bp, Rhizobium meliloti; identical to SEQ ID NO: 7188
  CDS (1)..(1098)

SEQ ID NO: 44188 - protein, 365 aa, Rhizobium meliloti; identical to SEQ ID NO: 7189

SEQ ID NO: 44189 - DNA, 870 bp, Brucella suis; identical to SEQ ID NO: 7190
  CDS (1)..(870)

SEQ ID NO: 44190 - protein, 289 aa, Brucella suis; identical to SEQ ID NO: 7191

SEQ ID NO: 44191 - DNA, 912 bp, Streptomyces avermitilis; identical to SEQ ID NO: 7192
  CDS (1)..(912)

SEQ ID NO: 44192 - protein, 303 aa, Streptomyces avermitilis; identical to SEQ ID NO: 7193

SEQ ID NO: 44193 - DNA, 1398 bp, Capsicum annuum; identical to SEQ ID NO: 7194
  CDS (85)..(1242)

SEQ ID NO: 44194 - protein, 385 aa, Capsicum annuum; identical to SEQ ID NO: 7195

SEQ ID NO: 44195 - DNA, 1449 bp, Oryza sativa; identical to SEQ ID NO: 7196
  CDS (1)..(1146)

SEQ ID NO: 44196 - protein, 381 aa, Oryza sativa; identical to SEQ ID NO: 7197

SEQ ID NO: 44197 - DNA, 876 bp, Rhizobium loti; identical to SEQ ID NO: 7198
  CDS (1)..(876)

SEQ ID NO: 44198 - protein, 291 aa, Rhizobium loti; identical to SEQ ID NO: 7199

SEQ ID NO: 44199 - DNA, 879 bp, Rhizobium loti; identical to SEQ ID NO: 7200
  CDS (1)..(879)

SEQ ID NO: 44200 - protein, 292 aa, Rhizobium loti; identical to SEQ ID NO: 7201

SEQ ID NO: 44201 - DNA, 894 bp, Rhizobium loti; identical to SEQ ID NO: 7202
  CDS (1)..(894)

SEQ ID NO: 44202 - protein, 297 aa, Rhizobium loti; identical to SEQ ID NO: 7203

SEQ ID NO: 44203 - DNA, 963 bp, Rhizobium loti; identical to SEQ ID NO: 7204
  CDS (1)..(963)

SEQ ID NO: 44204 - protein, 320 aa, Rhizobium loti; identical to SEQ ID NO: 7205

SEQ ID NO: 44205 - DNA, 864 bp, Rhizobium loti; identical to SEQ ID NO: 7206
  CDS (1)..(864)

SEQ ID NO: 44206 - protein, 287 aa, Rhizobium loti; identical to SEQ ID NO: 7207

SEQ ID NO: 44207 - DNA, 1200 bp, Rattus norvegicus; identical to SEQ ID NO: 7208
  CDS (1)..(1200)

SEQ ID NO: 44208 - protein, 399 aa, Rattus norvegicus; identical to SEQ ID NO: 7209

SEQ ID NO: 44209 - DNA, 873 bp, Rickettsia montana; identical to SEQ ID NO: 7210
  CDS (1)..(873)

SEQ ID NO: 44210 - protein, 290 aa, Rickettsia montana; identical to SEQ ID NO: 7211

SEQ ID NO: 44211 - DNA, 1023 bp, Pasteurella multocida; identical to SEQ ID NO: 7212
  CDS (1)..(1023)

SEQ ID NO: 44212 - protein, 340 aa, Pasteurella multocida; identical to SEQ ID NO: 7213

SEQ ID NO: 44213 - DNA, 1080 bp, Staphylococcus carnosus; identical to SEQ ID NO: 7214
  CDS (1)..(1080)

SEQ ID NO: 44214 - protein, 359 aa, Staphylococcus carnosus; identical to SEQ ID NO: 7215

SEQ ID NO: 44215 - DNA, 822 bp, Streptomyces coelicolor; identical to SEQ ID NO: 7216
  CDS (1)..(822)

SEQ ID NO: 44216 - protein, 273 aa, Streptomyces coelicolor; identical to SEQ ID NO: 7217

SEQ ID NO: 44217 - DNA, 1700 bp, Solanum tuberosum; identical to SEQ ID NO: 7218
  CDS (340)..(1473)

SEQ ID NO: 44218 - protein, 377 aa, Solanum tuberosum; identical to SEQ ID NO: 7219

SEQ ID NO: 44219 - DNA, 1683 bp, Solanum tuberosum; identical to SEQ ID NO: 7220
  CDS (116)..(1372)

SEQ ID NO: 44220 - protein, 418 aa, Solanum tuberosum; identical to SEQ ID NO: 7221

SEQ ID NO: 44221 - DNA, 1668 bp, Arabidopsis thaliana; identical to SEQ ID NO: 7222
  CDS (1)..(1668)

SEQ ID NO: 44222 - protein, 555 aa, Arabidopsis thaliana; identical to SEQ ID NO: 7223

SEQ ID NO: 44223 - DNA, 1680 bp, Arabidopsis thaliana; identical to SEQ ID NO: 7224
  CDS (1)..(1680)

SEQ ID NO: 44224 - protein, 559 aa, Arabidopsis thaliana; identical to SEQ ID NO: 7225

SEQ ID NO: 44225 - DNA, 1973 bp, Arabidopsis thaliana; identical to SEQ ID NO: 7226
  CDS (571)..(1818)

SEQ ID NO: 44226 - protein, 415 aa, Arabidopsis thaliana; identical to SEQ ID NO: 7227

SEQ ID NO: 44227 - DNA, 1541 bp, Homo sapiens; identical to SEQ ID NO: 7228
  CDS (1)..(1179)

SEQ ID NO: 44228 - protein, 392 aa, Homo sapiens; identical to SEQ ID NO: 7229

SEQ ID NO: 44229 - DNA, 1953 bp, Ovis aries; identical to SEQ ID NO: 7230
  CDS (492)..(1649)

SEQ ID NO: 44230 - protein, 385 aa, Ovis aries; identical to SEQ ID NO: 7231

SEQ ID NO: 44231 - DNA, 1322 bp, Bacillus licheniformis; identical to SEQ ID NO: 7232
  CDS (247)..(1098)

SEQ ID NO: 44232 - protein, 283 aa, Bacillus licheniformis; identical to SEQ ID NO: 7233

SEQ ID NO: 44233 - DNA, 1194 bp, Bacillus sphaericus; identical to SEQ ID NO: 7234
  CDS (134)..(985)

SEQ ID NO: 44234 - protein, 283 aa, Bacillus sphaericus; identical to SEQ ID NO: 7235

SEQ ID NO: 44235 - DNA, 849 bp, Staphylococcus epidermidis; identical to SEQ ID NO: 7236
  CDS (1)..(849)

SEQ ID NO: 44236 - protein, 282 aa, Staphylococcus epidermidis; identical to SEQ ID NO: 7237

SEQ ID NO: 44237 - DNA, 1529 bp, Staphylococcus haemolyticus; identical to SEQ ID NO: 7238
  CDS (216)..(1064)

SEQ ID NO: 44238 - protein, 282 aa, Staphylococcus haemolyticus; identical to SEQ ID NO: 7239

SEQ ID NO: 44239 - DNA, 921 bp, Methanobacterium thermoautotrophicum; identical to SEQ ID NO: 7240
  CDS (1)..(921)

SEQ ID NO: 44240 - protein, 306 aa, Methanobacterium thermoautotrophicum; identical to SEQ ID NO: 7241

SEQ ID NO: 44241 - DNA, 1077 bp, Staphylococcus epidermidis; identical to SEQ ID NO: 7242
  CDS (1)..(1077)

SEQ ID NO: 44242 - protein, 358 aa, Staphylococcus epidermidis; identical to SEQ ID NO: 7243

SEQ ID NO: 44243 - DNA, 1074 bp, Cochliobolus carbonum; identical to SEQ ID NO: 7244
  CDS (1)..(1074)

SEQ ID NO: 44244 - protein, 357 aa, Cochliobolus carbonum; identical to SEQ ID NO: 7245

SEQ ID NO: 44245 - DNA, 24 bp, Artificial sequence
  (1)..(24): primer
atgaccacgaagaaagctgattac

SEQ ID NO: 44246 - DNA, 26 bp, Artificial sequence
  (1)..(26): primer
ttattgattaacttgatctaaccagc

SEQ ID NO: 44247 - protein, 278 aa, Artificial sequence; identical to SEQ ID NO: 9102
  Variant (2)..(3): xaa in position 2 to 3 is any amino acid
  Variant (5)..(8): xaa in position 5 to 8 is any amino acid
  Variant (10)..(12): xaa in position 10 to 12 is any amino acid
  Variant (14)..(15): xaa in position 14 to 15 is any amino acid
  Variant (17)..(19): xaa in position 17 to 19 is any amino acid
  Variant (22)..(24): xaa in position 22 to 24 is any amino acid
  Variant (28)..(28): xaa in position 28 is any amino acid
  Variant (30)..(30): xaa in position 30 is any amino acid
  Variant (32)..(42): xaa in position 32 to 42 is any amino acid
  Variant (44)..(47): xaa in position 44 to 47 is any amino acid
  Variant (49)..(50): xaa in position 49 to 50 is any amino acid
  Variant (53)..(54): xaa in position 53 to 54 is any amino acid
  Variant (57)..(87): xaa in position 57 to 87 is any amino acid
  Variant (89)..(89): xaa in position 89 is any amino acid
  Variant (91)..(95): xaa in position 91 to 95 is any amino acid
  Variant (97)..(132): xaa in position 97 to 132 is any amino acid
  Variant (134)..(142): xaa in position 134 to 142 is any amino acid
  Variant (144)..(153): xaa in position 144 to 153 is any amino acid
  Variant (155)..(158): xaa in position 155 to 158 is any amino acid
  Variant (160)..(167): xaa in position 160 to 167 is any amino acid
  Variant (170)..(172): xaa in position 170 to 172 is any amino acid
  Variant (174)..(179): xaa in position 174 to 179 is any amino acid
  Variant (181)..(183): xaa in position 181 to 183 is any amino acid
  Variant (185)..(187): xaa in position 185 to 187 is any amino acid
  Variant (189)..(192): xaa in position 189 to 192 is any amino acid
  Variant (194)..(194): xaa in position 194 is any amino acid
  Variant (196)..(196): xaa in position 196 is any amino acid
  Variant (198)..(199): xaa in position 198 to 199 is any amino acid
  Variant (201)..(203): xaa in position 201 to 203 is any amino acid
  Variant (206)..(211): xaa in position 206 to 211 is any amino acid
  Variant (213)..(213): xaa in position 213 is any amino acid
  Variant (218)..(227): xaa in position 218 to 227 is any amino acid
  Variant (229)..(232): xaa in position 229 to 232 is any amino acid
  Variant (234)..(244): xaa in position 234 to 244 is any amino acid
  Variant (248)..(248): xaa in position 248 is any amino acid
  Variant (250)..(251): xaa in position 250 to 251 is any amino acid
  Variant (255)..(255): xaa in position 255 is any amino acid
  Variant (257)..(258): xaa in position 257 to 258 is any amino acid
  Variant (260)..(263): xaa in position 260 to 263 is any amino acid
  Variant (265)..(274): xaa in position 265 to 274 is any amino acid
  Variant (276)..(277): xaa in position 276 to 277 is any amino acid

SEQ ID NO: 44248 - protein, 64 aa, Artificial sequence; identical to SEQ ID NO: 9097
  Variant (1)..(1): xaa in position 1 is Trp, Tyr, Phe, Asn or Leu
  Variant (2)..(13): xaa in position 2 to 13 is any amino acid
  Variant (14)..(14): xaa in position 14 is Ile, Leu, Val, Met, Thr or Phe
  Variant (15)..(23): xaa in position 15 to 23 is any amino acid
  Variant (24)..(24): xaa in position 24 is Gly, Ala or Ser
  Variant (25)..(27): xaa in position 25 to 27 is any amino acid
  Variant (28)..(28): xaa in position 28 is Phe, Tyr or Trp
  Variant (29)..(29): xaa in position 29 is Glu, Asp or Gly
  Variant (30)..(30): xaa in position 30 is Gly, Val, Thr or Tyr
  Variant (31)..(31): xaa in position 31 is any amino acid
  Variant (32)..(32): xaa in position 32 is Arg, Lys, His, Ala or Pro
  Variant (33)..(38): xaa in position 33 to 38 is any amino acid
  Variant (39)..(45): xaa in position 39 to 45 is any or no amino acid
  Variant (46)..(46): xaa in position 46 is Phe, His, Pro, Val or Leu
  Variant (47)..(50): xaa in position 47 to 50 is any amino acid
  Variant (51)..(51): xaa in position 51 is His or Asn
  Variant (52)..(53): xaa in position 52 to 53 is any amino acid
  Variant (55)..(55): xaa in position 55 is Leu, Met, Phe, Val or Ile
  Variant (56)..(63): xaa in position 56 to 63 is any amino acid
  Variant (64)..(64): xaa in position 64 is Leu, Met, Ile, Phe or Thr

SEQ ID NO: 44249 - protein, 61 aa, Artificial sequence; identical to SEQ ID NO: 9098
  Variant (2)..(2): xaa in position 2 is any amino acid
  Variant (3)..(3): xaa in position 3 is Gly or Ser
  Variant (4)..(4): xaa in position 4 is Ile, Val or Cys
  Variant (5)..(5): xaa in position 5 is Thr, Ile or Val
  Variant (6)..(6): xaa in position 6 is Arg, Lys, Gln, Asn or Tyr
  Variant (7)..(8): xaa in position 7 to 8 is any amino acid
  Variant (9)..(9): xaa in position 9 is Val, Ile, Leu, Thr, Ala or Met
  Variant (10)..(29): xaa in position 10 to 29 is any amino acid
  Variant (30)..(44): xaa in position 30 to 44 is any or no amino acid
  Variant (45)..(45): xaa in position 45 is Glu or Gly
  Variant (46)..(46): xaa in position 46 is any amino acid
  Variant (47)..(47): xaa in position 47 is Phe, Gly, Ile, Trp or Met
  Variant (48)..(48): xaa in position 48 is any amino acid
  Variant (49)..(49): xaa in position 49 is Thr, Cys, Ser, Ala or Val
  Variant (50)..(50): xaa in position 50 is Gly, Ser, Ala or Asn
  Variant (51)..(51): xaa in position 51 is Thr, Ser, Asn or Ala
  Variant (52)..(54): xaa in position 52 to 54 is any amino acid
  Variant (55)..(55): xaa in position 55 is Ile, Val or Leu
  Variant (56)..(57): xaa in position 56 to 57 is any amino acid
  Variant (58)..(58): xaa in position 58 is Val, Ile, Met or Leu
  Variant (59)..(60): xaa in position 59 to 60 is any amino acid
  Variant (61)..(61): xaa in position 61 is Ile, Val, Leu, Phe or Tyr

SEQ ID NO: 44250 - protein, 55 aa, Artificial sequence; identical to SEQ ID NO: 9099
  Variant (1)..(1): xaa in position 1 is Trp, Tyr, Phe, Leu or His
  Variant (2)..(2): xaa in position 2 is any amino acid
  Variant (3)..(3): xaa in position 3 is Asn, Asp, Glu or Gly
  Variant (4)..(4): xaa in position 4 is Gly, Asp or Leu
  Variant (5)..(6): xaa in position 5 to 6 is any amino acid
  Variant (7)..(7): xaa in position 7 is Val, Leu or Ile
  Variant (8)..(11): xaa in position 8 to 11 is any amino acid
  Variant (13)..(13): xaa in position 13 is any amino acid
  Variant (14)..(14): xaa in position 14 is Val, Ile, Leu or Thr
  Variant (15)..(15): xaa in position 15 is His or Ser
  Variant (16)..(16): xaa in position 16 is Val, Ile or Phe
  Variant (17)..(17): xaa in position 17 is any amino acid
  Variant (18)..(18): xaa in position 18 is Thr, Asp or Ser
  Variant (19)..(19): xaa in position 19 is His, Ser, Arg, Trp or Asn
  Variant (20)..(21): xaa in position 20 to 21 is any amino acid
  Variant (22)..(22): xaa in position 22 is His, Leu or Gln
  Variant (23)..(23): xaa in position 23 is Tyr, His or Gly
  Variant (24)..(24): xaa in position 24 is Gly, Ser or Ala
  Variant (25)..(25): xaa in position 25 is any amino acid
  Variant (26)..(26): xaa in position 26 is Ser, Gly, Ala or Thr
  Variant (27)..(27): xaa in position 27 is Val, Ile, Ala or Thr
  Variant (28)..(28): xaa in position 28 is Phe, Tyr, Trp or Leu
  Variant (29)..(29): xaa in position 29 is Glu, Gly or Asp
  Variant (30)..(30): xaa in position 30 is Gly, Thr or Val
  Variant (31)..(31): xaa in position 31 is any amino acid
  Variant (32)..(32): xaa in position 32 is Arg or His
  Variant (33)..(33): xaa in position 33 is any amino acid
  Variant (34)..(34): xaa in position 34 is Tyr, Trp, Ile or Leu
  Variant (35)..(38): xaa in position 35 to 38 is any amino acid
  Variant (39)..(45): xaa in position 39 to 45 is any or no amino acid
  Variant (46)..(46): xaa in position 46 is Phe or Leu
  Variant (47)..(47): xaa in position 47 is Arg, Lys, Phe, Ala or Met
  Variant (48)..(50): xaa in position 48 to 50 is any amino acid
  Variant (52)..(53): xaa in position 52 to 53 is any amino acid
  Variant (55)..(55): xaa in position 55 is Leu, Phe or Met

SEQ ID NO: 44251 - protein, 64 aa, Artificial sequence; identical to SEQ ID NO: 9100
  Variant (1)..(1): xaa in position 1 is Lys or His
  Variant (2)..(4): xaa in position 2 to 4 is any amino acid
  Variant (5)..(5): xaa in position 5 is any or no amino acid
  Variant (6)..(6): xaa in position 6 is Tyr, Trp or Leu
  Variant (7)..(7): xaa in position 7 is Leu, Met, Ile, Val or Asn
  Variant (8)..(14): xaa in position 8 to 14 is any amino acid
  Variant (15)..(15): xaa in position 15 is any or no amino acid
  Variant (16)..(16): xaa in position 16 is Ala, Ser or Asp
  Variant (17)..(19): xaa in position 17 to 19 is any amino acid
  Variant (20)..(20): xaa in position 20 is Gly, Asn or Asp
  Variant (21)..(22): xaa in position 21 to 22 is any amino acid
  Variant (23)..(23): xaa in position 23 is Glu, Asp or Thr
  Variant (24)..(24): xaa in position 24 is Ala or Gly
  Variant (25)..(25): xaa in position 25 is Ile, Leu, Met or Phe
  Variant (26)..(26): xaa in position 26 is any amino acid
  Variant (27)..(27): xaa in position 27 is Leu, Met or Val
  Variant (28)..(28): xaa in position 28 is Asp, Asn, Ser or Thr
  Variant (29)..(30): xaa in position 29 to 30 is any amino acid
  Variant (31)..(31): xaa in position 31 is Gly or Asp
  Variant (32)..(32): xaa in position 32 is any amino acid
  Variant (33)..(33): xaa in position 33 is Val, Ile or Leu
  Variant (34)..(34): xaa in position 34 is any amino acid
  Variant (36)..(36): xaa in position 36 is Gly, Ala, Cys or Thr
  Variant (37)..(37): xaa in position 37 is any amino acid
  Variant (38)..(38): xaa in position 38 is Gly, Ala or Thr
  Variant (39)..(39): xaa in position 39 is any amino acid
  Variant (40)..(40): xaa in position 40 is Asn or Cys
  Variant (41)..(41): xaa in position 41 is Ile, Leu, Val or Phe
  Variant (42)..(42): xaa in position 42 is Phe or Trp
  Variant (43)..(43): xaa in position 43 is any amino acid
  Variant (44)..(44): xaa in position 44 is Val or Ile
  Variant (45)..(46): xaa in position 45 to 46 is any amino acid
  Variant (47)..(47): xaa in position 47 is Gly, Asp, Lys or Asn
  Variant (48)..(48): xaa in position 48 is any amino acid
  Variant (49)..(49): xaa in position 49 is Leu, Ile, Val or Ala
  Variant (50)..(50): xaa in position 50 is any amino acid
  Variant (51)..(51): xaa in position 51 is Thr or Ser
  Variant (53)..(56): xaa in position 53 to 56 is any amino acid
  Variant (57)..(58): xaa in position 57 to 58 is any or no amino acid
  Variant (60)..(60): xaa in position 60 is any amino acid
  Variant (61)..(61): xaa in position 61 is Gly or Ser
  Variant (62)..(62): xaa in position 62 is Ile or Phe
  Variant (64)..(64): xaa in position 64 is Arg or Gln

SEQ ID NO: 44252 - protein, 20 aa, Artificial sequence
  Variant (1)..(1): xaa in position 1 is Ala or Phe
  Variant (2)..(2): xaa in position 2 is Asp, Thr, Ser, Asn or Glu
  Variant (3)..(3): xaa in position 3 is Glu, Gly or Gln
  Variant (4)..(4): xaa in position 4 is any amino acid
  Variant (5)..(5): xaa in position 5 is Phe or Trp
  Variant (6)..(6): xaa in position 6 is any amino acid
  Variant (7)..(7): xaa in position 7 is Thr, Ser or Val
  Variant (8)..(8): xaa in position 8 is Gly, Ser or Asn
  Variant (9)..(9): xaa in position 9 is Thr or Ser
  Variant (10)..(10): xaa in position 10 is Ala, Met, Gly, Thr or Val
  Variant (11)..(12): xaa in position 11 to 12 is any amino acid
  Variant (13)..(13): xaa in position 13 is Ile, Val, Leu, Ser or Ala
  Variant (14)..(14): xaa in position 14 is any amino acid
  Variant (15)..(15): xaa in position 15 is Pro, Trp or Asn
  Variant (16)..(16): xaa in position 16 is Val or Ile
  Variant (17)..(18): xaa in position 17 to 18 is any amino acid
  Variant (19)..(19): xaa in position 19 is Val, Ile or Leu
  Variant (20)..(20): xaa in position 20 is Asp, Gly, Glu or Asn
XXXXXXXXXXXXXXXXXXXX

SEQ ID NO: 44253 - protein, 37 aa, Artificial sequence; identical to SEQ ID NO: 9103
  Variant (2)..(2): xaa in position 2 is any amino acid
  Variant (3)..(3): xaa in position 3 is Ser, Thr, Ala, Gly, Cys or Ile
  Variant (4)..(5): xaa in position 4 to 5 is any amino acid
  Variant (7)..(7): xaa in position 7 is Leu, Ile, Val, Met, Phe, Ala or Cys
  Variant (8)..(8): xaa in position 8 is Phe or Tyr
  Variant (9)..(14): xaa in position 9 to 14 is any amino acid
  Variant (15)..(20): xaa in position 15 to 20 is any or no amino acid
  Variant (21)..(21): xaa in position 21 is Leu, Ile, Val, Met, Phe or Ala
  Variant (22)..(22): xaa in position 22 is any amino acid
  Variant (24)..(29): xaa in position 24 to 29 is any amino acid
  Variant (30)..(31): xaa in position 30 to 31 is any or no amino acid
  Variant (32)..(32): xaa in position 32 is Leu, Ile, Val or Met
  Variant (33)..(33): xaa in position 33 is any amino acid
  Variant (34)..(34): xaa in position 34 is Gly or Ser
  Variant (35)..(35): xaa in position 35 is Leu, Ile, Val or Met
  Variant (36)..(36): xaa in position 36 is any amino acid
  Variant (37)..(37): xaa in position 37 is Lys or Arg

SEQ ID NO: 44254 - DNA, 1647 bp, Escherichia coli
  CDS (1)..(1647)
atgtcaaacaaaccctttatctaccaggcacctttcccgatggggaaagacaataccgaatactatctactcacttccgattacgttagcgttgccgacttcgacggcgaaaccatcctgaaagtggaaccagaagccctgaccctgctggcgcagcaagcctttcacgacgcttcttttatgctccgcccggcacaccagaaacaggttgcggctattcttcacgatccagaagccagcgaaaacgacaagtacgtggcgctgcaattcttaagaaactccgaaatcgccgccaaaggcgtgctgccgacctgccaggataccggcaccgcgatcatcgtcggtaaaaaaggccagcgcgtgtggaccggcggcggtgatgaagaaacgctgtcgaaaggcgtctataacacctatatcgaagataacctgcgctattcacagaatgcggcgctggacatgtacaaagaggtcaacaccggcactaacctgcctgcgcaaatcgacctgtacgcggtagatggcgatgagtacaaattcctttgcgttgcgaaaggcggcggctctgccaacaaaacgtatctctaccaggaaaccaaagccctgctgactcccggcaaactgaaaaacttcctcgtcgagaaaatgcgtaccctcggtactgcagcctgcccgccgtaccatatcgcgtttgtgattggcggtacgtctgcggaaaccaacctgaaaaccgtcaagttagcaagcgctcactattacgatgaactgccgacggaagggaacgaacatggtcaggcgttccgcgatgtccagctggaacaggaactgctggaagaggcccagaaactcggtcttggcgcgcagtttggcggtaaatacttcgcgcacgacattcgcgttatccgtctgccacgtcacggcgcatcctgcccggtcggcatgggcgtctcctgctccgctgaccgtaacattaaagcgaaaatcaaccgcgaaggtatctggatcgaaaaactggaacacaacccaggccagtacattccacaagaactgcgccaggccggtgaaggcgaagcggtgaaagttgaccttaaccgcccgatgaaagagatcctcgcccagctttcgcaatacccggtatccactcgtttgtcgctcaccggcaccattatcgtgggccgagatattgcacacgccaagctgaaagagctgattgacgccggtaaagaacttccgcagtacatcaaagatcacccgatctactacgcgggtccggcgaaaacccctgccggttatccatcaggttcacttggcccaaccaccgcaggccgtatggactcctacgtggatctgctgcaatcccacggcggcagcatgatcatgctggcgaaaggtaaccgcagtcagcaggttaccgacgcgtgtcataaacacggcggcttctacctcggtagcatcggcggtccggcggcggtactggcgcagcagagcatcaagcatctggagtgcgtcgcttatccggagctgggtatggaagctatctggaaaatcgaagtagaagatttcccggcgtttatcctggtcgatgacaaaggtaacgacttcttccagcaaatcgtcaacaaacagtgcgcgaactgcactaagtaa

SEQ ID NO: 44255 - protein, 548 aa, Escherichia coli
MSNKPFIYQAPFPMGKDNTEYYLLTSDYVSVADFDGETILKVEPEALTLLAQQAFHDASFMLRPAHQKQVAAILHDPEASENDKYVALQFLRNSEIAAKGVLPTCQDTGTAIIVGKKGQRVWTGGGDEETLSKGVYNTYIEDNLRYSQNAALDMYKEVNTGTNLPAQIDLYAVDGDEYKFLCVAKGGGSANKTYLYQETKALLTPGKLKNFLVEKMRTLGTAACPPYHIAFVIGGTSAETNLKTVKLASAHYYDELPTEGNEHGQAFRDVQLEQELLEEAQKLGLGAQFGGKYFAHDIRVIRLPRHGASCPVGMGVSCSADRNIKAKINREGIWIEKLEHNPGQYIPQELRQAGEGEAVKVDLNRPMKEILAQLSQYPVSTRLSLTGTIIVGRDIAHAKLKELIDAGKELPQYIKDHPIYYAGPAKTPAGYPSGSLGPTTAGRMDSYVDLLQSHGGSMIMLAKGNRSQQVTDACHKHGGFYLGSIGGPAAVLAQQSIKHLECVAYPELGMEAIWKIEVEDFPAFILVDDKGNDFFQQIVNKQCANCTK

SEQ ID NO: 44256 - DNA, 1545 bp, Mesorhizobium loti MAFF303099
  CDS (1)..(1545): transl_table=11
gtgggaaatagaacacggaccatagccggcaaggacatcacaaggagcgtggccgacgcccttcagtacatctcgtactaccatcctccagattatatccggtctctttcgcaggcctacgcgcgcgaacagagtccagcggcgaagaacgcaatagggcagattctgctgaactcccgcatggcggccttcgggcggcggccgatctgccaggacaccggccttgtggtcgtcttcgcgaaggtcggcatggaaacccgcatcaaatcaacgatcagtttcgcagacctcgtgaacgagggcgtccgtcaggcatatctcgacccggacaatccccttcgggcctcgatcgttgccgatccgctcgccggacgggtcaatactcgtgacaacacgccggcggtcgtccacgttgaccttgtacaaggtaaccagattgagatcaccattgccgcaaaaggcggcgggtcagagaacaaagcacgttttaccaccttgaaccccagcgcctccgtttccgactgggtgattgacacagtatcgacgcttggcagtgggtggtgtccgcccggcctgatctccgtcggcatcggtggtagcgctgaaaaggcgatgctgctggccaaggaggccatgaacaagcccatcgacatgtcggaactaatcgccagggggccgtcaagcgcggaggaggcattgcggattgagctttatgagcggattaacgcgctgggcatcggcgcccaaggcctcggtggcctgacgacagtcgtcgatgtcaaggttgcgacgtatcctacccatgcggcgtccaagcccgtggcgctcattccgcaatgcgccgccaaccggcacctgaagtttaccttggatggctccggaccaatcagggtgcagccgcccgatttgtgcgaatggcccgacattggaaccgacgaattgagtccagccggcgtgcgaagagtcaacctcgatgcgttgaccaaggaagagacggcatcgtggcgctgtggtgaaacgctccttctgtccggaaagatgctgacaggccgtgacgccgcccacaagcgaatggtcgagctgatcgacgccggcaaaccgcttccgttcgatctgcagggacgcgtgatatactacgttggacccgtccgcgccgtgcgagatgaggtcgtcggaccggctggcccaacaacctccagccgcttggacgattttacggacaaggtgctcgccgaaaccgggcttttcgcgatggtgggcaaagcggagaggggacgagcggccatcgagtcgatcgtaagacataaaacgccgtatctcatcgcagtgggtggggctgcctacctgatatcaaaatcaattaagtcagcgcggctcattgccttcgaagacctgggtatggaagcagtctatgaattcgaggtgcaggatatgcccgtgatcatggctgtcgatgttgatggaaactccattcacaattcagggcctcttgagtggcgcaagcgcatggcggccgacagcatcgcacgcaacatcggcgtttga

SEQ ID NO: 44257 - protein, 514 aa, Mesorhizobium loti MAFF303099
MGNRTRTIAGKDITRSVADALQYISYYHPPDYIRSLSQAYAREQSPAAKNAIGQILLNSRMAAFGRRPICQDTGLVVVFAKVGMETRIKSTISFADLVNEGVRQAYLDPDNPLRASIVADPLAGRVNTRDNTPAVVHVDLVQGNQIEITIAAKGGGSENKARFTTLNPSASVSDWVIDTVSTLGSGWCPPGLISVGIGGSAEKAMLLAKEAMNKPIDMSELIARGPSSAEEALRIELYERINALGIGAQGLGGLTTVVDVKVATYPTHAASKPVALIPQCAANRHLKFTLDGSGPIRVQPPDLCEWPDIGTDELSPAGVRRVNLDALTKEETASWRCGETLLLSGKMLTGRDAAHKRMVELIDAGKPLPFDLQGRVIYYVGPVRAVRDEVVGPAGPTTSSRLDDFTDKVLAETGLFAMVGKAERGRAAIESIVRHKTPYLIAVGGAAYLISKSIKSARLIAFEDLGMEAVYEFEVQDMPVIMAVDVDGNSIHNSGPLEWRKRMAADSIARNIGV

SEQ ID NO: 44258 - DNA, 1539 bp, Bacillus halodurans C-125
  CDS (1)..(1539): transl_table=11
atggagaaactgcaggaaagcatgtatcaactcatcgtcgaaacgtcaaccaatttaccgaatgatgtgcgccgtgcgattgcagaagcaaaggcaaaagagaacgctggaacacgggcagcactttctttatcgaccataacagaaaacattaaaatggccgatgaaaatatctctccaatctgtcaagatactgggatgccaacatttgaaataaaggttcccgttggcgtcaaccaaattgagatgaagaaggcgatctatgcagccattgaacaggcaacaaaagatggaaagcttcgtcccaattctgttgattcgctaacagggaaaaatagtggcaacaaccttggagaaggaacgccggtcatccattttgaacaatgggaagaggattacattgatgcccgcttgatcctaaagggaggcggctgtgaaaacaaaaacattcaatatagcttacctgctgaactagaaggtttaggccgtgctggacgtgaccttgacggaatccgtaaatgcattatgcactcggtataccaagctcaaggacaaggctgtagcgctggttttatcggtgttggtattggcggagaccggacaacgagctatagccttgcgaaggagcagctgttccgcaaagtcgatgatgtgaatccgaatgacgacttgcgaaagctcgaagaatacgtattagagaatgcaaataaacttgggatcggtacgatgggctttggtggagaagcaacccttttaggctgtaaggtcggggcgatgaaccgtctcccagcaagcttttttgtctctgttgcgtacaactgctgggcgtttcgtcgtctcggcgtcgagctagacgcggaaaccggtgagattaaaaaatggctctacaaagatggtgaacgagtcgacttaaatgaagtggcaagccaagtcgctgcaaccgctgagacaacggaagtacgtgaggttgtgcttgaagcgccagttacagaagagcaaattcgggaattaaaggtcggggatgtcgttattattaatggcatgcttcacaccggtcgagatgcgatccaccatcacttaatggatcatgatgcaccgatcgacttggacggacaaatcatttaccactgcggaccggtcatgctccaagatgacgcaggggaatggcatgtaaaggcagcaggtccaacgacaagtattcgtgaagagccgtaccaaggagacattatgaaaaaattcggcattcgtgcagtcattggaaaaggtggcatgggaccaaaaacattgaaagccttacaggagcatggcggtgtgtatttgaatgcgattggcggcgctgctcaatattatgcggactgtattaagaaagtgaagggtgtcgacttaatggaatttggaattcctgaagcgatgtggcatttagaagtggaagggttcgcagcgattgtgacgatggattctcatggaaatagtcttcacgaagatgtcgataaatcatcacttgaaaagctcgaacaatttgcagaaaaggtcttttaa

SEQ ID NO: 44259 - protein, 512 aa, Bacillus halodurans C-125
MEKLQESMYQLIVETSTNLPNDVRRAIAEAKAKENAGTRAALSLSTITENIKMADENISPICQDTGMPTFEIKVPVGVNQIEMKKAIYAAIEQATKDGKLRPNSVDSLTGKNSGNNLGEGTPVIHFEQWEEDYIDARLILKGGGCENKNIQYSLPAELEGLGRAGRDLDGIRKCIMHSVYQAQGQGCSAGFIGVGIGGDRTTSYSLAKEQLFRKVDDVNPNDDLRKLEEYVLENANKLGIGTMGFGGEATLLGCKVGAMNRLPASFFVSVAYNCWAFRRLGVELDAETGEIKKWLYKDGERVDLNEVASQVAATAETTEVREVVLEAPVTEEQIRELKVGDVVIINGMLHTGRDAIHHHLMDHDAPIDLDGQIIYHCGPVMLQDDAGEWHVKAAGPTTSIREEPYQGDIMKKFGIRAVIGKGGMGPKTLKALQEHGGVYLNAIGGAAQYYADCIKKVKGVDLMEFGIPEAMWHLEVEGFAAIVTMDSHGNSLHEDVDKSSLEKLEQFAEKVF

SEQ ID NO: 44260 - DNA, 1524 bp, Pseudomonas aeruginosa PAO1
  CDS (1)..(1524): transl_table=11
atggccgtgatcaagcaagacgacctgatccagagcgtcgccgatgccctgcagttcatctcctactaccacccggtcgatttcatccaggccatgcatgaggcctacctgcgcgaagaatcgccggctgcccgcgactccatggcgcagatcctgatcaactcgcgcatgtgcgccaccggccaccgcccgatctgccaggacaccgggatcgtcaccgtgttcgtccgggtcggcatggacgtgcgctgggacggcgctaccatgagcgtcgacgatatgatcaacgaaggcgtgcgtcgcgcctacaacctgccggagaacgtcctgcgcgcctcgatcctggccgacccggccggcgcgcggaagaacaccaaggacaacacgccggcggtgatccactactccatcgttcccggcgacaaggtcgaagtcgatgtcgcggccaagggcggcggctcggagaacaagtcgaagatggccatgctcaacccgtccgactcgatcgtcgactgggtgctgaaaaccgtaccgaccatgggcgccggctggtgcccgccgggcatgctcggcatcggcatcggcggcaccgcggagaaagcagcggtgatggcgaaggaagtcctcatggacccgatcgacatccacgaactgaaggcccgcggcccgcagaaccgcatcgaggaactgcgcctggagctgttcgagaaggtcaaccagttgggcatcggtgcccagggcctgggcggcctgaccaccgtgctcgacgtcaagatcatggactacccgacccacgccgcctcgctgccggtgtgcatgatccccaactgcgccgcgacccgccacgcccacttcgtgctcgacggctccggccccgccgaactggaagcgccgtcgctcgacgcctacccggagatcgtctgggaagccggcccgtccgcgcgccgcgtcgacctggacaagatcaccccggaagaggtgcaaagctggaaaccgggcgagaccctgctgctcaacggcaagatgctcaccggccgcgacgccgcgcacaagcgcatggtcgacatgctgaacaagggcgaaacgctgccggtggacctgaaaggccgcttcatctattacgtcggcccggtcgatccggtcggcgacgaggtggtcggcccggccggtcccaccaccgccacccggatggacaagttcacccgccagatcctcgaacagaccggcctgctgggcatgatcggcaagtccgagcgcggtcccatcgccatcgaggcgatcaaggacaacaaggcggtatacctgatggccgtcggcggcgccgcctacctggtcgcccaggcgatcaagaagtccaaggtgctggccttcgccgaactgggcatggaagcgatctacgagttcgaggtaaaggacatgccggtcaccgtcgcggttgacaccaacggcgagtcggtgcacatcaccggcccagcggtctggcagaagaagatcgccgaaagcctggcggtcgaggtcaagtaa

SEQ ID NO: 44261 - protein, 507 aa, Pseudomonas aeruginosa PAO1
MAVIKQDDLIQSVADALQFISYYHPVDFIQAMHEAYLREESPAARDSMAQILINSRMCATGHRPICQDTGIVTVFVRVGMDVRWDGATMSVDDMINEGVRRAYNLPENVLRASILADPAGARKNTKDNTPAVIHYSIVPGDKVEVDVAAKGGGSENKSKMAMLNPSDSIVDWVLKTVPTMGAGWCPPGMLGIGIGGTAEKAAVMAKEVLMDPIDIHELKARGPQNRIEELRLELFEKVNQLGIGAQGLGGLTTVLDVKIMDYPTHAASLPVCMIPNCAATRHAHFVLDGSGPAELEAPSLDAYPEIVWEAGPSARRVDLDKITPEEVQSWKPGETLLLNGKMLTGRDAAHKRMVDMLNKGETLPVDLKGRFIYYVGPVDPVGDEVVGPAGPTTATRMDKFTRQILEQTGLLGMIGKSERGPIAIEAIKDNKAVYLMAVGGAAYLVAQAIKKSKVLAFAELGMEAIYEFEVKDMPVTVAVDTNGESVHITGPAVWQKKIAESLAVEVK

SEQ ID NO: 44262 - DNA, 1524 bp, Neisseria meningitidis MC58
  CDS (1)..(1524): transl_table=11
atgaccgtcatcaaacaggaagactttatccaaagcatttgcgatgccttccaattcatcagctactatcatcccaaagactacatcgacgcgctttataaggcgtggcagaaggaagaaaatcctgccgccaaagacgcgatgacgcagattttggtcaacagccgtatgtgtgcggaaaacaaccgccccatctgccaagacacaggtatcgcaaccgtcttcctcaaagtcggtatgaacgtccaatgggatgcggacatgagcgtggaagagatggttaacgaaggcgtacgccgcgcctacacttgggaaggcaatacgctgcgcgcttccgtcctcgccgatccggccggcaaacgccaaaacaccaaagacaacacccccgccgtcatccatatgagcatcgtgccgggcggtaaagtcgaagtaacctgcgcggcaaaaggcggcggctctgaaaacaaatccaaactcgccatgctcaatccttccgacaacatcgtcgattgggtattgaaaaccatcccgaccatgggcgcgggctggtgtcctcccggcatcttgggtatcggcatcggcggcacgcccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttga

SEQ ID NO: 44263 - protein, 507 aa, Neisseria meningitidis MC58
MTVIKQEDFIQSICDAFQFISYYHPKDYIDALYKAWQKEENPAAKDAMTQILVNSRMCAENNRPICQDTGIATVFLKVGMNVQWDADMSVEEMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLNKGEELPVDFTNRLIYYVGPVDPVGDEVVGPAGPTTATRMDKFTRQMLEQTDLLGMIGKSERGVATCEAIADNKAVYLMAVGGAAYLVAKAIKSSKVLAFPELGMEAIYEFEVKDMPVTVAVDSKGESIHATAPRKWQAKIGIIPVES

SEQ ID NO: 44264 - DNA, 1641 bp, Neisseria meningitidis Z2491
  CDS (1)..(1641): transl_table=11
ttgtctttaccgtacaaacgctggcactatttcaacctgataaaaaacagccttcaaaaaggttgtttaaaacagcagcagacacttaccgccacaaccttgaaaaggaacacaatcatgaccgtcatcaaacaggaagactttatccaaagcatttgcgatgccttccaattcatcagctactaccatcccaaagactacatcgacgcgctttataaggcgtggcagaaggaagaaaaccccgccgccaaagacgcgatgacgcagattttggtcaacagccgcatgtgtgccgaaaacaaccgccccatctgccaagataccggtatcgcgaccgtgtttttgaaagtcggtatggatgtgcaatgggatgcagacatgagcgtcgaagagatggttaacgaaggcgtgcgccgcgcctacacttgggaaggcaatacgctgcgcgcttccgttctcgccgaccccgccggcaaacgccaaaataccaaagacaacacgcccgccgtcatccatatgagcatcgtgccgggcgacaaagtcgaagtaacctgcgcggcaaaaggcggcggttctgaaaacaaatccaaactcgccatgctcaacccttccgacaacatcgtcgattgggtattgaaaaccattccgaccatgggcgcgggctggtgtcctcccggcatcttgggcatcggcatcggcggtacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaagtcaacgcgctaggcatcggcgcgcaaggcttgggcggtctgaccaccgtgttggacgtgaaaatcctcgattacccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcgacaaaggcgaagaattgcccgtcgatttcaccaaccgcctgatttactacgtcggccccgtcgatccggtcggcgacgaaatcgtcggcccagcaggtccgaccaccgccacccgcatggacaaattcacccgccaaatgctcgaacaaaccgacctcttgggcatgatcggcaaatccgagcgcggcgcggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagacagcaaaggcgaatccatccacgccaccgccccgccccaatggcaggcgaaaatcggcatcatccccgtcaaatcttga

SEQ ID NO: 44265 - protein, 546 aa, Neisseria meningitidis Z2491
MSLPYKRWHYFNLIKNSLQKGCLKQQQTLTATTLKRNTIMTVIKQEDFIQSICDAFQFISYYHPKDYIDALYKAWQKEENPAAKDAMTQILVNSRMCAENNRPICQDTGIATVFLKVGMDVQWDADMSVEEMVNEGVRRAYTWEGNTLRASVLADPAGKRQNTKDNTPAVIHMSIVPGDKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLDKGEELPVDFTNRLIYYVGPVDPVGDEIVGPAGPTTATRMDKFTRQMLEQTDLLGMIGKSERGAATCEAIADNKAVYLMAVGGAAYLVAKAIKSSKVLAFPELGMEAIYEFEVKDMPVTVAVDSKGESIHATAPPQWQAKIGIIPVKS

SEQ ID NO: 44266 - DNA, 1656 bp, Xylella fastidiosa 9a5c
  CDS (1)..(1656): transl_table=11
ttggaagaaaatttaagcgataagcggggtagggatgtaagcggtttcagtggggggatcgcaatgtttatcctatggctgatgtattcagggggattacaatggcaacgttttttagtcagccataagggccagccggtgtcattgatcaaacaagaagactttatccagtccatcgctgatgcgctgcaatacatcagttactaccatccggtcgattacatcaagactctggttttggcgtatgagcgcgaggaatcgcccgccgctaaagatgcaatggcgcagattttgattaactcacgtatgtgtgcggaggggcgccgcccgatttgccaagatacagggattgtcacggtgttccttagcatcgggatggaggtacgttgggatgacgtcacgatggatgtggaagagatggtgaatgagggggttcgccgtgcctatcgtcatccggataacacgctacgtgcgtctgtgcttgctgatcctgccggcaagcgctgcaatacgagggacaatacgccagcagtcgttaacgtcaaggttgtttctgggggccatgttgaagtgattgttgctgccaagggagggggatcggaggccaagagcaaatttgcaatgctaaatccatcggattccatcgttgattgggtcctggacactgtgccaaccatgggggctggctggtgcccaccagggatgcttgggatcggtatcggtggtacggctgagaaagcgatgctgctcgctaaggaagcgttgatggaaccgattgacatccaggatttgatggtacgcggcccttccaatcgtgctgaagaattacgcttggagttgtacgagaaggtcaatgctttggggatcggtgctcagggggtgggtggggtgacgacggtattagacattaaagtcaaagattatccaacgcatgctgctaatttgccggtagcgatgatccctaattgtgcgtccacacgccatgcccatttcacattggacggtagcggtccagttgctctggaaccgccgtcattagagcattggcctaagttgagctatctcccggagtctgcccgccaggtgaatttgaatacgatgaccagggatgaggtggcgcagttcaaaccaggtgaggtgttgctactcagcggcaaattgttgacggggcgagatgctgcgcataagcgtatcgttgagatgctcaacaagggggagacattaccagttgatttcacgaatcgctttatctactacgtgggtccggtggatcctgtgcgtgatgaagtcgtcggtcctgcgggtccaaccacagcaacgcgtatggataagttcacgcgtcagatgctggagcaggccgggttgctcggtatggtgggcaaggccgagcgtggccctactgccatcgctgcaatccgtgacaacaaagccgtgtatctgatggcggtgggaggggcggcttatcttgtgtccaaggcgatcaaaacgagccggatactggcttttgaagatcttggcatggaggcaatttatgagtttgaagtcaaggagatgcctgtaacagtggcggttgattgcaacggtgagtcgatacatacaactgggccgcgtgagtggcggagccggatcggaaaaattccggttgttgtggagtag

SEQ ID NO: 44267 - protein, 551 aa, Xylella fastidiosa 9a5c
MEENLSDKRGRDVSGFSGGIAMFILWLMYSGGLQWQRFLVSHKGQPVSLIKQEDFIQSIADALQYISYYHPVDYIKTLVLAYEREESPAAKDAMAQILINSRMCAEGRRPICQDTGIVTVFLSIGMEVRWDDVTMDVEEMVNEGVRRAYRHPDNTLRASVLADPAGKRCNTRDNTPAVVNVKVVSGGHVEVIVAAKGGGSEAKSKFAMLNPSDSIVDWVLDTVPTMGAGWCPPGMLGIGIGGTAEKAMLLAKEALMEPIDIQDLMVRGPSNRAEELRLELYEKVNALGIGAQGVGGVTTVLDIKVKDYPTHAANLPVAMIPNCASTRHAHFTLDGSGPVALEPPSLEHWPKLSYLPESARQVNLNTMTRDEVAQFKPGEVLLLSGKLLTGRDAAHKRIVEMLNKGETLPVDFTNRFIYYVGPVDPVRDEVVGPAGPTTATRMDKFTRQMLEQAGLLGMVGKAERGPTAIAAIRDNKAVYLMAVGGAAYLVSKAIKTSRILAFEDLGMEAIYEFEVKEMPVTVAVDCNGESIHTTGPREWRSRIGKIPVVVE

SEQ ID NO: 44268 - DNA, 1647 bp, Escherichia coli K12
  CDS (1)..(1647): transl_table=11
atgtcaaacaaaccctttcattatcaggctccttttccactcaaaaaagatgatactgagtattacctgctaaccagcgaacacgttagcgtatctgaatttgaagggcaggagattttgaaagtcgcacccgaagcgttaactctgttggcgcgccaggcgtttcatgatgcgtcgttcatgctgcgtccggcgcaccaacaacaggtggccgacattctgcgtgacccggaggccagcgaaaatgataaatatgtggcgctgcaattcctgcgtaactccgacatcgcggcgaaaggcgttctgccaacctgtcaggataccggcaccgcgattattgttggtaaaaaagggcagcgtgtatggaccggtggtggtgatgaagcggcgctggcgcgcggtgtctataacacttatatcgaagataatctgcgctactcgcaaaacgcgccgctggatatgtataaagaagtgaataccggcaccaatctgccagcgcagatcgatctttatgccgttgatggcgacgaatacaaattcctctgtatcgccaaaggtggtggttcggcaaacaagacgtatctctatcaggaaaccaaagcgttactgacgccggggaaactgaaaaattacctggttgagaagatgcgcacgctgggtacggcggcctgtcctccgtatcatattgcgttcgttattggtggaacttctgcagaaacgaaccttaaaacggtgaaactggcttccgcgaaatactatgatgaactgccaacggaagggaatgagcacggtcaggcgttccgcgatgtggaactggaaaaagaattgctgatcgaagcgcaaaatcttggtctgggtgcgcagtttggtggtaaatacttcgctcacgacatccgcgtgattcgcctgccacgtcacggcgcatcctgcccggtcggtatgggcgtctcctgctctgctgaccgtaatatcaaagcgaagatcaaccgtcaggggatctggatcgaaaaactggaacataatccaggcaaatatatcccggaagagctgcgcaaagcgggagaaggcgaagcggtgcgcgttgaccttaaccgtccgatgaaagagatcctcgcacagttgtcgcagtatcccgtttctacacgcttatcgcttaacggcacgattatcgtcggtcgtgatattgctcacgccaaactgaaagagcggatggataacggtgaagggctgccgcagtacatcaaagatcatccgatttactacgcgggtccggccaaaacgccggaaggttatgcctccggttctcttggcccaacgaccgccggacggatggattcttatgtcgatcaactgcaagcgcagggcggaagtatgatcatgctggcgaaaggcaaccgcagccagcaggtgacggatgcctgtaaaaaacacggcggcttctaccttggcagtatcggtggtccggccgctgtattggcgcagggaagtattaagagcctggaatgtgttgaatatccggaactgggaatggaagccatctggaaaattgaagtggaagatttcccggcgtttatccttgtggatgataaaggaaatgacttcttccagcagatacaactcacacaatgcacccgctgtgtgaaataa

SEQ ID NO: 44269 - protein, 548 aa, Escherichia coli K12
MSNKPFHYQAPFPLKKDDTEYYLLTSEHVSVSEFEGQEILKVAPEALTLLARQAFHDASFMLRPAHQQQVADILRDPEASENDKYVALQFLRNSDIAAKGVLPTCQDTGTAIIVGKKGQRVWTGGGDEAALARGVYNTYIEDNLRYSQNAPLDMYKEVNTGTNLPAQIDLYAVDGDEYKFLCIAKGGGSANKTYLYQETKALLTPGKLKNYLVEKMRTLGTAACPPYHIAFVIGGTSAETNLKTVKLASAKYYDELPTEGNEHGQAFRDVELEKELLIEAQNLGLGAQFGGKYFAHDIRVIRLPRHGASCPVGMGVSCSADRNIKAKINRQGIWIEKLEHNPGKYIPEELRKAGEGEAVRVDLNRPMKEILAQLSQYPVSTRLSLNGTIIVGRDIAHAKLKERMDNGEGLPQYIKDHPIYYAGPAKTPEGYASGSLGPTTAGRMDSYVDQLQAQGGSMIMLAKGNRSQQVTDACKKHGGFYLGSIGGPAAVLAQGSIKSLECVEYPELGMEAIWKIEVEDFPAFILVDDKGNDFFQQIQLTQCTRCVK

SEQ ID NO: 44270 - DNA, 1524 bp, Ralstonia solanacearum GMI1000
  CDS (1)..(1524): transl_table=11
atgaccgtcattcgtcaagaagacctcatccagagcgtcgccgactccctgcagtacatcagctattaccacccgatggactacatcactgctctgggccaggcctatgagcaggagcagagcccggccgccaaggatgccatcgcgcagatcctgaccaacagccgcatgtgcgccgaaggcaagcgcccgatctgccaggacaccggcatcgtcaccgtgttcctgaaagtcggcatgaacgtgcgctgggacggcgccacgatgagcctggaagacatggtcaacgaaggcgtgcgccgcgcctataacgaccaggacaacaagctgcgcgccagcgtcctggccgacccggccggcaagcgcaccaacacgaaggacaacaccccggcggtgatcaacatgtccatcgtgccgggcgacacagtggacgtgatcgtcgcggccaagggcggcggctccgaggccaagtccaagttcgtgatgctcaacccgtccgactcgatcgtcgactgggtgctcaagacggtgccgaccatgggcgccggctggtgcccgccgggcatgctgggcatcggcatcggcggcaccgccgagaaggcgatgctgctggccaaggaagccctgatggagccgatcgacatccaggacctgatcgcgcgcggcccgtcgaaccgcgccgaagagctgcgcatcgagctctacgaaaaggtcaacgcactgggtatcggggcccagggcctgggcggcctcgccaccgtgctcgacgtgaagatcaaggactacccgacccacgccgccaacctgccggtggccatgatcccgaactgcgcggccacccgccacgcgcacttcacgctggacggcagcggcgtcgccaagctcgaagcgccggacctgtcgcaatggccgaaggtcgagtgggcgccgaacaccgaaacctccaagcgcgttgatctgaacgcgctcacgccggaagaagtcgcctcgtggaagccgggccaaaccctgctgctcaacggcaagatgctcacgggccgcgacgccgcgcacaagcgcatcgccgacatgctggcccgcggcgaacagttgccgatcgacttcaccaaccgcgtgatctactacgtcggcccggtcgatccggtgcgcgacgaggtggtcggtccggccggccccaccacggccacgcgcatggacaagttcaccgagacgatgctcgccaagaccggcctgatcgccatggtcggcaaggccgagcgcggtccggtcgccatcgaggccatccagaagcacaagtcggcctacctgatggccgtgggcggcgcggcctaccttgtgtccaaggccatccgcggcgcgaaggtgctggcattcgaagacctgggcatggaagccatctacgaattcgacgtgaaggacatgcccgtcaccgtggcggtcgacagcgcgggcacctcggtgcacaagaccggcccggcggaatggcaggccaagatcggcaagatcccggtcgccgcggcgtga

SEQ ID NO: 44271 - protein, 507 aa, Ralstonia solanacearum GMI1000
MTVIRQEDLIQSVADSLQYISYYHPMDYITALGQAYEQEQSPAAKDAIAQILTNSRMCAEGKRPICQDTGIVTVFLKVGMNVRWDGATMSLEDMVNEGVRRAYNDQDNKLRASVLADPAGKRTNTKDNTPAVINMSIVPGDTVDVIVAAKGGGSEAKSKFVMLNPSDSIVDWVLKTVPTMGAGWCPPGMLGIGIGGTAEKAMLLAKEALMEPIDIQDLIARGPSNRAEELRIELYEKVNALGIGAQGLGGLATVLDVKIKDYPTHAANLPVAMIPNCAATRHAHFTLDGSGVAKLEAPDLSQWPKVEWAPNTETSKRVDLNALTPEEVASWKPGQTLLLNGKMLTGRDAAHKRIADMLARGEQLPIDFTNRVIYYVGPVDPVRDEVVGPAGPTTATRMDKFTETMLAKTGLIAMVGKAERGPVAIEAIQKHKSAYLMAVGGAAYLVSKAIRGAKVLAFEDLGMEAIYEFDVKDMPVTVAVDSAGTSVHKTGPAEWQAKIGKIPVAAA

SEQ ID NO: 44272 - DNA, 1677 bp, Streptomyces coelicolor A3(2)
  CDS (1)..(1677)
atgggcgagatgcctgagttcgcgtacaccgatctgctcccccagggcgaggacaccactccgtaccggctggtgaccgccgagggtgtcgccaccttcgaggccgacgggcggaccttcctcaaggtggagccggaggccctgcgcaagctggccgaggaggccgttcacgacatccagcactacctgcgcccggcgcacctggcacagctgcgccgcatcatcgacgacccggaggcgtccggcaacgacaagttcgtcgccctggacctgctgaagaacgcgaacatcgcggctgcgggcgtgctgccgatgtgccaggacaccggcacggcgatcgtcatgggcaagcgcggccagaacgtgctcaccgagggcggtgacgaggaggccctgagccggggcatctacgacgcgtacaagaacctgaacctgcgctactcccagatggccccgctgaccatgtgggaggagaagaacaccggctccaacctccccgcccagatcgagctgtacgcgaccgacggcggcgcctacaagttcctcttcatggcgaagggcggcggctcggccaacaagtccttcctctaccaggagacgaaggccgtcctgaacgagtcctccatgatgaagttcctggaggagaagatccgctcgctcggcacggccgcctgcccgccgtaccacctggcgatcgtggtcggcggcacgtcggccgagtacgcgctgaagaccgcgaagtacgcctccgcgcactacctggacgagatcccggccgagggctcggagctcgggcacggcttccgggacaaggagctggaggagaaggtcttcgagctgacccagaagatcggcatcggcgctcagttcggcggcaagtacttctgccacgacgtgcgcgtggtgcggctgccccggcacggggcgtcctgcccggtcgccatcgcggtgtcctgctcggcggaccggcaggcggtcgcgaagatcaccgccgagggcgtcttcctggagcagctggagaccgacccggcgcggttcctgccggagaccacggacgagcatctggaggaggagggcgacgtcgtcaaggtcgacctcaaccagccgatggacgacatcctcgccgagctgaccaggcacccggtcaagacccggctgtcgctgaccggtccgctggtggtggcccgcgacatcgcgcacgccaagatcaaggagcggctggacgcgggcgaggagatgccgcagtacctgaaggaccacccggtgtactacgcgggccccgcgaagacgcccgagggctacgcctccgggtccttcggtccgaccaccgccgggcgcatggactcctacgtcgagcagttccaggcggcgggcggctccaaggtgatgctggccaagggcaaccggagcaagcaggtcaccgacgcgtgcgacgcgcacggcggcttctacctgggctcgatcggcgggcccgcggcgcggctcgcacaggactgcatcaagaaggtcgaggtcgtcgagtacgaggagctcggcatggaggcggtctggaagatcgaggtcgaggacttccccgcgttcatcgtggtggacgacaagggcaacgacttcttccaggacccggcgcccgcgccgacgttcacgacgattccggtacgggggccgggcctggcgtaa

SEQ ID NO: 44273 - protein, 558 aa, Streptomyces coelicolor A3(2)
MGEMPEFAYTDLLPQGEDTTPYRLVTAEGVATFEADGRTFLKVEPEALRKLAEEAVHDIQHYLRPAHLAQLRRIIDDPEASGNDKFVALDLLKNANIAAAGVLPMCQDTGTAIVMGKRGQNVLTEGGDEEALSRGIYDAYKNLNLRYSQMAPLTMWEEKNTGSNLPAQIELYATDGGAYKFLFMAKGGGSANKSFLYQETKAVLNESSMMKFLEEKIRSLGTAACPPYHLAIVVGGTSAEYALKTAKYASAHYLDEIPAEGSELGHGFRDKELEEKVFELTQKIGIGAQFGGKYFCHDVRVVRLPRHGASCPVAIAVSCSADRQAVAKITAEGVFLEQLETDPARFLPETTDEHLEEEGDVVKVDLNQPMDDILAELTRHPVKTRLSLTGPLVVARDIAHAKIKERLDAGEEMPQYLKDHPVYYAGPAKTPEGYASGSFGPTTAGRMDSYVEQFQAAGGSKVMLAKGNRSKQVTDACDAHGGFYLGSIGGPAARLAQDCIKKVEVVEYEELGMEAVWKIEVEDFPAFIVVDDKGNDFFQDPAPAPTFTTIPVRGPGLA

SEQ ID NO: 44274 - DNA, 1512 bp, Chlorobium tepidum TLS
  CDS (1)..(1512): transl_table=11
atgatcgccttgatcaccgagacctccacgaatctgccgagcgacgttcgcaaggccatcgccgatgccgttggcaatgatgctgccgattcgagggccggacttgccatgtctgccatcacgctcaatatcgacatggcggtcgataatgtcggcccggtttgccaggataccggtatgcctaccttcttcgtgcacacgccgaaaggcgctgaccagctcgccatgaagcgcgacatcgaggaggctgtcgtcgaggcaacccgaaccggcaagcttcgtcccaatgcggtcgattcgctgaccggtaagaactccggcaacaaccttggctgccatgtgccggtgatccatttcgagccgtgggatcgcgacgagatcgaggtgaagctcatcctcaaaggcggcggctgcgagaacaaaaacatccagtactcgctgcctgccgatattcccggacttggccgcgcggctcgcgacctcgacggcgtgcgtaagtgcatcctccacgccgtgtaccaggcgcagggacaggggtgcagccccggcttcatcggcgtcggcgtcggtggcgaccgcaccagcagcttcgagctggccaagaagcagttgctccgctcggtcgatgacaccaattccgatgcggtgctggccgaactcgaacaggagattctcgacaaggctaaccgcctgaacatcgggccgatgggctttgccggcaagaccacgctgcttggctgcaagatcggcacatcgcatcgcgttccggctagcttctttgtctcggtagcctacaattgctgggcctatcgccgtcttggcgtcatcatcgacccgaaagagggttcgatttccgagtggcagtaccgctatccgggcgaaatcaagcgcatggcgcgcggcgcgggcattccgctgacgggccgtgaggtggtgctcaccgcgccggtcagcgaggagacgatccgctcgctcaaggttggcgacatcgtgatcgttgatggcgaaatgcacaccggacgcgatgccttccaccactacatcatgcaccatgatctgcccgagggtctcgacatccgcggcggcatcatctaccactgcggcccggtgatgctcaagaacgaggcgggcgagtacacggtcgttgctgccgggccgaccacttcgattcgcgaggagccttaccagtcggacgtgatcgaaaagctcggacttcgcgcggtgattggcaagggcggcatggggccgaagacgcttgcgggcttgcagaagcacggtgcggtctatctcaacgccatcggcggtgcggcgcagtactacgccaggtgcatcgaaaaggtgaccggcgtcgatttcttggaagagatgggcgtgccggaggcgatgtggcacttgcaggccaaagccttcccgtgcatcgtcacgatggacgcgcacggcaacagcctgcacaagcaggtcgatgaggagtccttcgcgatgcttgaaaacatcggcaaggagcaggcgtaa

SEQ ID NO: 44275 - protein, 503 aa, Chlorobium tepidum TLS
MIALITETSTNLPSDVRKAIADAVGNDAADSRAGLAMSAITLNIDMAVDNVGPVCQDTGMPTFFVHTPKGADQLAMKRDIEEAVVEATRTGKLRPNAVDSLTGKNSGNNLGCHVPVIHFEPWDRDEIEVKLILKGGGCENKNIQYSLPADIPGLGRAARDLDGVRKCILHAVYQAQGQGCSPGFIGVGVGGDRTSSFELAKKQLLRSVDDTNSDAVLAELEQEILDKANRLNIGPMGFAGKTTLLGCKIGTSHRVPASFFVSVAYNCWAYRRLGVIIDPKEGSISEWQYRYPGEIKRMARGAGIPLTGREVVLTAPVSEETIRSLKVGDIVIVDGEMHTGRDAFHHYIMHHDLPEGLDIRGGIIYHCGPVMLKNEAGEYTVVAAGPTTSIREEPYQSDVIEKLGLRAVIGKGGMGPKTLAGLQKHGAVYLNAIGGAAQYYARCIEKVTGVDFLEEMGVPEAMWHLQAKAFPCIVTMDAHGNSLHKQVDEESFAMLENIGKEQA

SEQ ID NO: 44276 - DNA, 1644 bp, Yersinia pestis KIM
  CDS (1)..(1644): transl_table=11
atgtcaaacaaaccgttccactatcaggatcccttcccgctcaaggaagatgatactgaatattaccttgtcagtgataaacatgtctcagttgcacagtttgaaggacacgacatcctaaaagtcgagccggaagccctgaccctcctcgctcaacaggctttccacgatgcctctttcctcctgcgccccgctcaccaaaaacaagttgccgccattctggatgacccggaagccagcgaaaacgataaatatgtcgccctgcaattcctacgtaactctgagatttcggctaaagggattttacccacctgtcaagataccggcaccgcgatcatcatgggcaaaaaaggccagcgggtctggactgggggtaacgatgccgaagcgttatcacgtggggtctataacacctttattgaagataacctgcgctattcacaaaacgccgcgctggatatgtataaggaagtgaataccggtaccaacctgccagcacagatcgatctatacagcaccgaaggtgaagagtacaaattcttgtttgtgactaaaggcggcggttcagccaataaaacctatctgtatcaggaaaccaaagccctgctcacaccgggcaggctgaaagcgtttttggtcgagaaaatgcgcacattgggtaccgcggcttgcccgccttatcacattgcctttgtcatcggcggtacctctgccgaaagtacgctgaagacggttaaactggcctcgaccaaatattacgatggcttgccgaccgaagggaatgaacacggccaagcgttccgtgacactgcgttagagcaagaattgctggaagcagcacaagatttaggtctgggcgcgcaatttggcggcaaatactttgcccacgatgttcgggtcgttcgcctgccacgccacggagcctcctgcccggtcggcatgggggtatcttgttctgctgaccgtaatatcaaaggcaaaattaaccgcaaaggcatttggttggagaaactggaacagaatccagggaaatatattcccgaacatttgcgccacagcactgaaggccaagtggttaaaattgatcttaaccgcccgatgcctgaaattttaaaagagctgtcacagtacccggtctccacccgcctgtcgttaagcggcaccattattgttggccgtgatatcgcccatgccaaattaaaagagcggctggataacggtgaaggcttaccacaatacattaaagatcatccgatctattacgccggaccggccaaaacccccgaaggctatgcttcaggatcactcgggccaaccaccgcagggcgcatggactcttacgtggatctgctgcaatcccacgggggtagcatgatcatgttagccaaaggcaaccgtagccagcaagtgaccgacgcctgccataaacacgggggcttctatctgggcagcatcggtggcccggcagcggtattggcgcaaaacagtattaagagtctggaatgtgtggaatatcctgaattagggatggaagccatctggaagattgaagtggaagacttcccagcctttattttagttgatgataagggcaatgatttcttccagcagatccaagcggcaaaatgcaaccgttgtggctga

SEQ ID NO: 44277 - protein, 547 aa, Yersinia pestis KIM
MSNKPFHYQDPFPLKEDDTEYYLVSDKHVSVAQFEGHDILKVEPEALTLLAQQAFHDASFLLRPAHQKQVAAILDDPEASENDKYVALQFLRNSEISAKGILPTCQDTGTAIIMGKKGQRVWTGGNDAEALSRGVYNTFIEDNLRYSQNAALDMYKEVNTGTNLPAQIDLYSTEGEEYKFLFVTKGGGSANKTYLYQETKALLTPGRLKAFLVEKMRTLGTAACPPYHIAFVIGGTSAESTLKTVKLASTKYYDGLPTEGNEHGQAFRDTALEQELLEAAQDLGLGAQFGGKYFAHDVRVVRLPRHGASCPVGMGVSCSADRNIKGKINRKGIWLEKLEQNPGKYIPEHLRHSTEGQVVKIDLNRPMPEILKELSQYPVSTRLSLSGTIIVGRDIAHAKLKERLDNGEGLPQYIKDHPIYYAGPAKTPEGYASGSLGPTTAGRMDSYVDLLQSHGGSMIMLAKGNRSQQVTDACHKHGGFYLGSIGGPAAVLAQNSIKSLECVEYPELGMEAIWKIEVEDFPAFILVDDKGNDFFQQIQAAKCNRCG

SEQ ID NO: 44278 - DNA, 1620 bp, Brucella suis 1330
  CDS (1)..(1620): transl_table=11
atggcagaagcaagcaccgccgatcttttccctcttggcgaagacgacaccccttatcgcaaactgacttcggattatgtgtcggtggacacgttcaaggggcaggaagtcctgactgtggacccggaagggcttcgcctgctttcagaagtagcctttgccgatatcaaccatctgctgcgccccggccatctgcaacagcttgcaaagattcttcaggatcccgaagcaaccgacaatgaccgcttcgtcgcctacgaccttttgaagaacgccaatatcgcagccggcggcgtgctgcccatgtgccaggataccggcacggccattatcatgggcaagaagggccgccgcgtctggaccgaaggcggcgatgccgatgcgctcggcgccggtgtgctggacgcctataacaagaagaacctgcgttattcgcagctcgccccgctttcgatgttcgaggaaaagaacaccaagaacaacctgcccgcgcagatcgatatctatgaagaaggcgaagacgcctacaagttcctgttcgttgccaagggcggcggttcggcgaacaagacgtttctctatcagggaacgccttcgcttctgacgcatgaccgcatgattgatttcctcaaggacaaaatcctgagcctcggcacagccgcctgcccgccctatcatctggccatcgtcattggcggcacttcggcggaaatgaacctgaagacggtgaagcttgcttccacgcgctatctcgacagcctgccgaccaaaggctcggaaaccggccacgccttccgcgaccttgaaatggaagcagaaattcacaagctgacccagtcgctcggtgtcggcgcgcagttcggcggcaaatatttctgccatgacgtgcgcgtcatccgcctgccccgccacggcgcttcgctgccgatcggcatcggcgtttcctgttcggccgaccgtcaggcgaagggcaagatcaccaaggacggcattttccttgagcagcttgaagccaatccggcaaaatacatgccggatatcgacgaggaaaagctgaccgcgcatgtggtcaagatcgacctcaaccagccgatgtcggaaatactcaaggaactctcgaagcatccggtcaagacgcgtctttcgctctccggcccgatcatcgtggcgcgcgatctggcacatgcgaaaatccgcgaacggctggaaaacggcgagccaatgccggattacttcaagaaccacccgatctattatgcgggccccgccaagacgcccgcgggctatgcttccggctccttcgggccgacaacggcaggccgcatggattcctacgtggaccagttccagtctttcggcggctccatggtcatgctcgccaagggcaaccgttcgcgccaggtgcgcgaagcctgcggccagcacgggggcttctatctcggctccatcggcgggccggccgcacgtcttgcgcaagactgcatcaaaaaggtggaagtcgtcgagtacccggaacttggcatggaggccatctggcgcattgaagtcgaagatttcccggctttcatcgttatcgatgacaagggcaatgacttcttcaaggaattcaacctgagttga

SEQ ID NO: 44279 - protein, 539 aa, Brucella suis 1330
MAEASTADLFPLGEDDTPYRKLTSDYVSVDTFKGQEVLTVDPEGLRLLSEVAFADINHLLRPGHLQQLAKILQDPEATDNDRFVAYDLLKNANIAAGGVLPMCQDTGTAIIMGKKGRRVWTEGGDADALGAGVLDAYNKKNLRYSQLAPLSMFEEKNTKNNLPAQIDIYEEGEDAYKFLFVAKGGGSANKTFLYQGTPSLLTHDRMIDFLKDKILSLGTAACPPYHLAIVIGGTSAEMNLKTVKLASTRYLDSLPTKGSETGHAFRDLEMEAEIHKLTQSLGVGAQFGGKYFCHDVRVIRLPRHGASLPIGIGVSCSADRQAKGKITKDGIFLEQLEANPAKYMPDIDEEKLTAHVVKIDLNQPMSEILKELSKHPVKTRLSLSGPIIVARDLAHAKIRERLENGEPMPDYFKNHPIYYAGPAKTPAGYASGSFGPTTAGRMDSYVDQFQSFGGSMVMLAKGNRSRQVREACGQHGGFYLGSIGGPAARLAQDCIKKVEVVEYPELGMEAIWRIEVEDFPAFIVIDDKGNDFFKEFNLS

SEQ ID NO: 44280 - DNA, 1551 bp, Shewanella oneidensis MR-1
  CDS (1)..(1551): transl_table=11
atgtcatctcaccatgaaacgtctgaaaatgtagtgattaaacaagccgacttcattgaaagtgtggcggatgccctgcaatacatctcctactaccaccccaaagattttgtcgatgccatgagcgaagcttatgagcgtgaacaaagtgctgcggcgaaggatgcaattgcacaaattttgattaactcgcgcatgtctgccgaaggcaaacgtccactgtgccaagacacgggtatcgtgaccacgtttgttaaagtgggtatgggggttaagtgggataaaactgatatgaccattcaacaaatggtcgatgaaggtgtgcgtcgtgcttacaccaacccagataatccactgcgtgcatcaattgtggcggatcctgcaggtagccgtaaaaacaccaaagacaacaccccatcagttgtgcatatcgatatggtgccaggtaatcatgttgaagttgctatcgcagcaaaaggcggcggcagtgaaaacaaagctaagatggtgatgttaaacccatcggacgatatcgccgcttgggttgaaaaaacgctgcccaccatgggcgcgggctggtgtcctcctggtatgctcggtatcggtattggcggcaccgctgaaaaagcggccgtattggccaaagaagccctgatggaaagcgtggatatccatgagttaatggcgcgcggtgcacaaactacagaagaaaaactgcgtttagatatctttgaacgtgccaacaacttaggtattggtgcgcaggggcttggcgggttaaccacggttttagacgtgaaaatcaagtctgcaccgacccacgcggcatcaaaacctgtggtgatgatccccaactgcgccgcaactcgtcacgtgcatttccacttagacggcacgggtcctgctgatcttgcgccgccatcactcagcgactggccagaaatcacccgcgaagtgggcagcgatgtgcgccgtgttaacttagacacagtcacacaagccgatatcgaacagtggcagagcggtgaaaccctgctgctgagcggtaaaatgctcaccggccgtgacgctgcccataaacgtatccaaagcctgattgaaagcggcgaaggtttaccagaaggcgtcgactttactggtaagtttatttattacgttggcccagttgaccccgtgggtaatgaagtggtggggcctgcaggacctacaaccgcgacccgtatggacaagtttactgacctgatgctggataagactggcctgatgggcatgatcggtaaggctgagcgtggtcctgcaaccgttgaatctatcaagaagcacaaagcggtgtacttgatggctgttggcggcgcggcttacttagtgtcaaaagccattaaaaaatcccgtgtggtagcttttgccgatttaggtatggaagcgatttacgagtttgatgtgcaggatatgccagtcactgtagcggttgactcaaacggcgtgaatgcccatgaaacgggtcctgcgatttggaaagtgaatatcgctaacgcgaatgcaaaagcctaa

SEQ ID NO: 44281 - protein, 516 aa, Shewanella oneidensis MR-1
MSSHHETSENVVIKQADFIESVADALQYISYYHPKDFVDAMSEAYEREQSAAAKDAIAQILINSRMSAEGKRPLCQDTGIVTTFVKVGMGVKWDKTDMTIQQMVDEGVRRAYTNPDNPLRASIVADPAGSRKNTKDNTPSVVHIDMVPGNHVEVAIAAKGGGSENKAKMVMLNPSDDIAAWVEKTLPTMGAGWCPPGMLGIGIGGTAEKAAVLAKEALMESVDIHELMARGAQTTEEKLRLDIFERANNLGIGAQGLGGLTTVLDVKIKSAPTHAASKPVVMIPNCAATRHVHFHLDGTGPADLAPPSLSDWPEITREVGSDVRRVNLDTVTQADIEQWQSGETLLLSGKMLTGRDAAHKRIQSLIESGEGLPEGVDFTGKFIYYVGPVDPVGNEVVGPAGPTTATRMDKFTDLMLDKTGLMGMIGKAERGPATVESIKKHKAVYLMAVGGAAYLVSKAIKKSRVVAFADLGMEAIYEFDVQDMPVTVAVDSNGVNAHETGPAIWKVNIANANAKA

SEQ ID NO: 44282 - DNA, 1524 bp, Pseudomonas putida KT2440
  CDS (1)..(1524): transl_table=11
atgaccgtgatcaagcaagacgacctgattcagagcgtcgccgacgccctgcaattcatctcgtactaccaccccgtcgatttcatccaggccatgcacgaggcctatctgcgtgaggaatcgcctgctgcacgcgattccatcgcccagatcctgatcaactcgcgcatgtgcgccaccggccatcgtccaatctgccaggacaccggtatcgtcaccgtgttcatccgcgtgggcatggacgtgcgctgggatggcgccaccatgagcgtcgacgacatgatcaacgaaggtgtgcgtcgcgcctacaacctgcctgaaaacgtcctgcgcgcttcgatcctggccgacccggccggtgcccgcaagaacaccaaggacaacaccccggcagtgatccactactccatagtccccggcgacaaggtggaagtcgatgtcgcagccaagggcggcggctcggaaaacaagtcgaagatggccatgctcaacccgtccgactcgatcgtcgactgggtactgaagaccgtgccgaccatgggtgctggctggtgcccgcctggcatgctcggcatcggcatcggcggtaccgccgagaaggccgcggtcatggccaaggaagtgttgatggagtccatcgacattcacgaactgaaagcccgtggcccacagaaccgcctggaagaaatccgcctggagctgttcgacaaggtcaaccagctgggcatcggcgcccagggcctgggtggcctgaccaccgtgctcgacgtcaagatcatggactacccgacccacgccgcgtccttgccggtgtgcatgatccccaactgcgctgctacccgccacgcccacttcgtgctcgatggcaccggcccggcagaactggaagcgccgtcgctggacgcttacccggaaatcgtctgggaagccggcccgagcgcccgtcgcgtcaacctcgacgacatcaccccggaagaagtggccagctggaagccgggcgaaaccatcctgctcaacggcaagatgctgaccggccgtgatgccgcgcacaagcgcatggttgaaatgctcaaccgtggcgaagagttgccggtagacctgaaaggccgcttcatctactacgtcggcccggtcgacccggtgggtgacgaagtggtaggcccagccggcccgaccactgctacccgtatggacaagttcactcgccagatccttgagcagactggcctgctgggcatgattggcaagtccgagcgtggcccgaccgccatcgaggcgatcaaggacaacaaggccgtgtacctgatggccgttggcggcgctgcctacctggtcgcccaggccatccgcaagtcgaaggtactggccttcgccgagctgggcatggaagcgatctacgagttcgaagtcaaggacatgccggtgaccgtcgccgtggacagcaacggtgaatcggtacacatcactggccctgccctgtggcagagcaagattgccgaaagcctggccgtcgaagtgaagtaa

SEQ ID NO: 44283 - protein, 507 aa, Pseudomonas putida KT2440
MTVIKQDDLIQSVADALQFISYYHPVDFIQAMHEAYLREESPAARDSIAQILINSRMCATGHRPICQDTGIVTVFIRVGMDVRWDGATMSVDDMINEGVRRAYNLPENVLRASILADPAGARKNTKDNTPAVIHYSIVPGDKVEVDVAAKGGGSENKSKMAMLNPSDSIVDWVLKTVPTMGAGWCPPGMLGIGIGGTAEKAAVMAKEVLMESIDIHELKARGPQNRLEEIRLELFDKVNQLGIGAQGLGGLTTVLDVKIMDYPTHAASLPVCMIPNCAATRHAHFVLDGTGPAELEAPSLDAYPEIVWEAGPSARRVNLDDITPEEVASWKPGETILLNGKMLTGRDAAHKRMVEMLNRGEELPVDLKGRFIYYVGPVDPVGDEVVGPAGPTTATRMDKFTRQILEQTGLLGMIGKSERGPTAIEAIKDNKAVYLMAVGGAAYLVAQAIRKSKVLAFAELGMEAIYEFEVKDMPVTVAVDSNGESVHITGPALWQSKIAESLAVEVK

SEQ ID NO: 44284 - DNA, 1656 bp, Bradyrhizobium japonicum USDA 110
  CDS (1)..(1656)
atgaacgctcccaccgccttccccgaccccgcaaagcccgttccgccctacaagcacaccccgctgttcccgctgggcaaggacgagacgccctacaagaagatttcgtccgagggcgtccgggtcgagaaggtcctgggcaaggacatgctggtggtgtcgcgcgaggcgctgcgggcgctgtcggaggcggctttcggcgacatcaaccattacctgcgccccggccatttgaagcagctccgcgcgatcctggaagacggcgaggcgagcccgaacgacaagttcgtcgcgctcgacttcttgaagaacgccaacatcgcggccggcggcgtgctgccgatgtgccaggacaccggcaccgcgatcatcatgggcaagaagggctgcaacgtcatcaccgacggtgacgacgaggcggcgctgtcggaaggcgcgcgcgatgcgtacctgcgccgcaacctgcgctactcgcaggtcgcgccgctctcgatgtacgaggagaagaacaccgccaacaacatgccggcgcagtgcgagatctacgccgagggcgacgacgcctacaagttcatgttcatggcgaagggcggcggctccgccaacaagagcttcctgttccaggcgacgccttccgtcctgaccaaggaccgcctgctcgcgttcctgaaggaaaagatcctcacgctcggcaccgcggcgtgcccgccctatcacctcgccatcgtgatcggcggcacttcggccgagctctgcatgaagacggtgaagcttgcgtcggcccgctatctcgacgcgctgccgacccacggctcgcccgacggcaacgccttccgcgacgtcgagatggaaaaggaaatccacaagatgacgcagtcgctcggcgtcggcgcgcagttcggaggcaagtatttctgccacgacgtccgcgtgatccgcatgccgcgccatggcgcctcgctcccgatcgggcttggcgtgtcctgctcggccgatcgccaggtgctcggcaagatcaccagggacggcgtctatctcgaggagctcgagcacaacccggcgcaatatctgccgcaggtcgaagaggcgctgggcggcgaggtcgtcaagatcgacctcaaccagccgatgaaggacattttggcgacgttctcgaagcacccgatcaagacccgggtctcgatgaccggcaccatgatcgtcgcgcgcgattccgcccatgccaagctgcgcgagcggctggagaagggcgagccgctgccggactacttcaagaaccatccggtctactacgctggccccgccaagacgccggagggctatgcctccggtgcgttcggtccgaccaccgcgggccggatggattccttcgtcgaccagttccaggccgcgggcggctccatggtgatggtggccaagggcaaccgcgcgccggccgtgcgcgaggcctgcaagaagtatggcggcttctatctcggctcgatcggcggcgccgcggcgaacctcgccgagcactgcatcaagaaggtcgaggtgctcgaatatcccgagctcggcatggaagcgatctggcgcatcgaagtcgtggatttcccggcgttcatcatcatcgatgacaaggggaatgatttcttcaaggagttgaatttgggctag

SEQ ID NO: 44285 - protein, 551 aa, Bradyrhizobium japonicum USDA 110
MNAPTAFPDPAKPVPPYKHTPLFPLGKDETPYKKISSEGVRVEKVLGKDMLVVSREALRALSEAAFGDINHYLRPGHLKQLRAILEDGEASPNDKFVALDFLKNANIAAGGVLPMCQDTGTAIIMGKKGCNVITDGDDEAALSEGARDAYLRRNLRYSQVAPLSMYEEKNTANNMPAQCEIYAEGDDAYKFMFMAKGGGSANKSFLFQATPSVLTKDRLLAFLKEKILTLGTAACPPYHLAIVIGGTSAELCMKTVKLASARYLDALPTHGSPDGNAFRDVEMEKEIHKMTQSLGVGAQFGGKYFCHDVRVIRMPRHGASLPIGLGVSCSADRQVLGKITRDGVYLEELEHNPAQYLPQVEEALGGEVVKIDLNQPMKDILATFSKHPIKTRVSMTGTMIVARDSAHAKLRERLEKGEPLPDYFKNHPVYYAGPAKTPEGYASGAFGPTTAGRMDSFVDQFQAAGGSMVMVAKGNRAPAVREACKKYGGFYLGSIGGAAANLAEHCIKKVEVLEYPELGMEAIWRIEVVDFPAFIIIDDKGNDFFKELNLG

SEQ ID NO: 44286 - DNA, 1524 bp, Pseudomonas syringae pv. tomato str. DC3000
  CDS (1)..(1524): transl_table=11
atgaccgtgatcaagcaagacgacctgattcagagcgttgcagatgcactgcagttcatttcctattaccaccccgtggacttcatccaggccatgcacgaggcgtatctgcgtgaagaatcgcctgccgcccgcgactccatcgcccagatcctgatcaactcgcgcatgtgcgcgaccggtcatcgcccgatctgccaggacaccggcatcgtcacggtttttgtgcgcgtgggtatggatgttcgctgggacggcgccaccatgggcctggacgacatgatcaacgaaggcgtgcgtcgcgcttacaacctgcctgaaaacgtcttgcgtgcctcgatccttgccgacccggcaggcgctcgcaaaaacaccaaggacaacaccccggccgttatccactactccatcgtcccgggtaacaccgtggaagtggacgtcgcggcaaaaggcggcggttcggaaaacaaatcgaagatggcgatgctcaacccgtccgactcgatcgtcgactgggttctgaaaaccgttccgaccatgggcgcaggctggtgccccccgggcatgctcggcatcggcatcggcggcaccgcagaaaaggccgcggtcatggccaaggaagtgttgatggagtccatcgacattcacgaactgaaagcccgcggcccgcaaagccgtatcgaagagatgcgtctggagctgttcgagaaggtcaaccagctgggcattggcgctcagggcctgggcggcctgaccaccgtgctcgacgtcaagatcatggattacccgacccacgccgcgtcgctgccggtgtgcatgatccccaactgcgccgccacccgccacgcgcacttcgtgctcgacggcagcggccctgcctcgctggaggctccatcgctggacgcctatccggaaatcgtctgggaagccggcccatcggcccgccgcgtcaacctcgataccctgaccccggaagaagtacaaagctggaaaccgggcgaaaccgttttgctcaatggcaagatgctcaccggccgcgacgcagcgcacaagcgcatggtcgaaatgctcaacaggggtgaaaccctgccggtagacctcaagggtcgcttcatctactacgtcggcccggttgatccggtacgcgaagaagtcgtcggcccggccggcccgaccacggccacccggatggacaagttcacccggcagatcctcgatcagaccgggttgctgggcatgatcggcaagtccgaacgcggcccgaccgccatagaagcgatccgtgaccacaaggccgtgtacctgatggccgttggtggtgctgcctatctggtggctcaggcgatcaagaaatcccgcgtcgtggccttcgccgagctgggcatggaagcgatctacgagttcgaggttaaggacatgccggtgaccgttgccgtcgacagcaccggtgaatccgttcacatcaccggcccgcagatctggcagaagaagatcagcgacagtctggcggtggaagtgcagtaa

SEQ ID NO: 44287 - protein, 507 aa, Pseudomonas syringae pv. tomato str. DC3000
MTVIKQDDLIQSVADALQFISYYHPVDFIQAMHEAYLREESPAARDSIAQILINSRMCATGHRPICQDTGIVTVFVRVGMDVRWDGATMGLDDMINEGVRRAYNLPENVLRASILADPAGARKNTKDNTPAVIHYSIVPGNTVEVDVAAKGGGSENKSKMAMLNPSDSIVDWVLKTVPTMGAGWCPPGMLGIGIGGTAEKAAVMAKEVLMESIDIHELKARGPQSRIEEMRLELFEKVNQLGIGAQGLGGLTTVLDVKIMDYPTHAASLPVCMIPNCAATRHAHFVLDGSGPASLEAPSLDAYPEIVWEAGPSARRVNLDTLTPEEVQSWKPGETVLLNGKMLTGRDAAHKRMVEMLNRGETLPVDLKGRFIYYVGPVDPVREEVVGPAGPTTATRMDKFTRQILDQTGLLGMIGKSERGPTAIEAIRDHKAVYLMAVGGAAYLVAQAIKKSRVVAFAELGMEAIYEFEVKDMPVTVAVDSTGESVHITGPQIWQKKISDSLAVEVQ

SEQ ID NO: 44288 - DNA, 1518 bp, Vibrio parahaemolyticus RIMD 2210633
  CDS (1)..(1518): transl_table=11
atgacggtaatacgcaagcaggatgtaatcagcagtgtcgctgatgcgctacagtatatttcttactaccacccgctagactttgttcaagctcttgaaaaagcctatcaccgcgaagagagtcaagccgcgaaagacgcgattgctcagatcctaattaactcccgaatgtcagcagaaggtcaccgaccaatttgtcaggatactggcatcgtgacgtgtttcgtcaacatcggtatgggcgtgcaatgggactcaaccgacatgacggttcagcaaatggtagatgaaggtgtccgacaagcgtatacgaacccagacaacccgttgcgtgcgtcagtacttatggatcctgctggtaaacgtattaataccaaagacaacacacctgctgtcgtacacatcaacatggtaccgggcgataaagttgaaattcagatcgcagcgaagggcggcggtagtgaaaacaaaactaagatggtgatgctaaacccatctgacgatattgctgagtgggtagagaaaacactaccaacaatgggcgcgggctggtgtccaccaggtatgcttggcattggtattggcggtacggctgagaaagcagcggtattggcaaaagaatctctaatggaacacatcgatattcaagagcttatcgaccgtggtccacaaaacgcagaagaagagcttcgccttgatattttcaatcgcgtgaacaaacttggtatcggcgcgcaaggtcttggtggtttgacgactgttgtcgacgttaagatcaaaactgcgccaacgcacgcggcttctaagcctgtttgtttgatcccgaactgtgcggcgactcgtcacgtacacttcacgcttgatggcagcggcccagcagagctaacaccacctaaactagaagattggccagacattacttgggaagcgggcgaaaacacgcgtcgcgtaaacttagacactattactaaagaagaagtacaagagtggaagacaggcgaaaccgttcttctatcaggtaaaattctgactggtcgtgatgctgcgcataaacgtattcaaggcatgttagacaatggtgaaggtctaccagaaggcgtagatctaaacggtaagttcatttactacgtaggccctgtcgatgcggttggtgatgaggtcgttggtcctgccggcccaacaacatcaacgcgtatggataaattcaccgatatgatgttagaaaaaaccggcatcatgggcatgatcggtaaagctgagcgtggccctgcaacggttgaatctattaagaatcacaaagcggtttacctaatggctgttggtggcgcggcctaccttgtagcgaaagcgatcaagaaagctcgcgttgtcgcatttgaagatttaggtatggaagcgatttacgaatttgaagttgaagatatgccagtaacagtggctgtagactcaaatggtgttaacgcgcaccaaatcggtccagacacttggaaagtgaaaattcaagagatggaagcataa

SEQ ID NO: 44289 - protein, 505 aa, Vibrio parahaemolyticus RIMD 2210633
MTVIRKQDVISSVADALQYISYYHPLDFVQALEKAYHREESQAAKDAIAQILINSRMSAEGHRPICQDTGIVTCFVNIGMGVQWDSTDMTVQQMVDEGVRQAYTNPDNPLRASVLMDPAGKRINTKDNTPAVVHINMVPGDKVEIQIAAKGGGSENKTKMVMLNPSDDIAEWVEKTLPTMGAGWCPPGMLGIGIGGTAEKAAVLAKESLMEHIDIQELIDRGPQNAEEELRLDIFNRVNKLGIGAQGLGGLTTVVDVKIKTAPTHAASKPVCLIPNCAATRHVHFTLDGSGPAELTPPKLEDWPDITWEAGENTRRVNLDTITKEEVQEWKTGETVLLSGKILTGRDAAHKRIQGMLDNGEGLPEGVDLNGKFIYYVGPVDAVGDEVVGPAGPTTSTRMDKFTDMMLEKTGIMGMIGKAERGPATVESIKNHKAVYLMAVGGAAYLVAKAIKKARVVAFEDLGMEAIYEFEVEDMPVTVAVDSNGVNAHQIGPDTWKVKIQEMEA

SEQ ID NO: 44290 - DNA, 1647 bp, Salmonella enterica subsp. enterica serovar Typhi Ty2
  CDS (1)..(1647): transl_table=11
atgtcaaacaaacccttcttttatcaagacccttttcccctcaaaaaggacgataccgagtactacttgttgaccagcgaacatgtttccgtcgccgagttcgaaggacaagagatcctgaaagtcgcgccggaagcgctaacgttgttggcgcgtcaggccttccacgatgcgtcttttatgctacgtcccgcgcatcagcagcaggtggcggatattctgcgcgatccgcaggccagtgaaaacgacaaatatgtcgcgctgcaattcctgcgaaactccgatatcgcggccaagggcgtgttgcccacctgccaggataccggtacggccattattgtcggcaaaaaaggccaacgcgtctggactggtggaggtgatgaagcggcgctggctcgcggcgtatataacacctatatcgaagataacctgcgctattcgcagaacgcggcgctggatatgtacaaagaggtcaataccggtactaacctgccggcgcagatcgatctctacagcgtcgatggcgatgaatataaattcctctgtatcgctaaaggcggcggttcggcgaataaaacctacctctatcaggagacaaaagcgctactgacgccgggtaagctcaaaaattatctcgtcgataagatgcgtacgctgggcaccgccgcctgtccgccgtatcacattgcgtttgtcattggcggtacctcggcggaagcgaacctgaagaccgttaagctggcctcggcaaaatactatgatgcgctaccgaccgaaggcaatgaacacgggcaggccttccgcgatattgagctggaaaaagaattgttgcttgaggcgcaaaatcttggcttaggcgcgcagttcggcggcaaatatttcgctcacgatattcgtgtcatccgattgccgcgccatggggcatcgtgtccggtaggtatgggcgtgtcctgctccgcggatcgaaacattaaagcgaagatcaaccgggaagggttctggatcgagaagctggagcgcaatcccggtaaatatattccagaggcgctgcgccaggcgggagagggcgaggcggtgcgcgttgatcttaaccgtcccatgagcgagatactgcaacaactgtcgcagtatccggtatcaacgcgcttgtcgctgaacggcacgattattgtgggccgcgatatcgcgcacgctaaactgaaagaacggatggacagaggcgaaggtttgccgcagtacatcaaagatcatcctatctattatgcggggccggcaaaaacgccggaagggtacgcctccgggtcgcttgggccgactaccgcaggacggatggactcttatgttgatcagctccagtcgcagggcggcagtatgatcatgctggcgaaaggcaaccgcagccagcaggtgaccgatgcctgtaagaaacatggcggcttctacctgggcagtatcggcggcccggcagccgttctggcgcagggcagtatcaagcgcctggagtgtgtggaatatcctgaactgggtatggaggctatctggaaaattgaagtggaggattttccggcctttattctggtggatgataaaggtaacgatttcttccagcagattcagtcatcgcagtgcgcgcgctgcgttaagtaa

SEQ ID NO: 44291 - protein, 548 aa, Salmonella enterica subsp. enterica serovar Typhi Ty2
MSNKPFFYQDPFPLKKDDTEYYLLTSEHVSVAEFEGQEILKVAPEALTLLARQAFHDASFMLRPAHQQQVADILRDPQASENDKYVALQFLRNSDIAAKGVLPTCQDTGTAIIVGKKGQRVWTGGGDEAALARGVYNTYIEDNLRYSQNAALDMYKEVNTGTNLPAQIDLYSVDGDEYKFLCIAKGGGSANKTYLYQETKALLTPGKLKNYLVDKMRTLGTAACPPYHIAFVIGGTSAEANLKTVKLASAKYYDALPTEGNEHGQAFRDIELEKELLLEAQNLGLGAQFGGKYFAHDIRVIRLPRHGASCPVGMGVSCSADRNIKAKINREGFWIEKLERNPGKYIPEALRQAGEGEAVRVDLNRPMSEILQQLSQYPVSTRLSLNGTIIVGRDIAHAKLKERMDRGEGLPQYIKDHPIYYAGPAKTPEGYASGSLGPTTAGRMDSYVDQLQSQGGSMIMLAKGNRSQQVTDACKKHGGFYLGSIGGPAAVLAQGSIKRLECVEYPELGMEAIWKIEVEDFPAFILVDDKGNDFFQQIQSSQCARCVK

SEQ ID NO: 44292 - DNA, 1647 bp, Salmonella enterica subsp. enterica serovar Typhi Ty2
  CDS (1)..(1647): transl_table=11
atgtcgaaaaaagagtttatctatcaggcgcctttcccgatgggagaggacaaaacagagtattatctgctcacctccgattatgtcagcgtcagtgaattcaatggagaatctatcctcaacgttgagccgcaggcgttaacgttgctggctcagcaggctttccatgatgcgtcttttatgctccgtcctgaacaccagcagcaagtcgccgccattctccatgaccccgaagccagcgaaaacgacaaatatgtggcgttgcaattcctgagaaactccgagatcgccgccaaaggcattctgccgacctgccaggataccggcacggcgattatcatgggtaaaaaaggccaacgcgtctggacgggcggcggcgatgaagccgcgctctccaaaggcgtgtttaatacctatatcgaagataacctgcgctactcgcagaacgcgccgctggatatgtacaaagaggtcaataccggcagcaacctgccagcgcaaatcgatctctatgccgtcgatggcgacgagtacaagttcctttgcgtggcgaaaggcggcggttcagcaaacaaaacgtatctctatcaggagaccaaagcgctgctcaccccaggcaagctgaaaaacttcctcgttgagaaaatgcgcacgctgggcaccgcggcctgtccgccataccatatcgcctttgtcattggtggcacctcggcggaaagcacgctgaaaaccgttaaactcgccagcacccactattacgacgcgctgccgacggaaggtaacgagcacggccaggcattccgcgatctccacctggaacaggaactgctggaagaagcgcaaaaacttggcctcggcgcccagttcggcgggaaatatttcgcccacgatattcgcgtaattcgcctgccgcgtcacggcgcttcctgtccggtggggatgggcgtctcctgctcggcagaccgtaacatcaaagcgaaaatcaaccgcgaaggcatctggatcgaaaaactggaacacaatccgggccagtatattccgccagcgctgcgtcaggcgggcgaaggcgacgcggtgaaagtcgatcttaaccgtccgatgaaagagatcctcgcccagctatcgcagtacccggtctcgactcgcctgtcgctgacgggcaccattatcgtaggtcgcgatatcgcccacgcgaagctaaaagagcgtattgaatccggcgaagacctgccgcagtatattaaagaccaccccatctattacgcaggtccggccaaaaccccggcaggttatccatctggctcattaggccccaccaccgcaggccgaatggactcttatgtcgatctactgcaatcccacggcggcagtatgatcatgctggcgaaaggcaaccgtagtcagcaggtcacggatgcctgtaaaaaacacggcggcttttatttgggcagtatcggcggcccggcggcggtactggcacagcagagcattaagcatctggagtgcgtcgagtatccggaactcggcatggaagctatctggaaaattgaagtagaagatttcccggcctttattctggtggatgacaaaggcaacgatttcttccagcagattgtcagcaaacagtgcgctaactgcgcgaaataa

SEQ ID NO: 44293 - protein, 548 aa, Salmonella enterica subsp. enterica serovar Typhi Ty2
MSKKEFIYQAPFPMGEDKTEYYLLTSDYVSVSEFNGESILNVEPQALTLLAQQAFHDASFMLRPEHQQQVAAILHDPEASENDKYVALQFLRNSEIAAKGILPTCQDTGTAIIMGKKGQRVWTGGGDEAALSKGVFNTYIEDNLRYSQNAPLDMYKEVNTGSNLPAQIDLYAVDGDEYKFLCVAKGGGSANKTYLYQETKALLTPGKLKNFLVEKMRTLGTAACPPYHIAFVIGGTSAESTLKTVKLASTHYYDALPTEGNEHGQAFRDLHLEQELLEEAQKLGLGAQFGGKYFAHDIRVIRLPRHGASCPVGMGVSCSADRNIKAKINREGIWIEKLEHNPGQYIPPALRQAGEGDAVKVDLNRPMKEILAQLSQYPVSTRLSLTGTIIVGRDIAHAKLKERIESGEDLPQYIKDHPIYYAGPAKTPAGYPSGSLGPTTAGRMDSYVDLLQSHGGSMIMLAKGNRSQQVTDACKKHGGFYLGSIGGPAAVLAQQSIKHLECVEYPELGMEAIWKIEVEDFPAFILVDDKGNDFFQQIVSKQCANCAK

SEQ ID NO: 44294 - DNA, 1635 bp, Bacteroides thetaiotaomicron VPI-5482
  CDS (1)..(1635): transl_table=11
atggcaacacctccgtttaagtatcaacccatgtttgaaaagggaaaagataccactgagtattatctgcttacaaaagactatgtatcggtaagcgagtttgaaggaaatcctatcctgaaaattgagaaagaaggcttgactgcgatggcaaatgcagcttttcgtgatgtgtcattcatgcttcgccgttcgcacaatgaacaggttgctaagattctgagtgatccggaagccagcgagaacgataagtacgtagcactgactttcctgcgtaatgcggaagtggctgccaaaggtgtacttccattctgtcaggataccggtactgctattatccacggtgaaaagggacagcaagtgtggaccggctataccgacgaggaagctctgtcactgggtgtttacaaaacatataccgaagaaaacctgcgttactctcagaatgcgcctctgaatatgtatgatgaggtaaatacaaaatgtaacctgcctgcacagattgacatcgaagctaccgaagggatggaatatgaattcctctgcgtaacgaaaggtggtggttctgccaacaaaacatatctgtatcaggaaacaaaagcaattttgaaccccggtacactggttccgttcctggtggaaaaaatgaagactctgggaactgccgcttgtcctccttatcatatcgcttttgtgatcggcggtacttctgctgagaagaacctgctgacagtgaaactggcgtctactcacttctacgataatctgccgactacgggaaatgaatttggccgtgctttccgtgatatcgaactggaaaaacaagtactggaagaagctcacaagatcggtctgggtgcacaattcggcggtaaatatctggcacatgatgttcgtatcattcgtctgcctcgtcacggtgcttcttgtccggtaggtctgggcgtgtcttgttctgccgaccgtaacatcaaatgtaaaatcaataaagatggtatctggattgagaaactggattcaaatccgggtagcctgattccggcagaattgcgtcaggccggtgaaggtgatgtagtgaagattgatctgaaccgtccgatggctgagattctgaaagaactgaccaaatatcctgtatctactcgtctgtcactgaacggtactatcatcgttggccgtgatatcgctcacgctaaactgaaagaacgtctggatcgtggagaagatttgcctcagtatatcaaggatcatcctatttactatgctggtccggccaagactccggctggtatggcttgcggttcaatgggcccgacaactgccggacgtatggactcgtatgttgagctgttccagagccacggtggcagcatggttatgttggcgaaaggtaaccgtagccagcaggttacagatgcttgtcagaaatatggcggcttctatctgggttctatcggcggaccggctgcaatccttgctcagaacaacatcaagagcattgagtgcgtagaatatccggaactgggcatggaagcaatctggaaaattgaagtggaagatttcccggcatttattctggtagatgacaaaggaaatgacttcttcaaacagattaaaccacgttgtgccaaataa

SEQ ID NO: 44295 - protein, 544 aa, Bacteroides thetaiotaomicron VPI-5482
MATPPFKYQPMFEKGKDTTEYYLLTKDYVSVSEFEGNPILKIEKEGLTAMANAAFRDVSFMLRRSHNEQVAKILSDPEASENDKYVALTFLRNAEVAAKGVLPFCQDTGTAIIHGEKGQQVWTGYTDEEALSLGVYKTYTEENLRYSQNAPLNMYDEVNTKCNLPAQIDIEATEGMEYEFLCVTKGGGSANKTYLYQETKAILNPGTLVPFLVEKMKTLGTAACPPYHIAFVIGGTSAEKNLLTVKLASTHFYDNLPTTGNEFGRAFRDIELEKQVLEEAHKIGLGAQFGGKYLAHDVRIIRLPRHGASCPVGLGVSCSADRNIKCKINKDGIWIEKLDSNPGSLIPAELRQAGEGDVVKIDLNRPMAEILKELTKYPVSTRLSLNGTIIVGRDIAHAKLKERLDRGEDLPQYIKDHPIYYAGPAKTPAGMACGSMGPTTAGRMDSYVELFQSHGGSMVMLAKGNRSQQVTDACQKYGGFYLGSIGGPAAILAQNNIKSIECVEYPELGMEAIWKIEVEDFPAFILVDDKGNDFFKQIKPRCAK

SEQ ID NO: 44296 - DNA, 1524 bp, Bordetella bronchiseptica RB50
  CDS (1)..(1524)
atgaccgtcctcatcaaagaagaagacttcatccagtccatcgccgatggcatccagttcatcagctactaccacccggtggactatatccgtcacctggcgcgcgcctacgagcgtgaagaaagcccggctgcccgcgatgccatggcgcagatcctgaccaactcgcgcatgtgcgccgagggcaagcgcccgctgtgccaggacaccggcatcgtcaacgtgttcctcaaggtcggcatgaacgtgcgcttcgacacgcaacgcacgctgcaggaactctgtgacgaaggcgtgcgccgcggctacctcaaccccgacaacccgctgcgcgcgtcggtgctggacgatccgctgttcgcgcgcaagaacacccgcgacaacacgccctgtatcctgcacgtcgaactggtgccgggcgacaccgtcgacgtgcaagtggcctccaagggcggcggctcggaaaacaagtccaagttcgtcatgctcaatcccagcgattcgctggtcgactgggtgctcaaaaccgtgccgaccatgggcgccggctggtgcccgccgggcatgctcggcatcggcgtgggcggcacggccgagaaggccatgctgatggccaagcagtcgctgatggaagacatcgacatgtacgagctgctggcgcgcggcccgcagagcaagctggaagagctgcgcatcgagctgtacgagaaggtcaacgccctgggcatcggcgcgcagggcctgggcggcctgacgaccgtgctggacgtcaagatcagcaccttccccacgcacgccgcgtccaagccggtggcgatgatcccgaactgcgccgccacgcgccacgcgcatttcgtgctggacggctccggtccggcccgcctcgatccgccgtcgctgtccgaatggccggaagtgcactgggcgcccgattacaacaagtccaggcaggtcgacctcgataccctgaccaaggaagaagtcgccagctggaaaccgggccagaccttgctgctgtcgggcaagatgctgaccggccgcgacgcggcgcacaagcgcatccaggacatgctgtccaagggcgagagcctgccggtggacttcaccaaccgcgtcatctactacgtcggcccggtcgatccggtgcgcgacgaagtcgtcggcccggccggtcccaccacggcgacccgcatggacaagttcaccgacatgatgctggcgcagaccggcctgatttccatgatcggcaagtccgagcgcggcccggtcgccatcgagtcgatccgcaagcacggctcggcctacctgatggcggtgggcggcgcggcctacctggtgtccaaggccatccgcaacgccaaggttctggctttcgaggacctgggcatggaagccatctacgagttcgacgtcaaggacatgcccgtgaccgtcgcggtggactcgcagggcacctcggtgcacaccaccggcccgaaggagtggcaggcccgcatcggcaagattccggtcgcggtcgcctga

SEQ ID NO: 44297 - protein, 507 aa, Bordetella bronchiseptica RB50
MTVLIKEEDFIQSIADGIQFISYYHPVDYIRHLARAYEREESPAARDAMAQILTNSRMCAEGKRPLCQDTGIVNVFLKVGMNVRFDTQRTLQELCDEGVRRGYLNPDNPLRASVLDDPLFARKNTRDNTPCILHVELVPGDTVDVQVASKGGGSENKSKFVMLNPSDSLVDWVLKTVPTMGAGWCPPGMLGIGVGGTAEKAMLMAKQSLMEDIDMYELLARGPQSKLEELRIELYEKVNALGIGAQGLGGLTTVLDVKISTFPTHAASKPVAMIPNCAATRHAHFVLDGSGPARLDPPSLSEWPEVHWAPDYNKSRQVDLDTLTKEEVASWKPGQTLLLSGKMLTGRDAAHKRIQDMLSKGESLPVDFTNRVIYYVGPVDPVRDEVVGPAGPTTATRMDKFTDMMLAQTGLISMIGKSERGPVAIESIRKHGSAYLMAVGGAAYLVSKAIRNAKVLAFEDLGMEAIYEFDVKDMPVTVAVDSQGTSVHTTGPKEWQARIGKIPVAVA

SEQ ID NO: 44298 - DNA, 1527 bp, Chromobacterium violaceum ATCC 12472
  CDS (1)..(1527): transl_table=11
atgaccatcatccgccaggaagacttcatccagagcatcgccgatgccttccagtacatcagttgctaccaccctaaagactatatcgacgcgctgtaccaggcttacctgaacgaggagagcaccgccgccaaggacgcgatggcgcagatcctggtcaacagccgcatgtgcgccgaaggccgccggccgatctgccaggataccggcatcgccgtggtgttcctgaaagtgggcatgaaagtgcagtgggacgcccagctcagcgtgcaggagatggtcaacgaaggcgtgcgccgcgcctacaaccacccggacaacaagctgcgcgcctccgtgctgctggacccggccggcaagcgccagaactccaaggacaataccccggccgtggtgcacttcgagatcgtcgaaggcgaccaggtggaggtgatctgcgcggccaagggcggcggctcggaaaacaagtccaagatggtgatgctgaacccgtccgattccatcgtcgactgggtgctgaagaccgtgccgaccatgggcgccggctggtgtccgcctggcattctcggcatcggcatcggcggcacgccggagaaggcgatgctgctggcgaaagagtcgctgatggaccacgtcgacatccacgagctgaaggccaaggccgcggccggcgccgagctgtcccgcgtcgaggcgctgcggctggagctgttcgacaaggtcaacgcgctgggcatcggcgcccagggcctgggcggcctgaccacggtgctggacgtgaagatcctggattacccgacccacgcggcgtcgctgccggtggcgatgatccccaactgcgccgccacccgccacatccatttccacctggacggcagcggcccggcccacctggaaacgcctagcctggaagactggccggacatcacctacgacgcctcgtccggcaagcgcgtggacctggacaagatcaccaaggaagaagtggccagctggcagccgggcgacgtgctgctgctgaacggcaagatcctgaccggccgcgacgccgcgcacaagcgcatgatcgatatgctgaacaagggcgagaagctgccggtggacttcaccaaccgcttcatctactacgtcggcccggtcgatccggtgcgagacgaagtcgtcggcccggccggcccgaccaccgccacgcggatggacaagttcacgcgccagatgctggagcagaccggcttgctgggcatgataggcaaggccgagcgcggtccggcggcgatagaggcgatcaaggacaacaaggcggtctacctgatggccgtcggcggttcggcttacctggtgtccaaggcgatcaaggcgtccaaggtggtgggcttcgccgacctgggcatggaggcgatctacgagttcgaggtcaaggacatgccggtgacggtggcggtggattcctgtggcacctcggtgcacaacaccggcccggcggagtggcgggtgaagattggcaagattccagtaagccaaatttaa

SEQ ID NO: 44299 - protein, 508 aa, Chromobacterium violaceum ATCC 12472
MTIIRQEDFIQSIADAFQYISCYHPKDYIDALYQAYLNEESTAAKDAMAQILVNSRMCAEGRRPICQDTGIAVVFLKVGMKVQWDAQLSVQEMVNEGVRRAYNHPDNKLRASVLLDPAGKRQNSKDNTPAVVHFEIVEGDQVEVICAAKGGGSENKSKMVMLNPSDSIVDWVLKTVPTMGAGWCPPGILGIGIGGTPEKAMLLAKESLMDHVDIHELKAKAAAGAELSRVEALRLELFDKVNALGIGAQGLGGLTTVLDVKILDYPTHAASLPVAMIPNCAATRHIHFHLDGSGPAHLETPSLEDWPDITYDASSGKRVDLDKITKEEVASWQPGDVLLLNGKILTGRDAAHKRMIDMLNKGEKLPVDFTNRFIYYVGPVDPVRDEVVGPAGPTTATRMDKFTRQMLEQTGLLGMIGKAERGPAAIEAIKDNKAVYLMAVGGSAYLVSKAIKASKVVGFADLGMEAIYEFEVKDMPVTVAVDSCGTSVHNTGPAEWRVKIGKIPVSQI

SEQ ID NO: 44300 - DNA, 1647 bp, Porphyromonas gingivalis W83
  CDS (1)..(1647): transl_table=11
atggcaactccagaatttaagtatcagaagcctttccctatgggggatgatacgacagagtattatttgctgacgaaggagtatgtgtccgtggacaagtttggcgatcatgatgtcctgaaagtggagccggaagctctgcgattacttgcgcggacggcttttcatgacatcgctttctatttgcgaccggagcatcagcagcaagtggctcggattctgtccgatccggaagccagcgaaaacgacaaattcgtggctttgactttcctgcgcaatgcggaggtttcagccaagggacagctccctttctgccaagatacgggcacggctatcatcctcggtaagaagggacagcaggtctggacgggcggtcatgacgaagagcagctctcgcatggtgtctatgatacctatacgcaggagaacctgcgctattcgcagaatgctcctttggatatgtataaggaggtgaatacggggtgcaacctgcccgcacagatcgacctgatggccgtggacggcatggagtacgactttctctgcatagccaaaggaggagggtcggccaataagacgtatctctatcaggaaacgaaagcactgctcaaccccaagacgctggtgaacttcctcgtggataagatgagttctctcggtacagctgcctgtcctccgtatcacattgcattcgtgataggcggaacttcggccgaaacgaacctcaagaccgtcaagctggcttcggccaagtactacgacaatctgcctacttcgggcaacgaaggcgggcgtgccttccgcgatgtcgaactggaaaaagaagtcttggaagctgcctatcatctgggactgggtgctcagtttggaggcaaatacttcgcacacgacgtgcgcatcatccgcctgccccgacatggagcaagctgtcccgtaggtatgggcgtcagttgttcggcagaccgcaatatcaaggcaaagatcaataaagacggtatctggatcgaaaagatggagaccaatcccacacgcctcatccctgaatccatgcgtgagggtacagagggtacggtggtcaaggtcgatctgaatcgtccgatgcctgagattctgagagagctgtcgcagtatcctgtttccacccgtttgtctctcagtggtacgattatcgtggggcgtgatattgctcacgccaaactaaaagaacgtatcgaccgtggcgagggtttgcccgactatatcaagaatcatcccatctactacgccggtccggccaagacaccgaaggggatgccgagcggttcgttcgggcctacgacagcgggccgtatggatagctatgtggatctcttccaatcgcatggaggcagtatggtgatgatagccaaaggcaaccgctctcagcaagtgacggatgcgtgtaagaagtacggcggattctacctcggcagtgttggaggcccagcagctattctggctcaggacagcattaagaaagtggagtgtctggaatatcccgagctgggtatggaggctatttggaagatcgaagtggaggacttcccggcctttattctggtagatgacaagggcaatgatttctttactcagataagagagaagtgtaagggttgtgccttgcattga

SEQ ID NO: 44301 - protein, 548 aa, Porphyromonas gingivalis W83
MATPEFKYQKPFPMGDDTTEYYLLTKEYVSVDKFGDHDVLKVEPEALRLLARTAFHDIAFYLRPEHQQQVARILSDPEASENDKFVALTFLRNAEVSAKGQLPFCQDTGTAIILGKKGQQVWTGGHDEEQLSHGVYDTYTQENLRYSQNAPLDMYKEVNTGCNLPAQIDLMAVDGMEYDFLCIAKGGGSANKTYLYQETKALLNPKTLVNFLVDKMSSLGTAACPPYHIAFVIGGTSAETNLKTVKLASAKYYDNLPTSGNEGGRAFRDVELEKEVLEAAYHLGLGAQFGGKYFAHDVRIIRLPRHGASCPVGMGVSCSADRNIKAKINKDGIWIEKMETNPTRLIPESMREGTEGTVVKVDLNRPMPEILRELSQYPVSTRLSLSGTIIVGRDIAHAKLKERIDRGEGLPDYIKNHPIYYAGPAKTPKGMPSGSFGPTTAGRMDSYVDLFQSHGGSMVMIAKGNRSQQVTDACKKYGGFYLGSVGGPAAILAQDSIKKVECLEYPELGMEAIWKIEVEDFPAFILVDDKGNDFFTQIREKCKGCALH

SEQ ID NO: 44302 - DNA, 1524 bp, Vibrio vulnificus YJ016
  CDS (1)..(1524): transl_table=11
atgactgtaattcgcacgcaagatgtcatcagcagcgtagctgatgcacttcagtacatctcttactaccacccactcgattttgttcaagccctagaaaaagcctaccatcgtgagcagagccaagcggccaaagatgccattgcgcagattttgatcaactcgcgtatgtcggcggaagggcatcgcccaatttgccaagataccggtatcgtgacgtgttttgtcaatatcggtatgggcgttcagtgggactcaacggatctcaccgtacaacagatgattgacgaaggcgtgcgtcaggcttacaccaatcctgacaacccattgcgtgcgtcggtattgatggaccctgcaggtaaacgtattaacaccaaagacaatacacctgcggttgttcacatcaatatggtgccgggcaataccgtagaaattcagatcgcggcaaaaggcggcggctctgaaaacaaaaccaagatggtgatgctcaacccttcagacgatattgctgagtgggtagaaaaaacattgcctttgatgggcgcgggctggtgtcctccgggcatgcttggcattggcattggtggcacagcagaaaaagcggcggtactggctaaagagtcgttgatggagcacatcgacatccacgaactgattgagcgtggcccgcaaaatgcggaagaagagctgcgtttggacatcttcaatcgtgtcaaccgtttaggtattggtgctcaagggctcggtggggtgacaacggtggtggatgtgaaaatcaaaaccgcccctacgcacgcagcgtccaagccagtgtgtatgatcccgaactgtgcggcgactcgtcacgttcatttcacacttgacggctctggcccagcagaactgacgccaccgaagctagaagattggccaaacatcacttgggatgcgggtgcaagcgcgcgccgtgttaacctcgataccgtgacaaaagaagacgttcagcaatggaaaaccggtgagacactcttgctttcaggtaagattttgaccggtcgcgatgccgcgcataaacgcattcaaaccatgttgcaaaatggcgaaggcctacctgaaggcgttgaccttaaagggaagtttatctactacgttggccctgtggatgcagtgggtgacgaagtggttggcccagcaggcccaaccacctcaacacgtatggataagttcaccgatatgatgctggatgaaacgggcattatgggcatgatcggcaaagcggagcgtggcccagccactgttgagtcaatcaagaaccataaagcggtgtatctgatggcggtcggtggtgcggcgtacttggtagcaaaagccatcaagaaagcacgtgttgttgcttttgaagatctcggtatggaagcgatttacgaatttgaagtcgaagatatgccagtgacggtcgcggtggattcgagcggtgccaatgctcaccaaattggtcctgatacttggaaagttaaaatccaagaaatggaatcacaaaaataa

SEQ ID NO: 44303 - protein, 507 aa, Vibrio vulnificus YJ016
MTVIRTQDVISSVADALQYISYYHPLDFVQALEKAYHREQSQAAKDAIAQILINSRMSAEGHRPICQDTGIVTCFVNIGMGVQWDSTDLTVQQMIDEGVRQAYTNPDNPLRASVLMDPAGKRINTKDNTPAVVHINMVPGNTVEIQIAAKGGGSENKTKMVMLNPSDDIAEWVEKTLPLMGAGWCPPGMLGIGIGGTAEKAAVLAKESLMEHIDIHELIERGPQNAEEELRLDIFNRVNRLGIGAQGLGGVTTVVDVKIKTAPTHAASKPVCMIPNCAATRHVHFTLDGSGPAELTPPKLEDWPNITWDAGASARRVNLDTVTKEDVQQWKTGETLLLSGKILTGRDAAHKRIQTMLQNGEGLPEGVDLKGKFIYYVGPVDAVGDEVVGPAGPTTSTRMDKFTDMMLDETGIMGMIGKAERGPATVESIKNHKAVYLMAVGGAAYLVAKAIKKARVVAFEDLGMEAIYEFEVEDMPVTVAVDSSGANAHQIGPDTWKVKIQEMESQK

SEQ ID NO: 44304 - DNA, 1656 bp, Rhodopseudomonas palustris CGA009
  CDS (1)..(1656): transl_table=11
atgaacgctcccacgccgattccgtccgccgctaccccggttccgccctataagcacaccccgctgttcccgctgggcaaggacgagaccgtctatcgcaagatcacgtcggacggcgtgcgggtcgagaaggtgctcgggcgcgacatgctggtggtggagcgcgaggcgctgcgggcgctgtcggaggcagcgttcggcgagatcaaccattatctgcggcccggccacctcaagcagctccgcgccatcctggacgatccggaggcgagcccgaacgacaagttcgtcgcgctggatttcctgaagaacgccaacatcgccgccggcggcgtgctgccgatgtgccaggacactggcaccgcgatcatcatgggcaagaagggctcgaacgtcatcaccgacggcgacgacgaggcggcgctgtcggaaggcgcgcgcgacgcttacttgcgccgcaacctgcgctactcgcaggtcgcgccgctgtcgatgttcgaagagaagaacaccgccaacaacatgccggcgcagtgcgagatctacgccgagggcgatgatgcctacaagttcatgttcatggccaagggcggcggctcggccaacaagagcttcctgttccaggcgacgccgtcgttgctgacccgcgaccggctgctggcgttcctgaaagagaagatcatgacgctcggcaccgcggcgtgcccgccctatcacctggcgatcgtgatcggcggcacttcggtcgagaccacgatgaagacggtgaagctcgcatccgcgcgctatctcgatgcgctgccgacccacggctccgaactcggcaacgccttccgcgacgtcgagatggagcaggaaatccacaagatgacgcagagcctcggcgtcggcgcgcagttcggcggcaagtatttctgccacgacgttcgcgtcatccggctgccgcgccacggcgcctcgttgccgatcgggcttggggtgtcgtgctcggccgaccgccagatggtgggcaagatcaccaaggacggcgtgtatctggaggagctggagcacaatccggcgcagtatctgccggaagtcgagcaggcgctcggcggcgaggtggtgaagatcgacctcaaccagccgatgaaagatatcctcgccacgctgagcaagcacccgatcaagacccggctgtcgctgaccggcaccatgatcgtggcgcgcgacgccgcccatgccaagctgcgcgaccggctggagaagggcgagccgctgccggactacttcaagaaccacccggtgtactacgccggtccagccaagaccccggacggctatgcttccggcgcgttcggcccgactaccgcggggcgcatggactcgttcgtcgatcagttccaggcggccggcggctcgatggtgatggtcgccaagggcaaccgcgcgccggcggtgcgcgaggcctgcaagaagtacggcggtttctacctcggctcgatcggcggcgctgcggccaacctcgctgagcactgcatcaagaaggtcgaggtgctggaatatcccgagctcggcatggaggcgatctggaagatcgacgtcgtcgacttcccggccttcatcatcgtcgacgacaagggcaacgacttcttcaaggaactgaatctgggctga

SEQ ID NO: 44305 - protein, 551 aa, Rhodopseudomonas palustris CGA009
MNAPTPIPSAATPVPPYKHTPLFPLGKDETVYRKITSDGVRVEKVLGRDMLVVEREALRALSEAAFGEINHYLRPGHLKQLRAILDDPEASPNDKFVALDFLKNANIAAGGVLPMCQDTGTAIIMGKKGSNVITDGDDEAALSEGARDAYLRRNLRYSQVAPLSMFEEKNTANNMPAQCEIYAEGDDAYKFMFMAKGGGSANKSFLFQATPSLLTRDRLLAFLKEKIMTLGTAACPPYHLAIVIGGTSVETTMKTVKLASARYLDALPTHGSELGNAFRDVEMEQEIHKMTQSLGVGAQFGGKYFCHDVRVIRLPRHGASLPIGLGVSCSADRQMVGKITKDGVYLEELEHNPAQYLPEVEQALGGEVVKIDLNQPMKDILATLSKHPIKTRLSLTGTMIVARDAAHAKLRDRLEKGEPLPDYFKNHPVYYAGPAKTPDGYASGAFGPTTAGRMDSFVDQFQAAGGSMVMVAKGNRAPAVREACKKYGGFYLGSIGGAAANLAEHCIKKVEVLEYPELGMEAIWKIDVVDFPAFIIVDDKGNDFFKELNLG

SEQ ID NO: 44306 - DNA, 1626 bp, Geobacter sulfurreducens PCA
  CDS (1)..(1626): transl_table=11
atgtccaccaagccgttcgtctaccaggaccctttccccctcggcaaagatgagacgaagtaccgcaagatcgagggatccgagaaacatgtcacggtcgagcagttcgccggcaaggaagtgctgcgggtctgccccgaggcgctttccatcctcgccaacgaggcgatgcgcgatgtatccttcctgctgcgccccgagcacaacgagtcggtggcgaagatcctgcgcgacccggaagcgtccatgaacgacaagggcgtggccctcgcattcctgcgcaacgccgagatctccgccaacttcgagcttcccatctgccaggataccggcaccgccaccgtcatcgccaagaagggccagcaggtctggaccggcggcaaggatgaagaatacctctccaagggggtctacaagacctacaccgaggagaacctccgttactcccagaccgttgccctcaacatgtacgacgagatcaacaccggcaccaatctcccggcccaggtcgagatccaggccgtggacggcgatgcctacaagtttctcttcatggccaaaggtgggggctccgccaacaagaccatgcttttccaggagaccaaggcgctgctcacccccgagaagcttgaaaagttcctcgtggacaagatgaagtacctgggcaccgccgcctgtccgccctaccacatcgccgtggtcgtgggcggctgctccgccgaccagtgcatgaagaccgtcaagcttgcctcggccaagtacctggacgcactccccacccaggggaacgagcacggccaggcgttccgcgatgtggagcttgaggagaaactcctccaggccgcctacaagctcggcatcggcgcccagttcggcggcaagtacttcgcccacgacgtccgggtcatccggcttccgcgtcacggcgcttcctgccccgtggggatggcggtctcctgttccgccgaccgcaacatcaaggcgaagatcaccagggacggcctcttcgtggaagagctcgaccgcaatccgggccgcctcatccccgagcagtaccgcggcaagcacgagcacggcgtcaagatcgacctgaaccgccccatgaaggaaatcctcgccgagctcagcaagtacccggttgcaacgccgctgctcctgaacggtaccatcgtggtcggccgcgacatcgcccacgccaagttcaaggagatcatcgacgccggcaagccggtgcccgagtacctgctcaaccacccgatctactacgcgggaccggccaagaccccggctggcaagccctccggctccttcggccccaccaccgccggccggatggactcctacgtggatctcctccagtccaagggcgcatccatgatcatgatcgccaaggggaaccgcagccagcaggtgaccgatgcctgccagaagtacggcgggttctacctgggctccatcggcggcccggccgcggttcttgccgaggagaacatcaagaaggtcgagtgcatcgacttccccgaactggggatggaagcggtctggaagatcgaagtggaaaacttcccggccttcatccttgtggacgacaaggggaacgacttcttcaagcaactgggtctgtaa

SEQ ID NO: 44307 - protein, 541 aa, Geobacter sulfurreducens PCA
MSTKPFVYQDPFPLGKDETKYRKIEGSEKHVTVEQFAGKEVLRVCPEALSILANEAMRDVSFLLRPEHNESVAKILRDPEASMNDKGVALAFLRNAEISANFELPICQDTGTATVIAKKGQQVWTGGKDEEYLSKGVYKTYTEENLRYSQTVALNMYDEINTGTNLPAQVEIQAVDGDAYKFLFMAKGGGSANKTMLFQETKALLTPEKLEKFLVDKMKYLGTAACPPYHIAVVVGGCSADQCMKTVKLASAKYLDALPTQGNEHGQAFRDVELEEKLLQAAYKLGIGAQFGGKYFAHDVRVIRLPRHGASCPVGMAVSCSADRNIKAKITRDGLFVEELDRNPGRLIPEQYRGKHEHGVKIDLNRPMKEILAELSKYPVATPLLLNGTIVVGRDIAHAKFKEIIDAGKPVPEYLLNHPIYYAGPAKTPAGKPSGSFGPTTAGRMDSYVDLLQSKGASMIMIAKGNRSQQVTDACQKYGGFYLGSIGGPAAVLAEENIKKVECIDFPELGMEAVWKIEVENFPAFILVDDKGNDFFKQLGL

SEQ ID NO: 44308 - DNA, 1836 bp, Bdellovibrio bacteriovorus HD100
  CDS (1)..(1836): transl_table=11
gtgcttataggtccagggcgatatgttgtgtttcagaaggagacgtcacaaacgaagccttctaacctcggtaggttcctgaccactctccagcgaagagagacccggtcccaagaaaaccgccgcaatcgcggctcacaaagtcccacccaaatagcccacctaacacagcctaccgagggttgcgcgcgaacacgacgcaatgctactttcagttgcatgtcatttaaatacttccccctctatgaaaagcaaaaagatacgactcaatataaaaagatctcttccgatcacgtgcgcgtggaaaaaatcggcgagcgcgaggttctgattgttgaacctgaagcattggaactgctcgctcaagaggccttgagcgatgtttcgcacctgttgcgcccaaagcacctggaaaaactggaaagaatccttcaggaccctgaagcttcaccaaatgaccgctttgtggcggtggatctgctgcgcaatgcggtgatcgcggcgcagatggagttcccttcctgtcaggacacgggaactgcaattgttgtcggcaaaaaaggggagcgcgtgttcaccggggctgatgacaaggaattcctgtccaaagggatttacaacacctatcaaaaacgcaatctgcgcttttctcagatggcgccgatttctttctttgaagaaaaaaataccggcagcaatctgccagcccagatcgacatctattccgagcagggcgaagagtacaacttcctgttcctggctaaaggtggcggcagtgcgaataaatcctatctgtatcaaaaaaccaaagcggttctgaatccggaaggttttgaaaagtttgtgcgcgaaacgctgaactctttgggcacggcggcttgtcctccttatcacctggctttttgcgtgggtggaacgtcggcggaagaaacgctgaagatcgtgaaatacgcatctgcaggttatctggatggtctgccgacgacaggcagcgaaggcggacgggcctatcgtgatcttgaaatggaaaaacaagtcgagcagtgggctcgtgaaacgggcatcggtgctcagttcggtggcaagtacttcgtgcacgacgtgcgtgtgatccgactgcctcgccacggagcaagttgcccgattggtgtgggcgtcagctgttctgcggatcgtaacatcaaaggcaagatcacccgcgacggtatcttcctggaacaattggagcttcatccagagcagtacctgccaaatcacctgaaggatgccagcgccgaagcaattgaaattgatctgaacaaaccgatggcggaaacgctgaaggttctttcccagcaaaaagtggcgacccgggtgatgttaagcggtcccatgatcgtggctcgcgacatcgctcatgcgaaactgaaagaaaaagtcgatcgcggcgaaggtgtgcctcagtactttaaggattatgcagtctattacgcgggcccggctaagacgccaaaaggctacgcttccggctccttcgggccgacgaccagtgaacgaatggacccgtatgtggggacgttccaggcgctgggaggctccatgatcatgttgggtaaggggaaccgcagcccgcaggtcacagaagcctgcaaacagtacggtggcttctatctgggctctattggcggcccggcggcccgtttgggcaaagagtgcatcacaaaagttgaagtgctggatttcccggaactgggtatggagtctgtgtggaagatcgaagtcaaagacttcccggcctttatcatcgtcgatgacaaaggaaatgacttcttcaagtccgttatccgaaaactttaa

SEQ ID NO: 44309 - protein, 611 aa, Bdellovibrio bacteriovorus HD100
MLIGPGRYVVFQKETSQTKPSNLGRFLTTLQRRETRSQENRRNRGSQSPTQIAHLTQPTEGCARTRRNATFSCMSFKYFPLYEKQKDTTQYKKISSDHVRVEKIGEREVLIVEPEALELLAQEALSDVSHLLRPKHLEKLERILQDPEASPNDRFVAVDLLRNAVIAAQMEFPSCQDTGTAIVVGKKGERVFTGADDKEFLSKGIYNTYQKRNLRFSQMAPISFFEEKNTGSNLPAQIDIYSEQGEEYNFLFLAKGGGSANKSYLYQKTKAVLNPEGFEKFVRETLNSLGTAACPPYHLAFCVGGTSAEETLKIVKYASAGYLDGLPTTGSEGGRAYRDLEMEKQVEQWARETGIGAQFGGKYFVHDVRVIRLPRHGASCPIGVGVSCSADRNIKGKITRDGIFLEQLELHPEQYLPNHLKDASAEAIEIDLNKPMAETLKVLSQQKVATRVMLSGPMIVARDIAHAKLKEKVDRGEGVPQYFKDYAVYYAGPAKTPKGYASGSFGPTTSERMDPYVGTFQALGGSMIMLGKGNRSPQVTEACKQYGGFYLGSIGGPAARLGKECITKVEVLDFPELGMESVWKIEVKDFPAFIIVDDKGNDFFKSVIRKL

SEQ ID NO: 44310 - DNA, 1527 bp, Acinetobacter sp. ADP1
  CDS (1)..(1527): transl_table=11
atgaccacaattatcaaacaagaagacttgatcacttcggtcaaggatgcccttcagttcatttcctactatcatccgcaagattttattcaggccatgagccgtgcgtacgatcgtgaagcgaaccaagctgcaaaggatgcaatcgcacaaattctcatcaactctcgtatgtgtgcagaaggtcatcgcccaatctgtcaagatacaggtatcgtcaacgtatttgttgatgtcggtctagatgttaagttcgatcttagcatgagcctagatgatgcgattaatgaaggtgtacgccaaggttatcttgaaaataccaacgtactccgtgcttctgtgcttgcagatccagcctttggccgtaaaaataccaaagacaacacccccgctgtaatccattataaacttgttccaggtaacaaagttgatattacagtagccgctaaaggcggtggttctgaaaataaatctaaacttgccatgttgaatccgtctgattcaattgtggactgggtactgaaaactgttccaactatgggcgctggctggtgtcctccaggtatgctgggtatcgggattggtggtactgctgaaaaagccatgatgcttgccaaagaagcattgatggaagaaatcaacatggacgaattacttcgtcgcgggccagaaaacaaaattgaagaacttcgtatcgaaatcttcgagaaagtgaatgcgcttggtattggtgcacaaggtcttggcggtttgactacagttctcgatatcaaaattaaagattatccatgtcatgcggcaggcaaaccagtgggcatgattccaaactgtgctgcgactcgtcatgctcattttcagttagatggttcaggccctgcacatattcaagcacctaaacttgaagattacccagaagtgacgtgggattcatctaaatcaaaacgcgtaaaccttgataccatcactcaagaagaaatgaactcttggcagccaggtgataccttgttgctcagtggcaccatgtacactggtcgtgatgcagcgcataaacgtctggtagaaatgatcgataatggtgaagagcttcctgtcgatcttaaaggtaagtttatttactacgtgggtccagtcgatcctgtaggtgatgaagtggttggacctgctggcccaacaacagcaacgcgtatggacaaattcacacgtaaagtgcttgagcatacgggtctgtttggcatgattggtaaagcagatcgtggcccaaccgcgattgaagcgattaaagataatcaagcaacgtatctcatggcagtcggtggtgcagcataccttgtatctaaggcagtgcgtgaagccgaagtggttgcatttgctgatctaggtatggaagctatctacaaatttgtagtcgaagacatgccagtatccgttgcagttgatgttaacggtacatcggtacatgcaattgcacccaaaatctggcaagaaaagattggtaaaattccagtgattgatgccactgcagtttaa

SEQ ID NO: 44311 - protein, 508 aa, Acinetobacter sp. ADP1
MTTIIKQEDLITSVKDALQFISYYHPQDFIQAMSRAYDREANQAAKDAIAQILINSRMCAEGHRPICQDTGIVNVFVDVGLDVKFDLSMSLDDAINEGVRQGYLENTNVLRASVLADPAFGRKNTKDNTPAVIHYKLVPGNKVDITVAAKGGGSENKSKLAMLNPSDSIVDWVLKTVPTMGAGWCPPGMLGIGIGGTAEKAMMLAKEALMEEINMDELLRRGPENKIEELRIEIFEKVNALGIGAQGLGGLTTVLDIKIKDYPCHAAGKPVGMIPNCAATRHAHFQLDGSGPAHIQAPKLEDYPEVTWDSSKSKRVNLDTITQEEMNSWQPGDTLLLSGTMYTGRDAAHKRLVEMIDNGEELPVDLKGKFIYYVGPVDPVGDEVVGPAGPTTATRMDKFTRKVLEHTGLFGMIGKADRGPTAIEAIKDNQATYLMAVGGAAYLVSKAVREAEVVAFADLGMEAIYKFVVEDMPVSVAVDVNGTSVHAIAPKIWQEKIGKIPVIDATAV

SEQ ID NO: 44312 - DNA, 1644 bp, Erwinia carotovora subsp. atroseptica SCRI1043
  CDS (1)..(1644)
atgtcgaataaacccttctattaccaagatccttttccactcagtaaagatgacactgaatatcgcctgctgagcagcgactttgtctctgtcgcgcaatttgaaggtcaggacatcctgaaagtcgagccagcggcgttgacccttctggcccagcaagccttccacgatgcttctttcatgctccgccccgctcatcagcagcaagttgccgatattctccatgacccagaagccagcgaaaacgataaatacgttgctctgcaattcctgcgcaactcagaaatttccgccaagggaattctgccgacctgtcaggataccggtaccgcgattatcgtcggtaaaaaaggccaaaacgtgtggactggcggtaacgatgccgaagcgctgtctcagggcgtgtacaacacgttcattgaagacaacttgcgttactcgcagaacgctgcgctggatatgtaccaagaggtcaacactggcaccaacctgcctgcgcagattgatctctacagtaccgagggcgaagattataaattcctgttcgtcaccaaaggcggcggttctgctaacaagacctacttgtatcaggaaaccaaagcgctgctgacgccgggtaaactgaagagcttcctgatcgagaaaatgcgttcattgggcacggcggcctgcccgccataccacatcgcgtttgctattggcggtacctcggcagaaaccacgctgaaaaccgttaaactggcttcgaccaagtactatgacgaactgccgaccgaaggcaacgagcacggtcaggcgttccgcgatgtcgcactggagcaggaaattctggaagccgcacgcgatttgggtctgggggcgcagttcggcggtaaatatttcgcgcacgacgtgcggattatccgcttgccgcgccacggcgcatcttgtccggtcgggatgggcgtatcctgttccgctgaccgcaacatcaaaggcaagatcaaccgcaagggcgtctggctggagcagttagagcagaatccgggcaaatatatccctgagcacctgcgtgaaacgggcgaaggcgatgcggttaaaatcgacctgaaccgcccaatgaccgagatcctgaagacgctgtcgcagtatccggtgtccacccgcctttccctgactggcactatcatcgtgggtcgtgatattgctcacgccaagctgaaagagcgtctggataacggtgaaggtctgccgcagtacattaaagatcacccgatctactacgcaggcccagcgaaaacaccggaaggttatccatcaggttcattaggcccaaccacagctggccgcatggattcctatgtcgatttactgcaagccaacggcggcagcatggtcatgctggcaaaaggcaaccgtagccaacaagtcaccgacgcatgccataaacatggcggtttctacctcggcagcatcggcggcccggcagcgattctggcgcaaaacagcatcaaaagcctgacctgtgtggaatacccagaactgggtatggaagccatctggaaaatcgaagtagaagatttccctgcctttattctggtcgatgataaaggcaacgatttcttccaggtgattcagagcgccaaatgcgtgaaatgcggttaa

SEQ ID NO: 44313 - protein, 547 aa, Erwinia carotovora subsp. atroseptica SCRI1043
MSNKPFYYQDPFPLSKDDTEYRLLSSDFVSVAQFEGQDILKVEPAALTLLAQQAFHDASFMLRPAHQQQVADILHDPEASENDKYVALQFLRNSEISAKGILPTCQDTGTAIIVGKKGQNVWTGGNDAEALSQGVYNTFIEDNLRYSQNAALDMYQEVNTGTNLPAQIDLYSTEGEDYKFLFVTKGGGSANKTYLYQETKALLTPGKLKSFLIEKMRSLGTAACPPYHIAFAIGGTSAETTLKTVKLASTKYYDELPTEGNEHGQAFRDVALEQEILEAARDLGLGAQFGGKYFAHDVRIIRLPRHGASCPVGMGVSCSADRNIKGKINRKGVWLEQLEQNPGKYIPEHLRETGEGDAVKIDLNRPMTEILKTLSQYPVSTRLSLTGTIIVGRDIAHAKLKERLDNGEGLPQYIKDHPIYYAGPAKTPEGYPSGSLGPTTAGRMDSYVDLLQANGGSMVMLAKGNRSQQVTDACHKHGGFYLGSIGGPAAILAQNSIKSLTCVEYPELGMEAIWKIEVEDFPAFILVDDKGNDFFQVIQSAKCVKCG

SEQ ID NO: 44314 - DNA, 1545 bp, Desulfotalea psychrophila LSv54
  CDS (1)..(1545): transl_table=11
ttgatattattaaacaaaaaaggaatagccatgaccaccatcaagaaaaaagactttgtcgattctattgctgaaagtttacagcatatctcctactaccaccccctcgactttgtaaaggcgatgcacgcagcctatctgcgtgaggaaaaccccgcggccaaggacgccataggccaaattctgatcaactccaagatggctgctgtcggaaaaaggcctatctgccaagatacgggcatcgtcaatgtcttcttaaaggttggaaaaaactgtcaatttgactgctcagaaagcctgcaagaactggtagatgagggggtacgtcttgcctacgggcatccagaaaaccccctacgcgcctccgttgtcaaaagtcctgcaaccaaccgtctcaataccaaggataacagcccggccattgtctatacagagattgttgaaggtaacgggatcgatataagtatagcagccaagggcggtggttcagaaaataagaccaaattggccatgctcaaccccaacgactcaatcgttgactgggtcaagaaagttgtccccaccatgggcgcgggctggtgtcctccggggataatcagccttggggtcggtggtactgctgacaaggctatggtccttgccaaggagggactcatggcagccgttgatatgccagagattctcgcacgcggaccaaaggacaaggtcgaagagttgcgagtggccctctaccatgccataaatgatctgggcattggcgcccagggtctcggcggactcaccaccgtagtcgacgtcaaattagcagaatatccgacccacgcggcatctctgcccgtggcccttattccaaactgcgcagcaacccgtcatacccactttcatcttgacggcagcggccccgccgaatttccacgtcctgatataacccagtggccggacatctctcttgctgcgggcgacaaggttaaacgtgtccaccttaacaatataaccaaggaagagattgccacctggcaaaccggtgagaccctccttctcaacggtaaaatcctcaccggtcgtgatgccgcccataaacgcatcaagggactgctcgatgcgggagagccactacctgcgggggttgatttcaacggacgatttatctattacgtaggccccgttgatccagtcggcaccgaggtggttggacccgccggccccacaacatctacccgcatggacaagtttaccgacatgatgctagaagaggcgggcctctttggtatgattggcaaatcagaacgtggcgatgaaaccattgagtccatcaagaaaaacaaagctgtctacctgatggccgtaggcggagccgcctaccttgtctccaaggcaatcaaaaaatcccgggtggtggcctttgccgatctcggaatggaggccatctacgaatttgaggtggaggatatgccagtgaccgtggccgtcgacgcccgaggagaggcaatccacaaaacagggcccaccttttggcaggaacatatcaggcagatgaagagatag

SEQ ID NO: 44315 - protein, 514 aa, Desulfotalea psychrophila LSv54
MILLNKKGIAMTTIKKKDFVDSIAESLQHISYYHPLDFVKAMHAAYLREENPAAKDAIGQILINSKMAAVGKRPICQDTGIVNVFLKVGKNCQFDCSESLQELVDEGVRLAYGHPENPLRASVVKSPATNRLNTKDNSPAIVYTEIVEGNGIDISIAAKGGGSENKTKLAMLNPNDSIVDWVKKVVPTMGAGWCPPGIISLGVGGTADKAMVLAKEGLMAAVDMPEILARGPKDKVEELRVALYHAINDLGIGAQGLGGLTTVVDVKLAEYPTHAASLPVALIPNCAATRHTHFHLDGSGPAEFPRPDITQWPDISLAAGDKVKRVHLNNITKEEIATWQTGETLLLNGKILTGRDAAHKRIKGLLDAGEPLPAGVDFNGRFIYYVGPVDPVGTEVVGPAGPTTSTRMDKFTDMMLEEAGLFGMIGKSERGDETIESIKKNKAVYLMAVGGAAYLVSKAIKKSRVVAFADLGMEAIYEFEVEDMPVTVAVDARGEAIHKTGPTFWQEHIRQMKR

SEQ ID NO: 44316 - DNA, 1521 bp, Bacillus cereus ZK
  CDS (1)..(1521): transl_table=11
atggaaaagcttcaagaaagcatgtatcaactaattgttgaaacgtcaacgaacttaccgaaagatgttcgtcgtgcgattcaacaagcgaaagagcgagaaaatgcagggactcgctctgcgatggcacttggcacaattacgaataatattaaaatggctgatgataacatctcaccaatttgccaagatacagggatgccaacgtttaaaatttatacaccagttggtgtgaatcaattaaagttgaaggaagctatctataatgcgcttgagcgggcgacaaaagatggtaaacttcgtccaaattctgttgattctctttttggagacaatagtggaaataatttaggaccaggtactccggtgattaagtttgaacaatgggaaaaagattatattgatgcacgtttaattctaaagggtggtggctgtgagaataaaaatattcagtatagcttaccatgtgaattagaaggacttggacgtgcaggccgtgatttagaaggaattcgtaaatgccttcttcacgcagtatatcaagcacaagggcaaggatgtagtgcaggtgtaattggtgttggtatcgggggagaccgcacatcaggttacgaattagcaaaaaatcaattattccgtacattagatgatgttaatccaatcccagaattacaacaacttgaagaatatgtattagaaaatgcgaataagcttggcattggtacgatgggatttggcggagaaacaactttacttggctgtaaaattggcgtgtataatcgtctgccagctagcttctatgtatctgtggcgtataattgctgggcatatcgccgtcttggcgtaataattcaccctgaaacaggtgaaattatggattggttatatcaagaaggtgacgatacacttcagcaagaggcgcaaaaaaaaacagagcaacgtgagattgtattacaagcaccgattacagaagagcaaattcgtgaacttcgcgttggtgatgttgtaacaattaatggcatgatgtatacaggtcgtgacgcaatccataagcatttaatggataatgattgtccagtagatttaaatggacaagttatttatcactgtggtccagttgtcgtgaaagatgaaaaggacaattggcaaattaaagcggcaggtccaacgacaagtattcgtgaagaaccgtaccaaggtgatattatgaagaaattcggtattcgcgctgtcattggaaaaggcggtatgggtgcgaaaacattagcggctttagaagaacacggcggtgtatatttaaacgcaatcggtggtgcagcgcaatattatgctgaatgtattaaagaagtgaaagatgttgatttcttacaatttggtattccagaggcaatgtggcatttacgtattgaagggtttaaagcagttgtaacgatggattctcatggtaatagcttacatgcagatgttgataaaacatcacttgaaaaattagcgagctttaaagagccagtatttaagtaa

SEQ ID NO: 44317 - protein, 506 aa, Bacillus cereus ZK
MEKLQESMYQLIVETSTNLPKDVRRAIQQAKERENAGTRSAMALGTITNNIKMADDNISPICQDTGMPTFKIYTPVGVNQLKLKEAIYNALERATKDGKLRPNSVDSLFGDNSGNNLGPGTPVIKFEQWEKDYIDARLILKGGGCENKNIQYSLPCELEGLGRAGRDLEGIRKCLLHAVYQAQGQGCSAGVIGVGIGGDRTSGYELAKNQLFRTLDDVNPIPELQQLEEYVLENANKLGIGTMGFGGETTLLGCKIGVYNRLPASFYVSVAYNCWAYRRLGVIIHPETGEIMDWLYQEGDDTLQQEAQKKTEQREIVLQAPITEEQIRELRVGDVVTINGMMYTGRDAIHKHLMDNDCPVDLNGQVIYHCGPVVVKDEKDNWQIKAAGPTTSIREEPYQGDIMKKFGIRAVIGKGGMGAKTLAALEEHGGVYLNAIGGAAQYYAECIKEVKDVDFLQFGIPEAMWHLRIEGFKAVVTMDSHGNSLHADVDKTSLEKLASFKEPVFK

SEQ ID NO: 44318 - DNA, 1647 bp, Bacteroides fragilis YCH46
  CDS (1)..(1647): transl_table=11
atggcaacacctccgtttaagtatcaacctatgttcgaacatggggaagataaaaccgagtattatctgcttaccaaagactatgtgtcagtaagcgagttcgaaggaacacctgtgctgaaagtacagaaagaaggtctgacagcgatggctaatactgctttccgcgacgtatctttcatgcttcgccgtgcgcacaacgagcaggtagcgaagattctgagcgacccggaagcaagtgaaaacgacaaatacgtggcattgactttcctgcgcaacgctgaagtggctgccaaaggtatacttcctttctgccaggataccggtacggctatcatccacggtgaaaaaggacagcaggtatggacaggctattgcgatgaagaagctttgtcattgggtgtttacaagacatatacggaagaaaacctgcgttattcacagaatgctccgctcaacatgtacgacgaggtgaacacgaagtgcaatctgccggcccagatcgatatcgaggctacggaaggcatggagtacaaattcctgtgtgtgaccaagggtggtggttctgccaataagacttatctgtatcaggagacaaaagcgatcctgaatccgggcactctggttccgttcctggttgagaagatgaagacactgggtacagcggcttgtcctccttatcatattgcattcgttatcggcggtacttcggctgagaagaatctgctgactgtgaaactggcttctacccactattacgacgagttgccgactaccggtaatgagtatggtcgtgctttccgcgacgtagaactggagaaagaggtacttgccgaagcccaaaagatcggtttgggagcacagtttggcggtaaatatctggcacacgatgtacgtatcatccgtctgccccgtcacggagcttcttgtccggtgggcttgggtgtatcttgttctgccgaccgtaacatcaaatgtaagatcaataaagacggtatctggattgaaaaactcgattctaatccgggcagtctgattcccgcagaactgcgtggcgcaggtgaaggcgatgtagtgaaaatcgacctgaaccagccgatggcggatatcctgaaggaactgactaaatatccggtagctacacgtctgtcactcaacggtacgatcatcgtaggccgtgatatcgctcacgctaaactgaaagaacgtctggatcgcggcgaagatctgcctcaatatatcaaagaccatccgatttattatgccggtccggctaaaactcctgccggcatggcttgcggttcgatgggaccgactactgccggacgtatggatccctatgtggacttgttccagagccatggcggcagcatgattatgttggcaaaaggtaaccgtagccagcaggtgaccgatgcttgtaagaagtatggcggtttctaccttggttcaatcggtggtccggctgctatccttgcccagaacaatatcaagagcatcgaatgcgtagaatatccggaattgggtatggaagctatctggaagatcgaagtagaggacttccccgcatttattcttgtagatgacaagggtaacgacttctttaagcagataaaaccccgttgcggttcttgcagcaacaaataa

SEQ ID NO: 44319 - protein, 548 aa, Bacteroides fragilis YCH46
MATPPFKYQPMFEHGEDKTEYYLLTKDYVSVSEFEGTPVLKVQKEGLTAMANTAFRDVSFMLRRAHNEQVAKILSDPEASENDKYVALTFLRNAEVAAKGILPFCQDTGTAIIHGEKGQQVWTGYCDEEALSLGVYKTYTEENLRYSQNAPLNMYDEVNTKCNLPAQIDIEATEGMEYKFLCVTKGGGSANKTYLYQETKAILNPGTLVPFLVEKMKTLGTAACPPYHIAFVIGGTSAEKNLLTVKLASTHYYDELPTTGNEYGRAFRDVELEKEVLAEAQKIGLGAQFGGKYLAHDVRIIRLPRHGASCPVGLGVSCSADRNIKCKINKDGIWIEKLDSNPGSLIPAELRGAGEGDVVKIDLNQPMADILKELTKYPVATRLSLNGTIIVGRDIAHAKLKERLDRGEDLPQYIKDHPIYYAGPAKTPAGMACGSMGPTTAGRMDPYVDLFQSHGGSMIMLAKGNRSQQVTDACKKYGGFYLGSIGGPAAILAQNNIKSIECVEYPELGMEAIWKIEVEDFPAFILVDDKGNDFFKQIKPRCGSCSNK

SEQ ID NO: 44320 - DNA, 1536 bp, Burkholderia mallei ATCC 23344
  CDS (1)..(1536): transl_table=11
atgaccgtcatcaaacaggaagacctgatccagagcatcgcggattcgctgcagtacatcagctactaccatccgctcgattacatccaggcgctcggccgcgcatacgagctcgagcagagcccggccgcgaaggatgcgatcgcgcagatcctgacgaacagccgcatgtgcgcggaaggcaagcgcccgatctgccaggacacgggcatcgtcacgatcttcgtgaaggtcggcatggacgtgcgctgggcaagcgagaacggcgccgcgacgatgagcgtcaccgacatgatcaacgaaggcgtgcgccgcggctacacgcatccggacaacgtgctgcgcgcatcgatcgtcaacccgcccgaaggcgcgcgcaagaacacgaaggacaacacgccggccgtgatccattacgagatcgtgccgggcgacaaggtcgacgtgcaagtcgcggcgaagggcggcggctccgagaacaaatcgaagttcgtgatgctgaacccgtcggattcgatcgtcgactgggtactgaagaccgtgccgacgatgggcgcgggctggtgcccgccgggcatgctcggcatcggcatcggcggcaccgccgagaaggcgatgctgatggcgaaggaatcgctgatggagccgatcgacatccaggaaatcatcgcgcgcggcccgaaggactgggtcgaggaactgcgcgtcgagctgcacgagaaggtcaacgcgctcggcatcggcgcgcagggtctcggcggcctcgcgaccgtgctcgacgtgaagatcctggccgcgccgacgcacgcggcgtcgaagcccgtcgcgatgatcccgaactgcgcggccacgcgccatgcgcacttcgtgctcgacggctcgggcgcggcgaagctcgaggcgccgtcgctcgacgcatggccgaaggttcaatgggaaccgaacaccgagacgagcaagcgcgtcgacctgaacacgctgacgccggaagaagtcgcatcgtggaagccgggccagacgctgctgctgtcgggcaagatgctcacgggccgcgacgccgcgcacaagcgcatcgccgacatgctcgccaagggcgagccgttgcccgtcgacttcaagaaccgcgtgatctactacgtcgggccggtcgatccggtgcgcgacgaagtggtcggtccggcgggcccgacgacggccacgcgcatggacaagttcaccgagacgatgctcgcgcagacgggcctcatctcgatggtcggcaaggccgagcgcggcccggtcgcgatcgacgcgatcaagaagcacaaggccgcttatctgatggcggtcggcggcgccgcgtacctcgtgtcgaaggcgattcgcggcgcgaaggtgctcgcgttcgaagacctcggcatggaagcgatctacgagttcgacgtacaggacatgccggtgacggtcgcggtcgattcgcagggcacgtcggtccatcaaacggggccgaaggagtggcaggcgaagatcggcaagatccctgtcgcgagcgcgtaa

SEQ ID NO: 44321 - protein, 511 aa, Burkholderia mallei ATCC 23344
MTVIKQEDLIQSIADSLQYISYYHPLDYIQALGRAYELEQSPAAKDAIAQILTNSRMCAEGKRPICQDTGIVTIFVKVGMDVRWASENGAATMSVTDMINEGVRRGYTHPDNVLRASIVNPPEGARKNTKDNTPAVIHYEIVPGDKVDVQVAAKGGGSENKSKFVMLNPSDSIVDWVLKTVPTMGAGWCPPGMLGIGIGGTAEKAMLMAKESLMEPIDIQEIIARGPKDWVEELRVELHEKVNALGIGAQGLGGLATVLDVKILAAPTHAASKPVAMIPNCAATRHAHFVLDGSGAAKLEAPSLDAWPKVQWEPNTETSKRVDLNTLTPEEVASWKPGQTLLLSGKMLTGRDAAHKRIADMLAKGEPLPVDFKNRVIYYVGPVDPVRDEVVGPAGPTTATRMDKFTETMLAQTGLISMVGKAERGPVAIDAIKKHKAAYLMAVGGAAYLVSKAIRGAKVLAFEDLGMEAIYEFDVQDMPVTVAVDSQGTSVHQTGPKEWQAKIGKIPVASA

SEQ ID NO: 44322 - DNA, 1677 bp, Nocardia farcinica IFM 10152
  CDS (1)..(1677): transl_table=11
gtgaccgccccggagttccgctattcagatctgctgccgatcggcgccgacgacacgccgtaccggctgctgaccaccgagggcgtcagcaccttcgagcacaacggtcgcaccttcctgcaggtcgaccccgaggtgctgcggatgctcaccgccgaggcgatgcacgacatcagccactacctgcggcccgcgcacctggcgcagctgcgcaagatcatcgacgacccggagtcctccggcaacgaccgcttcgtcgcgctggacctgctcaaaaacgtcaacatctccgcgggcggcatcctgccgatgtgccaggacaccggcaccgcgatcgtgatgggcaagaagtccgagggcgtgctcaccggggtcgacgacgccgagtggatcagccgcggcgtcttcgacgcctacaccaagctgaacctgcgctactcccagctggccccgttgaccatgtgggaggagaagaacaccggcaccaacctgcccgcgcaggtcgagttgtactccacccagggcgatcccgcgcacccgtcctacaagttcctgttcatggccaagggcggcggctcggccaacaagtcgttcctgtaccaggagaccaaggccatcctgaaccccgagcggatgctggagttcctggacgagaagatccgttcgctgggcaccgcggcctgcccgccctaccacctggccgtggtgatcggcggcaccagcgccgaattcgcgctcaagaccgccaaatacgcctccgcgcactacctggacaatctgcccaccgagggctcgatgaccgcgcacgccttccgcgacctggcgctggaggaggaggtcttcaagctgacccagtccttcggcatcggcgcgcagttcggcggcaagtacttctgccacgacgtgcgcgtggtgcgcctgccccggcacggcgccagctgcccggtcgccatcgcggtgtcctgctcggccgaccgccaggcgttggccaagatcacccccgagggcgtgttcctcgagcagctcgagcgcgagcccgcccagtacctgcccgagcagaccgacgagatcctcggcggcgacgtggtgaagatcgacctgaaccggccgatgtcggagatccgcgccgaactgtcgaaatacccggtgaagacccgcctctcgctcaccggcccgctggtggtggcccgcgacatcgcgcacgccaagatcaaggaacgcctcgacgccggcgagccgatgccgcagtacatgcgcgacatggccgtctactacgcgggcccggccaagacgcccgagggctacgcctccggctcgttcggccccaccaccgccggacgcatggactcctacgtcgaccagttccaggcggcgggcggctcctacgtcatgctcgccaagggcaaccgctcggcgcaggtcaccaaggcgtgcaaggagcacggtggtttctacctcggctcgatcggcggcccggccgcgcggctggcgctggactgcatcaagaacgtcgaggtgctcgaataccccgagctcggcatggaggcggtctggaagatcgaggtcgaggacttcccggccttcatcgtcgtcgacgacaagggcaacgatttcttcgccgagacccagaagccgatcgcgctgcgcgtgcgcacccggtccaaggaacgggtctag

SEQ ID NO: 44323 - protein, 558 aa, Nocardia farcinica IFM 10152
MTAPEFRYSDLLPIGADDTPYRLLTTEGVSTFEHNGRTFLQVDPEVLRMLTAEAMHDISHYLRPAHLAQLRKIIDDPESSGNDRFVALDLLKNVNISAGGILPMCQDTGTAIVMGKKSEGVLTGVDDAEWISRGVFDAYTKLNLRYSQLAPLTMWEEKNTGTNLPAQVELYSTQGDPAHPSYKFLFMAKGGGSANKSFLYQETKAILNPERMLEFLDEKIRSLGTAACPPYHLAVVIGGTSAEFALKTAKYASAHYLDNLPTEGSMTAHAFRDLALEEEVFKLTQSFGIGAQFGGKYFCHDVRVVRLPRHGASCPVAIAVSCSADRQALAKITPEGVFLEQLEREPAQYLPEQTDEILGGDVVKIDLNRPMSEIRAELSKYPVKTRLSLTGPLVVARDIAHAKIKERLDAGEPMPQYMRDMAVYYAGPAKTPEGYASGSFGPTTAGRMDSYVDQFQAAGGSYVMLAKGNRSAQVTKACKEHGGFYLGSIGGPAARLALDCIKNVEVLEYPELGMEAVWKIEVEDFPAFIVVDDKGNDFFAETQKPIALRVRTRSKERV

SEQ ID NO: 44324 - DNA, 1509 bp, Photobacterium profundum SS9
  CDS (1)..(1509): transl_table=11
atgaccgtcatccgtaaagaagatgtgattagtagtgttgctgatgcattacagtacatatcttactaccatccacttgattttgttcaagcattggaaaaagcttataacaaagaacagagtcaagctgcgaaagatgctatcgcacagattttgatcaattcgcgtatgtctgcagaaggtaagcgtcctatctgtcaagatacgggtattgtgacctgtttcgttaaaatcggtatgaatgtgcagtgggagggtgatcttactgttcagcaaatggtcgatgaaggtgtccgtcaagcttataacaacccagacaaccccctacgagcgtctgttgttgccgatcctgctggcacgcgtaccaatacgaaagataatacgccagcagttgttcatattgatatggtgccaggtaataaagttgatattcaaattgcagctaaaggcggcggttctgaaaataaaaccaaaatggtgatgctaaacccttctgatgatgtagctgagtgggttgaaaaaacagtgccactaatgggcgcgggttggtgcccaccaggtatgttaggcataggcatcggtggtacggctgaaaaagcggcagtattagcaaaagagtcgttgatggactctattgatatccatgagctgcaagagcgtggcgcgcaaaatgctgaagaagaattacgtttagatatttataaccgtgtgaacaagttgggtattggtgcacaagggctgggtgggttaacaaccgttgttgatgtgaaaattaaaacagcaccaacacacgctgcgtctaagcctgtttgcatgatccctaactgtgcggctacgcgtcatgtgcattttacacttgacggtacaggccctgctgaattaaccccaccgaagctagaagactggccagaagtgacatgggaagtcggcgagagtgttcgccgtgttaacgttgatgaaattactaaagctgatgttcaggaatggaaatcaggcgaaacggttttattgtcaggtaaaatcttaacaggtcgtgatgctgcgcataaacgtattcaagatatgttggctcgcggcgaagatttccctgtagatttcaataaccgctttatttattacgtgggtccagtcgatgccgtccgtgatgaggtagtgggtcctgctggtccaacaacgtcaacgcgtatggataagtttaccgatatgatgttaggtcaagctggcttaatgggcatgattggtaaagctgaacgtggacctaaggcaattgagtcgattaaagcacacaacgcggtttatctaatggctgttggtggtgctgcttacttggttgcgaaggcgattaagaaagcacgtatagttgcatttgaagatctcggtatggaagctatctacgaatttgaagtcgaagatatgccagtgactgttgcggttgattctgcaggcactaacgcccatgagacaggtccagatacttggaaagtcaaaatagctgaaatggatgcttaa

SEQ ID NO: 44325 - protein, 502 aa, Photobacterium profundum SS9
MTVIRKEDVISSVADALQYISYYHPLDFVQALEKAYNKEQSQAAKDAIAQILINSRMSAEGKRPICQDTGIVTCFVKIGMNVQWEGDLTVQQMVDEGVRQAYNNPDNPLRASVVADPAGTRTNTKDNTPAVVHIDMVPGNKVDIQIAAKGGGSENKTKMVMLNPSDDVAEWVEKTVPLMGAGWCPPGMLGIGIGGTAEKAAVLAKESLMDSIDIHELQERGAQNAEEELRLDIYNRVNKLGIGAQGLGGLTTVVDVKIKTAPTHAASKPVCMIPNCAATRHVHFTLDGTGPAELTPPKLEDWPEVTWEVGESVRRVNVDEITKADVQEWKSGETVLLSGKILTGRDAAHKRIQDMLARGEDFPVDFNNRFIYYVGPVDAVRDEVVGPAGPTTSTRMDKFTDMMLGQAGLMGMIGKAERGPKAIESIKAHNAVYLMAVGGAAYLVAKAIKKARIVAFEDLGMEAIYEFEVEDMPVTVAVDSAGTNAHETGPDTWKVKIAEMDA

SEQ ID NO: 44326 - DNA, 1548 bp, Geobacillus kaustophilus HTA426
  CDS (1)..(1548): transl_table=11
atggaaaaattccagcaaagcatgtatgacttgatcgttgagacatcaacgaagctgccgaaggacgttcgccgagcgatcgctcgagcgaaagtgcgcgaaaacgccggcacgcgggcggccatggcgctcgatacgatcgtcgagaacattcaaatggcggacgaaaacgtgtcgccgatctgtcaggacaccggcttgccgacgtttaaaatcaaagtgccggtcggcgtgaatcaaatcgaaatgaaaaaagcgatccgcgccgccattgtcgaagcgacgaaaaacggcaagctgcgtccgaactcggtcgactcgctcaccggcaaaaacagcggcgacaacttaggggaaggcgtgccggtcatcaaatttgaacaatgggaaaacgattacattgacgttcgccttattttaaaaggcggcggttgtgaaaacaaaaacattcaatacagccttccgtgtgaactcgaggggctcggccgcgccggccgcgaccttgacggcatccgcaaatgcattttgcatgcggtgtaccaagcgcaagggcaaggatgcagcgccggctttatcggcgtcggcatcggcggcgaccgctcatcgggctatgagttggcgaaagagcagctgttccgtccggtcgatgatgtcaatccgattgaagaattgcgccaactcgaagaatacattatggaaaacgccaacaaacttggcatcggcacgatgggctttggcggcgaatcgacgctgcttggctgtaaaatcggcgttatgcaccgcatcccggcgagcttcttcgtttcggtcgcctacaactgctgggcgtttcggcgcatgggcgtgaaaatcgacccggcgaccggtgagatcatcgaatggctgtaccaagacggcgaagacgtcgattttgcaaaagagttggaaaaagcggaagcagccgcggcgcttgaacaaggcgacacacgcgtcatcgaccttgttccgccgctgtcggaagaacaagtgcgccagcttcgcgtcggcgacgtcgtccgcatcagcggcgtcatttacaccggccgcgatgccattcataaatatttgatggaccatgacgcgccggtcgacttgaacgggcaaatcatttatcattgcggcccggtcatgttaaaagatgaagaaggccgctggcacgccaaagctgccggcccgacgacaagcatccgtgaagagccgtaccaaggcgacatcatgaaaaaattcggtgtccgcgctgtcatcggcaaaggcggcatgggcgcgaagacgctgcaagcgttaaaagaacacggcggcgtgtatttgaacgccatcggcggcgcggcgcaatattacgccgattgcatcaaatccgtggaaggcgttgatttgctggagtttggcatccccgaagcgatgtggcatttgcgcgtcgaaaacttcactgctgttgtcacgatggattcgcacggcaacagcttgcatgaagatgtggaaaaatcgtcgcttgaaaagctggctcagttcaaagagccggtgttcaagtaa

SEQ ID NO: 44327 - protein, 515 aa, Geobacillus kaustophilus HTA426
MEKFQQSMYDLIVETSTKLPKDVRRAIARAKVRENAGTRAAMALDTIVENIQMADENVSPICQDTGLPTFKIKVPVGVNQIEMKKAIRAAIVEATKNGKLRPNSVDSLTGKNSGDNLGEGVPVIKFEQWENDYIDVRLILKGGGCENKNIQYSLPCELEGLGRAGRDLDGIRKCILHAVYQAQGQGCSAGFIGVGIGGDRSSGYELAKEQLFRPVDDVNPIEELRQLEEYIMENANKLGIGTMGFGGESTLLGCKIGVMHRIPASFFVSVAYNCWAFRRMGVKIDPATGEIIEWLYQDGEDVDFAKELEKAEAAAALEQGDTRVIDLVPPLSEEQVRQLRVGDVVRISGVIYTGRDAIHKYLMDHDAPVDLNGQIIYHCGPVMLKDEEGRWHAKAAGPTTSIREEPYQGDIMKKFGVRAVIGKGGMGAKTLQALKEHGGVYLNAIGGAAQYYADCIKSVEGVDLLEFGIPEAMWHLRVENFTAVVTMDSHGNSLHEDVEKSSLEKLAQFKEPVFK

SEQ ID NO: 44328 - DNA, 1524 bp, Idiomarina loihiensis L2TR
  CDS (1)..(1524): transl_table=11
atgaccaccattcgtcaggccgattttattgacagtattgccgatgcgttgcagtacatttcttattatcacccactggactttattaaagcactggacgaggcataccagcgtgaagagaacgaagcggcgaaaaacgccattgctcaggtgctgactaactcgcgtatgtctgcgcaagggcaccgtccaatttgccaggacaccggtattgtcacctgctttgtgaaagtgggcatgggcgtgcaatgggataaaaccgacctgaccgttcagcaaatggtggatgaaggtactcgtcgagcctacaacaacccggacaacccactgcgtgcttctattgtggctgacccggcgggcgctcgtaaaaacactggcgataacacgccagctgtggtgcatattgatatggtggcgggcaatgaaattgaagtgatgattgccgctaaaggtggtggttctgagaataaatcgaaaatggccatgttaaaccccagcgattcgattgccgattgggttgttgaaaccttgccgaagatgggcgctggctggtgtccgccgggtatgctgggtataggtattggtggtacagcggaaaagtctgcggtattggcaaaagaatctttaatggagtctgtcgatatccatgagcttattgagcgcggcccgcagaatgccgaagaagagctgcgtttagaaattttgaaccgcgttaacgcattaggtattggtgctcagggtttgggaggtttaacaacggtgctggatgtgaagattaagtcactaccaacccacgcagcctctaagcctgtcactttaattccgaactgtgcagccacccgtcacgttcactttacgttagacggcagcggagcagcagatttaaccccgccgaaactggaagattggccggatgtgacttttgaactgggtgatgatgcccgccgtgtgaacctggatgaagtgaccaaagaagacattcaggactggaaaatgggtgaaaccgtgctcttgtccggtaagttgctgaccggtcgtgatgcggcgcacaaacgcattaaaggtatgctggataacggtgaagagctgccagttgatttcaacaaccgctttatttactacgtagggccggtagatcctgtgggtgatgaagttgttggtccggcaggtcctacaacctctacgcgtatggataaattcactgatcagatgctcgaagaagccggtattattggtatggtaggcaaagcagagcgtggccctgaagctgtggaaagtattcgtaagcacaaagcggtttacctgatggccgtgggtggtgccgcgtatttggtcgctaaagccattaaaaaatcccgggttgttgcctttgaagacttaggtatggaagccatttatgagtttgaagtggaagacatgccggtcactgttgctgtggatagcgacggtcaaaacgcgcatacccaagggcctgctatctggaaagcgaaaattgctgacctcaatgaaaaattaggagcttaa

SEQ ID NO: 44329 - protein, 507 aa, Idiomarina loihiensis L2TR
MTTIRQADFIDSIADALQYISYYHPLDFIKALDEAYQREENEAAKNAIAQVLTNSRMSAQGHRPICQDTGIVTCFVKVGMGVQWDKTDLTVQQMVDEGTRRAYNNPDNPLRASIVADPAGARKNTGDNTPAVVHIDMVAGNEIEVMIAAKGGGSENKSKMAMLNPSDSIADWVVETLPKMGAGWCPPGMLGIGIGGTAEKSAVLAKESLMESVDIHELIERGPQNAEEELRLEILNRVNALGIGAQGLGGLTTVLDVKIKSLPTHAASKPVTLIPNCAATRHVHFTLDGSGAADLTPPKLEDWPDVTFELGDDARRVNLDEVTKEDIQDWKMGETVLLSGKLLTGRDAAHKRIKGMLDNGEELPVDFNNRFIYYVGPVDPVGDEVVGPAGPTTSTRMDKFTDQMLEEAGIIGMVGKAERGPEAVESIRKHKAVYLMAVGGAAYLVAKAIKKSRVVAFEDLGMEAIYEFEVEDMPVTVAVDSDGQNAHTQGPAIWKAKIADLNEKLGA

SEQ ID NO: 44330 - DNA, 1533 bp, Azoarcus sp. EbN1
  CDS (1)..(1533): transl_table=11
atgaccgtgattcgcgaagaagacctcattcagtccgtcgcggatgcctttcagttcatcagctattaccaccccctcgacttcatcgaggcgctcggtgaggcctggaagcacgaggagaacccggcggcgaaggacgccatcgcgcagatcctgaccaactcgcgcatgtgcgccgaaggccaccgcccgatctgccaggacactggcatcgcggtcgtcttcctcaaggtcggcatgaacgtgcagtgggacgcgaagatgagcgtccaggagatggtcaatgaaggcgtgcgccgcgcgtacaccaacgtcgacaacaagctgcgcgcctcggtgctgctcgacccggccggcaagcgtcagaattcgaaggacaacacgcccgctgtcgtgcattacgagatcgtccccggcgaccacgtcgaagtcacctgtgcggcgaagggcggcggctcggagaacaagtcgaagttctacgcgctgaacccgtccgactcgatcgtcgactgggtactgaagacgctgccgacgatgggtgccggctggtgcccgccgggcatcctcggcatcggcatcggcggcacgcccgagaaggcgatgctgctcgcgaaggaatcgctgatggcgccggtcgacatccacgaactacgcgcaaaagctgcttcgggggcgacgctcacgcgcgtcgaggaattgcgcctcgagctgatggacaaggtcaacgcactgggtatcggcgcgcagggtctcggcggcctcacgaccgtgctcgacgtcaagatcctcgactacccgacgcacgctgcgagcctgccggtcgcgatgattccgaactgcgcggcgacgcgccacgtgcatttcgagctcgacggctccgggccggcgaaactcgaggcgccgaagctcgaggactggccggacgtcacgtggcaggccgacaccaaggtcgccacgcgcgtcaatctcgacaccctgacgaaggaagaagtcgcgtcgtggaagcccggccaggtgctgctgctgaacggcaagatgctgaccggccgcgacgccgcacacaagcgcatcgccgacatgctcgcaaaaggcgagaagctgcccgtcgacttcacgaaccgcgtcatctactacgtcggcccggtcgacccggtgcgcgacgaagtcgtcggtccggccggcccgaccaccgcgacgcgcatggacaagttcacccgcatgatgctcgaacagaccggcctgatctcgatggtcggcaaggccgagcgcggcccggcggcgatcgacgcgatccgcgacaacaagtcggcctatctgatggcagtcggcggcgcagcctacctcgtcgcgaaagcgatcaagaccgccaaggtcgtcggcttcgccgatctgggcatggaagcgatctacgagttcgacgtgcaggacatgcccgtgaccgtcgccgtcgattcgaccggcaccagcgtccatgaaaccggcccgaagacgtggcaggcgaagatcggaaagatcccggtcgcgaccgcctga

SEQ ID NO: 44331 - protein, 510 aa, Azoarcus sp. EbN1
MTVIREEDLIQSVADAFQFISYYHPLDFIEALGEAWKHEENPAAKDAIAQILTNSRMCAEGHRPICQDTGIAVVFLKVGMNVQWDAKMSVQEMVNEGVRRAYTNVDNKLRASVLLDPAGKRQNSKDNTPAVVHYEIVPGDHVEVTCAAKGGGSENKSKFYALNPSDSIVDWVLKTLPTMGAGWCPPGILGIGIGGTPEKAMLLAKESLMAPVDIHELRAKAASGATLTRVEELRLELMDKVNALGIGAQGLGGLTTVLDVKILDYPTHAASLPVAMIPNCAATRHVHFELDGSGPAKLEAPKLEDWPDVTWQADTKVATRVNLDTLTKEEVASWKPGQVLLLNGKMLTGRDAAHKRIADMLAKGEKLPVDFTNRVIYYVGPVDPVRDEVVGPAGPTTATRMDKFTRMMLEQTGLISMVGKAERGPAAIDAIRDNKSAYLMAVGGAAYLVAKAIKTAKVVGFADLGMEAIYEFDVQDMPVTVAVDSTGTSVHETGPKTWQAKIGKIPVATA

SEQ ID NO: 44332 - DNA, 1524 bp, Zymomonas mobilis subsp. mobilis ZM4
  CDS (1)..(1524): transl_table=11
atgaccgttattcgccaaaatgacctgattgatagtgttgccgatgctttacagtttatcgcttgctatcatcctcgtgattttatccagtcgctttatgaagcctatcagcgcgaggaaaatccggcagcaaaagaggctctggcgcaaatccttatcaattcccgcctgtctgctatcggcaagcgccccatgtgtcaggataccggcattgtcaccgtttttgctgaaatcggtatgggagtgcgttttgaaggcgaaatgacgctggacgagatgatcaatgaaggcgtgagacgagcttatacctgcccttccaatcgtcttcgatattcagtggtggccgatcccgatggcagccggaagaataccggtgacaataccccagccattattcatcatcatttagtcgcaggcgatcaggtaaaattgcggctggcagcgaaaggcggaggcagcgaggcaaagacccgttttgcgatgctgaacccgtctgatagcgttgtggattgggtgttagaacaaattccccatttaggtgccggatggtgtccgcccggtattatcgggatcgggattgggggtaatcccgaaaaggctatggaaatggccaaatcccaagcgatggaatctattgatattcatcaattgcagggaagaggcgcacaaaatcacgaagaagccttgagattagaattatatcgtaagatcaatgaattggggattggtgcgcagggattgggcggattgaccacggttttggatgtcaaaattgaaagctatccaacccatgccgcgaataagcccattgccttggtaccgaattgtgccgcgacccgtcatattgaaatcactttggatgggcatggcgcagcgattatgccggaaattcatttagatgattggccagaaatcgccaagaaaagcgatggcgtggttagacgggtcaatattgatgacattaccaaagaagaaatggctgattggaaggccggtgacagcctattactgtccggtaaaatcctgaccggacgagatgctgcccataaaaggctggttgatttgttagaccaagggcaagccttgcctgtcgatcttgaaaatcgttttatctattatgtgggtcccgttgatccggttaaaggcgaagtgatgggccctgcgggcccgacgacggccacccgtatggataaattcaccccccgtttattagccgaaactggattaatcggcatgattggcaaagccgaaagaggtgaagccacgatcaaggccattcgtgacaataaggccgcttatttaattgcggtcgggggtgcggcttatctcatttcaaaagcaatcaaatccgcgagaattttggcttttgaagatttgggtatggaagctatttatgaatttgaggttgaggatatgcccgttacggtagcggtcgatagtgacggccaaaatatccataaaatagccccgaaaaaatggcaggcctatattcaagagaaagcttgttccgcctgtttaagctag

SEQ ID NO: 44333 - protein, 507 aa, Zymomonas mobilis subsp. mobilis ZM4
MTVIRQNDLIDSVADALQFIACYHPRDFIQSLYEAYQREENPAAKEALAQILINSRLSAIGKRPMCQDTGIVTVFAEIGMGVRFEGEMTLDEMINEGVRRAYTCPSNRLRYSVVADPDGSRKNTGDNTPAIIHHHLVAGDQVKLRLAAKGGGSEAKTRFAMLNPSDSVVDWVLEQIPHLGAGWCPPGIIGIGIGGNPEKAMEMAKSQAMESIDIHQLQGRGAQNHEEALRLELYRKINELGIGAQGLGGLTTVLDVKIESYPTHAANKPIALVPNCAATRHIEITLDGHGAAIMPEIHLDDWPEIAKKSDGVVRRVNIDDITKEEMADWKAGDSLLLSGKILTGRDAAHKRLVDLLDQGQALPVDLENRFIYYVGPVDPVKGEVMGPAGPTTATRMDKFTPRLLAETGLIGMIGKAERGEATIKAIRDNKAAYLIAVGGAAYLISKAIKSARILAFEDLGMEAIYEFEVEDMPVTVAVDSDGQNIHKIAPKKWQAYIQEKACSACLS

SEQ ID NO: 44334 - DNA, 1509 bp, Silicibacter pomeroyi DSS-3
  CDS (1)..(1509): transl_table=11
atgggcgtgatccgcgaaagcgacatgatcgaaagcatcgccgaggcgctgcaatatatctcgtattaccacccggccgatttcatcggcaccatgaccagcgcctgggagcgcgaggagaaccccggcgccaaggccgcgatggcgcagatcctggtcaattcgcgcatgtgcgccatgggccgccgcccgatctgtcaggacaccggcgccgccaatatccacgtcaaggtcggggtgcaggccaagaccgacttctcccgctcgctgcaggagatctgtgacgagggcacccgccaaggctatcagcgcgacaccaacccgctgcgcgccagcgtggtggtcgacccgttcggcgcccgcaagaactcgggcgacaacacgccctgcatgctgacggtcgagatggtcgccggcgacacgatcgaggtcgaggtcgcggccaagggcggcggatccgagaacaagtcgaaattcaccacgctcaacccctcgggcaatgtggccgactgggtggtgcagacggtcgagacgctgggcgcgggctggtgcccgccgggcgtgctgggcatcggcgtgggcggcaatgcggacaaggcgatggcgctggccaaacaggcgctgagcgaaccgctcgacatgtccgacctgctgcgtcgcggcccctcggacaagaccgaggagctgcggctggaaatctatgaccgcgtcaacgcgctgggcatcggcgcacagggcctgggtggcgtgaccaccgtgcttgacgtcaagatcaagagctttccgacccatgcggcctcgctgcccgtggggctgatccccaactgcgccgccacaaggcatgtgcatttcaccctcgacgggtcgggggctgcggaattcaccccgccctcgatggacctttatcccgacatcctgctggatgcggccggggcgcaggcgacgcggctggacctcgacgatctgaacgacacggtgctggcgtcgctggagccggggcagacactgctgctctcgggcacgctctatacgggccgtgacgccgcgcataagcggatggtcgacatgctcgacaagggtgagccgctgcccgtcgacctgaagggcaaggcgatctattacgtcggtcccgtcgatgcggtgggcgacgaggtgatcggcccggcgggcccgaccacctcgacccggatggacaagttcaccgaccgtatcctgggcgataccgggctcaaggtgatggtcggcaaggccgagcgcggcccggtcgccatcgaggccattgccaagcacaaggcggcctatctgatcgcggtgggcggtgcggcctatctggtgtccaaggcgatcaaggcggccaggccggtggcgttccaggacctggggatggaagccatctatgagctgagggtcgaggatatgccggtgagtgtcgcggtcgacacccagggcaactcgatccaccagaccggcccggccaagtggcgccgcgccactgccgcaggcagctga

SEQ ID NO: 44335 - protein, 502 aa, Silicibacter pomeroyi DSS-3
MGVIRESDMIESIAEALQYISYYHPADFIGTMTSAWEREENPGAKAAMAQILVNSRMCAMGRRPICQDTGAANIHVKVGVQAKTDFSRSLQEICDEGTRQGYQRDTNPLRASVVVDPFGARKNSGDNTPCMLTVEMVAGDTIEVEVAAKGGGSENKSKFTTLNPSGNVADWVVQTVETLGAGWCPPGVLGIGVGGNADKAMALAKQALSEPLDMSDLLRRGPSDKTEELRLEIYDRVNALGIGAQGLGGVTTVLDVKIKSFPTHAASLPVGLIPNCAATRHVHFTLDGSGAAEFTPPSMDLYPDILLDAAGAQATRLDLDDLNDTVLASLEPGQTLLLSGTLYTGRDAAHKRMVDMLDKGEPLPVDLKGKAIYYVGPVDAVGDEVIGPAGPTTSTRMDKFTDRILGDTGLKVMVGKAERGPVAIEAIAKHKAAYLIAVGGAAYLVSKAIKAARPVAFQDLGMEAIYELRVEDMPVSVAVDTQGNSIHQTGPAKWRRATAAGS

SEQ ID NO: 44336 - DNA, 1515 bp, Francisella tularensis subsp. tularensis Schu 4
  CDS (1)..(1515): transl_table=11
atggctgttatcaaagcagaagatctagtaaatagtgttgcagaagcattgcaatatatatcttattatcatccaaaagattttattgatgcaatgtatgaagcatatcagcgtgaagagtcaaaaccagctaaagatgcaatggtgcaaattctaataaactcgagaatgtctgctattggtaagcgtccgatctgccaagatacagggatggtatgcgcttttgtcaaagttggcatggatgcaaaacttgacaagactgatagaacaattacagaacttattaatgagggtgtgcgtcgtggctataatgatccgcataaccctttgagagcatctatggtttttccgccacatggatctagaaaaaacactaaagataatactccagcaattgttcatattgatttagttcatggtgataaaattgaggttgatattgctgcaaaaggtggtggatctgaatttaaatcaaaatttaaggtgttaaatcctagtgatagcataattgattgggttgaagagatgttgccaactatgggggctggctggtgtccacctggaattattggtataggtattggaggcactgcagaaaaagcgatacttttggctaaggaatctcttagtgaagagattaatatccaagatattatcaaaaatggcccacaaaatgaaacagagcaactaagattagatatctataatcgtgtcaatgctctgggtataggtgcacaaggcttaggtggtttgacaacagttttagatgtcaaaataaatgaatatccaacacatgctgcgtgtaagccagttgctttgattcctaactgtgcagctactcgccatgttcattttgttttagatggttctggtgccgttgatttaccagctcctaagatagaagactggccagtaattgagcaagcacaaaatgatgatgttaagagaataaatcttgatacagttactagagaagagattgaggcattaaggtcgggagataacgttttgattagcggtaaaatcttaactggtcgagatgctgcacataagcgtctacaagatatgtataatgctggagaagattttcctgttgatcttaacggtagatttatctactacgtaggtcctgttgatccagtaggtgatgaggtggttggtccagctggtccaactactgctacgcgtatggataagtttacgccatttatgttagagaaagctggtatcatgggaatgataggtaaatcagagcgtggtcaggcaacgattgattctatcaagaaaaataaagctatttacttcatgggtgtaggtggtgctgcttatctcatatctaaatctatcaaaaaagcagaagttgttgcatttgaagatcttggtatggaggcaatttatgagtttgaggttgaggatatgccagtaactgtggctgttgactctttaggtgtttctgctcatcagcaaggtcctaaactttggaaacaaaaaatagctgaaattaataaggtctaa

SEQ ID NO: 44337 - protein, 504 aa, Francisella tularensis subsp. tularensis Schu 4
MAVIKAEDLVNSVAEALQYISYYHPKDFIDAMYEAYQREESKPAKDAMVQILINSRMSAIGKRPICQDTGMVCAFVKVGMDAKLDKTDRTITELINEGVRRGYNDPHNPLRASMVFPPHGSRKNTKDNTPAIVHIDLVHGDKIEVDIAAKGGGSEFKSKFKVLNPSDSIIDWVEEMLPTMGAGWCPPGIIGIGIGGTAEKAILLAKESLSEEINIQDIIKNGPQNETEQLRLDIYNRVNALGIGAQGLGGLTTVLDVKINEYPTHAACKPVALIPNCAATRHVHFVLDGSGAVDLPAPKIEDWPVIEQAQNDDVKRINLDTVTREEIEALRSGDNVLISGKILTGRDAAHKRLQDMYNAGEDFPVDLNGRFIYYVGPVDPVGDEVVGPAGPTTATRMDKFTPFMLEKAGIMGMIGKSERGQATIDSIKKNKAIYFMGVGGAAYLISKSIKKAEVVAFEDLGMEAIYEFEVEDMPVTVAVDSLGVSAHQQGPKLWKQKIAEINKV

SEQ ID NO: 44338 - DNA, 1518 bp, Xanthomonas oryzae pv. oryzae KACC10331
  CDS (1)..(1518): transl_table=11
gtgacctcgatcaagcaggaagacctcatccagtccgtcgccgacgcgctgcagtacatcagctactaccacccggtcgactacatcaagaatttgtccgccgcgtatgagcgcgaggaatcgccggccgccaaggacgccatcgcgcagatcctgatcaattcgcgcatgtgcgccgaaggccaccgcccgatctgccaggacaccggcatcgtcaccgtgttcctggaaatcggcatgaacgtgcgctgggacgacgccacgatgggcgtggaagacatggtcaacgaaggcgtgcgccgcgcctacaaccaccccgacaacaagctgcgcgccagcgttctggccgacccggcgggaaagcgcgccaacaccaaggacaacacgccggcggtggtcaacaccaagatcgtgcccggcgaccatgtcgaggtgatcgtcgcagccaagggcggcggctcggaggccaagagcaagttcgccatgctcaatccctccgactccatcgtcgattgggtgctcaagaccgtgccgaccatgggcgccggctggtgcccgccgggcatgctcggcatcggcatcggcggcaccgccgaaaaggcgatgctgctggccaaggaagccttgatggagccgatcgacatcgtcgacctgcaggcgcgcggcgcgtccaaccgtgccgaagagctgcggcttgagctgtacgaaaaggtcaatgcactgggcatcggcgcgcaaggcctgggcggcctgaccaccgtgctggacatcaaggtcaaggattacccgacccacgcggcgaacctgccggtggcgttgattcccaactgcgcggcgactcgccacgcccacttcaccctggacggcagcggcccggtgatgctggatccgccgtcgctggaagactggcccacgctcacctacaacccgaccaatgcgcgccgggtcaatctggataccatcagcaaggaagaagtggccagcttcaagccgggcgaggtgattctgcttaacggcaagctgctgaccggccgcgatgccgcgcacaagcgcatgatcgacatgctcaaccgtggccaaacgctgccggtggatttcaccaatcgcttcatctactacgtcggtccggtcgacccggtgcgcgatgaagtggtcggcccggcgggcccgacgaccgccacgcgcatggacaagttcacccgccagatgctggagcagaccggcctgctgggcatggtcggtaagtccgagcgtggcgatgcggccatcgatgcgatccgcgacaacaaggccgtgtacctgatggcggtcggcggttcggcctacctggtgtccaaggcgatcaaggcggcccgcgtgcttgcgttcgaagatctcggcatggaggcgatctacgaattcgaggtcaaggacatgccagtcaccgtagcggtggattccactggcgaatcggtgcacaagactggcccacggctgtggcagtcgcgcatcggcaagatcccggtggtggtggaataa

SEQ ID NO: 44339 - protein, 505 aa, Xanthomonas oryzae pv. oryzae KACC10331
MTSIKQEDLIQSVADALQYISYYHPVDYIKNLSAAYEREESPAAKDAIAQILINSRMCAEGHRPICQDTGIVTVFLEIGMNVRWDDATMGVEDMVNEGVRRAYNHPDNKLRASVLADPAGKRANTKDNTPAVVNTKIVPGDHVEVIVAAKGGGSEAKSKFAMLNPSDSIVDWVLKTVPTMGAGWCPPGMLGIGIGGTAEKAMLLAKEALMEPIDIVDLQARGASNRAEELRLELYEKVNALGIGAQGLGGLTTVLDIKVKDYPTHAANLPVALIPNCAATRHAHFTLDGSGPVMLDPPSLEDWPTLTYNPTNARRVNLDTISKEEVASFKPGEVILLNGKLLTGRDAAHKRMIDMLNRGQTLPVDFTNRFIYYVGPVDPVRDEVVGPAGPTTATRMDKFTRQMLEQTGLLGMVGKSERGDAAIDAIRDNKAVYLMAVGGSAYLVSKAIKAARVLAFEDLGMEAIYEFEVKDMPVTVAVDSTGESVHKTGPRLWQSRIGKIPVVVE

SEQ ID NO: 44340 - DNA, 1530 bp, Vibrio fischeri ES114
  CDS (1)..(1530): transl_table=11
atgattaacgttcaccaagaaacattgattcgtaatgaagatgtgatcagttctgtagccgatgctctgcaatatatatcttattatcatccgctagattttgttcaagcacttgaaaaagcgtatcaccgagaagaaagccaagctgcaaaagatgcgcttgcacaaatcctaattaattcacgtatgtcagcagaggggcgtcgtcctatctgtcaagatacgggaattgtaacttgttttgttaatattggtatgaacgttaggtgggaaggagacttaacggttcaacaaatgattgatgaaggtactcgtcaagcttataccaatcctgacaatccattaagggcatccgtattgtctgatccggctggtaaacgtataaacacaaaagataatacgccagcagtggttcatattaatatggttccgggaaacaaagttgagattcaaattgctgcaaaaggtggcggctctgagaataaaactaaaatggtaatgttaaacccatcagatgatattgctgagtgggtagaaaagacgcttccaacaatgggtgcgggttggtgtcctccaggtatgcttggtataggtgttggcggtacggctgagaaagcagctgtattagcaaaagaagcactgatggaacacattgatattcaagaccttattgaacgaggtcctcagaatgcagaagaagaacttcgtcttgatatttttaaccgtgttaataaattaggtatcggagctcaaggtcttggcggacttactactgttgttgatgtaaaaatcaaatcagcaccaacgcacgcagcctctaaacctgtgtgtttaattcctaactgtgctgctactcgtcacgtacattttacccttgatggtacaggtcctgctgatcttcagccgccaaagttagaggaatggcctgatattacgtgggaagcgggagcaaatacacgccgagttaatcttgatgagataacaaaagaagacgttcaagagtggaaaacgggcgaaacgatcttgcttaatggtaaaattctaacaggacgtgacgcggcacataaacgtcttcaaggaatgatcgaaagcggtgaaggtttacctgatggtgttgattttaatggtaaattcatttactacgtaggccctgttgatgctgtaggtgatgaagcggtaggtcctgccggcccaacgacctctactcgcatggataaatttaccgatatgatgttagctacaggcttaacgggcatgataggtaaagcggaacgtggtccagcaaccgtggcatctattaaagaaaataaagcggtatatttaatggctgttggtggcgctgcttacttggttgctaaagcgattaaaaaagcacgtgttgttgcctttgaagatcttggaatggaagctatttatgagtttgaggttgaagatatgccagttactgtggccgttgattcaacaggtgtaaatgcgcatcaaattggtcctgatacatggaaggtaaaaattgctgaaatgagcaattaa

SEQ ID NO: 44341 - protein, 509 aa, Vibrio fischeri ES114
MINVHQETLIRNEDVISSVADALQYISYYHPLDFVQALEKAYHREESQAAKDALAQILINSRMSAEGRRPICQDTGIVTCFVNIGMNVRWEGDLTVQQMIDEGTRQAYTNPDNPLRASVLSDPAGKRINTKDNTPAVVHINMVPGNKVEIQIAAKGGGSENKTKMVMLNPSDDIAEWVEKTLPTMGAGWCPPGMLGIGVGGTAEKAAVLAKEALMEHIDIQDLIERGPQNAEEELRLDIFNRVNKLGIGAQGLGGLTTVVDVKIKSAPTHAASKPVCLIPNCAATRHVHFTLDGTGPADLQPPKLEEWPDITWEAGANTRRVNLDEITKEDVQEWKTGETILLNGKILTGRDAAHKRLQGMIESGEGLPDGVDFNGKFIYYVGPVDAVGDEAVGPAGPTTSTRMDKFTDMMLATGLTGMIGKAERGPATVASIKENKAVYLMAVGGAAYLVAKAIKKARVVAFEDLGMEAIYEFEVEDMPVTVAVDSTGVNAHQIGPDTWKVKIAEMSN

SEQ ID NO: 44342 - DNA, 1593 bp, Xylella fastidiosa Ann-1
  CDS (1)..(1593)
atgtttatcctatggctgatgtattcagggggattacaatggcaacgttttttagtcagccataagggccagccggtgtcattgatcaaacaagaagactttatccagtctatcgctgatgcgctgcaatacatcagttactaccatccggtcgattacatcaagaatctggctttggcgtatgagtgcgagaaatcgcccgccgctaaagatgcaatggcgcagattttgattaactcacgtatgtgtgctgaggggcgccgcccgatttgccaagatacagggattgtcacggtgttccttagcatcgggatggatgtacgttgggatgacgtcacgatggatgtggaagagatggtgaatgagggggttcgccgtgcctatcgtcatccggataacacgctacgtgcgtctgtgcttgctgatcctgccggcaagcgctgcaatacgagggacaatacgccagcagtcgttaacgtcaaggttgtttctgggggccatgttgaagtgattgttgctgccaagggagggggatcggaggccaagagcaaatttgcaatgctaaatccatcggattccatcgttgattgggttctggacactgtgcccaccatgggggctggctggtgcccaccagggatgcttgggattggtatcggtggtacggctgagaaagcgatgctgctcgctaaggaagcgttgatggaaccgattgacatccaggatttgatggtacgcggcccttccaatcgtgctgaagaattacgcttggagctgtacgagaaggtcaatgctttagggatcggtgctcagggggtgggcgggatgacgacggtattagacattaaagtcaaagattatccgacgcatgctgccaatttgccggtagcgatgatccctaattgtgcgtccacacgccatgcgcatttcacattggacggtagcggtcctgttgttctggaaccgccgtcattagaggattggcctaagttgagctatctcccggagtctgcacggcaggtggatttgaatacgatcaccagggatgaggtggcgcagttcaagccaggtgaggtgttgctactcagcggcaaattgttgacgggacgagatgctgcgcataagcgcatcgttgagatgctcaacaagggggagacattaccagttgatttcacgaatcgctttatctactacgtgggtccagtggatcctgtgcgtgatgaagtcgtcggtcctgcgggtccaaccacagcaacgcgtatggataagtttacgcgtcagatgctggagcagggcgggttgctcggtatggtgggcaaggccgagcgtggtcctactgccatcgctgcaatccgtgacaacaaagccgtgtatctgatggcggtgggaggggcggcttatcttgtctccaaggcgatcaaaacgagccggatactggcttttgaagaccttggcatggaggcaatttatgagtttgaagtcaaggagatgcctgtaacagtggcggttgattgcaacggtgagtcgatacatacaactgggccgcgtgagtggcgaagccggatcgggaaaattccggttgttgtggagtag

SEQ ID NO: 44343 - protein, 530 aa, Xylella fastidiosa Ann-1
MFILWLMYSGGLQWQRFLVSHKGQPVSLIKQEDFIQSIADALQYISYYHPVDYIKNLALAYECEKSPAAKDAMAQILINSRMCAEGRRPICQDTGIVTVFLSIGMDVRWDDVTMDVEEMVNEGVRRAYRHPDNTLRASVLADPAGKRCNTRDNTPAVVNVKVVSGGHVEVIVAAKGGGSEAKSKFAMLNPSDSIVDWVLDTVPTMGAGWCPPGMLGIGIGGTAEKAMLLAKEALMEPIDIQDLMVRGPSNRAEELRLELYEKVNALGIGAQGVGGMTTVLDIKVKDYPTHAANLPVAMIPNCASTRHAHFTLDGSGPVVLEPPSLEDWPKLSYLPESARQVDLNTITRDEVAQFKPGEVLLLSGKLLTGRDAAHKRIVEMLNKGETLPVDFTNRFIYYVGPVDPVRDEVVGPAGPTTATRMDKFTRQMLEQGGLLGMVGKAERGPTAIAAIRDNKAVYLMAVGGAAYLVSKAIKTSRILAFEDLGMEAIYEFEVKEMPVTVAVDCNGESIHTTGPREWRSRIGKIPVVVE

SEQ ID NO: 44344 - DNA, 1524 bp, Pseudomonas syringae pv. syringae B728a
  CDS (1)..(1524)
atgaccgtgatcaagcaagacgacctgattcagagcgttgcagacgcactgcagttcatttcctattaccaccccgtggacttcatccaggccatgcacgaggcgtatctgcgtgaagagtcgcctgccgctcgtgactccatcgcccagatcctgatcaactcgcgcatgtgcgcgaccggtcatcgcccgatctgccaggacaccggcatcgtcacggttttcgtgcgcgtggggatggatgttcgctgggacggcgccaccatgggcctggacgacatgatcaacgaaggcgtgcgtcgcgcgtacaacctgcctgaaaacgtgctgcgtgcctcgatccttgccgatccggcaggcgctcgcaaaaacaccaaggacaacaccccggccgtcattcactactccatcgtcccgggtaacaccgtggaagtggacgtcgcggcgaaaggcggcggttcggaaaacaaatcgaagatggcgatgctcaacccgtccgattcgatcgtcgactgggttctgaaaaccgtaccgaccatgggcgcaggctggtgcccgccgggcatgctcggcatcggcatcggcggtacggctgaaaaagccgccgttatggccaaggaagtgttgatggagtccatcgacattcatgaacttaaagcccgcggcccgcagaatcgtatcgaagagatgcgtctggagctgttcgagaaggtcaaccagctgggcattggcgctcagggcctgggcggtctgaccaccgtgctcgacgtcaagatcatggattacccgacccacgccgcgtcgctgccggtgtgcatgatccccaattgcgccgccacccgccacgcgcacttcgtgctcgacggcagcggccctgcttcgctggaggcgccatcgctggacgcctacccggaaatcgtctgggaagccggcccatcggcccgccgcgtcaacctcgatacgctgaccccggaagaagtacaaagctggaaaccgggcgaaaccgttttgctcaatggcaagatgctcaccggccgcgacgcggcgcacaagcgcatggtcgaaatgctcaaccggggtgaaaccctgccggtagacctcaagggtcgcttcatctactacgtcggcccggttgatccggtgcgcgaagaagtcgtcggcccggccggcccgaccacggccacccggatggacaagttcacccggcagatcctcgaccagaccggcctgctgggcatgatcggcaaatccgaacgcggcccgaccgccatcgaagcgatccgtgaccacaaggccgtgtacctgatggccgtcggtggtgctgcctatttggtggctcaggcgatcaagaaatcccgcgtcgtggccttcgccgagctgggcatggaagcgatctacgagttcgaggtcaaggacatgccggtgaccgtggccgtagacagcaacggtgagtccgtacacatcaccggcccgcagatctggcagaagaagatcagcgacagtctggcggtggaagtgcagtaa

SEQ ID NO: 44345 - protein, 507 aa, Pseudomonas syringae pv. syringae B728a
MTVIKQDDLIQSVADALQFISYYHPVDFIQAMHEAYLREESPAARDSIAQILINSRMCATGHRPICQDTGIVTVFVRVGMDVRWDGATMGLDDMINEGVRRAYNLPENVLRASILADPAGARKNTKDNTPAVIHYSIVPGNTVEVDVAAKGGGSENKSKMAMLNPSDSIVDWVLKTVPTMGAGWCPPGMLGIGIGGTAEKAAVMAKEVLMESIDIHELKARGPQNRIEEMRLELFEKVNQLGIGAQGLGGLTTVLDVKIMDYPTHAASLPVCMIPNCAATRHAHFVLDGSGPASLEAPSLDAYPEIVWEAGPSARRVNLDTLTPEEVQSWKPGETVLLNGKMLTGRDAAHKRMVEMLNRGETLPVDLKGRFIYYVGPVDPVREEVVGPAGPTTATRMDKFTRQILDQTGLLGMIGKSERGPTAIEAIRDHKAVYLMAVGGAAYLVAQAIKKSRVVAFAELGMEAIYEFEVKDMPVTVAVDSNGESVHITGPQIWQKKISDSLAVEVQ

SEQ ID NO: 44346 - DNA, 1533 bp, Dechloromonas aromatica RCB
  CDS (1)..(1533)
atgaccgccatcaaacaggaagacctgatccagtccgtcgccgatgccttccagtacatcagctactatcacccgctcgattacatcaaggcgctgggtgaagcctatgatcgcgaggaaagccccgctgcaaaggacgccatcgcccagatcctgaccaattcgcggatgtccgccgaaggccatcgcccgatctgtcaggacactggtatcggcatggttttcatcaaggtcggcatgcaggttacctggccggatgccaccatgagcatccagcagatgatcgacgaaggcgtgcgtcgcgcctacggcaacccggacaatccgctgcgcgcctcggtgctggccgacccggccggtgcccgcaagaacaccaaggacaacaccccggccgtcgtgcatttcgagatcgtccccggccaccatgttgaagtcatctgcgccgccaagggcggcggctcggaagccaagtccaaattcgccatgctcaacccttccgacgacctggtcgactgggtgctcaagaagatcccggaaatgggcgccggttggtgcccgcccggcatcatcggtatcgggatcggcggcacgccggaaaaggccatgctgctggccaaggaatcgatcatggcgccggtcgacatccatgaactgaaggccaaggcggccaccggcaccaagctgacccgtccggaagaattgcgcctcgaactgatggaaaagatcaacgcgctgggcgttggcgcccaaggcctcggcggcctgaccaccgtgctcgacgtcaaggtgctggattacccctgccacgctgccaacctgccggtcgccctggtcccgaactgtgctgcaacccgccactgccatttccacctcgacggctccggcccggccaagctggaagtgccgaagctcgaagactggccggccgtcacgtggacgccggatctcaagtcagccacgcaggtcaacctgaacaccctgaccaaggacgaagtcgcttcctggaagccgggccagaaactgctgctcaacggcaagatgctgactggccgcgatgccgcccacaagcgcattcaggacatgctggccaagggcgagaagctgccggtagatttcaccaaccgcgtcatctactacgtcggcccggtcgatccggtgcgtgacgaagtcgtcggcccggccggcccgaccaccggcacccgcatggacaagttcacccgcatgatgctggaacagaccggcctgatctcgatgatcggcaagtccgaacgcggtccggtcgccatcgaggcgatcaaggacaacaagtcggcctacctgatggctgtcggcggcgctgcctacctggttgccaaggcgatcaagtcggccaaggtcgtcggctttgccgatctgggcatggaagccatctacgagttcgatgtcgagaacatgccggtcacagtggccgtcgattcatcaggcatcagcgtgcacgaaaccggcccgaaggaatggcaggtcaagatcggcaagattccgctcaaggcctga

SEQ ID NO: 44347 - protein, 510 aa, Dechloromonas aromatica RCB
MTAIKQEDLIQSVADAFQYISYYHPLDYIKALGEAYDREESPAAKDAIAQILTNSRMSAEGHRPICQDTGIGMVFIKVGMQVTWPDATMSIQQMIDEGVRRAYGNPDNPLRASVLADPAGARKNTKDNTPAVVHFEIVPGHHVEVICAAKGGGSEAKSKFAMLNPSDDLVDWVLKKIPEMGAGWCPPGIIGIGIGGTPEKAMLLAKESIMAPVDIHELKAKAATGTKLTRPEELRLELMEKINALGVGAQGLGGLTTVLDVKVLDYPCHAANLPVALVPNCAATRHCHFHLDGSGPAKLEVPKLEDWPAVTWTPDLKSATQVNLNTLTKDEVASWKPGQKLLLNGKMLTGRDAAHKRIQDMLAKGEKLPVDFTNRVIYYVGPVDPVRDEVVGPAGPTTGTRMDKFTRMMLEQTGLISMIGKSERGPVAIEAIKDNKSAYLMAVGGAAYLVAKAIKSAKVVGFADLGMEAIYEFDVENMPVTVAVDSSGISVHETGPKEWQVKIGKIPLKA

SEQ ID NO: 44348 - DNA, 1524 bp, Methylobacillus flagellatus KT
  CDS (1)..(1524)
atggccttcatccgccaagaagattttatcgacagcatccaccaggcattgcaatacattgcctgctaccattcgccggacttcctcgctgccatgcacgatgcatggcagcgtgagccgtctccggcagcgcgggatgcgatcggtcaaatcctcatcaactcttatctctgcgcacaaggacaacgcccgctctgccaagacaccgggattgtcgtggccttcgtttccgtcggcatgaacgtgcagtggcaggccagcatgagcctgcaggagatggtggacgaaggtgtacgccgcgcctacctcgacccggacaaccgcctgcgcgcctccatcgtgcgcgaccccgcgggcaagcgcctcaatacccgcgacaacacgccgtctgtcgtacatgtggacatggtgcccggcgatacggtggaaatccatatcgccgccaaaggtggtggatcggaaaacaaatccaaactcgccatgctggaaccttccgacgacctcatcgaatgggtgctgaaaacagtaccggaaatgggtgccggctggtgcccacctggggtactcggcatcggcatcggcggcacggcggaaaaagccgtactgctcgccaagcaatccttgtttgctcccatcgacatccaggcattgagagccaggggacctcagacacgggcagaggagctacgcctggaaatctacgagaaagtcaaccggctcggcatcggcgctcaaggcctgggcggactcacaacggtactggatgtgaagatcctggaggccccgacccatgcgacttcgctaccagtcgccatcattcccaattgcgcagccacacgccatgtgcatttcacattggatggcactgggccagcacgcctgcctgcgccccggctggaagattggccacgagttgcgctggatgccagcacccccatgcgccgggtcgatctcggcaaggtaacacgagaagacgtgatcagctggcagccaggagaaaaactgctgctctcgggcaaactgctcaccgggcgcgatgccgcccataagcgcatcgtcgacctgatcgcccgcggtgagccgatgccggagggcctggacttcaccaaccgcttcatctattacgtcgggccggtcgacccggtaggcgatgaaatcattggcccagcgggccccaccaccgccacacgtatggaccgcttcacggagaccatgctgacccaaaccggcctgctcggcatgataggcaaggccgagcgcggcgaagccaccgtacagtccatcaagcggcatcaatcggtctacctgatcgcgatcggcggcgcagcctacctgatctcgcaggccatcaaggcatctcgtatcgtggcatttgccgacctgggcatggaagccatctacgaattcacggtggaggatatgcccgtgacggtggccgtggatagccgaggccacgctgtgcatgataccggcccggccgagtggcgtcccagaattgctaacatccccattttcagcgaatag

SEQ ID NO: 44349 - protein, 507 aa, Methylobacillus flagellatus KT
MAFIRQEDFIDSIHQALQYIACYHSPDFLAAMHDAWQREPSPAARDAIGQILINSYLCAQGQRPLCQDTGIVVAFVSVGMNVQWQASMSLQEMVDEGVRRAYLDPDNRLRASIVRDPAGKRLNTRDNTPSVVHVDMVPGDTVEIHIAAKGGGSENKSKLAMLEPSDDLIEWVLKTVPEMGAGWCPPGVLGIGIGGTAEKAVLLAKQSLFAPIDIQALRARGPQTRAEELRLEIYEKVNRLGIGAQGLGGLTTVLDVKILEAPTHATSLPVAIIPNCAATRHVHFTLDGTGPARLPAPRLEDWPRVALDASTPMRRVDLGKVTREDVISWQPGEKLLLSGKLLTGRDAAHKRIVDLIARGEPMPEGLDFTNRFIYYVGPVDPVGDEIIGPAGPTTATRMDRFTETMLTQTGLLGMIGKAERGEATVQSIKRHQSVYLIAIGGAAYLISQAIKASRIVAFADLGMEAIYEFTVEDMPVTVAVDSRGHAVHDTGPAEWRPRIANIPIFSE

SEQ ID NO: 44350 - DNA, 1509 bp, Mesorhizobium sp. BNC1
  CDS (1)..(1509)
atgacccgtatttccaacgcagcgatcgtcactaacatcgccgccgcgctgcagtacatctcggtcttccatccgcccgagtacatccgccaccttgcggctgcccacgcacaagaggagagcttgcccgcccgcgccgcaatcgagcagatcctgatcagttcgcgcatggccgcgctcgggcaacgtgccatttgtcaggacaccggcactgtcaacgcgcatatgaaagtgggcatgggggtgcggcttgatggtgattccagccttcagaacctgctcgacgaagcgatccggctagcctgggccgatgaccgcaacccgctgagggcctccatcgtcgccgacccgctgttcgcgcgccgcaatacccgcgacaacaccccgggcatgctgaccgtggaaatcgtgcccggagacggtatcgaaattgccctcatgtcgaagggcggcggctcggagaacaagagccgcttcaccacactcaggccttcagacagcgtcgaggactgggtaatcgatcagcttcccggcttgggcgccggctggtgccctccgggcatgctgggcatcggggtcggcggcagcgccgacatggccatgcggcttgccaaggagagcctttacgatgcgcccaacatggcatggttacgacagaaggcgaaccacaccgaagaggaggccttccgcgtccgcgtctgtgaccgggccaacgcactcggcattggtgcccaggggttgggtgggctgaccgcggtgctcgacgtaaagctacggaccgcgccaacgcatgcctctgcgctgccggtcgcgctgatcccgcaatgcgtggcaacgcgaatggtccgcttccgcatctcggcaaccgagggcttcgatctctcgccgcccgatcctgcgctttggccggagatcaccgcccccgccgttgacggagtccagcggatcaatctcgacaccttgaccgagtccgcgaagcagagttggaaagcaggcgacaccctgcttctgtcgggccgcatcctgactggccgtgatgcagcccacaagcgcctcgacgaaatgctggatcgcggcgatcccctgcccgtcgatttgcgcggccgcgcgatctattatgtcggtccggtcgatcccgctccgggcgagatcatcggcccggcgggacccaccacttccacccgaatggacaaattcactccccgtcttcttgcccaaaccggtctcggactgatgattgggaaggccgagcgtggaccagacgttattgaagcgatcgctcgccacaaggccccgtacctcatcgccgtcggcggcgcagccgttctcatctcccgcgcgatccgcaacgcccgcgtcgtcgccttcgaggacctcggcatggaagccatccacgaattcgaagtccaggacctgcccgtcatcgtcgcagtcgacaccgcgggtacatcgatacacgacacaggacccgcgcagtggcgtagaacgtcaaccagccggtcttcttaa

SEQ ID NO: 44351 - protein, 502 aa, Mesorhizobium sp. BNC1
MTRISNAAIVTNIAAALQYISVFHPPEYIRHLAAAHAQEESLPARAAIEQILISSRMAALGQRAICQDTGTVNAHMKVGMGVRLDGDSSLQNLLDEAIRLAWADDRNPLRASIVADPLFARRNTRDNTPGMLTVEIVPGDGIEIALMSKGGGSENKSRFTTLRPSDSVEDWVIDQLPGLGAGWCPPGMLGIGVGGSADMAMRLAKESLYDAPNMAWLRQKANHTEEEAFRVRVCDRANALGIGAQGLGGLTAVLDVKLRTAPTHASALPVALIPQCVATRMVRFRISATEGFDLSPPDPALWPEITAPAVDGVQRINLDTLTESAKQSWKAGDTLLLSGRILTGRDAAHKRLDEMLDRGDPLPVDLRGRAIYYVGPVDPAPGEIIGPAGPTTSTRMDKFTPRLLAQTGLGLMIGKAERGPDVIEAIARHKAPYLIAVGGAAVLISRAIRNARVVAFEDLGMEAIHEFEVQDLPVIVAVDTAGTSIHDTGPAQWRRTSTSRSS

SEQ ID NO: 44352 - DNA, 1524 bp, Burkholderia cepacia R18194
  CDS (1)..(1524)
atgaccgtcatcaaacaggaagacctgatccagagcatcgcggattcgctgcagtacatcagctactaccatccgctcgactacatccaggccctcggccgcgcgtacgagctggaagaaagcccggccgcgaaggatgcgatcgcgcagatcctcacgaacagccgcatgtgcgcggaaggcaagcgcccgatctgccaggacaccggcatcgtcacgatcttcgtgaaggtcggcatggacgtgcgctgggacggcgcgacgatgggcctgaccgacatgatcaacgaaggcgtgcgccgcggttacacgcacccggacaacgtactgcgcgcgtcgatcgtcaatccgccggaaggcgcccgcaagaacacgaaggacaacacgccggccgtgatccactacgagatcgtgccgggcgacaaggtcgacgtgcaggttgcggcgaagggcggcggctcggagaacaagtcgaagttcgtgatgctgaacccgtccgactcgatcgtcgactgggtgctgaagacggtcccgacgatgggtgcgggctggtgcccgcccggcatgctcgggatcggcatcggcggcaccgctgaaaaggcgatgctgatggcgaaggaatcgctgatggagccgatcgacatccaggaaatcatcgcacgcggtccgaaggactgggtcgaggaactgcgcgtcgaactgcacgagaaggtcaacgcgctcggcatcggcgcacagggcctcggcggcctggcaaccgtgctcgacgtgaagatcatggccgcaccgacgcacgcggcgtcgaagccggtcgcgctgatcccgaactgcgcagcaacgcgccacgcgcacttcgtgctcgacggctcgggcccggccaagcttgaagcaccgtcgctcgacgcgtggccgaaggtcaactgggaaccgaataccgaaaccagcaagcgcgtcgacctgaacacgctgacgccggaggaagttgcaagctgggcgccgggccagacgctgctgctgtcgggcaagatgctcaccggccgcgacgccgcgcacaagcgtatcgccgacatgctcgcgaagggcgagaagctgccggtcgacttcacgaaccgcgtgatctactacgtcggcccggtcgatccggtccgcgacgaagtggtcggcccggcaggcccgacgacggccacgcgcatggacaagttcaccgagacgatgctcgcgcaaaccggcctgatctcgatggtcggcaaggccgagcgcggcccggtcgcgatcgaagcgatcaagaagcacaaggcggcctacctgatggcggtcggcggggcggcttacctcgtgtcgaaggcgatccgcggcgcgaaggtgctcgcattcgaagacctcggcatggaagcgatctacgagttcgacgtgcaggacatgccggtgacggtggctgtcgattcgtcgggcacgtcggtgcaccagaccggtccgaaggagtggcaggcgaagatcggcaagatcccggtcgcagccgcttaa

SEQ ID NO: 44353 - protein, 507 aa, Burkholderia cepacia R18194
MTVIKQEDLIQSIADSLQYISYYHPLDYIQALGRAYELEESPAAKDAIAQILTNSRMCAEGKRPICQDTGIVTIFVKVGMDVRWDGATMGLTDMINEGVRRGYTHPDNVLRASIVNPPEGARKNTKDNTPAVIHYEIVPGDKVDVQVAAKGGGSENKSKFVMLNPSDSIVDWVLKTVPTMGAGWCPPGMLGIGIGGTAEKAMLMAKESLMEPIDIQEIIARGPKDWVEELRVELHEKVNALGIGAQGLGGLATVLDVKIMAAPTHAASKPVALIPNCAATRHAHFVLDGSGPAKLEAPSLDAWPKVNWEPNTETSKRVDLNTLTPEEVASWAPGQTLLLSGKMLTGRDAAHKRIADMLAKGEKLPVDFTNRVIYYVGPVDPVRDEVVGPAGPTTATRMDKFTETMLAQTGLISMVGKAERGPVAIEAIKKHKAAYLMAVGGAAYLVSKAIRGAKVLAFEDLGMEAIYEFDVQDMPVTVAVDSSGTSVHQTGPKEWQAKIGKIPVAAA

SEQ ID NO: 44354 - DNA, 1524 bp, Burkholderia cepacia R1808
  CDS (1)..(1524)
atgaccgtcatcaaacaggaagacctgatccagagcatcgcggattcgctgcagtacatcagctactaccacccgctcgactacatccaggcgctcggccgcgcgtacgagctcgagcagagcccggccgcgaaggacgcgatcgcgcagatcctcacgaacagccgcatgtgcgcggaaggcaagcgcccgatctgccaggacaccggcatcgtgacggtcttcgtgaaggtcggcatggacgtgcgctgggacggcgcgacgatgagcgtcaccgacatgatcaacgaaggcgtgcgccgcggttacacgcacccggacaacgtcctgcgcgcgtcgatcgtcaatccgccggaaggcgcccgcaagaacaccaaggacaacacgccggccgtgatccactacgagatcgtgccgggcgacaaggtcgacgtgcaggtggcggcgaagggcggcggctcggagaacaagtcgaagttcgtgatgctgaacccgtccgattcgatcgtcgactgggtgctgaagacggtcccgacgatgggcgcgggctggtgcccgccgggcatgctcgggatcggcatcggcggcaccgccgaaaaggcgatgctgatggcgaaggaatcgctgatggagccgatcgacatccaggaaatcatcgcgcgcggcccgaaggactggatcgaggaactgcgtgtcgagctgcacgagaaggtcaacgcgctcggcatcggcgcacagggcctcggcggcctggcgaccgtgctcgacgtgaagatcatggccgcgccgacgcacgcggcgtcgaagccggtcgccctgatcccgaactgcgcggcgacgcgccacgcgcacttcgtgctcgacggctcgggcgcggcgaagctcgaagcgccgtcgctcgacgcatggccgaaggtccagtgggaaccgaacaccgagacgagcaagcgcgtcgacctgaacacgctgacgccggaagaagtcgcgagctggacgccgggccagacgctgctgctgtcgggcaagatgctcacgggccgcgacgctgcgcacaagcgcatcgccgacatgctcgcgaagggcgagaagctgccggtcgacttcaccaaccgcgtgatctattacgtcggtccggtcgatccggtgcgtgacgaagtggtcggcccggccggcccgacgacggccacgcggatggacaagttcaccgagatgatgctcgcgcagacgggcctgatctcgatggtcggcaaggcggaacgcggcccggtcgcgatcgacgcgatcaagaagcacaaggccgcgtacctgatggcggtcggcggcgcggcatacctggtgtcgaaggcgatccgcggcgcgaaggtgctcgcattcgaagacctcggcatggaagcgatctacgagttcgacgtgcaggacatgccggtgacggtggcggtcgattcgtcgggcacgtcggtgcaccagaccggtccgaaggaatggcaggcgaagatcggcaagatcccggtcgcaaccgcttaa

SEQ ID NO: 44355 - protein, 507 aa, Burkholderia cepacia R1808
MTVIKQEDLIQSIADSLQYISYYHPLDYIQALGRAYELEQSPAAKDAIAQILTNSRMCAEGKRPICQDTGIVTVFVKVGMDVRWDGATMSVTDMINEGVRRGYTHPDNVLRASIVNPPEGARKNTKDNTPAVIHYEIVPGDKVDVQVAAKGGGSENKSKFVMLNPSDSIVDWVLKTVPTMGAGWCPPGMLGIGIGGTAEKAMLMAKESLMEPIDIQEIIARGPKDWIEELRVELHEKVNALGIGAQGLGGLATVLDVKIMAAPTHAASKPVALIPNCAATRHAHFVLDGSGAAKLEAPSLDAWPKVQWEPNTETSKRVDLNTLTPEEVASWTPGQTLLLSGKMLTGRDAAHKRIADMLAKGEKLPVDFTNRVIYYVGPVDPVRDEVVGPAGPTTATRMDKFTEMMLAQTGLISMVGKAERGPVAIDAIKKHKAAYLMAVGGAAYLVSKAIRGAKVLAFEDLGMEAIYEFDVQDMPVTVAVDSSGTSVHQTGPKEWQAKIGKIPVATA

SEQ ID NO: 44356 - DNA, 1521 bp, Bacillus cereus G9241
  CDS (1)..(1521): transl_table=11
atggaaaagcttcaagaaagcatgtatcaactaattgttgaaacgtcaacgaacttaccgaaagatgttcgtcgtgcgattcaacaagcgaaagagcgagaaaatgcagggactcgttctgcgatggcacttggcacaattacaaataatattaaaatggctgatgataacatctcaccaatttgccaagatacagggatgccaacgtttaaaatttatacaccagttggtgtgaatcaattaaagctgaaggaagctatctatcatgcgcttgagcgggcgacaaaagatggtaaacttcgtccaaattctgttgattctctttttggagacaatagtggaaataatttaggaccaggtacaccggttataaagtttgaacaatgggaaaaagattatattgatgcacgtttaatcttaaaaggtggtggctgtgagaataaaaatattcagtatagcttaccatgcgaattagaaggacttggacgagctggccgtgatttagaagggattcgtaaatgccttcttcatgccgtatatcaagcacaaggtcaaggatgtagtgcaggtgtaattggtgttggtatcgggggagaccgcacatcaggttacgaattagcaaaaaatcaattattccgtacattagatgatgtcaatccaatcccagagttacaacaacttgaagagtacgtattagaaaatgcaaataagcttggcattggtacgatgggatttggcggagaaacaactttacttggctgtaaaattggcgtgtataaccgtctgccagctagcttctacgtatctgtggcgtataactgctgggcatatcgccgccttggtgtaacaatccatcctgaaacaggtgaaattatggattggctatatcaagaaggtgacgatacactgaagcaagaagcacaagaaaaaacagagcaacgtgagattgtattacaagcgccaattacagaagagcaaattcgtgaacttcgcgttggtgatgttgtaacaattaatggcatgatgtatacaggtcgtgacgcaatccataagcatttaatggataacgattgtccagtagatctaaatgggcaaattatttaccactgtggtccagttgttgtgaaagatgaaaatgacaattggcaaattaaagcggcaggtccaacgacaagtattcgtgaagaaccgtaccaaggcgatattatgaagaaattcggcattcgcgctgttattggaaaaggcggtatgggtgcgaaaacattagcagctttagaagaacacggcggtgtatatttaaatgcaattggtggtgcagcacaatattatgctgaatgtattaaagaagtgaaagatgttgatttcttacaatttggtattccagaggcaatgtggcatttacgtatcgatggatttaaagcagttgtaacaatggattctcacggtaatagcttacatgcagatgttgataaaacatcacttgaaaaattagctagctttaaagagccagtatttaagtaa

SEQ ID NO: 44357 - protein, 506 aa, Bacillus cereus G9241
MEKLQESMYQLIVETSTNLPKDVRRAIQQAKERENAGTRSAMALGTITNNIKMADDNISPICQDTGMPTFKIYTPVGVNQLKLKEAIYHALERATKDGKLRPNSVDSLFGDNSGNNLGPGTPVIKFEQWEKDYIDARLILKGGGCENKNIQYSLPCELEGLGRAGRDLEGIRKCLLHAVYQAQGQGCSAGVIGVGIGGDRTSGYELAKNQLFRTLDDVNPIPELQQLEEYVLENANKLGIGTMGFGGETTLLGCKIGVYNRLPASFYVSVAYNCWAYRRLGVTIHPETGEIMDWLYQEGDDTLKQEAQEKTEQREIVLQAPITEEQIRELRVGDVVTINGMMYTGRDAIHKHLMDNDCPVDLNGQIIYHCGPVVVKDENDNWQIKAAGPTTSIREEPYQGDIMKKFGIRAVIGKGGMGAKTLAALEEHGGVYLNAIGGAAQYYAECIKEVKDVDFLQFGIPEAMWHLRIDGFKAVVTMDSHGNSLHADVDKTSLEKLASFKEPVFK

SEQ ID NO: 44358 - DNA, 1524 bp, Rubrivivax gelatinosus PM1
  CDS (1)..(1524)
atgaccacgatccgacacgccgatctcgttgacagcatcgctgccgcgctgcagtacatcagctactaccacccggcagactacatcacgcacctggcgcgtgcctacgaacaggagcagagcccggccgccaaggacgcgatcgcgcagatcctcaccaactccaagatgtgcgccgaaggacgccggccgatctgccaggacaccggcatcgtcaacgtgttcctgaagatcggcatggacgtgcgcttcgagggcttcgccggctcgatcgaggatgccgtcaacgagggcgtgcgtcgcggctacctgaaccccgagaacaccctgcgcgccagcatcgtggccgatccccacttcgagcgcaagaacaccaaggacaacaccccggccgtcgtgcacatgacggtcgtgccgggcaacacggtcgacgtgcaggtggccgccaagggcggcggctccgagaacaagagcaagttcgtgatgctcaaccccagcgacagcctggtcgactgggtattgaaaacggtgccgacgatgggcgccggctggtgcccgccgggcatgctgggcatcggcatcggcggctcggcggagaaggccatgctgatggccaaggagtcgctgatgggcgacatcgacatgtacgagctcaagcagcgcggcccgcagaacaagctggaggagctgcgcatcgagctgtgcgacaagatcaacgccctcggcatcggcgcccagggcctgggcggcctgaccacggtgctcgacgtgaagatctcgaccttcccgacgcacgcggccagcaaacccgtggcaatgatcccgaactgcgccgccacgcgccacgcacacttcgtgctcgacggctccggcccgtcctacctcgagccgccgagcctggacctctggcccgacgtgaaatgggctcccgattacaacaagagcaagtcggtcaatctcgacacgctgacgcgcgaggaggtggcgagctggaagccgggcgacacgctgctgctcaacggcaagatgctcaccggccgcgacgccgcgcacaagcgcatccaggacatgctggccaagggcgagaagctgccggtggacttcaccaaccgcgtcatctactacgtcggcccggtcgatccggtgcgcgacgaggtggtcggcccggctggcccgaccaccgccacgcgcatggacaagttcaccgagatgatgctggcccagaccggcctgatcggcatgatcggcaaggccgagcgcggcccggccggcatcgaggcgatccgcaagcacaagagcgcctacctgatggccgtcggcggcgccgcctacctggtggccaaggcgatcaagcaggccaaggtgctgggcttcgccgaccttggcatggaggcgatctacgagttcgacgtcaaggacatgccggtgacggtggccgtcgactcgaccggcagctcggtgcaccagacgggaccggccgaatggcaggcgaagatcggcaagattccggtcgccatcgcctga

SEQ ID NO: 44359 - protein, 507 aa, Rubrivivax gelatinosus PM1
MTTIRHADLVDSIAAALQYISYYHPADYITHLARAYEQEQSPAAKDAIAQILTNSKMCAEGRRPICQDTGIVNVFLKIGMDVRFEGFAGSIEDAVNEGVRRGYLNPENTLRASIVADPHFERKNTKDNTPAVVHMTVVPGNTVDVQVAAKGGGSENKSKFVMLNPSDSLVDWVLKTVPTMGAGWCPPGMLGIGIGGSAEKAMLMAKESLMGDIDMYELKQRGPQNKLEELRIELCDKINALGIGAQGLGGLTTVLDVKISTFPTHAASKPVAMIPNCAATRHAHFVLDGSGPSYLEPPSLDLWPDVKWAPDYNKSKSVNLDTLTREEVASWKPGDTLLLNGKMLTGRDAAHKRIQDMLAKGEKLPVDFTNRVIYYVGPVDPVRDEVVGPAGPTTATRMDKFTEMMLAQTGLIGMIGKAERGPAGIEAIRKHKSAYLMAVGGAAYLVAKAIKQAKVLGFADLGMEAIYEFDVKDMPVTVAVDSTGSSVHQTGPAEWQAKIGKIPVAIA

SEQ ID NO: 44360 - DNA, 1524 bp, Pseudomonas fluorescens PfO-1
  CDS (1)..(1524)
atgaccgtgatcaagcaagacgacctgattcagagcgttgccgacgccctgcagttcatttcctactaccaccccgtggacttcatccaggcgatgcacgaagcctacctgcgcgaagaatcgccagcggcccgtgactcgatggcgcagatcctgatcaactcgcgcatgtgcgccacgggccaccggccgatctgccaggacaccggcatcgtgaccgtgttcgtgcgtgtgggcatggacgtgcgttgggatggcgcgaccatgagcctggacgacatgatcaacgaaggcgtgcgccgcgcctacaacctgccggaaaacgtcctgcgtgcctcgatcctcgccgacccggcgggcgctcgtaaaaacaccaaggacaacaccccggcggtcatccactactccatcgttccgggtaacaccgtggaagtggacgtagcggccaagggcggcggttccgagaacaagtcgaagatggccatgctcaacccgtccgactcgatcgtcgactgggtactcaagaccgttccgaccatgggcgccggctggtgcccgccgggcatgctgggcatcggcatcggcggtaccgccgagaaagccgctgtcatggccaaggaagtgttgatggaatccatcgacattcacgagctcaaggcccgtggcccgcagaaccgcatcgaagaaatgcgtctggagctgttcgagaaggtcaaccagctgggcatcggcgcccagggcctcggtggcctgaccaccgtcctcgacgtgaagatcatggactacccgacccacgccgcttccttgccggtgtgcatgatcccgaactgcgccgccacccgtcacgcgcacttcgtattggacggctccggcccggcctcgctggaagcgccaccgctggacgcctacccggaaatcgtctgggaagccggcccgtcggcccgtcgcgtcaacctcgacaccctgaccccggaagacgtgcagagctggaagccgggcgaaaccgtcctgctcaatggcaagatgctcaccggtcgcgacgctgcgcacaaacgcatggtcgagatgctgaacaagggtgaaaccctgccggttgatctgaagggccgcttcatctactacgtcggcccggttgatccggtcggtgacgaagtggttggcccggcgggtccgaccaccgccacgcggatggacaagttcacccgtcagatccttgagcagaccggcctgttgggcatgatcggcaagtccgagcgcggcccgaccgccatcgacgcgatcaaggacaacaaggctgtgtacctgatggccgtcggcggtgccgcttacctggtggcgcaagcgatcaagaagtccaaggttctggcgttctccgaactgggcatggaagcgatctacgagttcgaggtcaaggacatgccggtcaccgttgcggtggacagcaaaggtgaatcggtgcacatcaccggtcctgcgatctggcaacagaagatcagcgaaagcctggcggtggaagtgcagtaa

SEQ ID NO: 44361 - protein, 507 aa, Pseudomonas fluorescens PfO-1
MTVIKQDDLIQSVADALQFISYYHPVDFIQAMHEAYLREESPAARDSMAQILINSRMCATGHRPICQDTGIVTVFVRVGMDVRWDGATMSLDDMINEGVRRAYNLPENVLRASILADPAGARKNTKDNTPAVIHYSIVPGNTVEVDVAAKGGGSENKSKMAMLNPSDSIVDWVLKTVPTMGAGWCPPGMLGIGIGGTAEKAAVMAKEVLMESIDIHELKARGPQNRIEEMRLELFEKVNQLGIGAQGLGGLTTVLDVKIMDYPTHAASLPVCMIPNCAATRHAHFVLDGSGPASLEAPPLDAYPEIVWEAGPSARRVNLDTLTPEDVQSWKPGETVLLNGKMLTGRDAAHKRMVEMLNKGETLPVDLKGRFIYYVGPVDPVGDEVVGPAGPTTATRMDKFTRQILEQTGLLGMIGKSERGPTAIDAIKDNKAVYLMAVGGAAYLVAQAIKKSKVLAFSELGMEAIYEFEVKDMPVTVAVDSKGESVHITGPAIWQQKISESLAVEVQ

SEQ ID NO: 44362 - DNA, 1617 bp, Rhodospirillum rubrum
  CDS (1)..(1617)
atgatcgatcgcgctttcgcggacgtctttcccttggcggaggataaaaccctctaccgcgctctcgaagggacggaggggttggtttcggtggagcggttccgcggcgaggagatgctggtcgtcgcccccgaggccctgacccgtctggcgcaagaggccttccgcgacatcgcccatctgctgcgcccggcccatctttcccagctgcgcgccatcatggacgatcccgaggcttcggccaacgaccgcttcgtcgccctggaactgctgaaaaacgccaatatctcggccggcatggtcttgccgatgtgccaggacaccggcacggcgatcattcagggcaagaagggccagcgggtgttttcgggcgacgacgacgccctcgccctgtcggaaggcgtggcccggacctatcagaccctgaacctgcgctattcgcagatggcggcgctgtcggttttcgacgaggtcaataccggcaacaacctgcccgcccagatcgacctctacgccacgccgggcgacgcctataaattcctcttcatggccaaaggcggcggctcggccaataaggtcttcctttaccagcagaccaaggccctgctcaatcccgagagcctcgcccgcttccttgacgcccaggtgcgcacgctgggcaccgccgcctgcccgccctatcacctgtcgatcgccatcggcggcaccagcgccgaggcctgcctgaaggcggtgaaactggccagcgccaagtatctcgatggcctgccgaccaccgggggcaaggatggccacgccttccgcgatctggcgctcgaggccgaggttctggcgatgacccgggccatgggcatcggcgcccagttcggcggcaagtatttctgccacgacgtgcgcgttgtccgcctgccccgccacggcgcgagctgcccggtgggcatcggcgtctcctgctcggccgaccgccagatgctgggcaagatcaccgccgaagggctgttcctcgaacagcttgaaaccaatcccgcccattacctgcccgacgtgcgcaccgagaagctgtcggccgaggtggtcaagatcgacctgtcgcggccgatggcggaaatccgcgcgacgctcagcggctatccgatcaagacccgggtctcgctgtcggggccgatgatcgtcgcccgcgacatcgcccacgccaagctcaaggaacggctggatcgcggcgagggcctgcccgagtacttcaagaacggcgcggtctattacgccggcccggccaagaccccggccaattacgcctcgggctcctttggcccgaccaccgccggccgcatggacgcctatgtcgatctattccaagagaacggcggctcgatggtgatgatcgccaagggcaaccgttccaaggcggtgaccgaggcctgcaagaagcacggcgggttctatctgggctcgatcggcggcgccgccgcccaactggccctcaacagcatccgcaaggtcgaggttctggaatacccggaactgggcatggaagccatctggcgcatcgaggtcgaggattttccggccttcatcatcgtcgatgacaagggcaacgacttcttccagcagctttga

SEQ ID NO: 44363 - protein, 538 aa, Rhodospirillum rubrum
MIDRAFADVFPLAEDKTLYRALEGTEGLVSVERFRGEEMLVVAPEALTRLAQEAFRDIAHLLRPAHLSQLRAIMDDPEASANDRFVALELLKNANISAGMVLPMCQDTGTAIIQGKKGQRVFSGDDDALALSEGVARTYQTLNLRYSQMAALSVFDEVNTGNNLPAQIDLYATPGDAYKFLFMAKGGGSANKVFLYQQTKALLNPESLARFLDAQVRTLGTAACPPYHLSIAIGGTSAEACLKAVKLASAKYLDGLPTTGGKDGHAFRDLALEAEVLAMTRAMGIGAQFGGKYFCHDVRVVRLPRHGASCPVGIGVSCSADRQMLGKITAEGLFLEQLETNPAHYLPDVRTEKLSAEVVKIDLSRPMAEIRATLSGYPIKTRVSLSGPMIVARDIAHAKLKERLDRGEGLPEYFKNGAVYYAGPAKTPANYASGSFGPTTAGRMDAYVDLFQENGGSMVMIAKGNRSKAVTEACKKHGGFYLGSIGGAAAQLALNSIRKVEVLEYPELGMEAIWRIEVEDFPAFIIVDDKGNDFFQQL

SEQ ID NO: 44364 - DNA, 1524 bp, Ralstonia metallidurans CH34
  CDS (1)..(1524)
atgacagtcatcaagcaagaagacctcatccagagcgtcgccgattccctgcagtacatcagctactaccatccgatggactacatcaccagcctgggccgcgcctatgagctggaaaagagtccggccgccaaggatgcgatcgcgcagatcctgaccaacagccgcatgtgcgccgaaggcaagcgcccgctgtgccaggacaccggcatcgtgacggtcttcctgaaggtgggcatgaacgtgcgctgggatggcgccacgatgagcctggaagacatggtcaacgaaggcgtgcgccgcgcgtacaacgacgtggacaacaagctgcgcgccagcgtgctggccgatccggccggcaagcgcaccaatacgaaggacaacaccccggcggtgatcaacatgtcgatcgttccgggcgatacggtggacgtgatcgtcgcagccaagggcggcggttccgaagccaagtcgaagttcgtgatgctcaacccgtctgactcgatcgtcgactgggtgctcaagactgtcccgaccatgggcgccggctggtgcccgccgggcatgctgggcatcggcattggcggcacggctgaaaaggccatgctgctggccaaggaagccctgatggagccgatcgacattcaggacctgctcgcccgcggcccgagcaaccgcgccgaagaactgcgcatcgagctgtacgagaaggtcaacgcactgggcatcggcgcgcagggcctgggcggcctggctaccgtgctcgacgtgaaggtgctggactacccgacccacgcggccaacctgcctgtggccatgatcccgaactgcgcggccacccgccacgcgcacttcacgctggacggcagcggcgtcgccaagctggaagcgccggacctgtcgcaatggccgaaggtcgagtgggcaccgaacaccgaaacgtcgaaaagcgttgacctgaacacgctgacgccggaagaagtcgcctcgtggaagcccggccagacgctgctgctgaacggcaagatgctgaccggccgtgatgccgcgcacaagcgcatcgccgacatgctggccaagggcgagaagctgccgatcgacttcacgaaccgcgtgatctactacgtaggccccgtggatccggtacgtgacgaagtggttggcccggctggccccaccaccgccacccgcatggacaagttcaccgagacgatgctgtcgcagactggcctgatcgcgatgatcggcaaggccgagcgtggccccaccgcaatcgaatcgatccagaagcacaagtcggcctacctgatggccgtgggtggcgctgcctacctcgtgtcgaaggcgatccgtggcgccaaggtcctcgccttcgaagacctcggcatggaagccatctacgagttcgacgtcaaggacatgccggtgacggtggccgtggatagctcgggcacgtccgtccacaagaccggccccgccgagtggcaggccaagatcggcaagattccggtcgcgacggcctaa

SEQ ID NO: 44365 - protein, 507 aa, Ralstonia metallidurans CH34
MTVIKQEDLIQSVADSLQYISYYHPMDYITSLGRAYELEKSPAAKDAIAQILTNSRMCAEGKRPLCQDTGIVTVFLKVGMNVRWDGATMSLEDMVNEGVRRAYNDVDNKLRASVLADPAGKRTNTKDNTPAVINMSIVPGDTVDVIVAAKGGGSEAKSKFVMLNPSDSIVDWVLKTVPTMGAGWCPPGMLGIGIGGTAEKAMLLAKEALMEPIDIQDLLARGPSNRAEELRIELYEKVNALGIGAQGLGGLATVLDVKVLDYPTHAANLPVAMIPNCAATRHAHFTLDGSGVAKLEAPDLSQWPKVEWAPNTETSKSVDLNTLTPEEVASWKPGQTLLLNGKMLTGRDAAHKRIADMLAKGEKLPIDFTNRVIYYVGPVDPVRDEVVGPAGPTTATRMDKFTETMLSQTGLIAMIGKAERGPTAIESIQKHKSAYLMAVGGAAYLVSKAIRGAKVLAFEDLGMEAIYEFDVKDMPVTVAVDSSGTSVHKTGPAEWQAKIGKIPVATA

SEQ ID NO: 44366 - DNA, 1524 bp, Burkholderia fungorum LB400
  CDS (1)..(1524)
atgaccgtcatcaaacaggaagatctgattcagagcattgctgattcgcttcagtacatcagctattaccatccgctcgactacatccaggccttgggccgcgcgtacgaactcgaacagagcccggccgcgaaagacgccatcgcgcagattctcaccaacagccgcatgtgcgccgaaggcaagcgcccgatctgccaggataccggcatcgtcacggtgttcgtgaaagtcggcatggacgtgcgttgggacggcgcgacgatgggtgtcaccgacatgatcaacgaaggtgtgcgccgcggttatctgaacccggacaacgtgctgcgcgcgtcgatcgtgagcccgcccgaaggcggccgcaagaacacgaaggacaacacgccggccgtgatccactacgagatcgtgccgggcaatacggtcgacgtgcaggtcgcggccaagggcggcggctcggaaaacaagtcgaagttcgcgatgctgaacccgtcggattcgatcgtcgactggatcctgaagaccgtgccgaccatgggcgcgggctggtgcccgccgggcatgctcggcatcggcattggcggcaccgccgagaaagcgatggtgatggcgaaggaatcgctgatggatccgatcgacattcaggacgtgatcgcgcgcggcccgaaggactggatcgaagaactgcgcgtggaactgcacgagaaggtcaacgcgctcgggatcggcgcgcagggtctcggcggtctcgccaccgtgctcgacgtgaagatcatggccgcgccgactcacgccgcgtccaagccggttgcgatcatcccgaactgcgcggccacgcgccacgcgcacttcacgctggacggctcgggcgccgccagactcgaggcgccttcgctcgacgcatggccgaaggtgcattggcagccggacacggagaagagcaagcgggtcgatctgaacacgctcacgccggaagaagtcgcggcgtggacgccgggccagacgctgctgctgtcgggcaagatgctgacgggccgcgacgccgctcacaagcgcattgccgacatgctggcaaagggcgaaaagctgccggtcgacttcacgaaccgcgtgatctactacgtcggcccggtcgatccggtgcgcgatgaagccgtcggtcccgcaggcccgaccacggcaacccgcatggacaagttcaccgagatgatgctggcgcaaaccggcctgatttcgatgatcggcaaagccgagcgcggccctgtcgcgatcgaggcgatcaggaagcacaaggccgcttatctgatggccgtgggcggcgcggcgtatctcgtgtcgaaggcgattcgcagcgccaaggttctcgcattcgaagacctcggcatggaagcgatctacgagttcgacgtgcaggacatgccggtcaccgtggccgtcgattcgaacggcacctccgttcaccagaccggcccgaaggaatggcaggccagaatcggcaagattccggtcgcgaccgtttga

SEQ ID NO: 44367 - protein, 507 aa, Burkholderia fungorum LB400
MTVIKQEDLIQSIADSLQYISYYHPLDYIQALGRAYELEQSPAAKDAIAQILTNSRMCAEGKRPICQDTGIVTVFVKVGMDVRWDGATMGVTDMINEGVRRGYLNPDNVLRASIVSPPEGGRKNTKDNTPAVIHYEIVPGNTVDVQVAAKGGGSENKSKFAMLNPSDSIVDWILKTVPTMGAGWCPPGMLGIGIGGTAEKAMVMAKESLMDPIDIQDVIARGPKDWIEELRVELHEKVNALGIGAQGLGGLATVLDVKIMAAPTHAASKPVAIIPNCAATRHAHFTLDGSGAARLEAPSLDAWPKVHWQPDTEKSKRVDLNTLTPEEVAAWTPGQTLLLSGKMLTGRDAAHKRIADMLAKGEKLPVDFTNRVIYYVGPVDPVRDEAVGPAGPTTATRMDKFTEMMLAQTGLISMIGKAERGPVAIEAIRKHKAAYLMAVGGAAYLVSKAIRSAKVLAFEDLGMEAIYEFDVQDMPVTVAVDSNGTSVHQTGPKEWQARIGKIPVATV

SEQ ID NO: 44368 - DNA, 1608 bp, Magnetococcus sp. MC-1
  CDS (1)..(1608)
atggctgaatttcgccacgtagaagtgctcaaccccggtaaagataccacaacttaccgcctgctgagcaaagcttatgtgcagctggaaaaggtgggtgagcgtaatctgctacgggttgatccccaggcgttgaccttgttggctcaagaggccatccgagacgtttcgcacctttttcgcaccagccatttgcagcagctcgcccaaattttaaaggatcctgaggcgtcagacaatgatcgctatgtggccaccgagatgctaaaaaatgccagtgtctcagcgggcatggtgttgccaagctgtcaagatactggaacggccaccatccttgccaaaaaaggggagcaggtttggaccgggggcggtgatcgcgaagcgctctcccgtggggtgttccgtatctaccatgacaccaatttacgttattcgcaggtggccccgatcacgctgtttgacgaaaaaaataccggtaccaatctgcccgcccagattgatattgaggcggtggatggcgagagctacaagtttatgtttgtggtcaagggtgggggtagcgccaataagaccttcctctatcaagagaccaaggcgctgcttaacccagaacgtttccgcagctttattaccgaaaaggtcaaaagtttgggtacctccgcctgcccgccctatcatttggccattgtggtgggggggagctcgccggagatgaacctgaaaacggttaagttggccagtacccgctatctggatggattgcccactcgtggctcgggtttgggtgaagggattcgtgatctggagtgggagcaggaggtccataaaattacccaacagctaggcattggcgcccaatttggcggtaaatattttgcccatgatgtgcggattatccgcctgccccggcatggggcttcgtgtccggtggggattggggtgagctgttcggcggatcggcagatcttgggcaaaattgataaagagggcgtttggcttgaggatctggatcgggatcccgcccgttttctgcccgaaataagcggtacagagctaaccgaagaggtggtgcatctggatcttaaccgctcgatggctgagatccgcgccgagttaacacgctacccgatcaagacccgctttatgcttaccggccccattgtggtggcgcgggacatcgcccatgctaaaatcaatgaacgtctggatgccggtgagggtatgccagagtacctgaaaaatcatattgtttattatgcgggtcctgctaaaacccccgagggctacgcatctggcagctttggccccaccaccgctggccgcatggatagctatgtagaccgattccaaaaagaggggggctcgttggttatgctcgccaagggcaaccgcagcccgcaggtgaccgaggcctgtcgtagcaatgggggcttttacctgggttctattggtggcgttgctgcccagttggcgaaagagtcgatccgcaaggtcgagattatcgactatcccgaactgggtatggaagcggtctaccgcattgaagtcgagaacttccccgcctttattatcgtggatgataaaggcaatgacttttttacgccatga

SEQ ID NO: 44369 - protein, 535 aa, Magnetococcus sp. MC-1
MAEFRHVEVLNPGKDTTTYRLLSKAYVQLEKVGERNLLRVDPQALTLLAQEAIRDVSHLFRTSHLQQLAQILKDPEASDNDRYVATEMLKNASVSAGMVLPSCQDTGTATILAKKGEQVWTGGGDREALSRGVFRIYHDTNLRYSQVAPITLFDEKNTGTNLPAQIDIEAVDGESYKFMFVVKGGGSANKTFLYQETKALLNPERFRSFITEKVKSLGTSACPPYHLAIVVGGSSPEMNLKTVKLASTRYLDGLPTRGSGLGEGIRDLEWEQEVHKITQQLGIGAQFGGKYFAHDVRIIRLPRHGASCPVGIGVSCSADRQILGKIDKEGVWLEDLDRDPARFLPEISGTELTEEVVHLDLNRSMAEIRAELTRYPIKTRFMLTGPIVVARDIAHAKINERLDAGEGMPEYLKNHIVYYAGPAKTPEGYASGSFGPTTAGRMDSYVDRFQKEGGSLVMLAKGNRSPQVTEACRSNGGFYLGSIGGVAAQLAKESIRKVEIIDYPELGMEAVYRIEVENFPAFIIVDDKGNDFFTP

SEQ ID NO: 44370 - DNA, 1626 bp, Geobacter metallireducens GS-15
  CDS (1)..(1626)
atgtccaccaagccgttcgtttaccaggaacccttccccctcgagaaagatgagacgtcgtactacaagattcccgactcggagaagtatgtcagcgtcgcaactttcgaagggaaagaggtcctcaaggtcgatcccgaggcactcaccgtcctggccaacacggccatgagggacgtctccttcctgctccgccccgagcacaacgagtcggtggccaagatcctccgggatccggaagcctcccagaacgacaagggggttgccctggcattcctgcggaacgccgagatcgccgccaacttcgagctccccctctgccaggacaccggcaccgccaccgtcgtggccaagaaagggcagcaggtttggaccggcggaaaggacgaggagtttctctccaagggggtctacaagacctacaccgaggaaaatctccgctactcccagaccgtggccctggacatgtacaaggaagtcaacaccggcaccaacctgccggcccagatcgacatccaggctgtggacggcgattactacaagttcctcttcatggccaaaggggggggctccgccaacaagaccatgctctaccaggagaccaaggcactccttaccccggacagcctgctcaagttcctggtgggcaagatgaagtacctgggaaccgccgcctgcccgccgtaccacatcgccgtcgtggtcggcggtacctcggccgacgcctgcatgaaggcggtcaagctcgcctccgccaagtaccttgacgccctccccaccacggggaacgagcacggccgggccttccgcgacgtggaactggaggagaagcttctccaagaggcctacaagctcggcatcggcgcccagttcggcggcaagtacttcgcccatgacgtacgggtcatccggcttccccgccacggcgcctcctgccccgtggggatggcggtctcctgttccgccgaccgcaacatcaaggccaagatcacccaaaacggcctcttcgtcgaggaactggaccgcaatccgagccgactcattcccgagcagtaccgcggcaagcatgagcacggggtcaagatcgacctgaaccgccccatgaaggagatcctggccgaactgagcaagcacccggtttccacgccgctgctgctgaatggcaccatcgtggtggggcgcgacatcgcccacgccaagttcaaagagattctcgacagcggcaaaccgctccccgactatctcaagaatcatccgatctactacgccggaccggccaagaccccggctggcaagccttccggctccttcggccccaccactgccggccgcatggactcctacgtggatcttctccaggcgaacggcggctccatgatcatgatcgccaaggggaaccggagccagcaggtgaccgatgcctgcaagaagcacggcggcttctacctgggctccatcggcggccctgccgcggtcctggccgaggagaacatcaagaaggtcgagtgcatcgacttccccgaactggggatggaagcggtctggaagatcgaggtcgagaacttcccggccttcatcctggtggatgacaaggggaatgacttcttcaagcagttgggtctgtag

SEQ ID NO: 44371 - protein, 541 aa, Geobacter metallireducens GS-15
MSTKPFVYQEPFPLEKDETSYYKIPDSEKYVSVATFEGKEVLKVDPEALTVLANTAMRDVSFLLRPEHNESVAKILRDPEASQNDKGVALAFLRNAEIAANFELPLCQDTGTATVVAKKGQQVWTGGKDEEFLSKGVYKTYTEENLRYSQTVALDMYKEVNTGTNLPAQIDIQAVDGDYYKFLFMAKGGGSANKTMLYQETKALLTPDSLLKFLVGKMKYLGTAACPPYHIAVVVGGTSADACMKAVKLASAKYLDALPTTGNEHGRAFRDVELEEKLLQEAYKLGIGAQFGGKYFAHDVRVIRLPRHGASCPVGMAVSCSADRNIKAKITQNGLFVEELDRNPSRLIPEQYRGKHEHGVKIDLNRPMKEILAELSKHPVSTPLLLNGTIVVGRDIAHAKFKEILDSGKPLPDYLKNHPIYYAGPAKTPAGKPSGSFGPTTAGRMDSYVDLLQANGGSMIMIAKGNRSQQVTDACKKHGGFYLGSIGGPAAVLAEENIKKVECIDFPELGMEAVWKIEVENFPAFILVDDKGNDFFKQLGL

SEQ ID NO: 44372 - DNA, 1524 bp, Novosphingobium aromaticivorans DSM 12444
  CDS (1)..(1524)
atggcggaaatggtgacgatcaaggaagcggacctgatcgaaagcgttgcggatgcgcttcaatacatcagctatttccacccgatggactacatccgcgcgctgggtgaggcctacaaggccgagcaggggccagcggccaaggacgccatcgcccagatcctcaccaacagccgcatgtgcgccgaagggcatcgcccgatctgccaggacaccggcatcgtcaacgtcttcatcgagtggggccaggactgccgcctcgaaagcgacctttcgttgcaggatgtggtcgatgagggcgtgcgccgtgcctacaacaatcccgacaacaagctgcgcgcgtcggttcttgccgatcccgcattcacccgccgcaacacccgcgacaacacgccctgtgtgctgcacgtggaaatggtcaagggcaacaaggtgacggtcgatgttgccgccaagggaggcgggtcggagaacaagtcgaagttcaagatgatgaaccccagcgattcgatcgtcgactgggtgatcgagatgctgccccagatgggcgccggctggtgcccgccgggcatgctcggcattggcatcggcggcaccgcggaacactgcgtgctgctcgccaagaaggcgctgatggagccgatcgatatggcccagctcaagcagcgcgggccgcagaccgacatcgaacgcctgcgcatcgagatcttcgacaaggtcaacgcgcttggcatcggcgcgcaggggctgggcgggctttccaccatcctcgacgtcaagatcatggacgcgccgtgccatgccgccggcaagccggtggcgatgatccccaattgcgcggcaacccgccatgcgcacttcacgctcgacgggtcggggccgaccttcctcgagcgacccaagctcgatgaatggccggaagtgcactgggcgccggactcggcggcaaggcgcgtcgatctcgatacgctgacgcaggaagaggtgcagagctggaaggcgggcgaccgcctgctcctgaacggcaagatgctgacgggccgcgatgccgcgcacaagcggatcaaggacatgctcgccaagggcgaggaactgcccgtcgatttcaagggccgcgtgatctactacgtcggcccggtcgatccggtgcgcgacgaagtcgtcggcccggccggccccaccacggccacccgcatggacagcttctccgacaccatgctcgacctcggcctgctcgccagcgtcggcaaggccgagcgtggccctgccgcgacccagtccatcgccaaccacaagagcgcctatctgatggcggtgggcggagcggcctatcttgtcgcccgcgcgatcaaggaggcgaaggtcgtcggcttcgaggacctcggcatggaggcgatctacgaattcaccgtcgaggacatgccggtgaccgtggccgtcgattccgggggccagaacgttcaccagctcgcgccgctggtgtggaagaagaagatcgccgaggaacacctccttccggcctga

SEQ ID NO: 44373 - protein, 507 aa, Novosphingobium aromaticivorans DSM 12444
MAEMVTIKEADLIESVADALQYISYFHPMDYIRALGEAYKAEQGPAAKDAIAQILTNSRMCAEGHRPICQDTGIVNVFIEWGQDCRLESDLSLQDVVDEGVRRAYNNPDNKLRASVLADPAFTRRNTRDNTPCVLHVEMVKGNKVTVDVAAKGGGSENKSKFKMMNPSDSIVDWVIEMLPQMGAGWCPPGMLGIGIGGTAEHCVLLAKKALMEPIDMAQLKQRGPQTDIERLRIEIFDKVNALGIGAQGLGGLSTILDVKIMDAPCHAAGKPVAMIPNCAATRHAHFTLDGSGPTFLERPKLDEWPEVHWAPDSAARRVDLDTLTQEEVQSWKAGDRLLLNGKMLTGRDAAHKRIKDMLAKGEELPVDFKGRVIYYVGPVDPVRDEVVGPAGPTTATRMDSFSDTMLDLGLLASVGKAERGPAATQSIANHKSAYLMAVGGAAYLVARAIKEAKVVGFEDLGMEAIYEFTVEDMPVTVAVDSGGQNVHQLAPLVWKKKIAEEHLLPA

SEQ ID NO: 44374 - DNA, 1605 bp, Cytophaga hutchinsonii
  CDS (1)..(1605)
atgcctgaatttaattatcaaaaagcgtttcctctaaagaaagaccctacgccgtataaattgatcagtacggattatgtttcaaccattgaagttgatggccgtaaaattcttaaaattgatcccaaagcactggaattagtggcggagaaagcattggctgatgtatcattttatctgcgctcctcgcatttagaaaaacttgcaaaaattattaaagatccggaagcaacggataacgatcgtttcgtagcatataccttattgcagaatgcatctactgccggtgaaggtaagctcccttcctgccaggatacaggtactgccattgtaatggggaaaaaaggtgaaaacgtttggacaggtgctaatgatgaagaagctttgtcaaaaggaatttacaatacatatcaggaaaaaaatctgcgttactctcaggtagtgccgatcacgatgttcgaagaaaaaaattccggcacaaacctgcctgctcagattgacatttatgccgaacagggaaacgaatataagtttttgtttatggcaaagggcggaggctctgcaaacaaaacatatttgtatcagcaaacgaaagcgttactgaatgaaaacagtttagccgagtttgttaaaaataaaatcaaagacctgggtacgtctgcctgccctccatatcacctggcattagtgattggcggtacatcggccgaagcgaacctgaaagctgttaaattggcatcagcaggttattacgatgaacttccaacagaaggtaacatgggcggacaggcattccgtgatcttgaatgggaagagaaagtacaattgatctgccaggagagtttgatcggtgcgcagtttggcggtaaatattttacacacgatgtaaaagtgatccgtttaccacgtcacgcggcgtcttgtccggttggtattggtgtaagctgttctgctgatcgaaacatcaaagcaaaaattacggaagaaggtattttcatcgaagcattggagaccaatccggagaaatttttaccggcacaggcgccacatctggaaaaggctgtagaagttgatctgaatcagccgatggcagatgtattgaaactgctttctcagtatccgattaaaacccgtttgaaattaaaaggcacattaatcgttgcgcgtgatattgcacacgcgaagatcaaagaattgcttgatgcaggaaaaccaatgccggagtatttcaaaaatcatccggtatattatgccggcccggcgaaaacaccggaaggtatgccatccggaagctttggtccgacaacagccggccgtatggattcctatgtgaatttattccagagccagggcggctccatgatcatgcttgcaaaaggaaaccgttctaaagcagtaacagatgcatgcaaagaattcggtgggttctatctgggctctatcggcggaccagcagcgatattagcaaaagaaaatattaaatcggttgaagtagttgacttcgaagagttgggtatggaagccgtacgtaagattgaagtcgttgattttccggctttcattatttgcgatgataagggaaatgacttcttcgcgaatctgtaa

SEQ ID NO: 44375 - protein, 534 aa, Cytophaga hutchinsonii
MPEFNYQKAFPLKKDPTPYKLISTDYVSTIEVDGRKILKIDPKALELVAEKALADVSFYLRSSHLEKLAKIIKDPEATDNDRFVAYTLLQNASTAGEGKLPSCQDTGTAIVMGKKGENVWTGANDEEALSKGIYNTYQEKNLRYSQVVPITMFEEKNSGTNLPAQIDIYAEQGNEYKFLFMAKGGGSANKTYLYQQTKALLNENSLAEFVKNKIKDLGTSACPPYHLALVIGGTSAEANLKAVKLASAGYYDELPTEGNMGGQAFRDLEWEEKVQLICQESLIGAQFGGKYFTHDVKVIRLPRHAASCPVGIGVSCSADRNIKAKITEEGIFIEALETNPEKFLPAQAPHLEKAVEVDLNQPMADVLKLLSQYPIKTRLKLKGTLIVARDIAHAKIKELLDAGKPMPEYFKNHPVYYAGPAKTPEGMPSGSFGPTTAGRMDSYVNLFQSQGGSMIMLAKGNRSKAVTDACKEFGGFYLGSIGGPAAILAKENIKSVEVVDFEELGMEAVRKIEVVDFPAFIICDDKGNDFFANL

SEQ ID NO: 44376 - DNA, 1554 bp, Polaromonas sp. JS666
  CDS (1)..(1554)
atgacgaccatcatcaaacaagccgacctgattgaatccgttgccgccgccctgcagtacatcagctactaccaccccaccgactacatcgcccatctggcccgtgcctacgagcgcgagcaaagcccggcggccaaggatgccattgcgcaaatcctgaccaacagcaagatgagcgccacgggccagcggccaatctgccaggacaccggcatcgtcaacgtgtttttgaaggtcggcatggacgtgcgctgggaaggctttaccggcagcatcgacgacgccatcaacgaaggcgtgcgccgcggctacaaccaccccgacaacacgctgcgcgcctccgtggtggccgatccgcagttcgaccgcaagaacaccaaggacaatacgcccgccgtgatctttacagagctggtgaccggcaacacggttgaagtcacggtggcagccaaaggcggcggcagtgaaaacaagagcaagatggtgatgctcaaccccggcgactcggtggtcgactgggtgctcaaaaccgtgcccaccatgggcgccggctggtgcccgcccggcatgctgggcatcggcattggcggcaccgctgaaaaagccgtgctgatggccaaggaaagcctgatggacgacctggacatgtacgagctgcaggccaagtcgtctgcgggtgccaaactgaccaaaaccgaagagctgcgcctcgaactgttcgagaaagtcaacgcgctcggcattggcgcgcagggcctgggtggtctcaccaccgtgctcgacatcaagatcaagatgtacccgacgcacgcggccagcaagcctgtcgccatgatcccgaactgcgcggccacgcgccatgcacactttgtgctcgacggcaacggcccggtctacctggacccgccttcgctggacctctggcccaatgtgaactgggagcccgactacaacaagagcaaaaaggtcaacctcaacaccctgaccaaggcagaagtcgccagctggaagcccggcgacaccctgctgctcaatggcaagatgctgaccggtcgcgacgccgcgcacaaacgcattgccgacatgctgctcaagggtgaaaagctgccggtcgacttcaccaaccgcgtgatctactacgtcggcccggtggacccggtcaagggcgaggccgttggcccggccggcccaaccaccgcgacccgcatggacggcttcaccgaaatgatgctggcgcaaaccggcttgatctcgatggtgggcaaggccgagcgcggccccgtcgcgattgaggccatcaagaagcaccagagcgcttacctgatggccgtgggcggcgccgcctacctggtatccaaagccatcaagcacgccgaagtggtgggctttgccgacctgggcatggaagccatttacgagttcgacgtggtggacatgccggtgacggtggcggtggatgccggcggcaccagcgcgcacatcaccggcccggccgagtggcagaaaaaaattgccacgggcgagttcaagcaaatcccggtcaccagcgcttga

SEQ ID NO: 44377 - protein, 517 aa, Polaromonas sp. JS666
MTTIIKQADLIESVAAALQYISYYHPTDYIAHLARAYEREQSPAAKDAIAQILTNSKMSATGQRPICQDTGIVNVFLKVGMDVRWEGFTGSIDDAINEGVRRGYNHPDNTLRASVVADPQFDRKNTKDNTPAVIFTELVTGNTVEVTVAAKGGGSENKSKMVMLNPGDSVVDWVLKTVPTMGAGWCPPGMLGIGIGGTAEKAVLMAKESLMDDLDMYELQAKSSAGAKLTKTEELRLELFEKVNALGIGAQGLGGLTTVLDIKIKMYPTHAASKPVAMIPNCAATRHAHFVLDGNGPVYLDPPSLDLWPNVNWEPDYNKSKKVNLNTLTKAEVASWKPGDTLLLNGKMLTGRDAAHKRIADMLLKGEKLPVDFTNRVIYYVGPVDPVKGEAVGPAGPTTATRMDGFTEMMLAQTGLISMVGKAERGPVAIEAIKKHQSAYLMAVGGAAYLVSKAIKHAEVVGFADLGMEAIYEFDVVDMPVTVAVDAGGTSAHITGPAEWQKKIATGEFKQIPVTSA

SEQ ID NO: 44378 - DNA, 1698 bp, Schistosoma japonicum
  CDS (1)..(1698)
atgttggctcaaggtatatttgcgcacatctgctgtcggcttttacggcggaatttgggatcacaggcggtgaaaccttttttttatcaagatatattgcagttggataaacctccgtatgcagagacaccatttcgaaagctaacgggtgatttcgtttctctcaaaaaaattgatgacaaagaaattttgaaaattgattctaaggcactgattttgttgagtcagcaagccatgatagatgtcgctcatcttttaagacctgcacacctacaatctctttctaacatcctgagggatcctgaagcatctaacaacgataagtttgttgcacttgagcttttgaaaaatgcaaatgtggctgctggaatggttctacctggttgtcaggatactggcaccgctatatgcatggcgaaaaagggccagtttgtctggacagatgggaatgacgctgaagctatctcgcaaggtatatataacacatatacttctagttatcttcgttactcccaagttgcggcacttgatatgtttacggaaaaaaatactggtactaacctgccagcacaaattgaaatatattcaactggtggtaacgaatatagctttttgtttattgctaagggtggagggtcagcgaataaaactttcctgtatcaacagacaaaagctcttctcaatcccactagtctatattcatttgttaatgaaaaaattaaaaccttaggaactgcagcttgtcccccttatcacttggctgttgtcgttggtgggacgtcagctgaatttactctgaaaactgtgaagcttgcatcatgcaagtatttggatcaccttccatcgactggtaatgaacatggaagagcttttcgtgaccgggaagctgaagaaaaaatattacatttaactcagaaggttgggatcggagcacagttcggaggaaaatacttctgtcatgatgtacgagtaatccgcttgcctaggcatggtgcatcatgtcctgttggtattggtgtctcttgttctgcagacagacagattctggggagaataactaacgatggagtttttcttgaacagttagagactgatccatctcaatatttacctgacccttctttaaatcaactcccaacagatgttgtcaaagtgaatctcaatcttccaatgaaagaaattctagctgaactttctaagtatccaatcaaaactcgtttgtcactgactggaactttagtcgttgcacgtgatatcgcacatgcaaagattaaggaacgtcttgattctggtcaaccaatgcctgactatttttgtaatcacccggtatattacgctggcccagctaaaacacctatgaattatgctagtggatcttttggacctaccacggctggtcgcatggattcttatgttggtcaattccagcaggctgggggtagtttgattatgctagctaaaggtaacagatcaaaagctgtaacaaatgcttgcagaaaacatggtggattctatctaggttcgatcggcggtccagctgcaatccttgctcagaattgtataaagaaagttgaagtactcgagtatccggaattaggaatggaggctatctggcgtgttgaagttgaggattttcctgcttttatagttgtcgatgataaaggcaatgacttctttaaggaatggcaagtagaataa

SEQ ID NO: 44379 - protein, 565 aa, Schistosoma japonicum
MLAQGIFAHICCRLLRRNLGSQAVKPFFYQDILQLDKPPYAETPFRKLTGDFVSLKKIDDKEILKIDSKALILLSQQAMIDVAHLLRPAHLQSLSNILRDPEASNNDKFVALELLKNANVAAGMVLPGCQDTGTAICMAKKGQFVWTDGNDAEAISQGIYNTYTSSYLRYSQVAALDMFTEKNTGTNLPAQIEIYSTGGNEYSFLFIAKGGGSANKTFLYQQTKALLNPTSLYSFVNEKIKTLGTAACPPYHLAVVVGGTSAEFTLKTVKLASCKYLDHLPSTGNEHGRAFRDREAEEKILHLTQKVGIGAQFGGKYFCHDVRVIRLPRHGASCPVGIGVSCSADRQILGRITNDGVFLEQLETDPSQYLPDPSLNQLPTDVVKVNLNLPMKEILAELSKYPIKTRLSLTGTLVVARDIAHAKIKERLDSGQPMPDYFCNHPVYYAGPAKTPMNYASGSFGPTTAGRMDSYVGQFQQAGGSLIMLAKGNRSKAVTNACRKHGGFYLGSIGGPAAILAQNCIKKVEVLEYPELGMEAIWRVEVEDFPAFIVVDDKGNDFFKEWQVE

SEQ ID NO: 44380 - DNA, 1545 bp, Rhizobium loti
  CDS (1)..(1545): transl_table=11
gtgggcagtagaacacggaccatcgccggcaaggacatcataaggagcgtggccgacgcccttcagtacatctcgtactaccatcctccagattacatccgctctctttcgcaagcgtacgcgcgcgaacagagcccagcggcaaaaaacgcaatagggcagattctgctgaactcccgcatggcggccttcgggcggcggccgatctgccaggacaccggccttgtggtggtcttcgcaaaagtcggcatggacgcccggatcaaatcaacggccagtttcgcagagctcgtgaatgaaggcgtccgtcaggcctatctcgacccggacaacccccttcgggcatcgatcgttgccgatccgctcgccggacgagtcaatactcgtgacaacacgccggcggtcgtccacgtcgaccttgtactaggtaaccagattgacatcaccattgccgcaaaaggcggcgggtcagagaacaaggcacgttttaccaccttgaaccccagcgcctccgtttccgactgggtggttgacacagtcgcgacgcttggcagtgggtggtgtccacccggcctgatctcgattggcatcggtggcagcgctgaaaaggcgatgctgctggccaaggaggccatgaaccagcccatcgatatggcggaattgattgccaggcggccttcaagcgcggaagaggcactgcggattgaactttatgaccggattaacgcactgggcatcggcgcccaaggccttggtggcctgacgacagtcgtcgacgtcaaggttgcgacctatcctactcatgccgcgtccaagcccgtggcgctcattccgcaatgcgccgccaaccggcacctgaagtttaccttggatggctctggaccaatcatgctggagccgcccgatttgcgcgaatggcccgacattggaacggacgaattgagtccagccggcgtacgaagagtgaacctcgatgcgctgaccaaggaacagacggcgtcgtggcgttgcggggaaacgctccttttgtccggaaaaatgctgacgggccgtgacgccgcccacaagcgaatggtcgagttgatcgacgccggcaagccgcttccgttcgatctgcaggggcgcgtaatctactacgttggacccgtccgcgccgtgagagatgaggtcgtcggaccggccggcccaacaacgtccagccgcttggacgattttacggacaaggtgctcgccgaaaccgggcttttcgcgatggtaggcaaagcggagagaggacgggcggccatcgagtcgattgtaaggcacaaaacgccgtatctcatcgcagtgggtggggctgcctacctgatatcaaaatcaatcaagtcagcgcggctcattgccttcgaagacctgggcatggaagcagtctatgaattcgaggtgcaggatatgcctgtcatcatggctgtcgatgttgagggaaactcaattcacaattctgggcctcttgagtggcgcaagcgcatggcggcggacagcatcgcacgcaacatcggcgtttga

SEQ ID NO: 44381 - protein, 514 aa, Rhizobium loti
MGSRTRTIAGKDIIRSVADALQYISYYHPPDYIRSLSQAYAREQSPAAKNAIGQILLNSRMAAFGRRPICQDTGLVVVFAKVGMDARIKSTASFAELVNEGVRQAYLDPDNPLRASIVADPLAGRVNTRDNTPAVVHVDLVLGNQIDITIAAKGGGSENKARFTTLNPSASVSDWVVDTVATLGSGWCPPGLISIGIGGSAEKAMLLAKEAMNQPIDMAELIARRPSSAEEALRIELYDRINALGIGAQGLGGLTTVVDVKVATYPTHAASKPVALIPQCAANRHLKFTLDGSGPIMLEPPDLREWPDIGTDELSPAGVRRVNLDALTKEQTASWRCGETLLLSGKMLTGRDAAHKRMVELIDAGKPLPFDLQGRVIYYVGPVRAVRDEVVGPAGPTTSSRLDDFTDKVLAETGLFAMVGKAERGRAAIESIVRHKTPYLIAVGGAAYLISKSIKSARLIAFEDLGMEAVYEFEVQDMPVIMAVDVEGNSIHNSGPLEWRKRMAADSIARNIGV

SEQ ID NO: 44382 - DNA, 1545 bp, Bacillus stearothermophilus
  CDS (1)..(1545): transl_table=11
atggaaaaattatatgagagtatgtatcaattaattgtggaaacgtctacaaaattgccgaaggatgtccgccgcgctattttgaaggcgaagcagcgtgaaaatgctggtacaagagctgcgatgtcgcttgccacgataaccgaaaatattaaaatggcagatgaaaatgtatcgccgatctgccaagataccggattgccgacatttaaaattaaagtgccagtcggtatcaatcaaattcaaataaaggaaacaataaaaaaagcgatcgctcaagcgacgaaggacgggaagcttcgcccgaactcggtcgattcactcactggagaaaattccggcgataacttgggcgaagggcttccagtcgtaaaatttgaacaatgggaaaaagattatatggatgttcgcttaatattaaaaggcggcggctgcgaaaacaaaaatattcaatacagcctgccgtgcgaactagaaggattgggaagagccggcagagatttggatggaatccgcaaatgtattttgcatgcggtatatcaagcacagggccaaggatgcagcgcaggattcattggagttggaatcggtggagaccgttcagcggggtacgatttagcgaaagaacaattattccgcgaagtcgatgacgtaaatccgaacgaagaattgcggcaattggaagaatatattatggaaaatgcaaacaagcttggcattggaacgatgggatttggcggggaaaccactttattaggctgcaaagtcggcgcaatgcacagaattcctgcgagcttttttgtttctgtcgcatacaactgctgggcattccgccgtttaggtgtgcatatcgatccaaatacgggtgaaatcataaaatggctttatcaagatggagaagatgttgattttcaagaaaatgctgcacaagaagaacatttagcatcaacggactctgaaagacgtgtcatcacgctgcaagcgccaattacagaagaacaaatccgcgagctgaaagtcggcgacgttgttcgcatcaacggaatcatttacacaggaagggatgccatccataaatatttaatggatcatgatgcgccggttgatttaaacggtcaaattatttaccactgcggacctgtcatgttaaaagatgaaaacggcaattgggaagtgaaagcggccgggccgaccacttccattcgcgaagagccttatcaaggggatattatgaaaaaatttggcatccgtgcggtaatgggcaaaggcggcatggggcaaaaaacgctgcaagctttaaaagagcatggcggagtatacttgaatgcgattggcggtgctgctcaatattatgcggattgcatcgaagcggttgaaggtgttgacttgctggagtttggaattccagaagctatgtggcatttgcgcgtaaaagacttcacggccgttgtcacaatggattcacacggcaacagcctgcatgaagacattgaaaaatcgtcattagaaaagctttctcaatttaaagagccggtatttagctaa

SEQ ID NO: 44383 - protein, 514 aa, Bacillus stearothermophilus
MEKLYESMYQLIVETSTKLPKDVRRAILKAKQRENAGTRAAMSLATITENIKMADENVSPICQDTGLPTFKIKVPVGINQIQIKETIKKAIAQATKDGKLRPNSVDSLTGENSGDNLGEGLPVVKFEQWEKDYMDVRLILKGGGCENKNIQYSLPCELEGLGRAGRDLDGIRKCILHAVYQAQGQGCSAGFIGVGIGGDRSAGYDLAKEQLFREVDDVNPNEELRQLEEYIMENANKLGIGTMGFGGETTLLGCKVGAMHRIPASFFVSVAYNCWAFRRLGVHIDPNTGEIIKWLYQDGEDVDFQENAAQEEHLASTDSERRVITLQAPITEEQIRELKVGDVVRINGIIYTGRDAIHKYLMDHDAPVDLNGQIIYHCGPVMLKDENGNWEVKAAGPTTSIREEPYQGDIMKKFGIRAVMGKGGMGQKTLQALKEHGGVYLNAIGGAAQYYADCIEAVEGVDLLEFGIPEAMWHLRVKDFTAVVTMDSHGNSLHEDIEKSSLEKLSQFKEPVFS

SEQ ID NO: 44384 - DNA, 25 bp, Artificial sequence
  (1)..(25): primer
atgtcaaacaaaccctttatctacc

SEQ ID NO: 44385 - DNA, 22 bp, Artificial sequence
  (1)..(22): primer
ttacttagtgcagttcgcgcac

SEQ ID NO: 44386 - protein, 520 aa, Artificial sequence
  Variant (2)..(10): xaa in position 2 to 10 is any amino acid
  Variant (12)..(18): xaa in position 12 to 18 is any amino acid
  Variant (20)..(35): xaa in position 20 to 35 is any amino acid
  Variant (36)..(44): xaa in position 36 to 44 is any or no amino acid
  Variant (46)..(46): xaa in position 46 is any amino acid
  Variant (48)..(51): xaa in position 48 to 51 is any amino acid
  Variant (53)..(56): xaa in position 53 to 56 is any amino acid
  Variant (58)..(58): xaa in position 58 is any amino acid
  Variant (64)..(71): xaa in position 64 to 71 is any amino acid
  Variant (73)..(74): xaa in position 73 to 74 is any amino acid
  Variant (76)..(86): xaa in position 76 to 86 is any amino acid
  Variant (87)..(94): xaa in position 87 to 94 is any or no amino acid
  Variant (96)..(99): xaa in position 96 to 99 is any amino acid
  Variant (101)..(119): xaa in position 101 to 119 is any amino acid
  Variant (120)..(120): xaa in position 120 is any or no amino acid
  Variant (123)..(124): xaa in position 123 to 124 is any amino acid
  Variant (126)..(126): xaa in position 126 is any amino acid
  Variant (129)..(136): xaa in position 129 to 136 is any amino acid
  Variant (138)..(144): xaa in position 138 to 144 is any amino acid
  Variant (145)..(149): xaa in position 145 to 149 is any or no amino acid
  Variant (156)..(156): xaa in position 156 is any amino acid
  Variant (159)..(181): xaa in position 159 to 181 is any amino acid
  Variant (182)..(192): xaa in position 182 to 192 is any or no amino acid
  Variant (194)..(196): xaa in position 194 to 196 is any amino acid
  Variant (200)..(205): xaa in position 200 to 205 is any amino acid
  Variant (209)..(236): xaa in position 209 to 236 is any amino acid
  Variant (237)..(245): xaa in position 237 to 245 is any or no amino acid
  Variant (247)..(256): xaa in position 247 to 256 is any amino acid
  Variant (263)..(264): xaa in position 263 to 264 is any amino acid
  Variant (267)..(271): xaa in position 267 to 271 is any amino acid
  Variant (273)..(278): xaa in position 273 to 278 is any amino acid
  Variant (280)..(280): xaa in position 280 is any amino acid
  Variant (282)..(282): xaa in position 282 is any amino acid
  Variant (285)..(285): xaa in position 285 is any amino acid
  Variant (288)..(292): xaa in position 288 to 292 is any amino acid
  Variant (294)..(294): xaa in position 294 is any amino acid
  Variant (296)..(296): xaa in position 296 is any amino acid
  Variant (298)..(306): xaa in position 298 to 306 is any amino acid
  Variant (308)..(309): xaa in position 308 to 309 is any amino acid
  Variant (310)..(314): xaa in position 310 to 314 is any or no amino acid
  Variant (316)..(323): xaa in position 316 to 323 is any amino acid
  Variant (325)..(334): xaa in position 325 to 334 is any amino acid
  Variant (335)..(345): xaa in position 335 to 345 is any or no amino acid
  Variant (347)..(364): xaa in position 347 to 364 is any amino acid
  Variant (365)..(367): xaa in position 365 to 367 is any or no amino acid
  Variant (369)..(369): xaa in position 369 is any amino acid
  Variant (371)..(374): xaa in position 371 to 374 is any amino acid
  Variant (378)..(378): xaa in position 378 is any amino acid
  Variant (381)..(396): xaa in position 381 to 396 is any amino acid
  Variant (397)..(403): xaa in position 397 to 403 is any or no amino acid
  Variant (407)..(407): xaa in position 407 is any amino acid
  Variant (410)..(418): xaa in position 410 to 418 is any amino acid
  Variant (419)..(421): xaa in position 419 to 421 is any or no amino acid
  Variant (423)..(424): xaa in position 423 to 424 is any amino acid
  Variant (429)..(430): xaa in position 429 to 430 is any amino acid
  Variant (434)..(443): xaa in position 434 to 443 is any amino acid
  Variant (445)..(447): xaa in position 445 to 447 is any amino acid
  Variant (449)..(450): xaa in position 449 to 450 is any amino acid
  Variant (452)..(453): xaa in position 452 to 453 is any amino acid
  Variant (455)..(468): xaa in position 455 to 468 is any amino acid
  Variant (471)..(473): xaa in position 471 to 473 is any amino acid
  Variant (476)..(476): xaa in position 476 is any or no amino acid
  Variant (479)..(479): xaa in position 479 is any amino acid
  Variant (481)..(484): xaa in position 481 to 484 is any amino acid
  Variant (486)..(495): xaa in position 486 to 495 is any amino acid
  Variant (499)..(499): xaa in position 499 is any or no amino acid
  Variant (502)..(506): xaa in position 502 to 506 is any amino acid
  Variant (508)..(508): xaa in position 508 is any amino acid
  Variant (510)..(510): xaa in position 510 is any amino acid
  Variant (512)..(515): xaa in position 512 to 515 is any amino acid
  Variant (518)..(519): xaa in position 518 to 519 is any amino acid
LXXXXXXXXXDXXXXXXXAXXXXXXXXXXXXXXXXXXXXXXXXXLXNXXXXAXXXXPXCQDTGXXXXXXXXGXXVXXXXXXXXXXXXXXXXXXXGXXXXYXXXXXXXXXXXXXXXXXXXXNTXXNXPAXXXXXXXXGXXXXXXXXXXXXAKGGGSXNKXXXXXXXXXXXXXXXXXXXXXXXXXXXXXXXXXXGXXXCPPXXXXXXIGGXXXXXXXXXXXXXXXXXXXXXXXXXXXXXXXXXXXXXLXXXXXXXXXXLGIGAQXXGGXXXXXDXXXXXXPXHXASXPVXXXXXCXAXRXXXXXXXXXGXXXXXXXLXXXXXXXXPXXXXXXXXXXXXXXXXXXXXXLXXXXXXXXXXXXXXXXXXXXXLXGXXXXGRDXAHXXXXXXXXXXXXXXXXXXXXXXXIYYXGPXXXXXXXXXXXXGXXGPTTXXRMDXXXXXXXXXXGXXXMXXKXXRXXXXXXXXXXXXXXYLXXXGGXAAXLXXXXIXXXXXXXXXXLGMXEAXXXXXVXDXPXXXXVDXXG

SEQ ID NO: 44387 - protein, 109 aa, Artificial sequence
  Variant (1)..(1): xaa in position 1 is Met, Ile, Val, Leu or Thr
  Variant (2)..(2): xaa in position 2 is any amino acid
  Variant (3)..(3): xaa in position 3 is Ala, Asp, Gly or Val
  Variant (4)..(7): xaa in position 4 to 7 is any amino acid
  Variant (8)..(8): xaa in position 8 is Pro or Ala
  Variant (9)..(9): xaa in position 9 is any amino acid
  Variant (15)..(34): xaa in position 15 to 34 is any amino acid
  Variant (35)..(42): xaa in position 35 to 42 is any or no amino acid
  Variant (43)..(43): xaa in position 43 is Ile, Leu, Val or Cys
  Variant (44)..(45): xaa in position 44 to 45 is any amino acid
  Variant (46)..(46): xaa in position 46 is Gly or Ala
  Variant (47)..(47): xaa in position 47 is Val, Ile, Thr, Ala or Leu
  Variant (48)..(50): xaa in position 48 to 50 is any amino acid
  Variant (51)..(51): xaa in position 51 is Tyr, Thr, Phe or Trp
  Variant (52)..(70): xaa in position 52 to 70 is any amino acid
  Variant (71)..(71): xaa in position 71 is any or no amino acid
  Variant (73)..(73): xaa in position 73 is Thr, Leu or Ser
  Variant (74)..(75): xaa in position 74 to 75 is any amino acid
  Variant (76)..(76): xaa in position 76 is Asn, Gly or His
  Variant (77)..(77): xaa in position 77 is any amino acid
  Variant (79)..(96): xaa in position 79 to 96 is any amino acid
  Variant (97)..(101): xaa in position 97 to 101 is any or no amino acid
  Variant (106)..(106): xaa in position 106 is Ser or Cys
  Variant (107)..(108): xaa in position 107 to 108 is any amino acid
XXXXXXXXXCQDTGXXXXXXXXXXXXXXXXXXXXXXXXXXXXXXXXXXXXXXXXXXXXXXXXXXXXXXXXXNXXXXXPXXXXXXXXXXXXXXXXXXXXXXXKGGGXXXK

SEQ ID NO: 44388 - protein, 28 aa, Artificial sequence
  Variant (1)..(1): xaa in position 1 is Ile, Leu, Val, Met or Phe
  Variant (2)..(3): xaa in position 2 to 3 is any amino acid
  Variant (4)..(4): xaa in position 4 is Trp, Phe or Tyr
  Variant (5)..(5): xaa in position 5 is Val, Leu or Ile
  Variant (6)..(8): xaa in position 6 to 8 is any amino acid
  Variant (9)..(9): xaa in position 9 is Val, Met, Ile or Leu
  Variant (10)..(11): xaa in position 10 to 11 is any amino acid
  Variant (12)..(12): xaa in position 12 is Met or Leu
  Variant (14)..(14): xaa in position 14 is Ala, Thr or Ser
  Variant (15)..(15): xaa in position 15 is Gly, Ala or Ser
  Variant (16)..(16): xaa in position 16 is any amino acid
  Variant (20)..(21): xaa in position 20 to 21 is any amino acid
  Variant (22)..(22): xaa in position 22 is Leu or Ile
  Variant (23)..(23): xaa in position 23 is Gly, Ala or Ser
  Variant (24)..(24): xaa in position 24 is Ile, Val, Phe or Leu
  Variant (25)..(25): xaa in position 25 is any amino acid
  Variant (26)..(26): xaa in position 26 is Ile or Val
XXXXXXXXXXXXGXXXCPPXXXXXXXGG

SEQ ID NO: 44389 - protein, 58 aa, Artificial sequence
  Variant (1)..(1): xaa in position 1 is Leu, Met, Phe or Ile
  Variant (2)..(2): xaa in position 2 is Arg or Glu
  Variant (3)..(4): xaa in position 3 to 4 is any amino acid
  Variant (5)..(5): xaa in position 5 is Leu, Ile or Val
  Variant (6)..(9): xaa in position 6 to 9 is any amino acid
  Variant (10)..(10): xaa in position 10 is Asn, Gln or Arg
  Variant (11)..(11): xaa in position 11 is any amino acid
  Variant (12)..(12): xaa in position 12 is Leu, Ile, Phe, Met or Val
  Variant (13)..(13): xaa in position 13 is Gly or Asn
  Variant (14)..(14): xaa in position 14 is Ile, Leu or Val
  Variant (16)..(16): xaa in position 16 is Ala or Thr
  Variant (17)..(17): xaa in position 17 is Gln or Met
  Variant (18)..(18): xaa in position 18 is any or no amino acid
  Variant (19)..(19): xaa in position 19 is Leu, Phe or Val
  Variant (20)..(20): xaa in position 20 is Gly or Ala
  Variant (22)..(26): xaa in position 22 to 26 is any amino acid
  Variant (28)..(28): xaa in position 28 is Val or Ile
  Variant (29)..(29): xaa in position 29 is Lys or Arg
  Variant (30)..(30): xaa in position 30 is Ile, Val or Leu
  Variant (31)..(33): xaa in position 31 to 33 is any amino acid
  Variant (35)..(35): xaa in position 35 is any amino acid
  Variant (37)..(37): xaa in position 37 is Ala or Gly
  Variant (38)..(38): xaa in position 38 is Ala, Ser or Thr
  Variant (39)..(39): xaa in position 39 is Ser, Asn or Gly
  Variant (40)..(40): xaa in position 40 is any amino acid
  Variant (42)..(42): xaa in position 42 is Val or Ile
  Variant (43)..(43): xaa in position 43 is any amino acid
  Variant (44)..(44): xaa in position 44 is Met, Leu, Ile or Val
  Variant (45)..(46): xaa in position 45 to 46 is any amino acid
  Variant (47)..(47): xaa in position 47 is Asn, Ser or Gln
  Variant (49)..(49): xaa in position 49 is any amino acid
  Variant (50)..(50): xaa in position 50 is Ala or Ser
  Variant (51)..(51): xaa in position 51 is any amino acid
  Variant (53)..(57): xaa in position 53 to 57 is any amino acid
  Variant (58)..(58): xaa in position 58 is Leu or Ile
XXXXXXXXXXXXXXGXXXXXGXXXXXDXXXXXXPXHXXXXPXXXXXXCXXXRXXXXXX

SEQ ID NO: 44390 - protein, 89 aa, Artificial sequence
  Variant (1)..(1): xaa in position 1 is Leu, Val, Ile or Phe
  Variant (2)..(2): xaa in position 2 is any amino acid
  Variant (3)..(3): xaa in position 3 is Leu, Ile, Met or Val
  Variant (4)..(4): xaa in position 4 is any amino acid
  Variant (6)..(6): xaa in position 6 is any amino acid
  Variant (7)..(7): xaa in position 7 is Met, Ile or Leu
  Variant (8)..(9): xaa in position 8 to 9 is any amino acid
  Variant (10)..(10): xaa in position 10 is Gly or Ala
  Variant (13)..(13): xaa in position 13 is any amino acid
  Variant (14)..(14): xaa in position 14 is Ala, Ile or Phe
  Variant (16)..(16): xaa in position 16 is any amino acid
  Variant (17)..(17): xaa in position 17 is Arg, Lys, His or Tyr
  Variant (18)..(18): xaa in position 18 is Ile, Leu, Met or Phe
  Variant (19)..(24): xaa in position 19 to 24 is any or no amino acid
  Variant (25)..(25): xaa in position 25 is Gly or Pro
  Variant (26)..(26): xaa in position 26 is any amino acid
  Variant (27)..(28): xaa in position 27 to 28 is any or no amino acid
  Variant (29)..(29): xaa in position 29 is Pro, Cys or Asp
  Variant (30)..(38): xaa in position 30 to 38 is any amino acid
  Variant (39)..(39): xaa in position 39 is Ile or Val
  Variant (41)..(41): xaa in position 41 is Tyr or His
  Variant (42)..(42): xaa in position 42 is any amino acid
  Variant (45)..(53): xaa in position 45 to 53 is any amino acid
  Variant (54)..(56): xaa in position 54 to 56 is any or no amino acid
  Variant (57)..(57): xaa in position 57 is Gly, Lys or Val
  Variant (58)..(59): xaa in position 58 to 59 is any amino acid
  Variant (64)..(64): xaa in position 64 is Ala, Ser or Gly
  Variant (65)..(65): xaa in position 65 is any amino acid
  Variant (67)..(67): xaa in position 67 is Met, Glu or Leu
  Variant (68)..(68): xaa in position 68 is Asp or Glu
  Variant (69)..(69): xaa in position 69 is any amino acid
  Variant (70)..(70): xaa in position 70 is Phe or Tyr
  Variant (71)..(77): xaa in position 71 to 77 is any amino acid
  Variant (78)..(78): xaa in position 78 is any or no amino acid
  Variant (79)..(79): xaa in position 79 is Gly, Asp or Ala
  Variant (80)..(82): xaa in position 80 to 82 is any amino acid
  Variant (83)..(83): xaa in position 83 is Met, Val or Ser
  Variant (84)..(84): xaa in position 84 is Ile, Val, Leu or Met
  Variant (85)..(85): xaa in position 85 is Gly or Ala
  Variant (87)..(88): xaa in position 87 to 88 is any amino acid
  Variant (89)..(89): xaa in position 89 is Arg or Met
XXXXGXXXXXRDXXHXXXXXXXXXXXXXXXXXXXXXXXXYXXGPXXXXXXXXXXXXXXXGPTTXXRXXXXXXXXXXXXXXXXXXXKXXX

SEQ ID NO: 44391 - protein, 60 aa, Artificial sequence
  Variant (1)..(1): xaa in position 1 is Ala, Ser or Gly
  Variant (2)..(8): xaa in position 2 to 8 is any amino acid
  Variant (10)..(10): xaa in position 10 is Leu or Phe
  Variant (11)..(11): xaa in position 11 is any amino acid
  Variant (12)..(12): xaa in position 12 is Ala, Ser or Gly
  Variant (13)..(13): xaa in position 13 is Val or Ile
  Variant (16)..(16): xaa in position 16 is any or no amino acid
  Variant (17)..(17): xaa in position 17 is Ala or Ser
  Variant (18)..(18): xaa in position 18 is Ala or Gln
  Variant (19)..(19): xaa in position 19 is any amino acid
  Variant (20)..(20): xaa in position 20 is Leu or Tyr
  Variant (21)..(24): xaa in position 21 to 24 is any amino acid
  Variant (25)..(25): xaa in position 25 is Ile, Glu or Val
  Variant (26)..(26): xaa in position 26 is Lys, Arg, Glu or Thr
  Variant (27)..(30): xaa in position 27 to 30 is any amino acid
  Variant (31)..(31): xaa in position 31 is Val, Leu, Ile or Asp
  Variant (32)..(32): xaa in position 32 is any amino acid
  Variant (33)..(33): xaa in position 33 is Phe, Tyr or Leu
  Variant (34)..(34): xaa in position 34 is any amino acid
  Variant (35)..(35): xaa in position 35 is Glu, Asp or Gln
  Variant (36)..(36): xaa in position 36 is Leu, Phe or Met
  Variant (38)..(38): xaa in position 38 is Met, Ile or Val
  Variant (39)..(39): xaa in position 39 is any or no amino acid
  Variant (41)..(41): xaa in position 41 is Ala or Ser
  Variant (42)..(42): xaa in position 42 is Ile, Val or Met
  Variant (43)..(43): xaa in position 43 is Tyr, Trp, His or Arg
  Variant (44)..(46): xaa in position 44 to 46 is any amino acid
  Variant (47)..(47): xaa in position 47 is Val, Ile or Ala
  Variant (48)..(50): xaa in position 48 to 50 is any amino acid
  Variant (51)..(51): xaa in position 51 is Pro, Lys, Thr or Ala
  Variant (52)..(53): xaa in position 52 to 53 is any amino acid
  Variant (54)..(54): xaa in position 54 is Val, Ile or Met
  Variant (55)..(55): xaa in position 55 is any amino acid
  Variant (56)..(56): xaa in position 56 is Val, Met, Ile or Cys
  Variant (58)..(59): xaa in position 58 to 59 is any amino acid
XXXXXXXXYXXXXGGXXXXXXXXXXXXXXXXXXXXXGXXEXXXXXXXXXXXXXXXXDXXG

SEQ ID NO: 44392 - DNA, 2280 bp, Escherichia coli K12; identical to SEQ ID NO: 11018
  CDS (470)..(1951)

SEQ ID NO: 44393 - protein, 493 aa, Escherichia coli K12; identical to SEQ ID NO: 11019

SEQ ID NO: 44394 - DNA, 1770 bp, Arabidopsis thaliana; identical to SEQ ID NO: 11020
  CDS (84)..(1559)

SEQ ID NO: 44395 - protein, 491 aa, Arabidopsis thaliana; identical to SEQ ID NO: 11021

SEQ ID NO: 44396 - DNA, 1512 bp, Arabidopsis thaliana; identical to SEQ ID NO: 11022
  CDS (1)..(1479)

SEQ ID NO: 44397 - protein, 492 aa, Arabidopsis thaliana; identical to SEQ ID NO: 11023

SEQ ID NO: 44398 - DNA, 1500 bp, Arabidopsis thaliana; identical to SEQ ID NO: 11024
  CDS (1)..(1500)

SEQ ID NO: 44399 - protein, 499 aa, Arabidopsis thaliana; identical to SEQ ID NO: 11025

SEQ ID NO: 44400 - DNA, 1865 bp, Solanum tuberosum; identical to SEQ ID NO: 11026
  CDS (66)..(1547)

SEQ ID NO: 44401 - protein, 493 aa, Solanum tuberosum; identical to SEQ ID NO: 11027

SEQ ID NO: 44402 - DNA, 1616 bp, Arabidopsis thaliana; identical to SEQ ID NO: 11028
  CDS (44)..(1576)

SEQ ID NO: 44403 - protein, 510 aa, Arabidopsis thaliana; identical to SEQ ID NO: 11029

SEQ ID NO: 44404 - DNA, 1416 bp, Nostoc sp. PCC 7120; identical to SEQ ID NO: 11030
  CDS (1)..(1416)

SEQ ID NO: 44405 - protein, 471 aa, Nostoc sp. PCC 7120; identical to SEQ ID NO: 11031

SEQ ID NO: 44406 - DNA, 1437 bp, Salmonella enterica subsp. enterica serovar Typhi; identical to SEQ ID NO: 11032
  CDS (1)..(1437)

SEQ ID NO: 44407 - protein, 478 aa, Salmonella enterica subsp. enterica serovar Typhi; identical to SEQ ID NO: 11033

SEQ ID NO: 44408 - DNA, 1452 bp, Brucella melitensis; identical to SEQ ID NO: 11034
  CDS (1)..(1452)

SEQ ID NO: 44409 - protein, 483 aa, Brucella melitensis; identical to SEQ ID NO: 11035

SEQ ID NO: 44410 - DNA, 1416 bp, Bacillus halodurans; identical to SEQ ID NO: 11036
  CDS (1)..(1416)

SEQ ID NO: 44411 - protein, 471 aa, Bacillus halodurans; identical to SEQ ID NO: 11037

SEQ ID NO: 44412 - DNA, 1428 bp, Haemophilus influenzae; identical to SEQ ID NO: 11038
  CDS (1)..(1428)

SEQ ID NO: 44413 - protein, 475 aa, Haemophilus influenzae; identical to SEQ ID NO: 11039

SEQ ID NO: 44414 - DNA, 1398 bp, Neisseria meningitidis; identical to SEQ ID NO: 11040
  CDS (1)..(1398)

SEQ ID NO: 44415 - protein, 465 aa, Neisseria meningitidis; identical to SEQ ID NO: 11041

SEQ ID NO: 44416 - DNA, 1425 bp, Pseudomonas aeruginosa; identical to SEQ ID NO: 11042
  CDS (1)..(1425)

SEQ ID NO: 44417 - protein, 474 aa, Pseudomonas aeruginosa; identical to SEQ ID NO: 11043

SEQ ID NO: 44418 - DNA, 1398 bp, Clostridium acetobutylicum; identical to SEQ ID NO: 11044
  CDS (1)..(1398)

SEQ ID NO: 44419 - protein, 465 aa, Clostridium acetobutylicum; identical to SEQ ID NO: 11045

SEQ ID NO: 44420 - DNA, 1446 bp, Agrobacterium tumefaciens; identical to SEQ ID NO: 11046
  CDS (1)..(1446)

SEQ ID NO: 44421 - protein, 481 aa, Agrobacterium tumefaciens; identical to SEQ ID NO: 11047

SEQ ID NO: 44422 - DNA, 1377 bp, Thermotoga maritima; identical to SEQ ID NO: 11048
  CDS (1)..(1377)

SEQ ID NO: 44423 - protein, 458 aa, Thermotoga maritima; identical to SEQ ID NO: 11049

SEQ ID NO: 44424 - DNA, 1407 bp, Campylobacter jejuni; identical to SEQ ID NO: 11050
  CDS (1)..(1407)

SEQ ID NO: 44425 - protein, 468 aa, Campylobacter jejuni; identical to SEQ ID NO: 11051

SEQ ID NO: 44426 - DNA, 1452 bp, Vibrio cholerae; identical to SEQ ID NO: 11052
  CDS (1)..(1452)

SEQ ID NO: 44427 - protein, 483 aa, Vibrio cholerae; identical to SEQ ID NO: 11053

SEQ ID NO: 44428 - DNA, 1413 bp, Clostridium acetobutylicum; identical to SEQ ID NO: 11054
  CDS (1)..(1413)

SEQ ID NO: 44429 - protein, 470 aa, Clostridium acetobutylicum; identical to SEQ ID NO: 11055

SEQ ID NO: 44430 - DNA, 1407 bp, Helicobacter pylori; identical to SEQ ID NO: 11056
  CDS (1)..(1407)

SEQ ID NO: 44431 - protein, 468 aa, Helicobacter pylori; identical to SEQ ID NO: 11057

SEQ ID NO: 44432 - DNA, 2867 bp, Serratia marcescens; identical to SEQ ID NO: 11058
  CDS (787)..(2223)

SEQ ID NO: 44433 - protein, 478 aa, Serratia marcescens; identical to SEQ ID NO: 11059

SEQ ID NO: 44434 - DNA, 1428 bp, Bacillus subtilis; identical to SEQ ID NO: 11060
  CDS (1)..(1428)

SEQ ID NO: 44435 - protein, 475 aa, Bacillus subtilis; identical to SEQ ID NO: 11061

SEQ ID NO: 44436 - DNA, 2066 bp, Pseudomonas fluorescens; identical to SEQ ID NO: 11062
  CDS (323)..(1759)

SEQ ID NO: 44437 - protein, 478 aa, Pseudomonas fluorescens; identical to SEQ ID NO: 11063

SEQ ID NO: 44438 - DNA, 1437 bp, Bacillus cereus; identical to SEQ ID NO: 11064
  CDS (1)..(1437)

SEQ ID NO: 44439 - protein, 478 aa, Bacillus cereus; identical to SEQ ID NO: 11065

SEQ ID NO: 44440 - DNA, 1419 bp, Acinetobacter sp; identical to SEQ ID NO: 11066
  CDS (1)..(1419)

SEQ ID NO: 44441 - protein, 472 aa, Acinetobacter sp; identical to SEQ ID NO: 11067

SEQ ID NO: 44442 - DNA, 1431 bp, Bacillus anthracis str; identical to SEQ ID NO: 11068
  CDS (1)..(1431)

SEQ ID NO: 44443 - protein, 476 aa, Bacillus anthracis str; identical to SEQ ID NO: 11069

SEQ ID NO: 44444 - DNA, 1461 bp, Photobacterium profundum; identical to SEQ ID NO: 11070
  CDS (1)..(1461)

SEQ ID NO: 44445 - protein, 486 aa, Photobacterium profundum; identical to SEQ ID NO: 11071

SEQ ID NO: 44446 - DNA, 1431 bp, Bdellovibrio bacteriovorus; identical to SEQ ID NO: 11072
  CDS (1)..(1431)

SEQ ID NO: 44447 - protein, 476 aa, Bdellovibrio bacteriovorus; identical to SEQ ID NO: 11073

SEQ ID NO: 44448 - DNA, 1575 bp, Corynebacterium diphtheriae; identical to SEQ ID NO: 11074
  CDS (1)..(1575)

SEQ ID NO: 44449 - protein, 524 aa, Corynebacterium diphtheriae; identical to SEQ ID NO: 11075

SEQ ID NO: 44450 - DNA, 1407 bp, Desulfovibrio vulgaris; identical to SEQ ID NO: 11076
  CDS (1)..(1407)

SEQ ID NO: 44451 - protein, 468 aa, Desulfovibrio vulgaris; identical to SEQ ID NO: 11077

SEQ ID NO: 44452 - DNA, 1413 bp, Desulfovibrio vulgaris; identical to SEQ ID NO: 11078
  CDS (1)..(1413)

SEQ ID NO: 44453 - protein, 470 aa, Desulfovibrio vulgaris; identical to SEQ ID NO: 11079

SEQ ID NO: 44454 - DNA, 1434 bp, Bacillus cereus; identical to SEQ ID NO: 11080
  CDS (1)..(1434)

SEQ ID NO: 44455 - protein, 477 aa, Bacillus cereus; identical to SEQ ID NO: 11081

SEQ ID NO: 44456 - DNA, 1392 bp, Treponema denticola; identical to SEQ ID NO: 11082
  CDS (1)..(1392)

SEQ ID NO: 44457 - protein, 463 aa, Treponema denticola; identical to SEQ ID NO: 11083

SEQ ID NO: 44458 - DNA, 1392 bp, Geobacter sulfurreducens; identical to SEQ ID NO: 11084
  CDS (1)..(1392)

SEQ ID NO: 44459 - protein, 463 aa, Geobacter sulfurreducens; identical to SEQ ID NO: 11085

SEQ ID NO: 44460 - DNA, 1437 bp, Yersinia pestis; identical to SEQ ID NO: 11086
  CDS (1)..(1437)

SEQ ID NO: 44461 - protein, 478 aa, Yersinia pestis; identical to SEQ ID NO: 11087

SEQ ID NO: 44462 - DNA, 1401 bp, Bradyrhizobium japonicum USDA 110; identical to SEQ ID NO: 11088
  CDS (1)..(1401)

SEQ ID NO: 44463 - protein, 466 aa, Bradyrhizobium japonicum USDA 110; identical to SEQ ID NO: 11089

SEQ ID NO: 44464 - DNA, 1416 bp, Wolinella succinogenes; identical to SEQ ID NO: 11090
  CDS (1)..(1416)

SEQ ID NO: 44465 - protein, 471 aa, Wolinella succinogenes; identical to SEQ ID NO: 11091

SEQ ID NO: 44466 - DNA, 1452 bp, Vibrio vulnificus; identical to SEQ ID NO: 11092
  CDS (1)..(1452)

SEQ ID NO: 44467 - protein, 483 aa, Vibrio vulnificus; identical to SEQ ID NO: 11093

SEQ ID NO: 44468 - DNA, 1428 bp, Porphyromonas gingivalis W83; identical to SEQ ID NO: 11094
  CDS (1)..(1428)

SEQ ID NO: 44469 - protein, 475 aa, Porphyromonas gingivalis W83; identical to SEQ ID NO: 11095

SEQ ID NO: 44470 - DNA, 1425 bp, Photorhabdus luminescens subsp; identical to SEQ ID NO: 11096
  CDS (1)..(1425)

SEQ ID NO: 44471 - protein, 474 aa, Photorhabdus luminescens subsp; identical to SEQ ID NO: 11097

SEQ ID NO: 44472 - DNA, 1410 bp, Gloeobacter violaceus PCC 7421; identical to SEQ ID NO: 11098
  CDS (1)..(1410)

SEQ ID NO: 44473 - protein, 469 aa, Gloeobacter violaceus PCC 7421; identical to SEQ ID NO: 11099

SEQ ID NO: 44474 - DNA, 1404 bp, Chromobacterium violaceum ATCC 12472; identical to SEQ ID NO: 11100
  CDS (1)..(1404)

SEQ ID NO: 44475 - protein, 467 aa, Chromobacterium violaceum ATCC 12472; identical to SEQ ID NO: 11101

SEQ ID NO: 44476 - DNA, 1440 bp, Helicobacter hepaticus ATCC 51449; identical to SEQ ID NO: 11102
  CDS (1)..(1440)

SEQ ID NO: 44477 - protein, 479 aa, Helicobacter hepaticus ATCC 51449; identical to SEQ ID NO: 11103

SEQ ID NO: 44478 - DNA, 1428 bp, Haemophilus ducreyi 35000HP; identical to SEQ ID NO: 11104
  CDS (1)..(1428)

SEQ ID NO: 44479 - protein, 475 aa, Haemophilus ducreyi 35000HP; identical to SEQ ID NO: 11105

SEQ ID NO: 44480 - DNA, 1413 bp, Streptomyces avermitilis; identical to SEQ ID NO: 11106
  CDS (1)..(1413)

SEQ ID NO: 44481 - protein, 470 aa, Streptomyces avermitilis; identical to SEQ ID NO: 11107

SEQ ID NO: 44482 - DNA, 1395 bp, Eikenella corrodens; identical to SEQ ID NO: 11108
  CDS (1)..(1395)

SEQ ID NO: 44483 - protein, 464 aa, Eikenella corrodens; identical to SEQ ID NO: 11109

SEQ ID NO: 44484 - DNA, 1452 bp, Vibrio parahaemolyticus; identical to SEQ ID NO: 11110
  CDS (1)..(1452)

SEQ ID NO: 44485 - protein, 483 aa, Vibrio parahaemolyticus; identical to SEQ ID NO: 11111

SEQ ID NO: 44486 - DNA, 1425 bp, Pseudomonas syringae pv; identical to SEQ ID NO: 11112
  CDS (1)..(1425)

SEQ ID NO: 44487 - protein, 474 aa, Pseudomonas syringae pv; identical to SEQ ID NO: 11113

SEQ ID NO: 44488 - DNA, 1437 bp, Pseudomonas putida; identical to SEQ ID NO: 11114
  CDS (1)..(1437)

SEQ ID NO: 44489 - protein, 478 aa, Pseudomonas putida; identical to SEQ ID NO: 11115

SEQ ID NO: 44490 - DNA, 1401 bp, Lactobacillus plantarum WCFS1; identical to SEQ ID NO: 11116
  CDS (1)..(1401)

SEQ ID NO: 44491 - protein, 466 aa, Lactobacillus plantarum WCFS1; identical to SEQ ID NO: 11117

SEQ ID NO: 44492 - DNA, 1413 bp, Clostridium tetani E88; identical to SEQ ID NO: 11118
  CDS (1)..(1413)

SEQ ID NO: 44493 - protein, 470 aa, Clostridium tetani E88; identical to SEQ ID NO: 11119

SEQ ID NO: 44494 - DNA, 1461 bp, Bacteroides thetaiotaomicron VPI; identical to SEQ ID NO: 11120
  CDS (1)..(1461)

SEQ ID NO: 44495 - protein, 486 aa, Bacteroides thetaiotaomicron VPI; identical to SEQ ID NO: 11121

SEQ ID NO: 44496 - DNA, 1440 bp, Wigglesworthia glossinidia brevipalpis; identical to SEQ ID NO: 11122
  CDS (1)..(1440)

SEQ ID NO: 44497 - protein, 479 aa, Wigglesworthia glossinidia brevipalpis; identical to SEQ ID NO: 11123

SEQ ID NO: 44498 - DNA, 1617 bp, Corynebacterium efficiens YS; identical to SEQ ID NO: 11124
  CDS (1)..(1617)

SEQ ID NO: 44499 - protein, 538 aa, Corynebacterium efficiens YS; identical to SEQ ID NO: 11125

SEQ ID NO: 44500 - DNA, 1473 bp, Bifidobacterium longum; identical to SEQ ID NO: 11126
  CDS (1)..(1473)

SEQ ID NO: 44501 - protein, 490 aa, Bifidobacterium longum; identical to SEQ ID NO: 11127

SEQ ID NO: 44502 - DNA, 1410 bp, Cytophaga sp; identical to SEQ ID NO: 11128
  CDS (1)..(1410)

SEQ ID NO: 44503 - protein, 469 aa, Cytophaga sp; identical to SEQ ID NO: 11129

SEQ ID NO: 44504 - DNA, 1386 bp, Thermoanaerobacter tengcongensis; identical to SEQ ID NO: 11130
  CDS (1)..(1386)

SEQ ID NO: 44505 - protein, 461 aa, Thermoanaerobacter tengcongensis; identical to SEQ ID NO: 11131

SEQ ID NO: 44506 - DNA, 1419 bp, Pasteurella multocida; identical to SEQ ID NO: 11132
  CDS (1)..(1419)

SEQ ID NO: 44507 - protein, 472 aa, Pasteurella multocida; identical to SEQ ID NO: 11133

SEQ ID NO: 44508 - DNA, 1374 bp, Thermoplasma acidophilum; identical to SEQ ID NO: 11134
  CDS (1)..(1374)

SEQ ID NO: 44509 - protein, 457 aa, Thermoplasma acidophilum; identical to SEQ ID NO: 11135

SEQ ID NO: 44510 - DNA, 2106 bp, Bacillus sp; identical to SEQ ID NO: 11136
  CDS (349)..(1755)

SEQ ID NO: 44511 - protein, 468 aa, Bacillus sp; identical to SEQ ID NO: 11137

SEQ ID NO: 44512 - DNA, 1428 bp, Rhizobium etli; identical to SEQ ID NO: 11138
  CDS (1)..(1428)

SEQ ID NO: 44513 - protein, 475 aa, Rhizobium etli; identical to SEQ ID NO: 11139

SEQ ID NO: 44514 - DNA, 1581 bp, Corynebacterium glutamicum; identical to SEQ ID NO: 11140
  CDS (1)..(1581)

SEQ ID NO: 44515 - protein, 526 aa, Corynebacterium glutamicum; identical to SEQ ID NO: 11141

SEQ ID NO: 44516 - DNA, 26 bp, Artificial sequence
  (1)..(26): primer
atgtgtttaaagcaaatcattggcag

SEQ ID NO: 44517 - DNA, 25 bp, Artificial sequence
  (1)..(25): primer
ttactgttcgctttcatcagtatag

SEQ ID NO: 44518 - protein, 465 aa, Artificial sequence; identical to SEQ ID NO: 33375
  Variant (2)..(2): xaa in position 2 is any amino acid
  Variant (4)..(4): xaa in position 4 is any amino acid
  Variant (6)..(7): xaa in position 6 to 7 is any amino acid
  Variant (9)..(12): xaa in position 9 to 12 is any amino acid
  Variant (14)..(16): xaa in position 14 to 16 is any amino acid
  Variant (18)..(18): xaa in position 18 is any amino acid
  Variant (20)..(21): xaa in position 20 to 21 is any amino acid
  Variant (23)..(23): xaa in position 23 is any amino acid
  Variant (26)..(27): xaa in position 26 to 27 is any amino acid
  Variant (30)..(30): xaa in position 30 is any amino acid
  Variant (32)..(49): xaa in position 32 to 49 is any amino acid
  Variant (51)..(51): xaa in position 51 is any amino acid
  Variant (53)..(53): xaa in position 53 is any amino acid
  Variant (55)..(56): xaa in position 55 to 56 is any amino acid
  Variant (58)..(70): xaa in position 58 to 70 is any amino acid
  Variant (72)..(73): xaa in position 72 to 73 is any amino acid
  Variant (75)..(88): xaa in position 75 to 88 is any amino acid
  Variant (90)..(91): xaa in position 90 to 91 is any amino acid
  Variant (93)..(94): xaa in position 93 to 94 is any amino acid
  Variant (102)..(102): xaa in position 102 is any amino acid
  Variant (106)..(106): xaa in position 106 is any amino acid
  Variant (110)..(110): xaa in position 110 is any amino acid
  Variant (113)..(113): xaa in position 113 is any amino acid
  Variant (115)..(115): xaa in position 115 is any amino acid
  Variant (117)..(118): xaa in position 117 to 118 is any amino acid
  Variant (120)..(122): xaa in position 120 to 122 is any amino acid
  Variant (124)..(124): xaa in position 124 is any amino acid
  Variant (126)..(129): xaa in position 126 to 129 is any amino acid
  Variant (132)..(133): xaa in position 132 to 133 is any amino acid
  Variant (136)..(137): xaa in position 136 to 137 is any amino acid
  Variant (143)..(144): xaa in position 143 to 144 is any amino acid
  Variant (147)..(159): xaa in position 147 to 159 is any amino acid
  Variant (161)..(166): xaa in position 161 to 166 is any amino acid
  Variant (168)..(173): xaa in position 168 to 173 is any amino acid
  Variant (175)..(176): xaa in position 175 to 176 is any amino acid
  Variant (179)..(182): xaa in position 179 to 182 is any amino acid
  Variant (184)..(184): xaa in position 184 is any amino acid
  Variant (188)..(188): xaa in position 188 is any amino acid
  Variant (195)..(197): xaa in position 195 to 197 is any amino acid
  Variant (202)..(226): xaa in position 202 to 226 is any amino acid
  Variant (228)..(228): xaa in position 228 is any amino acid
  Variant (230)..(230): xaa in position 230 is any amino acid
  Variant (233)..(233): xaa in position 233 is any amino acid
  Variant (237)..(237): xaa in position 237 is any amino acid
  Variant (239)..(242): xaa in position 239 to 242 is any amino acid
  Variant (244)..(250): xaa in position 244 to 250 is any amino acid
  Variant (252)..(261): xaa in position 252 to 261 is any amino acid
  Variant (263)..(264): xaa in position 263 to 264 is any amino acid
  Variant (266)..(267): xaa in position 266 to 267 is any amino acid
  Variant (270)..(281): xaa in position 270 to 281 is any amino acid
  Variant (284)..(285): xaa in position 284 to 285 is any amino acid
  Variant (287)..(290): xaa in position 287 to 290 is any amino acid
  Variant (292)..(293): xaa in position 292 to 293 is any amino acid
  Variant (300)..(300): xaa in position 300 is any amino acid
  Variant (305)..(305): xaa in position 305 is any amino acid
  Variant (307)..(308): xaa in position 307 to 308 is any amino acid
  Variant (310)..(311): xaa in position 310 to 311 is any amino acid
  Variant (314)..(315): xaa in position 314 to 315 is any amino acid
  Variant (317)..(317): xaa in position 317 is any amino acid
  Variant (324)..(324): xaa in position 324 is any amino acid
  Variant (330)..(331): xaa in position 330 to 331 is any amino acid
  Variant (333)..(334): xaa in position 333 to 334 is any amino acid
  Variant (337)..(340): xaa in position 337 to 340 is any amino acid
  Variant (342)..(342): xaa in position 342 is any amino acid
  Variant (346)..(350): xaa in position 346 to 350 is any amino acid
  Variant (352)..(354): xaa in position 352 to 354 is any amino acid
  Variant (358)..(358): xaa in position 358 is any amino acid
  Variant (361)..(363): xaa in position 361 to 363 is any amino acid
  Variant (365)..(372): xaa in position 365 to 372 is any amino acid
  Variant (374)..(387): xaa in position 374 to 387 is any amino acid
  Variant (389)..(390): xaa in position 389 to 390 is any amino acid
  Variant (393)..(394): xaa in position 393 to 394 is any amino acid
  Variant (396)..(405): xaa in position 396 to 405 is any amino acid
  Variant (407)..(410): xaa in position 407 to 410 is any amino acid
  Variant (412)..(412): xaa in position 412 is any amino acid
  Variant (416)..(417): xaa in position 416 to 417 is any amino acid
  Variant (419)..(432): xaa in position 419 to 432 is any amino acid
  Variant (434)..(447): xaa in position 434 to 447 is any amino acid
  Variant (449)..(464): xaa in position 449 to 464 is any amino acid

SEQ ID NO: 44519 - protein, 50 aa, Artificial sequence; identical to SEQ ID NO: 13505
  Variant (2)..(2): xaa in position 2 is any amino acid
  Variant (4)..(4): xaa in position 4 is any amino acid
  Variant (6)..(6): xaa in position 6 is any amino acid
  Variant (7)..(7): xaa in position 7 is Leu, Ile, Phe, Met or Val
  Variant (9)..(11): xaa in position 9 to 11 is any amino acid
  Variant (12)..(12): xaa in position 12 is Val, Ile or Leu
  Variant (13)..(13): xaa in position 13 is Pro, Ser, Glu or Ala
  Variant (14)..(16): xaa in position 14 to 16 is any amino acid
  Variant (17)..(17): xaa in position 17 is Tyr, Leu or Phe
  Variant (18)..(18): xaa in position 18 is Tyr, Trp, Phe or His
  Variant (20)..(20): xaa in position 20 is Ile, Val or Ala
  Variant (21)..(21): xaa in position 21 is Gln, His or Asn
  Variant (22)..(22): xaa in position 22 is Thr or Ser
  Variant (23)..(23): xaa in position 23 is any amino acid
  Variant (25)..(25): xaa in position 25 is Ala, Ser or Gly
  Variant (26)..(27): xaa in position 26 to 27 is any amino acid
  Variant (29)..(29): xaa in position 29 is Phe, Tyr or Val
  Variant (30)..(30): xaa in position 30 is any amino acid
  Variant (31)..(31): xaa in position 31 is Ile, Leu or Val
  Variant (32)..(32): xaa in position 32 is Ser, Thr or Gly
  Variant (33)..(40): xaa in position 33 to 40 is any amino acid
  Variant (41)..(42): xaa in position 41 to 42 is any or no amino acid
  Variant (43)..(43): xaa in position 43 is Ile, Val or Met
  Variant (44)..(44): xaa in position 44 is any amino acid
  Variant (45)..(45): xaa in position 45 is Ala, Gly or Ser
  Variant (46)..(48): xaa in position 46 to 48 is any amino acid
  Variant (49)..(49): xaa in position 49 is Val, Thr, Ile or Leu

SEQ ID NO: 44520 - protein, 57 aa, Artificial sequence; identical to SEQ ID NO: 13506
  Variant (1)..(1): xaa in position 1 is Gln or Ser
  Variant (2)..(2): xaa in position 2 is Gly, Thr or Ala
  Variant (4)..(4): xaa in position 4 is Ala or Ser
  Variant (7)..(7): xaa in position 7 is Ser, Gln or Thr
  Variant (8)..(8): xaa in position 8 is any amino acid
  Variant (9)..(9): xaa in position 9 is Asn or His
  Variant (12)..(12): xaa in position 12 is any amino acid
  Variant (16)..(16): xaa in position 16 is Ile, Leu or Val
  Variant (17)..(17): xaa in position 17 is Ala, Ser, Thr or Gly
  Variant (19)..(19): xaa in position 19 is Arg, Ile, Leu or Val
  Variant (20)..(20): xaa in position 20 is Ala, Gly or Leu
  Variant (21)..(21): xaa in position 21 is any amino acid
  Variant (22)..(22): xaa in position 22 is Glu, Ile, Gln, Thr or Arg
  Variant (23)..(23): xaa in position 23 is any amino acid
  Variant (24)..(24): xaa in position 24 is Leu, Met, Arg, Ala or Ile
  Variant (25)..(25): xaa in position 25 is Gly, Asn or Pro
  Variant (26)..(27): xaa in position 26 to 27 is any or no amino acid
  Variant (28)..(28): xaa in position 28 is Lys, Arg, Ala or Pro
  Variant (29)..(29): xaa in position 29 is Gly or Val
  Variant (30)..(30): xaa in position 30 is any amino acid
  Variant (31)..(31): xaa in position 31 is Tyr, Phe or no amino acid
  Variant (32)..(33): xaa in position 32 to 33 is any or no amino acid
  Variant (34)..(34): xaa in position 34 is Leu, Val, Ile or Cys
  Variant (35)..(35): xaa in position 35 is His, Asn, Ser or Asp
  Variant (37)..(37): xaa in position 37 is Asn, Met, Ile or Leu
  Variant (38)..(38): xaa in position 38 is any amino acid
  Variant (39)..(39): xaa in position 39 is His or Asp
  Variant (40)..(40): xaa in position 40 is Val or Leu
  Variant (42)..(42): xaa in position 42 is any amino acid
  Variant (43)..(43): xaa in position 43 is Ser, Ala, Cys, Gly or His
  Variant (46)..(46): xaa in position 46 is Thr, Ser or Gln
  Variant (48)..(48): xaa in position 48 is Asp or Cys
  Variant (49)..(49): xaa in position 49 is Ala, Val, Thr or Ser
  Variant (50)..(50): xaa in position 50 is Tyr, Phe or Ile
  Variant (51)..(51): xaa in position 51 is Pro or Ser
  Variant (52)..(52): xaa in position 52 is Thr, Ser or Ala
  Variant (53)..(53): xaa in position 53 is Ala, Gly, Val, Ser or Met
  Variant (54)..(54): xaa in position 54 is any amino acid
  Variant (55)..(55): xaa in position 55 is Arg, His, Lys or Asn
  Variant (56)..(56): xaa in position 56 is Ile, Leu, Val or Met
  Variant (57)..(57): xaa in position 57 is Ala, Gly, Ser or Thr

SEQ ID NO: 44521 - protein, 56 aa, Artificial sequence; identical to SEQ ID NO: 13507
  Variant (1)..(1): xaa in position 1 is Leu, Ile or Val
  Variant (2)..(2): xaa in position 2 is Lys or Arg
  Variant (3)..(3): xaa in position 3 is any amino acid
  Variant (4)..(4): xaa in position 4 is Gly or Ala
  Variant (7)..(7): xaa in position 7 is Gln or His
  Variant (8)..(8): xaa in position 8 is Leu, Thr or Met
  Variant (9)..(9): xaa in position 9 is Gln, Glu or Met
  Variant (11)..(11): xaa in position 11 is Ala or Gly
  Variant (12)..(12): xaa in position 12 is Val, Thr, Leu, Ala or Pro
  Variant (14)..(14): xaa in position 14 is Met, Ile, Leu or Val
  Variant (15)..(15): xaa in position 15 is Thr, Arg, Ser, Met or Leu
  Variant (16)..(16): xaa in position 16 is Leu, Val, Met, Phe or Tyr
  Variant (18)..(18): xaa in position 18 is any amino acid
  Variant (19)..(19): xaa in position 19 is Glu or Thr
  Variant (21)..(21): xaa in position 21 is any amino acid
  Variant (22)..(22): xaa in position 22 is Ala, Gly, Thr or Ser
  Variant (23)..(23): xaa in position 23 is Phe, Tyr or Trp
  Variant (24)..(26): xaa in position 24 to 26 is any amino acid
  Variant (27)..(27): xaa in position 27 is Leu, Val, Ile, Met or Phe
  Variant (28)..(29): xaa in position 28 to 29 is any amino acid
  Variant (30)..(30): xaa in position 30 is Asp, Glu, Gly, His or Asn
  Variant (31)..(33): xaa in position 31 to 33 is any amino acid
  Variant (34)..(34): xaa in position 34 is Leu, Ile, Val or Phe
  Variant (35)..(38): xaa in position 35 to 38 is any amino acid
  Variant (39)..(39): xaa in position 39 is Pro or no amino acid
  Variant (40)..(41): xaa in position 40 to 41 is any amino acid
  Variant (42)..(42): xaa in position 42 is Leu, Ile, Met, Val or Phe
  Variant (43)..(44): xaa in position 43 to 44 is any amino acid
  Variant (45)..(45): xaa in position 45 is Val, Ile, Leu or Met
  Variant (46)..(46): xaa in position 46 is Asn, Ala, Gly or Ser
  Variant (47)..(47): xaa in position 47 is Leu, Met, Ile or Gln
  Variant (49)..(49): xaa in position 49 is Ala or Gly
  Variant (50)..(50): xaa in position 50 is Thr or Ser
  Variant (51)..(51): xaa in position 51 is Ala or Val
  Variant (52)..(52): xaa in position 52 is Ile, Val or Ala
  Variant (55)..(55): xaa in position 55 is Gly, Arg, Ala, Ser or Lys
  Variant (56)..(56): xaa in position 56 is Leu, Ile, Val or Met

SEQ ID NO: 44522 - protein, 105 aa, Artificial sequence; identical to SEQ ID NO: 13508
  Variant (1)..(1): xaa in position 1 is Lys or Arg
  Variant (2)..(2): xaa in position 2 is any amino acid
  Variant (3)..(3): xaa in position 3 is Cys, Ala, Ser or Gly
  Variant (4)..(4): xaa in position 4 is Asn, Ser, His, Asp or Gly
  Variant (6)..(6): xaa in position 6 is Leu or Ile
  Variant (8)..(8): xaa in position 8 is Leu, Phe or Ile
  Variant (9)..(9): xaa in position 9 is Leu or Met
  Variant (10)..(10): xaa in position 10 is any amino acid
  Variant (14)..(15): xaa in position 14 to 15 is any amino acid
  Variant (16)..(16): xaa in position 16 is Gly or Val
  Variant (17)..(17): xaa in position 17 is Leu, Ile or Phe
  Variant (18)..(18): xaa in position 18 is any amino acid
  Variant (19)..(19): xaa in position 19 is Glu or Asp
  Variant (20)..(20): xaa in position 20 is Ile, Leu, Phe or Val
  Variant (21)..(21): xaa in position 21 is any amino acid
  Variant (22)..(22): xaa in position 22 is Leu, Val or Ile
  Variant (23)..(23): xaa in position 23 is Pro or Glu
  Variant (24)..(25): xaa in position 24 to 25 is any amino acid
  Variant (26)..(26): xaa in position 26 is Gln, Glu or Ala
  Variant (27)..(27): xaa in position 27 is Pro, Ala, Asn or Gln
  Variant (34)..(34): xaa in position 34 is Gly or Ala
  Variant (36)..(36): xaa in position 36 is Val, Ile or Tyr
  Variant (39)..(39): xaa in position 39 is Val, Thr or Ser
  Variant (40)..(40): xaa in position 40 is Ile, Met, Val, Gln or Leu
  Variant (41)..(41): xaa in position 41 is Pro, Cys, Ala or Ser
  Variant (43)..(43): xaa in position 43 is any amino acid
  Variant (44)..(44): xaa in position 44 is Val, Ile, Leu, Met or Thr
  Variant (45)..(45): xaa in position 45 is any amino acid
  Variant (46)..(46): xaa in position 46 is Gln, Met, Thr or Leu
  Variant (47)..(47): xaa in position 47 is Val, Ile, Thr, Ala or Cys
  Variant (48)..(48): xaa in position 48 is Cys, Ala or Ser
  Variant (49)..(49): xaa in position 49 is Phe, Tyr, Ala, His or Met
  Variant (50)..(50): xaa in position 50 is any amino acid
  Variant (51)..(51): xaa in position 51 is Val, Ile or Ala
  Variant (52)..(52): xaa in position 52 is any amino acid
  Variant (53)..(53): xaa in position 53 is Gly, Ala or Ser
  Variant (54)..(54): xaa in position 54 is any amino acid
  Variant (55)..(55): xaa in position 55 is Asp, His, Gln or Asn
  Variant (56)..(56): xaa in position 56 is any amino acid
  Variant (57)..(57): xaa in position 57 is Thr, Ala, Cys, Ser or Ile
  Variant (58)..(58): xaa in position 58 is Val, Ile or Leu
  Variant (59)..(60): xaa in position 59 to 60 is any amino acid
  Variant (61)..(61): xaa in position 61 is Ala, Gly or Ser
  Variant (62)..(62): xaa in position 62 is Ala, Ser, Gly, Val or Cys
  Variant (63)..(63): xaa in position 63 is Glu, Ser, Gln, Ala or Asp
  Variant (64)..(64): xaa in position 64 is any amino acid
  Variant (65)..(65): xaa in position 65 is Gly or Ala
  Variant (66)..(66): xaa in position 66 is Gln, His or Asn
  Variant (67)..(67): xaa in position 67 is Leu, Phe or Met
  Variant (68)..(68): xaa in position 68 is Gln or Glu
  Variant (71)..(71): xaa in position 71 is Val, Ala or Gln
  Variant (72)..(72): xaa in position 72 is Met or Phe
  Variant (73)..(73): xaa in position 73 is any amino acid
  Variant (75)..(75): xaa in position 75 is any amino acid
  Variant (76)..(76): xaa in position 76 is Ile, Leu, Met, Thr or Val
  Variant (77)..(79): xaa in position 77 to 79 is any amino acid
  Variant (80)..(80): xaa in position 80 is Leu, Met, Ile or Cys
  Variant (81)..(82): xaa in position 81 to 82 is any amino acid
  Variant (83)..(83): xaa in position 83 is Ser, Gly or Thr
  Variant (84)..(86): xaa in position 84 to 86 is any amino acid
  Variant (87)..(87): xaa in position 87 is Leu, Met or Ile
  Variant (88)..(89): xaa in position 88 to 89 is any amino acid
  Variant (90)..(90): xaa in position 90 is Ala, Gly, Thr or Val
  Variant (91)..(93): xaa in position 91 to 93 is any amino acid
  Variant (94)..(94): xaa in position 94 is Leu or Phe
  Variant (95)..(96): xaa in position 95 to 96 is any amino acid
  Variant (97)..(97): xaa in position 97 is any or no amino acid
  Variant (98)..(98): xaa in position 98 is Cys, Ala, Tyr or Leu
  Variant (99)..(99): xaa in position 99 is Ile, Val or Leu
  Variant (100)..(101): xaa in position 100 to 101 is any amino acid
  Variant (102)..(102): xaa in position 102 is Ile, Leu, Met or Val
  Variant (103)..(103): xaa in position 103 is any amino acid
  Variant (104)..(104): xaa in position 104 is Ala, Val, Ile, Pro or Gly
  Variant (105)..(105): xaa in position 105 is Asn, Asp or Gln

SEQ ID NO: 44523 - DNA, 1791 bp, Saccharomyces cerevisiae; identical to SEQ ID NO: 7248
  CDS (2)..(1504)

SEQ ID NO: 44524 - protein, 500 aa, Saccharomyces cerevisiae; identical to SEQ ID NO: 7249

SEQ ID NO: 44525 - DNA, 1461 bp, Vibrio cholerae; identical to SEQ ID NO: 7250
  CDS (1)..(1461)

SEQ ID NO: 44526 - protein, 486 aa, Vibrio cholerae; identical to SEQ ID NO: 7251

SEQ ID NO: 44527 - DNA, 1455 bp, Chlamydophila pneumoniae, Chlamydia pneumoniae; identical to SEQ ID NO: 7252
  CDS (1)..(1455)

SEQ ID NO: 44528 - protein, 484 aa, Chlamydophila pneumoniae, Chlamydia pneumoniae; identical to SEQ ID NO: 7253

SEQ ID NO: 44529 - DNA, 1419 bp, Clostridium acetobutylicum; identical to SEQ ID NO: 7254
  CDS (1)..(1419)

SEQ ID NO: 44530 - protein, 472 aa, Clostridium acetobutylicum; identical to SEQ ID NO: 7255

SEQ ID NO: 44531 - DNA, 1413 bp, Yersinia pestis; identical to SEQ ID NO: 7256
  CDS (1)..(1413)

SEQ ID NO: 44532 - protein, 470 aa, Yersinia pestis; identical to SEQ ID NO: 7257

SEQ ID NO: 44533 - DNA, 1413 bp, Salmonella enterica subsp. enterica serovar Typhi; identical to SEQ ID NO: 7258
  CDS (1)..(1413)

SEQ ID NO: 44534 - protein, 470 aa, Salmonella enterica subsp. enterica serovar Typhi; identical to SEQ ID NO: 7259

SEQ ID NO: 44535 - DNA, 1758 bp, Listeria innocua; identical to SEQ ID NO: 7260
  CDS (1)..(1758)

SEQ ID NO: 44536 - protein, 585 aa, Listeria innocua; identical to SEQ ID NO: 7261

SEQ ID NO: 44537 - DNA, 1431 bp, Nostoc sp. PCC 7120; identical to SEQ ID NO: 7262
  CDS (1)..(1431)

SEQ ID NO: 44538 - protein, 476 aa, Nostoc sp. PCC 7120; identical to SEQ ID NO: 7263

SEQ ID NO: 44539 - DNA, 1440 bp, Agrobacterium tumefaciens; identical to SEQ ID NO: 7264
  CDS (1)..(1440)

SEQ ID NO: 44540 - protein, 479 aa, Agrobacterium tumefaciens; identical to SEQ ID NO: 7265

SEQ ID NO: 44541 - DNA, 1770 bp, Nostoc sp. PCC 7120; identical to SEQ ID NO: 7266
  CDS (1)..(1770)

SEQ ID NO: 44542 - protein, 589 aa, Nostoc sp. PCC 7120; identical to SEQ ID NO: 7267

SEQ ID NO: 44543 - DNA, 1401 bp, Thermotoga maritima; identical to SEQ ID NO: 7268
  CDS (1)..(1401)

SEQ ID NO: 44544 - protein, 466 aa, Thermotoga maritima; identical to SEQ ID NO: 7269

SEQ ID NO: 44545 - DNA, 1377 bp, Aeropyrum pernix; identical to SEQ ID NO: 7270
  CDS (1)..(1377)

SEQ ID NO: 44546 - protein, 458 aa, Aeropyrum pernix; identical to SEQ ID NO: 7271

SEQ ID NO: 44547 - DNA, 1449 bp, Deinococcus radiodurans; identical to SEQ ID NO: 7272
  CDS (1)..(1449)

SEQ ID NO: 44548 - protein, 482 aa, Deinococcus radiodurans; identical to SEQ ID NO: 7273

SEQ ID NO: 44549 - DNA, 1446 bp, Vibrio cholerae; identical to SEQ ID NO: 7274
  CDS (1)..(1446)

SEQ ID NO: 44550 - protein, 481 aa, Vibrio cholerae; identical to SEQ ID NO: 7275

SEQ ID NO: 44551 - DNA, 1740 bp, Halobacterium sp. NRC-1; identical to SEQ ID NO: 7276
  CDS (1)..(1740)

SEQ ID NO: 44552 - protein, 579 aa, Halobacterium sp. NRC-1; identical to SEQ ID NO: 7277

SEQ ID NO: 44553 - DNA, 1437 bp, Haemophilus influenzae; identical to SEQ ID NO: 7278
  CDS (1)..(1437)

SEQ ID NO: 44554 - protein, 478 aa, Haemophilus influenzae; identical to SEQ ID NO: 7279

SEQ ID NO: 44555 - DNA, 1434 bp, Borrelia burgdorferi (Lyme disease spirochete); identical to SEQ ID NO: 7280
  CDS (1)..(1434)

SEQ ID NO: 44556 - protein, 477 aa, Borrelia burgdorferi (Lyme disease spirochete); identical to SEQ ID NO: 7281

SEQ ID NO: 44557 - DNA, 1413 bp, Vibrio cholerae; identical to SEQ ID NO: 7282
  CDS (1)..(1413)

SEQ ID NO: 44558 - protein, 470 aa, Vibrio cholerae; identical to SEQ ID NO: 7283

SEQ ID NO: 44559 - DNA, 1755 bp, Bacillus halodurans; identical to SEQ ID NO: 7284
  CDS (1)..(1755)

SEQ ID NO: 44560 - protein, 584 aa, Bacillus halodurans; identical to SEQ ID NO: 7285

SEQ ID NO: 44561 - DNA, 1443 bp, Buchnera sp; identical to SEQ ID NO: 7286
  CDS (1)..(1443)

SEQ ID NO: 44562 - protein, 480 aa, Buchnera sp; identical to SEQ ID NO: 7287

SEQ ID NO: 44563 - DNA, 1344 bp, Methanococcus jannaschii; identical to SEQ ID NO: 7288
  CDS (1)..(1344)

SEQ ID NO: 44564 - protein, 447 aa, Methanococcus jannaschii; identical to SEQ ID NO: 7289

SEQ ID NO: 44565 - DNA, 1413 bp, Escherichia coli; identical to SEQ ID NO: 7290
  CDS (1)..(1413)

SEQ ID NO: 44566 - protein, 470 aa, Escherichia coli; identical to SEQ ID NO: 7291

SEQ ID NO: 44567 - DNA, 1434 bp, Pseudomonas aeruginosa; identical to SEQ ID NO: 7292
  CDS (1)..(1434)

SEQ ID NO: 44568 - protein, 477 aa, Pseudomonas aeruginosa; identical to SEQ ID NO: 7293

SEQ ID NO: 44569 - DNA, 1509 bp, Lactococcus lactis subsp. lactis; identical to SEQ ID NO: 7294
  CDS (1)..(1509)

SEQ ID NO: 44570 - protein, 502 aa, Lactococcus lactis subsp. lactis; identical to SEQ ID NO: 7295

SEQ ID NO: 44571 - DNA, 1431 bp, Caulobacter crescentus; identical to SEQ ID NO: 7296
  CDS (1)..(1431)

SEQ ID NO: 44572 - protein, 476 aa, Caulobacter crescentus; identical to SEQ ID NO: 7297

SEQ ID NO: 44573 - DNA, 1452 bp, Pseudomonas aeruginosa; identical to SEQ ID NO: 7298
  CDS (1)..(1452)

SEQ ID NO: 44574 - protein, 483 aa, Pseudomonas aeruginosa; identical to SEQ ID NO: 7299

SEQ ID NO: 44575 - DNA, 1437 bp, Pyrococcus horikoshii; identical to SEQ ID NO: 7300
  CDS (1)..(1437)

SEQ ID NO: 44576 - protein, 478 aa, Pyrococcus horikoshii; identical to SEQ ID NO: 7301

SEQ ID NO: 44577 - DNA, 1443 bp, Campylobacter jejuni; identical to SEQ ID NO: 7302
  CDS (1)..(1443)

SEQ ID NO: 44578 - protein, 480 aa, Campylobacter jejuni; identical to SEQ ID NO: 7303

SEQ ID NO: 44579 - DNA, 1446 bp, Chlamydia muridarum, Chlamydia trachomatis MoPn; identical to SEQ ID NO: 7304
  CDS (1)..(1446)

SEQ ID NO: 44580 - protein, 481 aa, Chlamydia muridarum, Chlamydia trachomatis MoPn; identical to SEQ ID NO: 7305

SEQ ID NO: 44581 - DNA, 1704 bp, Arabidopsis thaliana (mouse-ear cress); identical to SEQ ID NO: 7306
  CDS (1)..(1704)

SEQ ID NO: 44582 - protein, 567 aa, Arabidopsis thaliana (mouse-ear cress); identical to SEQ ID NO: 7307

SEQ ID NO: 44583 - DNA, 1758 bp, Staphylococcus aureus; identical to SEQ ID NO: 7308
  CDS (1)..(1758)

SEQ ID NO: 44584 - protein, 585 aa, Staphylococcus aureus; identical to SEQ ID NO: 7309

SEQ ID NO: 44585 - DNA, 1758 bp, Bacillus subtilis; identical to SEQ ID NO: 7310
  CDS (1)..(1758)

SEQ ID NO: 44586 - protein, 585 aa, Bacillus subtilis; identical to SEQ ID NO: 7311

SEQ ID NO: 44587 - DNA, 1419 bp, Mycobacterium tuberculosis; identical to SEQ ID NO: 7312
  CDS (1)..(1419)

SEQ ID NO: 44588 - protein, 472 aa, Mycobacterium tuberculosis; identical to SEQ ID NO: 7313

SEQ ID NO: 44589 - DNA, 1458 bp, Chlamydia trachomatis; identical to SEQ ID NO: 7314
  CDS (1)..(1458)

SEQ ID NO: 44590 - protein, 485 aa, Chlamydia trachomatis; identical to SEQ ID NO: 7315

SEQ ID NO: 44591 - DNA, 1437 bp, Pyrococcus abyssi; identical to SEQ ID NO: 7316
  CDS (1)..(1437)

SEQ ID NO: 44592 - protein, 478 aa, Pyrococcus abyssi; identical to SEQ ID NO: 7317

SEQ ID NO: 44593 - DNA, 1473 bp, Neisseria meningitidis; identical to SEQ ID NO: 7318
  CDS (1)..(1473)

SEQ ID NO: 44594 - protein, 490 aa, Neisseria meningitidis; identical to SEQ ID NO: 7319

SEQ ID NO: 44595 - DNA, 1506 bp, Streptococcus pneumoniae; identical to SEQ ID NO: 7320
  CDS (1)..(1506)

SEQ ID NO: 44596 - protein, 501 aa, Streptococcus pneumoniae; identical to SEQ ID NO: 7321

SEQ ID NO: 44597 - DNA, 1422 bp, Clostridium acetobutylicum; identical to SEQ ID NO: 7322
  CDS (1)..(1422)

SEQ ID NO: 44598 - protein, 473 aa, Clostridium acetobutylicum; identical to SEQ ID NO: 7323

SEQ ID NO: 44599 - DNA, 1359 bp, Sulfolobus solfataricus; identical to SEQ ID NO: 7324
  CDS (1)..(1359)

SEQ ID NO: 44600 - protein, 452 aa, Sulfolobus solfataricus; identical to SEQ ID NO: 7325

SEQ ID NO: 44601 - DNA, 1428 bp, Mycoplasma pulmonis; identical to SEQ ID NO: 7326
  CDS (1)..(1428): transl_table=4

SEQ ID NO: 44602 - protein, 475 aa, Mycoplasma pulmonis; identical to SEQ ID NO: 7327

SEQ ID NO: 44603 - DNA, 1533 bp, Solanum tuberosum (potato); identical to SEQ ID NO: 7328
  CDS (1)..(1533)

SEQ ID NO: 44604 - protein, 510 aa, Solanum tuberosum (potato); identical to SEQ ID NO: 7329

SEQ ID NO: 44605 - DNA, 2083 bp, Bacillus psychrophilus; identical to SEQ ID NO: 7330
  CDS (271)..(2031)

SEQ ID NO: 44606 - protein, 586 aa, Bacillus psychrophilus; identical to SEQ ID NO: 7331

SEQ ID NO: 44607 - DNA, 2054 bp, Bacillus licheniformis; identical to SEQ ID NO: 7332
  CDS (132)..(1889)

SEQ ID NO: 44608 - protein, 585 aa, Bacillus licheniformis; identical to SEQ ID NO: 7333

SEQ ID NO: 44609 - DNA, 1617 bp, Trichoderma reesei; identical to SEQ ID NO: 7334
  CDS (1)..(1617)

SEQ ID NO: 44610 - protein, 538 aa, Trichoderma reesei; identical to SEQ ID NO: 7335

SEQ ID NO: 44611 - DNA, 1725 bp, Rattus norvegicus (Norway rat); identical to SEQ ID NO: 7336
  CDS (1)..(1725)

SEQ ID NO: 44612 - protein, 574 aa, Rattus norvegicus (Norway rat); identical to SEQ ID NO: 7337

SEQ ID NO: 44613 - DNA, 1596 bp, Trypanosoma brucei; identical to SEQ ID NO: 7338
  CDS (59)..(1558)

SEQ ID NO: 44614 - protein, 499 aa, Trypanosoma brucei; identical to SEQ ID NO: 7339

SEQ ID NO: 44615 - DNA, 1581 bp, Aspergillus niger; identical to SEQ ID NO: 7340
  CDS (1)..(1581)

SEQ ID NO: 44616 - protein, 526 aa, Aspergillus niger; identical to SEQ ID NO: 7341

SEQ ID NO: 44617 - DNA, 1636 bp, Bacillus stearothermophilus; identical to SEQ ID NO: 7342
  CDS (114)..(1598)

SEQ ID NO: 44618 - protein, 494 aa, Bacillus stearothermophilus; identical to SEQ ID NO: 7343

SEQ ID NO: 44619 - DNA, 1581 bp, Emericella nidulans, Aspergillus nidulans; identical to SEQ ID NO: 7344
  CDS (1)..(1581)

SEQ ID NO: 44620 - protein, 526 aa, Emericella nidulans, Aspergillus nidulans; identical to SEQ ID NO: 7345

SEQ ID NO: 44621 - DNA, 1847 bp, Nicotiana tabacum (common tobacco); identical to SEQ ID NO: 7346
  CDS (45)..(1571)

SEQ ID NO: 44622 - protein, 508 aa, Nicotiana tabacum (common tobacco); identical to SEQ ID NO: 7347

SEQ ID NO: 44623 - DNA, 2243 bp, Nicotiana tabacum (common tobacco); identical to SEQ ID NO: 7348
  CDS (318)..(2006)

SEQ ID NO: 44624 - protein, 562 aa, Nicotiana tabacum (common tobacco); identical to SEQ ID NO: 7349

SEQ ID NO: 44625 - DNA, 2044 bp, Xenopus sp. (clawed frog); identical to SEQ ID NO: 7350
  CDS (29)..(1612)

SEQ ID NO: 44626 - protein, 527 aa, Xenopus sp. (clawed frog); identical to SEQ ID NO: 7351

SEQ ID NO: 44627 - DNA, 2146 bp, Mus musculus (house mouse); identical to SEQ ID NO: 7352
  CDS (30)..(1625)

SEQ ID NO: 44628 - protein, 531 aa, Mus musculus (house mouse); identical to SEQ ID NO: 7353

SEQ ID NO: 44629 - DNA, 1596 bp, Homo sapiens (man); identical to SEQ ID NO: 7354
  CDS (1)..(1596)

SEQ ID NO: 44630 - protein, 531 aa, Homo sapiens (man) [sequence omitted]

SEQ ID NO: 44631 - DNA, 2113 bp, Saccharomyces cerevisiae; identical to SEQ ID NO: 7356
  CDS (437)..(1957)

SEQ ID NO: 44632 - protein, 506 aa, Saccharomyces cerevisiae; identical to SEQ ID NO: 7357

SEQ ID NO: 44633 - DNA, 1527 bp, Mycoplasma pneumoniae; identical to SEQ ID NO: 7358
  CDS (1)..(1527): transl_table=4

SEQ ID NO: 44634 - protein, 508 aa, Mycoplasma pneumoniae; identical to SEQ ID NO: 7359

SEQ ID NO: 44635 - DNA, 1452 bp, Synechocystis sp; identical to SEQ ID NO: 7360
  CDS (1)..(1452)

SEQ ID NO: 44636 - protein, 483 aa, Synechocystis sp; identical to SEQ ID NO: 7361

SEQ ID NO: 44637 - DNA, 1776 bp, Synechocystis sp; identical to SEQ ID NO: 7362
  CDS (1)..(1776)

SEQ ID NO: 44638 - protein, 591 aa, Synechocystis sp; identical to SEQ ID NO: 7363

SEQ ID NO: 44639 - DNA, 1494 bp, Arabidopsis thaliana (mouse-ear cress); identical to SEQ ID NO: 7364
  CDS (1)..(1494)

SEQ ID NO: 44640 - protein, 497 aa, Arabidopsis thaliana (mouse-ear cress); identical to SEQ ID NO: 7365

SEQ ID NO: 44641 - DNA, 2115 bp, Ricinus communis (castor bean); identical to SEQ ID NO: 7366
  CDS (118)..(1869)

SEQ ID NO: 44642 - protein, 583 aa, Ricinus communis (castor bean); identical to SEQ ID NO: 7367

SEQ ID NO: 44643 - DNA, 2022 bp, Ricinus communis (castor bean); identical to SEQ ID NO: 7368
  CDS (46)..(1527)

SEQ ID NO: 44644 - protein, 493 aa, Ricinus communis (castor bean); identical to SEQ ID NO: 7369

SEQ ID NO: 44645 - DNA, 1548 bp, Caenorhabditis elegans; identical to SEQ ID NO: 7370
  CDS (1)..(1548)

SEQ ID NO: 44646 - protein, 515 aa, Caenorhabditis elegans; identical to SEQ ID NO: 7371

SEQ ID NO: 44647 - DNA, 1437 bp, Streptomyces coelicolor; identical to SEQ ID NO: 7372
  CDS (1)..(1437)

SEQ ID NO: 44648 - protein, 478 aa, Streptomyces coelicolor; identical to SEQ ID NO: 7373

SEQ ID NO: 44649 - DNA, 1530 bp, Schizosaccharomyces pombe; identical to SEQ ID NO: 7374
  CDS (1)..(1530)

SEQ ID NO: 44650 - protein, 509 aa, Schizosaccharomyces pombe; identical to SEQ ID NO: 7375

SEQ ID NO: 44651 - DNA, 1584 bp, Arabidopsis thaliana (mouse-ear cress); identical to SEQ ID NO: 7376
  CDS (40)..(1584)

SEQ ID NO: 44652 - protein, 514 aa, Arabidopsis thaliana (mouse-ear cress); identical to SEQ ID NO: 7377

SEQ ID NO: 44653 - DNA, 1533 bp, Arabidopsis thaliana (mouse-ear cress); identical to SEQ ID NO: 7378
  CDS (1)..(1533)

SEQ ID NO: 44654 - protein, 510 aa, Arabidopsis thaliana (mouse-ear cress); identical to SEQ ID NO: 7379

SEQ ID NO: 44655 - DNA, 1479 bp, Arabidopsis thaliana (mouse-ear cress); identical to SEQ ID NO: 7380
  CDS (1)..(1479)

SEQ ID NO: 44656 - protein, 492 aa, Arabidopsis thaliana (mouse-ear cress); identical to SEQ ID NO: 7381

SEQ ID NO: 44657 - DNA, 1572 bp, synthetic construct; identical to SEQ ID NO: 7382
  CDS (1)..(1572)

SEQ ID NO: 44658 - protein, 523 aa, synthetic construct; identical to SEQ ID NO: 7383

SEQ ID NO: 44659 - DNA, 2795 bp, Corynebacterium glutamicum; identical to SEQ ID NO: 7384
  CDS (740)..(2173)

SEQ ID NO: 44660 - protein, 477 aa, Corynebacterium glutamicum; identical to SEQ ID NO: 7385

SEQ ID NO: 44661 - DNA, 2264 bp, Bacillus subtilis; identical to SEQ ID NO: 7386
  CDS (258)..(2012)

SEQ ID NO: 44662 - protein, 584 aa, Bacillus subtilis; identical to SEQ ID NO: 7387

SEQ ID NO: 44663 - DNA, 2569 bp, Zymomonas mobilis; identical to SEQ ID NO: 7388
  CDS (137)..(1564)

SEQ ID NO: 44664 - protein, 475 aa, Zymomonas mobilis; identical to SEQ ID NO: 7389

SEQ ID NO: 44665 - DNA, 1701 bp, Homo sapiens; identical to SEQ ID NO: 7390
  CDS (1)..(1701)

SEQ ID NO: 44666 - protein, 566 aa, Homo sapiens; identical to SEQ ID NO: 7391

SEQ ID NO: 44667 - DNA, 1515 bp, Debaryomyces hansenii; identical to SEQ ID NO: 7392
  CDS (1)..(1515)

SEQ ID NO: 44668 - protein, 504 aa, Debaryomyces hansenii; identical to SEQ ID NO: 7393

SEQ ID NO: 44669 - DNA, 1443 bp, Erwinia carotovora subsp; identical to SEQ ID NO: 7394
  CDS (1)..(1443)

SEQ ID NO: 44670 - protein, 480 aa, Erwinia carotovora subsp; identical to SEQ ID NO: 7395

SEQ ID NO: 44671 - DNA, 1179 bp, Mycoplasma arthritidis; identical to SEQ ID NO: 7396
  CDS (1)..(1179): transl-table=4

SEQ ID NO: 44672 - protein, 392 aa, Mycoplasma arthritidis; identical to SEQ ID NO: 7397

SEQ ID NO: 44673 - DNA, 1437 bp, Mesoplasma florum L1; identical to SEQ ID NO: 7398
  CDS (1)..(1437): transl_table=4

SEQ ID NO: 44674 - protein, 478 aa, Mesoplasma florum L1; identical to SEQ ID NO: 7399

SEQ ID NO: 44675 - DNA, 1506 bp, Candida glabrata; identical to SEQ ID NO: 7400
  CDS (1)..(1506)

SEQ ID NO: 44676 - protein, 501 aa, Candida glabrata; identical to SEQ ID NO: 7401

SEQ ID NO: 44677 - DNA, 1527 bp, Candida glabrata; identical to SEQ ID NO: 7402
  CDS (1)..(1527)

SEQ ID NO: 44678 - protein, 508 aa, Candida glabrata; identical to SEQ ID NO: 7403

SEQ ID NO: 44679 - DNA, 1071 bp, Bacillus thuringiensis serovar konkukian str; identical to SEQ ID NO: 7404
  CDS (1)..(1071)

SEQ ID NO: 44680 - protein, 356 aa, Bacillus thuringiensis serovar konkukian str; identical to SEQ ID NO: 7405

SEQ ID NO: 44681 - DNA, 1960 bp, Zea mays; identical to SEQ ID NO: 7406
  CDS (144)..(1673)

SEQ ID NO: 44682 - protein, 509 aa, Zea mays; identical to SEQ ID NO: 7407

SEQ ID NO: 44683 - DNA, 1452 bp, Mycoplasma mobile; identical to SEQ ID NO: 7408
  CDS (1)..(1452)

SEQ ID NO: 44684 - protein, 483 aa, Mycoplasma mobile; identical to SEQ ID NO: 7409

SEQ ID NO: 44685 - DNA, 1668 bp, Picrophilus torridus; identical to SEQ ID NO: 7410
  CDS (1)..(1668)

SEQ ID NO: 44686 - protein, 555 aa, Picrophilus torridus; identical to SEQ ID NO: 7411

SEQ ID NO: 44687 - DNA, 1536 bp, Plasmodium falciparum; identical to SEQ ID NO: 7412
  CDS (1)..(1536)

SEQ ID NO: 44688 - protein, 511 aa, Plasmodium falciparum; identical to SEQ ID NO: 7413

SEQ ID NO: 44689 - DNA, 1458 bp, Photobacterium profundum; identical to SEQ ID NO: 7414
  CDS (1)..(1458)

SEQ ID NO: 44690 - protein, 485 aa, Photobacterium profundum; identical to SEQ ID NO: 7415

SEQ ID NO: 44691 - DNA, 1413 bp, Photobacterium profundum; identical to SEQ ID NO: 7416
  CDS (1)..(1413)

SEQ ID NO: 44692 - protein, 470 aa, Photobacterium profundum; identical to SEQ ID NO: 7417

SEQ ID NO: 44693 - DNA, 1344 bp, Methanococcus maripaludis; identical to SEQ ID NO: 7418
  CDS (1)..(1344)

SEQ ID NO: 44694 - protein, 447 aa, Methanococcus maripaludis; identical to SEQ ID NO: 7419

SEQ ID NO: 44695 - DNA, 1797 bp, Parachlamydia sp; identical to SEQ ID NO: 7420
  CDS (1)..(1797)

SEQ ID NO: 44696 - protein, 598 aa, Parachlamydia sp; identical to SEQ ID NO: 7421

SEQ ID NO: 44697 - DNA, 1488 bp, Bdellovibrio bacteriovorus; identical to SEQ ID NO: 7422
  CDS (1)..(1488)

SEQ ID NO: 44698 - protein, 495 aa, Bdellovibrio bacteriovorus; identical to SEQ ID NO: 7423

SEQ ID NO: 44699 - DNA, 1437 bp, Mycoplasma mycoides; identical to SEQ ID NO: 7424
  CDS (1)..(1437): transl_table=4

SEQ ID NO: 44700 - protein, 478 aa, Mycoplasma mycoides; identical to SEQ ID NO: 7425

SEQ ID NO: 44701 - DNA, 1434 bp, Rhodopseudomonas palustris; identical to SEQ ID NO: 7426
  CDS (1)..(1434)

SEQ ID NO: 44702 - protein, 477 aa, Rhodopseudomonas palustris; identical to SEQ ID NO: 7427

SEQ ID NO: 44703 - DNA, 1422 bp, Corynebacterium diphtheriae; identical to SEQ ID NO: 7428
  CDS (1)..(1422)

SEQ ID NO: 44704 - protein, 473 aa, Corynebacterium diphtheriae; identical to SEQ ID NO: 7429

SEQ ID NO: 44705 - DNA, 3179 bp, Lactobacillus casei; identical to SEQ ID NO: 7430
  CDS (1307)..(3070)

SEQ ID NO: 44706 - protein, 587 aa, Lactobacillus casei; identical to SEQ ID NO: 7431

SEQ ID NO: 44707 - DNA, 1341 bp, Onion yellows phytoplasma; identical to SEQ ID NO: 7432
  CDS (1)..(1341)

SEQ ID NO: 44708 - protein, 446 aa, Onion yellows phytoplasma; identical to SEQ ID NO: 7433

SEQ ID NO: 44709 - DNA, 2023 bp, Oryza sativa; identical to SEQ ID NO: 7434
  CDS (324)..(1688)

SEQ ID NO: 44710 - protein, 454 aa, Oryza sativa; identical to SEQ ID NO: 7435

SEQ ID NO: 44711 - DNA, 1410 bp, Desulfovibrio vulgaris; identical to SEQ ID NO: 7436
  CDS (1)..(1410)

SEQ ID NO: 44712 - protein, 469 aa, Desulfovibrio vulgaris; identical to SEQ ID NO: 7437

SEQ ID NO: 44713 - DNA, 1425 bp, Thermus thermophilus; identical to SEQ ID NO: 7438
  CDS (1)..(1425)

SEQ ID NO: 44714 - protein, 474 aa, Thermus thermophilus; identical to SEQ ID NO: 7439

SEQ ID NO: 44715 - DNA, 1317 bp, Leptospira interrogans; identical to SEQ ID NO: 7440
  CDS (1)..(1317)

SEQ ID NO: 44716 - protein, 438 aa, Leptospira interrogans; identical to SEQ ID NO: 7441

SEQ ID NO: 44717 - DNA, 1758 bp, Bacillus cereus; identical to SEQ ID NO: 7442
  CDS (1)..(1758)

SEQ ID NO: 44718 - protein, 585 aa, Bacillus cereus; identical to SEQ ID NO: 7443

SEQ ID NO: 44719 - DNA, 1059 bp, Bacillus cereus; identical to SEQ ID NO: 7444
  CDS (1)..(1059): n means a or g or c or t/u, s means g or c

SEQ ID NO: 44720 - protein, 352 aa, Bacillus cereus; identical to SEQ ID NO: 7445
  Xaa in position 224 is unknown

SEQ ID NO: 44721 - DNA, 1416 bp, Treponema denticola; identical to SEQ ID NO: 7446
  CDS (1)..(1416)

SEQ ID NO: 44722 - protein, 471 aa, Treponema denticola; identical to SEQ ID NO: 7447

SEQ ID NO: 44723 - DNA, 1419 bp, Mycobacterium paratuberculosis; identical to SEQ ID NO: 7448
  CDS (1)..(1419)

SEQ ID NO: 44724 - protein, 472 aa, Mycobacterium paratuberculosis; identical to SEQ ID NO: 7449

SEQ ID NO: 44725 - DNA, 1443 bp, Geobacter sulfurreducens; identical to SEQ ID NO: 7450
  CDS (1)..(1443)

SEQ ID NO: 44726 - protein, 480 aa, Geobacter sulfurreducens; identical to SEQ ID NO: 7451

SEQ ID NO: 44727 - DNA, 1770 bp, Lactobacillus johnsonii; identical to SEQ ID NO: 7452
  CDS (1)..(1770)

SEQ ID NO: 44728 - protein, 589 aa, Lactobacillus johnsonii; identical to SEQ ID NO: 7453

SEQ ID NO: 44729 - DNA, 1506 bp, Ashbya gossypii; identical to SEQ ID NO: 7454
  CDS (1)..(1506)

SEQ ID NO: 44730 - protein, 501 aa, Ashbya gossypii; identical to SEQ ID NO: 7455

SEQ ID NO: 44731 - DNA, 1461 bp, Leptospira interrogans; identical to SEQ ID NO: 7456
  CDS (1)..(1461)

SEQ ID NO: 44732 - protein, 486 aa, Leptospira interrogans; identical to SEQ ID NO: 7457

SEQ ID NO: 44733 - DNA, 1519 bp, Bombyx mori; identical to SEQ ID NO: 7458
  CDS (130)..(1341)

SEQ ID NO: 44734 - protein, 403 aa, Bombyx mori; identical to SEQ ID NO: 7459

SEQ ID NO: 44735 - DNA, 1437 bp, Pyrococcus kodakaraensis; identical to SEQ ID NO: 7460
  CDS (1)..(1437)

SEQ ID NO: 44736 - protein, 478 aa, Pyrococcus kodakaraensis; identical to SEQ ID NO: 7461

SEQ ID NO: 44737 - DNA, 1503 bp, Streptococcus pyogenes; identical to SEQ ID NO: 7462
  CDS (1)..(1503)

SEQ ID NO: 44738 - protein, 500 aa, Streptococcus pyogenes; identical to SEQ ID NO: 7463

SEQ ID NO: 44739 - DNA, 1476 bp, Vibrio vulnificus; identical to SEQ ID NO: 7464
  CDS (1)..(1476)

SEQ ID NO: 44740 - protein, 491 aa, Vibrio vulnificus; identical to SEQ ID NO: 7465

SEQ ID NO: 44741 - DNA, 1449 bp, Vibrio vulnificus; identical to SEQ ID NO: 7466
  CDS (1)..(1449)

SEQ ID NO: 44742 - protein, 482 aa, Vibrio vulnificus; identical to SEQ ID NO: 7467

SEQ ID NO: 44743 - DNA, 1410 bp, Photorhabdus luminescens; identical to SEQ ID NO: 7468
  CDS (1)..(1410)

SEQ ID NO: 44744 - protein, 469 aa, Photorhabdus luminescens; identical to SEQ ID NO: 7469

SEQ ID NO: 44745 - DNA, 1443 bp, Photorhabdus luminescens; identical to SEQ ID NO: 7470
  CDS (1)..(1443)

SEQ ID NO: 44746 - protein, 480 aa, Photorhabdus luminescens; identical to SEQ ID NO: 7471

SEQ ID NO: 44747 - DNA, 1527 bp, Mycoplasma gallisepticum; identical to SEQ ID NO: 7472
  CDS (1)..(1527)

SEQ ID NO: 44748 - protein, 508 aa, Mycoplasma gallisepticum; identical to SEQ ID NO: 7473

SEQ ID NO: 44749 - DNA, 1818 bp, Gloeobacter violaceus; identical to SEQ ID NO: 7474
  CDS (1)..(1818)

SEQ ID NO: 44750 - protein, 605 aa, Gloeobacter violaceus; identical to SEQ ID NO: 7475

SEQ ID NO: 44751 - DNA, 1422 bp, Gloeobacter violaceus; identical to SEQ ID NO: 7476
  CDS (1)..(1422)

SEQ ID NO: 44752 - protein, 473 aa, Gloeobacter violaceus; identical to SEQ ID NO: 7477

SEQ ID NO: 44753 - DNA, 1407 bp, Chromobacterium violaceum; identical to SEQ ID NO: 7478
  CDS (1)..(1407)

SEQ ID NO: 44754 - protein, 468 aa, Chromobacterium violaceum; identical to SEQ ID NO: 7479

SEQ ID NO: 44755 - DNA, 1662 bp, Giardia lamblia ATCC 50803; identical to SEQ ID NO: 7480
  CDS (1)..(1662)

SEQ ID NO: 44756 - protein, 553 aa, Giardia lamblia ATCC 50803; identical to SEQ ID NO: 7481

SEQ ID NO: 44757 - DNA, 1536 bp, Plasmodium yoelii yoelii; identical to SEQ ID NO: 7482
  CDS (1)..(1536)

SEQ ID NO: 44758 - protein, 511 aa, Plasmodium yoelii yoelii; identical to SEQ ID NO: 7483

SEQ ID NO: 44759 - DNA, 1584 bp, Neurospora crassa; identical to SEQ ID NO: 7484
  CDS (1)..(1584)

SEQ ID NO: 44760 - protein, 527 aa, Neurospora crassa; identical to SEQ ID NO: 7485

SEQ ID NO: 44761 - DNA, 1455 bp, Synechococcus sp; identical to SEQ ID NO: 7486
  CDS (1)..(1455)

SEQ ID NO: 44762 - protein, 484 aa, Synechococcus sp; identical to SEQ ID NO: 7487

SEQ ID NO: 44763 - DNA, 1431 bp, Rhodopirellula baltica; identical to SEQ ID NO: 7488
  CDS (1)..(1431)

SEQ ID NO: 44764 - protein, 476 aa, Rhodopirellula baltica; identical to SEQ ID NO: 7489

SEQ ID NO: 44765 - DNA, 1791 bp, Prochlorococcus marinus subsp; identical to SEQ ID NO: 7490
  CDS (1)..(1791)

SEQ ID NO: 44766 - protein, 596 aa, Prochlorococcus marinus subsp; identical to SEQ ID NO: 7491

SEQ ID NO: 44767 - DNA, 1818 bp, Prochlorococcus marinus; identical to SEQ ID NO: 7492
  CDS (1)..(1818)

SEQ ID NO: 44768 - protein, 605 aa, Prochlorococcus marinus; identical to SEQ ID NO: 7493

SEQ ID NO: 44769 - DNA, 1785 bp, Prochlorococcus marinus; identical to SEQ ID NO: 7494
  CDS (1)..(1785)

SEQ ID NO: 44770 - protein, 594 aa, Prochlorococcus marinus; identical to SEQ ID NO: 7495

SEQ ID NO: 44771 - DNA, 1440 bp, Haemophilus ducreyi; identical to SEQ ID NO: 7496
  CDS (1)..(1440)

SEQ ID NO: 44772 - protein, 479 aa, Haemophilus ducreyi; identical to SEQ ID NO: 7497

SEQ ID NO: 44773 - DNA, 1467 bp, Candidatus Blochmannia floridanus; identical to SEQ ID NO: 7498
  CDS (1)..(1467)

SEQ ID NO: 44774 - protein, 488 aa, Candidatus Blochmannia floridanus; identical to SEQ ID NO: 7499

SEQ ID NO: 44775 - DNA, 1443 bp, Bordetella parapertussis; identical to SEQ ID NO: 7500
  CDS (1)..(1443)

SEQ ID NO: 44776 - protein, 480 aa, Bordetella parapertussis; identical to SEQ ID NO: 7501

SEQ ID NO: 44777 - DNA, 2002 bp, Oryza sativa; identical to SEQ ID NO: 7502
  CDS (113)..(1648)

SEQ ID NO: 44778 - protein, 511 aa, Oryza sativa; identical to SEQ ID NO: 7503

SEQ ID NO: 44779 - DNA, 1071 bp, Bacillus cereus; identical to SEQ ID NO: 7504
  CDS (1)..(1071)

SEQ ID NO: 44780 - protein, 356 aa, Bacillus cereus; identical to SEQ ID NO: 7505

SEQ ID NO: 44781 - DNA, 1059 bp, Bacillus anthracis; identical to SEQ ID NO: 7506
  CDS (1)..(1059)

SEQ ID NO: 44782 - protein, 352 aa, Bacillus anthracis; identical to SEQ ID NO: 7507

SEQ ID NO: 44783 - DNA, 1446 bp, Chlamydophila caviae; identical to SEQ ID NO: 7508
  CDS (1)..(1446)

SEQ ID NO: 44784 - protein, 481 aa, Chlamydophila caviae; identical to SEQ ID NO: 7509

SEQ ID NO: 44785 - DNA, 1437 bp, Streptomyces avermitilis; identical to SEQ ID NO: 7510
  CDS (1)..(1437)

SEQ ID NO: 44786 - protein, 478 aa, Streptomyces avermitilis; identical to SEQ ID NO: 7511

SEQ ID NO: 44787 - DNA, 1431 bp, Streptomyces avermitilis; identical to SEQ ID NO: 7512
  CDS (1)..(1431)

SEQ ID NO: 44788 - protein, 476 aa, Streptomyces avermitilis; identical to SEQ ID NO: 7513

SEQ ID NO: 44789 - DNA, 1491 bp, Nitrosomonas europaea; identical to SEQ ID NO: 7514
  CDS (1)..(1491)

SEQ ID NO: 44790 - protein, 496 aa, Nitrosomonas europaea; identical to SEQ ID NO: 7515

SEQ ID NO: 44791 - DNA, 1758 bp, Enterococcus faecalis; identical to SEQ ID NO: 7516
  CDS (1)..(1758)

SEQ ID NO: 44792 - protein, 585 aa, Enterococcus faecalis; identical to SEQ ID NO: 7517

SEQ ID NO: 44793 - DNA, 1434 bp, Coxiella burnetii; identical to SEQ ID NO: 7518
  CDS (1)..(1434)

SEQ ID NO: 44794 - protein, 477 aa, Coxiella burnetii; identical to SEQ ID NO: 7519

SEQ ID NO: 44795 - DNA, 1422 bp, Tropheryma whipplei; identical to SEQ ID NO: 7520
  CDS (1)..(1422)

SEQ ID NO: 44796 - protein, 473 aa, Tropheryma whipplei; identical to SEQ ID NO: 7521

SEQ ID NO: 44797 - DNA, 1416 bp, Tropheryma whipplei; identical to SEQ ID NO: 7522
  CDS (1)..(1416)

SEQ ID NO: 44798 - protein, 471 aa, Tropheryma whipplei; identical to SEQ ID NO: 7523

SEQ ID NO: 44799 - DNA, 1584 bp, Shigella flexneri; identical to SEQ ID NO: 7524
  CDS (1)..(1584)

SEQ ID NO: 44800 - protein, 527 aa, Shigella flexneri; identical to SEQ ID NO: 7525

SEQ ID NO: 44801 - DNA, 1425 bp, Microbispora rosea subsp; identical to SEQ ID NO: 7526
  CDS (1)..(1425)

SEQ ID NO: 44802 - protein, 474 aa, Microbispora rosea subsp; identical to SEQ ID NO: 7527

SEQ ID NO: 44803 - DNA, 1806 bp, Oryza sativa; identical to SEQ ID NO: 7528
  CDS (75)..(1721)

SEQ ID NO: 44804 - protein, 548 aa, Oryza sativa; identical to SEQ ID NO: 7529

SEQ ID NO: 44805 - DNA, 1506 bp, Kluyveromyces lactis; identical to SEQ ID NO: 7530
  CDS (1)..(1506)

SEQ ID NO: 44806 - protein, 501 aa, Kluyveromyces lactis; identical to SEQ ID NO: 7531

SEQ ID NO: 44807 - DNA, 1506 bp, Saccharomyces kluyveri; identical to SEQ ID NO: 7532
  CDS (1)..(1506)

SEQ ID NO: 44808 - protein, 501 aa, Saccharomyces kluyveri; identical to SEQ ID NO: 7533

SEQ ID NO: 44809 - DNA, 1506 bp, Saccharomyces castellii; identical to SEQ ID NO: 7534
  CDS (1)..(1506)

SEQ ID NO: 44810 - protein, 501 aa, Saccharomyces castellii; identical to SEQ ID NO: 7535

SEQ ID NO: 44811 - DNA, 1521 bp, Saccharomyces bayanus; identical to SEQ ID NO: 7536
  CDS (1)..(1521)

SEQ ID NO: 44812 - protein, 506 aa, Saccharomyces bayanus; identical to SEQ ID NO: 7537

SEQ ID NO: 44813 - DNA, 1467 bp, Xylella fastidiosa; identical to SEQ ID NO: 7538
  CDS (1)..(1467)

SEQ ID NO: 44814 - protein, 488 aa, Xylella fastidiosa; identical to SEQ ID NO: 7539

SEQ ID NO: 44815 - DNA, 1479 bp, Vibrio parahaemolyticus; identical to SEQ ID NO: 7540
  CDS (1)..(1479)

SEQ ID NO: 44816 - protein, 492 aa, Vibrio parahaemolyticus; identical to SEQ ID NO: 7541

SEQ ID NO: 44817 - DNA, 1443 bp, Vibrio parahaemolyticus; identical to SEQ ID NO: 7542
  CDS (1)..(1443)

SEQ ID NO: 44818 - protein, 480 aa, Vibrio parahaemolyticus; identical to SEQ ID NO: 7543

SEQ ID NO: 44819 - DNA, 1413 bp, Vibrio parahaemolyticus; identical to SEQ ID NO: 7544
  CDS (1)..(1413)

SEQ ID NO: 44820 - protein, 470 aa, Vibrio parahaemolyticus; identical to SEQ ID NO: 7545

SEQ ID NO: 44821 - DNA, 1452 bp, Pseudomonas syringae; identical to SEQ ID NO: 7546
  CDS (1)..(1452)

SEQ ID NO: 44822 - protein, 483 aa, Pseudomonas syringae; identical to SEQ ID NO: 7547

SEQ ID NO: 44823 - DNA, 1416 bp, Pseudomonas putida; identical to SEQ ID NO: 7548
  CDS (1)..(1416)

SEQ ID NO: 44824 - protein, 471 aa, Pseudomonas putida; identical to SEQ ID NO: 7549

SEQ ID NO: 44825 - DNA, 1455 bp, Pseudomonas putida; identical to SEQ ID NO: 7550
  CDS (1)..(1455)

SEQ ID NO: 44826 - protein, 484 aa, Pseudomonas putida; identical to SEQ ID NO: 7551

SEQ ID NO: 44827 - DNA, 1761 bp, Lactobacillus plantarum; identical to SEQ ID NO: 7552
  CDS (1)..(1761)

SEQ ID NO: 44828 - protein, 586 aa, Lactobacillus plantarum; identical to SEQ ID NO: 7553

SEQ ID NO: 44829 - DNA, 1755 bp, Clostridium tetani; identical to SEQ ID NO: 7554
  CDS (1)..(1755)

SEQ ID NO: 44830 - protein, 584 aa, Clostridium tetani; identical to SEQ ID NO: 7555

SEQ ID NO: 44831 - DNA, 1437 bp, Bradyrhizobium japonicum; identical to SEQ ID NO: 7556
  CDS (1)..(1437)

SEQ ID NO: 44832 - protein, 478 aa, Bradyrhizobium japonicum; identical to SEQ ID NO: 7557

SEQ ID NO: 44833 - DNA, 1458 bp, Bacteroides thetaiotaomicron; identical to SEQ ID NO: 7558
  CDS (1)..(1458)

SEQ ID NO: 44834 - protein, 485 aa, Bacteroides thetaiotaomicron; identical to SEQ ID NO: 7559

SEQ ID NO: 44835 - DNA, 2797 bp, Staphylococcus epidermidis; identical to SEQ ID NO: 7560
  CDS (854)..(2611)

SEQ ID NO: 44836 - protein, 585 aa, Staphylococcus epidermidis; identical to SEQ ID NO: 7561

SEQ ID NO: 44837 - DNA, 1440 bp, Wigglesworthia glossinidia brevipalpis; identical to SEQ ID NO: 7562
  CDS (1)..(1440)

SEQ ID NO: 44838 - protein, 479 aa, Wigglesworthia glossinidia brevipalpis; identical to SEQ ID NO: 7563

SEQ ID NO: 44839 - DNA, 1413 bp, Vibrio vulnificus; identical to SEQ ID NO: 7564
  CDS (1)..(1413)

SEQ ID NO: 44840 - protein, 470 aa, Vibrio vulnificus; identical to SEQ ID NO: 7565

SEQ ID NO: 44841 - DNA, 1785 bp, Synechococcus elongatus; identical to SEQ ID NO: 7566
  CDS (1)..(1785)

SEQ ID NO: 44842 - protein, 594 aa, Synechococcus elongatus; identical to SEQ ID NO: 7567

SEQ ID NO: 44843 - DNA, 1503 bp, Streptococcus mutans; identical to SEQ ID NO: 7568
  CDS (1)..(1503)

SEQ ID NO: 44844 - protein, 500 aa, Streptococcus mutans; identical to SEQ ID NO: 7569

SEQ ID NO: 44845 - DNA, 1503 bp, Streptococcus agalactiae; identical to SEQ ID NO: 7570
  CDS (1)..(1503)

SEQ ID NO: 44846 - protein, 500 aa, Streptococcus agalactiae; identical to SEQ ID NO: 7571

SEQ ID NO: 44847 - DNA, 1440 bp, Shewanella oneidensis; identical to SEQ ID NO: 7572
  CDS (1)..(1440)

SEQ ID NO: 44848 - protein, 479 aa, Shewanella oneidensis; identical to SEQ ID NO: 7573

SEQ ID NO: 44849 - DNA, 1761 bp, Oceanobacillus iheyensis; identical to SEQ ID NO: 7574
  CDS (1)..(1761)

SEQ ID NO: 44850 - protein, 586 aa, Oceanobacillus iheyensis; identical to SEQ ID NO: 7575

SEQ ID NO: 44851 - DNA, 1497 bp, Mycoplasma penetrans; identical to SEQ ID NO: 7576
  CDS (1)..(1497): transl_table=4

SEQ ID NO: 44852 - protein, 498 aa, Mycoplasma penetrans; identical to SEQ ID NO: 7577

SEQ ID NO: 44853 - DNA, 1584 bp, Escherichia coli O6; identical to SEQ ID NO: 7578
  CDS (1)..(1584)

SEQ ID NO: 44854 - protein, 527 aa, Escherichia coli O6; identical to SEQ ID NO: 7579

SEQ ID NO: 44855 - DNA, 1437 bp, Brucella suis; identical to SEQ ID NO: 7580
  CDS (1)..(1437)

SEQ ID NO: 44856 - protein, 478 aa, Brucella suis; identical to SEQ ID NO: 7581

SEQ ID NO: 44857 - DNA, 1530 bp, Bifidobacterium longum; identical to SEQ ID NO: 7582
  CDS (1)..(1530)

SEQ ID NO: 44858 - protein, 509 aa, Bifidobacterium longum; identical to SEQ ID NO: 7583

SEQ ID NO: 44859 - DNA, 1890 bp, Lactobacillus delbrueckii; identical to SEQ ID NO: 7584
  CDS (1)..(1770)

SEQ ID NO: 44860 - protein, 589 aa, Lactobacillus delbrueckii; identical to SEQ ID NO: 7585

SEQ ID NO: 44861 - DNA, 2043 bp, Stigmatella aurantiaca; identical to SEQ ID NO: 7586
  CDS (463)..(1896)

SEQ ID NO: 44862 - protein, 477 aa, Stigmatella aurantiaca; identical to SEQ ID NO: 7587

SEQ ID NO: 44863 - DNA, 1584 bp, Arabidopsis thaliana; identical to SEQ ID NO: 7588
  CDS (1)..(1584)

SEQ ID NO: 44864 - protein, 527 aa, Arabidopsis thaliana; identical to SEQ ID NO: 7589

SEQ ID NO: 44865 - DNA, 1437 bp, Bartonella henselae; identical to SEQ ID NO: 7590
  CDS (1)..(1437)

SEQ ID NO: 44866 - protein, 478 aa, Bartonella henselae; identical to SEQ ID NO: 7591

SEQ ID NO: 44867 - DNA, 1533 bp, Glycine max; identical to SEQ ID NO: 7592
  CDS (1)..(1533)

SEQ ID NO: 44868 - protein, 510 aa, Glycine max; identical to SEQ ID NO: 7593

SEQ ID NO: 44869 - DNA, 1536 bp, Glycine max; identical to SEQ ID NO: 7594
  CDS (1)..(1536)

SEQ ID NO: 44870 - protein, 511 aa, Glycine max; identical to SEQ ID NO: 7595

SEQ ID NO: 44871 - DNA, 1527 bp, Xanthomonas campestris; identical to SEQ ID NO: 7596
  CDS (1)..(1527)

SEQ ID NO: 44872 - protein, 508 aa, Xanthomonas campestris; identical to SEQ ID NO: 7597

SEQ ID NO: 44873 - DNA, 1506 bp, Xanthomonas axonopodis; identical to SEQ ID NO: 7598
  CDS (1)..(1506)

SEQ ID NO: 44874 - protein, 501 aa, Xanthomonas axonopodis; identical to SEQ ID NO: 7599

SEQ ID NO: 44875 - DNA, 1434 bp, Methanosarcina mazei; identical to SEQ ID NO: 7600
  CDS (1)..(1434)

SEQ ID NO: 44876 - protein, 477 aa, Methanosarcina mazei; identical to SEQ ID NO: 7601

SEQ ID NO: 44877 - DNA, 1752 bp, Thermoanaerobacter tengcongensis; identical to SEQ ID NO: 7602
  CDS (1)..(1752)

SEQ ID NO: 44878 - protein, 583 aa, Thermoanaerobacter tengcongensis; identical to SEQ ID NO: 7603

SEQ ID NO: 44879 - DNA, 1428 bp, Fusobacterium nucleatum; identical to SEQ ID NO: 7604
  CDS (1)..(1428)

SEQ ID NO: 44880 - protein, 475 aa, Fusobacterium nucleatum; identical to SEQ ID NO: 7605

SEQ ID NO: 44881 - DNA, 1713 bp, Oryza sativa; identical to SEQ ID NO: 7606
  CDS (1)..(1713)

SEQ ID NO: 44882 - protein, 570 aa, Oryza sativa; identical to SEQ ID NO: 7607

SEQ ID NO: 44883 - DNA, 1872 bp, Oryza sativa; identical to SEQ ID NO: 7608
  CDS (1)..(1872)

SEQ ID NO: 44884 - protein, 623 aa, Oryza sativa; identical to SEQ ID NO: 7609

SEQ ID NO: 44885 - DNA, 1560 bp, Encephalitozoon cuniculi; identical to SEQ ID NO: 7610
  CDS (1)..(1560)

SEQ ID NO: 44886 - protein, 519 aa, Encephalitozoon cuniculi; identical to SEQ ID NO: 7611

SEQ ID NO: 44887 - DNA, 1470 bp, Methanosarcina acetivorans; identical to SEQ ID NO: 7612
  CDS (1)..(1470)

SEQ ID NO: 44888 - protein, 489 aa, Methanosarcina acetivorans; identical to SEQ ID NO: 7613

SEQ ID NO: 44889 - DNA, 1434 bp, Pyrococcus furiosus; identical to SEQ ID NO: 7614
  CDS (1)..(1434)

SEQ ID NO: 44890 - protein, 477 aa, Pyrococcus furiosus; identical to SEQ ID NO: 7615

SEQ ID NO: 44891 - DNA, 1404 bp, Clostridium perfringens; identical to SEQ ID NO: 7616
  CDS (1)..(1404)

SEQ ID NO: 44892 - protein, 467 aa, Clostridium perfringens; identical to SEQ ID NO: 7617

SEQ ID NO: 44893 - DNA, 1419 bp, Ralstonia solanacearum; identical to SEQ ID NO: 7618
  CDS (1)..(1419)

SEQ ID NO: 44894 - protein, 472 aa, Ralstonia solanacearum; identical to SEQ ID NO: 7619

SEQ ID NO: 44895 - DNA, 1440 bp, Ralstonia solanacearum; identical to SEQ ID NO: 7620
  CDS (1)..(1440)

SEQ ID NO: 44896 - protein, 479 aa, Ralstonia solanacearum; identical to SEQ ID NO: 7621

SEQ ID NO: 44897 - DNA, 1443 bp, Salmonella typhimurium; identical to SEQ ID NO: 7622
  CDS (1)..(1443)

SEQ ID NO: 44898 - protein, 480 aa, Salmonella typhimurium; identical to SEQ ID NO: 7623

SEQ ID NO: 44899 - DNA, 1386 bp, Pyrobaculum aerophilum; identical to SEQ ID NO: 7624
  CDS (1)..(1386)

SEQ ID NO: 44900 - protein, 461 aa, Pyrobaculum aerophilum; identical to SEQ ID NO: 7625

SEQ ID NO: 44901 - DNA, 1440 bp, Rhizobium meliloti; identical to SEQ ID NO: 7626
  CDS (1)..(1440)

SEQ ID NO: 44902 - protein, 479 aa, Rhizobium meliloti; identical to SEQ ID NO: 7627

SEQ ID NO: 44903 - DNA, 1745 bp, Mastigamoeba balamuthi; identical to SEQ ID NO: 7628
  CDS (36)..(1541)

SEQ ID NO: 44904 - protein, 501 aa, Mastigamoeba balamuthi; identical to SEQ ID NO: 7629

SEQ ID NO: 44905 - DNA, 2207 bp, Toxoplasma gondii; identical to SEQ ID NO: 7630
  CDS (225)..(1820)

SEQ ID NO: 44906 - protein, 531 aa, Toxoplasma gondii; identical to SEQ ID NO: 7631

SEQ ID NO: 44907 - DNA, 1317 bp, Sulfolobus tokodaii; identical to SEQ ID NO: 7632
  CDS (1)..(1317)

SEQ ID NO: 44908 - protein, 438 aa, Sulfolobus tokodaii; identical to SEQ ID NO: 7633

SEQ ID NO: 44909 - DNA, 1626 bp, Thermoplasma volcanium; identical to SEQ ID NO: 7634
  CDS (1)..(1626)

SEQ ID NO: 44910 - protein, 541 aa, Thermoplasma volcanium; identical to SEQ ID NO: 7635

SEQ ID NO: 44911 - DNA, 1437 bp, Rhizobium loti; identical to SEQ ID NO: 7636
  CDS (1)..(1437)

SEQ ID NO: 44912 - protein, 478 aa, Rhizobium loti; identical to SEQ ID NO: 7637

SEQ ID NO: 44913 - DNA, 1440 bp, Pasteurella multocida; identical to SEQ ID NO: 7638
  CDS (1)..(1440)

SEQ ID NO: 44914 - protein, 479 aa, Pasteurella multocida; identical to SEQ ID NO: 7639

SEQ ID NO: 44915 - DNA, 1880 bp, Arabidopsis thaliana; identical to SEQ ID NO: 7640
  CDS (126)..(1658)

SEQ ID NO: 44916 - protein, 510 aa, Arabidopsis thaliana; identical to SEQ ID NO: 7641

SEQ ID NO: 44917 - DNA, 1517 bp, Arabidopsis thaliana; identical to SEQ ID NO: 7642
  CDS (1)..(1497)

SEQ ID NO: 44918 - protein, 498 aa, Arabidopsis thaliana; identical to SEQ ID NO: 7643

SEQ ID NO: 44919 - DNA, 1564 bp, Arabidopsis thaliana; identical to SEQ ID NO: 7644
  CDS (1)..(1533)

SEQ ID NO: 44920 - protein, 510 aa, Arabidopsis thaliana; identical to SEQ ID NO: 7645

SEQ ID NO: 44921 - DNA, 1581 bp, Aspergillus oryzae; identical to SEQ ID NO: 7646
  CDS (1)..(1581)

SEQ ID NO: 44922 - protein, 526 aa, Aspergillus oryzae; identical to SEQ ID NO: 7647

SEQ ID NO: 44923 - DNA, 1431 bp, Streptomyces coelicolor; identical to SEQ ID NO: 7648
  CDS (1)..(1431)

SEQ ID NO: 44924 - protein, 476 aa, Streptomyces coelicolor; identical to SEQ ID NO: 7649

SEQ ID NO: 44925 - DNA, 1503 bp, Streptococcus thermophilus; identical to SEQ ID NO: 7650
  CDS (1)..(1503)

SEQ ID NO: 44926 - protein, 500 aa, Streptococcus thermophilus; identical to SEQ ID NO: 7651

SEQ ID NO: 44927 - DNA, 2150 bp, Pseudomonas hydrogenothermophila; identical to SEQ ID NO: 7652
  CDS (16)..(1437)

SEQ ID NO: 44928 - protein, 473 aa, Pseudomonas hydrogenothermophila; identical to SEQ ID NO: 7653

SEQ ID NO: 44929 - DNA, 1413 bp, Selenomonas ruminantium; identical to SEQ ID NO: 7654
  CDS (1)..(1413)

SEQ ID NO: 44930 - protein, 470 aa, Selenomonas ruminantium; identical to SEQ ID NO: 7655

SEQ ID NO: 44931 - DNA, 1822 bp, Arabidopsis thaliana; identical to SEQ ID NO: 7656
  CDS (1)..(1791)

SEQ ID NO: 44932 - protein, 596 aa, Arabidopsis thaliana; identical to SEQ ID NO: 7657

SEQ ID NO: 44933 - DNA, 1494 bp, Arabidopsis thaliana; identical to SEQ ID NO: 7658
  CDS (1)..(1494)

SEQ ID NO: 44934 - protein, 497 aa, Arabidopsis thaliana; identical to SEQ ID NO: 7659

SEQ ID NO: 44935 - DNA, 1920 bp, Lilium longiflorum; identical to SEQ ID NO: 7660
  CDS (145)..(1677)

SEQ ID NO: 44936 - protein, 510 aa, Lilium longiflorum; identical to SEQ ID NO: 7661

SEQ ID NO: 44937 - DNA, 1413 bp, Vibrio marinus; identical to SEQ ID NO: 7662
  CDS (1)..(1413)

SEQ ID NO: 44938 - protein, 470 aa, Vibrio marinus; identical to SEQ ID NO: 7663

SEQ ID NO: 44939 - DNA, 1979 bp, Oryza sativa; identical to SEQ ID NO: 7664
  CDS (224)..(1747)

SEQ ID NO: 44940 - protein, 507 aa, Oryza sativa; identical to SEQ ID NO: 7665

SEQ ID NO: 44941 - DNA, 1533 bp, Arabidopsis thaliana; identical to SEQ ID NO: 7666
  CDS (1)..(1533)

SEQ ID NO: 44942 - protein, 510 aa, Arabidopsis thaliana; identical to SEQ ID NO: 7667

SEQ ID NO: 44943 - DNA, 2235 bp, Drosophila melanogaster; identical to SEQ ID NO: 7668
  CDS (1)..(2235)

SEQ ID NO: 44944 - protein, 744 aa, Drosophila melanogaster; identical to SEQ ID NO: 7669

SEQ ID NO: 44945 - DNA, 3033 bp, Drosophila melanogaster; identical to SEQ ID NO: 7670
  CDS (1)..(3033)

SEQ ID NO: 44946 - protein, 1010 aa, Drosophila melanogaster; identical to SEQ ID NO: 7671

SEQ ID NO: 44947 - DNA, 1814 bp, Drosophila melanogaster; identical to SEQ ID NO: 7672
  CDS (83)..(1747)

SEQ ID NO: 44948 - protein, 554 aa, Drosophila melanogaster; identical to SEQ ID NO: 7673

SEQ ID NO: 44949 - DNA, 1425 bp, Agrobacterium vitis; identical to SEQ ID NO: 7674
  CDS (1)..(1425)

SEQ ID NO: 44950 - protein, 474 aa, Agrobacterium vitis; identical to SEQ ID NO: 7675

SEQ ID NO: 44951 - DNA, 1449 bp, Agrobacterium vitis; identical to SEQ ID NO: 7676
  CDS (1)..(1449)

SEQ ID NO: 44952 - protein, 482 aa, Agrobacterium vitis; identical to SEQ ID NO: 7677

SEQ ID NO: 44953 - DNA, 2234 bp, Nicotiana tabacum; identical to SEQ ID NO: 7678
  CDS (59)..(1840)

SEQ ID NO: 44954 - protein, 593 aa, Nicotiana tabacum; identical to SEQ ID NO: 7679

SEQ ID NO: 44955 - DNA, 1599 bp, Agaricus bisporus; identical to SEQ ID NO: 7680
  CDS (1)..(1599)

SEQ ID NO: 44956 - protein, 532 aa, Agaricus bisporus; identical to SEQ ID NO: 7681

SEQ ID NO: 44957 - DNA, 1446 bp, Buchnera aphidicola; identical to SEQ ID NO: 7682
  CDS (1)..(1446)

SEQ ID NO: 44958 - protein, 481 aa, Buchnera aphidicola; identical to SEQ ID NO: 7683

SEQ ID NO: 44959 - DNA, 1440 bp, Buchnera aphidicola; identical to SEQ ID NO: 7684
  CDS (1)..(1440)

SEQ ID NO: 44960 - protein, 479 aa, Buchnera aphidicola; identical to SEQ ID NO: 7685

SEQ ID NO: 44961 - DNA, 2354 bp, Gallus gallus; identical to SEQ ID NO: 7686
  CDS (81)..(1673)

SEQ ID NO: 44962 - protein, 530 aa, Gallus gallus; identical to SEQ ID NO: 7687

SEQ ID NO: 44963 - DNA, 1425 bp, Clostridium perfringens; identical to SEQ ID NO: 7688
  CDS (1)..(1425)

SEQ ID NO: 44964 - protein, 474 aa, Clostridium perfringens; identical to SEQ ID NO: 7689

SEQ ID NO: 44965 - DNA, 1425 bp, Corynebacterium efficiens; identical to SEQ ID NO: 7690
  CDS (1)..(1425)

SEQ ID NO: 44966 - protein, 474 aa, Corynebacterium efficiens; identical to SEQ ID NO: 7691

SEQ ID NO: 44967 - DNA, 2084 bp, Drosophila melanogaster; identical to SEQ ID NO: 7692
  CDS (229)..(1830)

SEQ ID NO: 44968 - protein, 533 aa, Drosophila melanogaster; identical to SEQ ID NO: 7693

SEQ ID NO: 44969 - DNA, 1901 bp, Eimeria tenella; identical to SEQ ID NO: 7694
  CDS (57)..(1652)

SEQ ID NO: 44970 - protein, 531 aa, Eimeria tenella; identical to SEQ ID NO: 7695

SEQ ID NO: 44971 - DNA, 3479 bp, Lactobacillus delbrueckii; identical to SEQ ID NO: 7696
  CDS (1277)..(3046)

SEQ ID NO: 44972 - protein, 589 aa, Lactobacillus delbrueckii; identical to SEQ ID NO: 7697

SEQ ID NO: 44973 - DNA, 1941 bp, Leishmania mexicana; identical to SEQ ID NO: 7698
  CDS (112)..(1611)

SEQ ID NO: 44974 - protein, 499 aa, Leishmania mexicana; identical to SEQ ID NO: 7699

SEQ ID NO: 44975 - DNA, 1452 bp, Methylobacterium extorquens; identical to SEQ ID NO: 7700
  CDS (1)..(1452)

SEQ ID NO: 44976 - protein, 483 aa, Methylobacterium extorquens; identical to SEQ ID NO: 7701

SEQ ID NO: 44977 - DNA, 1439 bp, Mycobacterium intracellulare; identical to SEQ ID NO: 7702
  CDS (1)..(1419)

SEQ ID NO: 44978 - protein, 472 aa, Mycobacterium intracellulare; identical to SEQ ID NO: 7703

SEQ ID NO: 44979 - DNA, 1635 bp, Thermoplasma acidophilum; identical to SEQ ID NO: 7704
  CDS (1)..(1635)

SEQ ID NO: 44980 - protein, 544 aa, Thermoplasma acidophilum; identical to SEQ ID NO: 7705

SEQ ID NO: 44981 - DNA, 1497 bp, Trypanoplasma borreli; identical to SEQ ID NO: 7706
  CDS (1)..(1497)

SEQ ID NO: 44982 - protein, 498 aa, Trypanoplasma borreli; identical to SEQ ID NO: 7707

SEQ ID NO: 44983 - DNA, 1629 bp, Yarrowia lipolytica; identical to SEQ ID NO: 7708
  CDS (1)..(1629)

SEQ ID NO: 44984 - protein, 542 aa, Yarrowia lipolytica; identical to SEQ ID NO: 7709

SEQ ID NO: 44985 - DNA, 1596 bp, Oryctolagus cuniculus; identical to SEQ ID NO: 7710
  CDS (1)..(1596)

SEQ ID NO: 44986 - protein, 531 aa, Oryctolagus cuniculus; identical to SEQ ID NO: 7711

SEQ ID NO: 44987 - DNA, 1799 bp, Xenopus laevis; identical to SEQ ID NO: 7712
  CDS (11)..(1606)

SEQ ID NO: 44988 - protein, 531 aa, Xenopus laevis; identical to SEQ ID NO: 7713

SEQ ID NO: 44989 - DNA, 2404 bp, Brachydanio rerio; identical to SEQ ID NO: 7714
  CDS (37)..(1635)

SEQ ID NO: 44990 - protein, 532 aa, Brachydanio rerio; identical to SEQ ID NO: 7715

SEQ ID NO: 44991 - DNA, 26 bp, Artificial sequence
  (1)..(26): primer
atgtctagattagaaagattgacctc

SEQ ID NO: 44992 - DNA, 25 bp, Artificial sequence
  (1)..(25): primer
ttaaacggtagagacttgcaaagtg

SEQ ID NO: 44993 - protein, 346 aa, Artificial sequence; identical to SEQ ID NO: 9106
  Variant (2)..(6): xaa in position 2 to 6 is any amino acid
  Variant (8)..(8): xaa in position 8 is any amino acid
  Variant (14)..(17): xaa in position 14 to 17 is any amino acid
  Variant (19)..(46): xaa in position 19 to 46 is any amino acid
  Variant (48)..(49): xaa in position 48 to 49 is any amino acid
  Variant (52)..(52): xaa in position 52 is any amino acid
  Variant (55)..(72): xaa in position 55 to 72 is any amino acid
  Variant (74)..(110): xaa in position 74 to 110 is any amino acid
  Variant (112)..(117): xaa in position 112 to 117 is any amino acid
  Variant (120)..(124): xaa in position 120 to 124 is any amino acid
  Variant (126)..(149): xaa in position 126 to 149 is any amino acid
  Variant (151)..(155): xaa in position 151 to 155 is any amino acid
  Variant (157)..(158): xaa in position 157 to 158 is any amino acid
  Variant (160)..(172): xaa in position 160 to 172 is any amino acid
  Variant (175)..(176): xaa in position 175 to 176 is any amino acid
  Variant (178)..(188): xaa in position 178 to 188 is any amino acid
  Variant (190)..(193): xaa in position 190 to 193 is any amino acid
  Variant (196)..(200): xaa in position 196 to 200 is any amino acid
  Variant (202)..(226): xaa in position 202 to 226 is any amino acid
  Variant (228)..(228): xaa in position 228 is any amino acid
  Variant (230)..(242): xaa in position 230 to 242 is any amino acid
  Variant (244)..(247): xaa in position 244 to 247 is any amino acid
  Variant (249)..(250): xaa in position 249 to 250 is any amino acid
  Variant (259)..(259): xaa in position 259 is any amino acid
  Variant (261)..(269): xaa in position 261 to 269 is any amino acid
  Variant (272)..(273): xaa in position 272 to 273 is any amino acid
  Variant (275)..(283): xaa in position 275 to 283 is any amino acid
  Variant (286)..(286): xaa in position 286 is any amino acid
  Variant (292)..(292): xaa in position 292 is any amino acid
  Variant (295)..(297): xaa in position 295 to 297 is any amino acid
  Variant (299)..(299): xaa in position 299 is any amino acid
  Variant (305)..(306): xaa in position 305 to 306 is any amino acid
  Variant (309)..(309): xaa in position 309 is any amino acid
  Variant (312)..(313): xaa in position 312 to 313 is any amino acid
  Variant (316)..(316): xaa in position 316 is any amino acid
  Variant (318)..(319): xaa in position 318 to 319 is any amino acid
  Variant (323)..(323): xaa in position 323 is any amino acid
  Variant (325)..(325): xaa in position 325 is any amino acid
  Variant (327)..(327): xaa in position 327 is any amino acid
  Variant (329)..(330): xaa in position 329 to 330 is any amino acid
  Variant (332)..(334): xaa in position 332 to 334 is any amino acid
  Variant (336)..(337): xaa in position 336 to 337 is any amino acid
  Variant (339)..(345): xaa in position 339 to 345 is any amino acid

SEQ ID NO: 44994 - protein, 48 aa, Artificial sequence; identical to SEQ ID NO: 9104
  Variant (2)..(2): xaa in position 2 is Ile, Val or Leu
  Variant (4)..(6): xaa in position 4 to 6 is any amino acid
  Variant (7)..(7): xaa in position 7 is Gly, Ala, Ser, Thr or Val
  Variant (8)..(8): xaa in position 8 is Val, Ile, Leu or Met
  Variant (9)..(10): xaa in position 9 to 10 is any amino acid
  Variant (11)..(13): xaa in position 11 to 13 is any or no amino acid
  Variant (14)..(14): xaa in position 14 is Phe, Ile, Leu or Met
  Variant (15)..(16): xaa in position 15 to 16 is any amino acid
  Variant (17)..(17): xaa in position 17 is Ile, Val or Leu
  Variant (18)..(18): xaa in position 18 is Leu, Ile, Val, Ala or Cys
  Variant (19)..(20): xaa in position 19 to 20 is any amino acid
  Variant (21)..(21): xaa in position 21 is Ser, Ala, Thr, Phe or Cys
  Variant (22)..(22): xaa in position 22 is Asp or Gln
  Variant (23)..(23): xaa in position 23 is any amino acid
  Variant (24)..(24): xaa in position 24 is Ile, Val, Leu, Phe or Ala
  Variant (25)..(25): xaa in position 25 is Met or Ile
  Variant (26)..(26): xaa in position 26 is Val, Ile or Leu
  Variant (27)..(27): xaa in position 27 is Ala or Ser
  Variant (31)..(31): xaa in position 31 is Leu or Met
  Variant (32)..(32): xaa in position 32 is Gly or Ala
  Variant (33)..(33): xaa in position 33 is Val, Ile, Met, Ala or Leu
  Variant (34)..(34): xaa in position 34 is Glu or Gln
  Variant (35)..(35): xaa in position 35 is Ile, Leu, Val, Met, Cys or Tyr
  Variant (36)..(39): xaa in position 36 to 39 is any amino acid
  Variant (40)..(40): xaa in position 40 is Val, Leu, Ile or Met
  Variant (41)..(43): xaa in position 41 to 43 is any amino acid
  Variant (44)..(44): xaa in position 44 is Gln or Glu
  Variant (45)..(45): xaa in position 45 is Lys, Arg, Glu or Gln
  Variant (46)..(46): xaa in position 46 is any amino acid
  Variant (47)..(47): xaa in position 47 is Ile, Leu, Met or Ala
  Variant (48)..(48): xaa in position 48 is Ile, Val, Thr, Leu or Ala

SEQ ID NO: 44995 - protein, 63 aa, Artificial sequence; identical to SEQ ID NO: 9105
  Variant (1)..(1): xaa in position 1 is Val, Ile, Ala, Cys, Ser or Thr
  Variant (2)..(2): xaa in position 2 is Ile, Val or Ala
  Variant (3)..(3): xaa in position 3 is any or no amino acid
  Variant (5)..(5): xaa in position 5 is Thr or Ser
  Variant (6)..(6): xaa in position 6 is Gln, Asn, His or Glu
  Variant (7)..(7): xaa in position 7 is Met, Leu, Val or Ile
  Variant (8)..(8): xaa in position 8 is Leu, Met or Val
  Variant (9)..(9): xaa in position 9 is any amino acid
  Variant (10)..(10): xaa in position 10 is Ser or Thr
  Variant (11)..(11): xaa in position 11 is Met or Leu
  Variant (12)..(16): xaa in position 12 to 16 is any amino acid
  Variant (17)..(17): xaa in position 17 is Pro or Ala
  Variant (20)..(20): xaa in position 20 is Ala or Ser
  Variant (22)..(22): xaa in position 22 is Val, Ala, Ile, Thr or Gly
  Variant (23)..(23): xaa in position 23 is any amino acid
  Variant (25)..(25): xaa in position 25 is Val or Ile
  Variant (26)..(26): xaa in position 26 is Ala, Gly, Phe, Ser, Tyr or Thr
  Variant (27)..(27): xaa in position 27 is any amino acid
  Variant (28)..(28): xaa in position 28 is Ala or Ser
  Variant (29)..(29): xaa in position 29 is Val, Ile or Thr
  Variant (30)..(32): xaa in position 30 to 32 is any amino acid
  Variant (33)..(33): xaa in position 33 is Thr, Ala, Ser or Val
  Variant (34)..(34): xaa in position 34 is Asp, Ser or Asn
  Variant (35)..(35): xaa in position 35 is Ala, Cys, Ser or Gly
  Variant (36)..(36): xaa in position 36 is Val, Ile, Thr or Leu
  Variant (37)..(37): xaa in position 37 is Met or Leu
  Variant (39)..(39): xaa in position 39 is Ser or Thr
  Variant (40)..(40): xaa in position 40 is Gly, Ala, Asn or Glu
  Variant (42)..(42): xaa in position 42 is Thr or Ser
  Variant (43)..(43): xaa in position 43 is Ala, Ser or Thr
  Variant (44)..(44): xaa in position 44 is any amino acid
  Variant (46)..(46): xaa in position 46 is any amino acid
  Variant (47)..(47): xaa in position 47 is Tyr, Phe, His, Asp or Trp
  Variant (49)..(50): xaa in position 49 to 50 is any amino acid
  Variant (51)..(51): xaa in position 51 is Ala, Thr, Ser, Val or Cys
  Variant (52)..(52): xaa in position 52 is Val, Ile, Leu or Ala
  Variant (53)..(54): xaa in position 53 to 54 is any amino acid
  Variant (55)..(55): xaa in position 55 is Met, Leu or Gln
  Variant (56)..(57): xaa in position 56 to 57 is any amino acid
  Variant (58)..(58): xaa in position 58 is Ile, Val, Thr or Ala
  Variant (59)..(61): xaa in position 59 to 61 is any amino acid
  Variant (62)..(62): xaa in position 62 is Ala, Thr, Val, Ile or Ser
  Variant (63)..(63): xaa in position 63 is Glu, Asp or Gln

SEQ ID NO: 44996 - DNA, 1032 bp, Saccharomyces cerevisiae
  CDS (1)..(1032)
atggtcaaagtcgcaattcttggcgcttctggtggcgtgggacaaccgctatcattactgctaaaattaagcccttacgtttccgagctggcgttgtacgatatccgagctgcggaaggcattggtaaggatttatctcacatcaacaccaactcaagttgtgtcggttatgataaggatagtattgagaacaccttgtcaaatgctcaggtggtgctaataccggctggtgttcccagaaagcccggtttaactagagatgatttgttcaagatgaacgccggtattgtcaaaagcctggtaaccgctgttggaaagttcgcaccaaatgcgaggattttagtcatttcaaaccctgtaaacagtttggtccctattgctgtggaaactttgaagaaaatgggtaagttcaaacctggaaacgttatgggtgtgacgaaccttgacctggtacgtgcagaaacctttttggtagattatttgatgctaaaaaaccccaaaattggacaagaacaagacaaaactacaatgcacagaaaggtcactgttattgggggtcattcaggggaaaccattatcccaataatcaccgacaaatcgctggtatttcaacttgataagcagtacgagcacttcattcatagggtccagttcggaggtgatgaaattgtcaaagctaaacagggcgccggttccgccacgttgtccatggcgttcgcgggggccaagtttgctgaagaagttttgaggagcttccataatgagaaaccagaaacggagtcactttccgcattcgtttatttaccaggcttaaaaaacggtaagaaagcgcagcaattagttggcgacaactctattgagtatttttccttgccaattgttttgagaaatggtagcgtagtatccatcgataccagtgttctggaaaaactgtctccgagagaggaacaactcgttaatactgcggtcaaagagctacgcaagaatattgaaaaaggcaagagtttcatcctagactcttccaagctatga

SEQ ID NO: 44997 - protein, 343 aa, Saccharomyces cerevisiae
MVKVAILGASGGVGQPLSLLLKLSPYVSELALYDIRAAEGIGKDLSHINTNSSCVGYDKDSIENTLSNAQVVLIPAGVPRKPGLTRDDLFKMNAGIVKSLVTAVGKFAPNARILVISNPVNSLVPIAVETLKKMGKFKPGNVMGVTNLDLVRAETFLVDYLMLKNPKIGQEQDKTTMHRKVTVIGGHSGETIIPIITDKSLVFQLDKQYEHFIHRVQFGGDEIVKAKQGAGSATLSMAFAGAKFAEEVLRSFHNEKPETESLSAFVYLPGLKNGKKAQQLVGDNSIEYFSLPIVLRNGSVVSIDTSVLEKLSPREEQLVNTAVKELRKNIEKGKSFILDSSKL

SEQ ID NO: 44998 - DNA, 960 bp, Francisella tularensis subsp. tularensis
  CDS (1)..(960)
atggctagaaaaaaaataacacttgttggtgctggtaatattggtggtacactagctcacttagcacttataaaacaattaggtgatgtagtcctttttgatatagctcagggcatgcctaatggcaaagcacttgatttactacaaacttgccctatcgagggagttgattttaaagtcaggggtacaaatgattacaaagatttagaaaattctgatgttgttattgtaactgctggtgttccgagaaagcctggcatgtctcgtgatgacctacttggtattaatatcaaagtaatgcaaacagtcggagaaggtatcaaacataactgtcctaatgctttcgtaatatgtatcacaaatccactagatattatggtaaatatgttacaaaaattctcaggcgtaccagataacaaaatcgttggtatggctggtgttttagattctgctagatttagaacatttttagcagatgaactaaatgtatcagtacaacaagtacaagcatatgtaatgggcggtcatggcgatactatggtccctctaactaaaatgtcaaatgttgcaggtgtgtcgttagagcagctagttaaagaaggtaaacttaaacaagagcgtttagatgctatagtatcgagaactagaagtggtggtggcgaaattgttgctttacttaaaacaggttcagcatattatgcaccagctgctgcaggtattcaaatggctgaaagcttcttaaaagataaaaagatgattttaccttgtgctgcaaaagtaaaagctggtatgtatggccttgatgaagatctatttgttggtgtaccaactgagatttctgcaaatggtgtcagacctattgaagtagagatttctgataaagaaagagaacaattacaagtatctataaacgctataaaagatcttaataaagcagctgctgaaattttagcaaaataa

SEQ ID NO: 44999 - protein, 319 aa, Francisella tularensis subsp. tularensis
MARKKITLVGAGNIGGTLAHLALIKQLGDVVLFDIAQGMPNGKALDLLQTCPIEGVDFKVRGTNDYKDLENSDVVIVTAGVPRKPGMSRDDLLGINIKVMQTVGEGIKHNCPNAFVICITNPLDIMVNMLQKFSGVPDNKIVGMAGVLDSARFRTFLADELNVSVQQVQAYVMGGHGDTMVPLTKMSNVAGVSLEQLVKEGKLKQERLDAIVSRTRSGGGEIVALLKTGSAYYAPAAAGIQMAESFLKDKKMILPCAAKVKAGMYGLDEDLFVGVPTEISANGVRPIEVEISDKEREQLQVSINAIKDLNKAAAEILAK

SEQ ID NO: 45000 - DNA, 1017 bp, Homo sapiens
  CDS (1)..(1017)
atgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtga

SEQ ID NO: 45001 - protein, 338 aa, Homo sapiens
MLSALARPASAALRRSFSTSAQNNAKVAVLGASGGIGQPLSLLLKNSPLVSRLTLYDIAHTPGVAADLSHIETKAAVKGYLGPEQLPDCLKGCDVVVIPAGVPRKPGMTRDDLFNTNATIVATLTAACAQHCPEAMICVIANPVNSTIPITAEVFKKHGVYNPNKIFGVTTLDIVRANTFVAELKGLDPARVNVPVIGGHAGKTIIPLISQCTPKVDFPQDQLTALTGRIQEAGTEVVKAKAGAGSATLSMAYAGARFVFSLVDAMNGKEGVVECSFVKSQETECTYFSTPLLLGKKGIEKNLGIGKVSSFEEKMISDAIPELKASIKKGEDFVKTLK

SEQ ID NO: 45002 - DNA, 1017 bp, Mus musculus
  CDS (1)..(1017)
atgctgtccgctctcgcccgtcctgccggcgccgctctccgccgcagcttcagcacttcggcccagaacaatgctaaagtggctgtcctgggagcttctgggggcattgggcaacccctttcactcctgctgaagaacagccccctagtgagccgcctgaccctctacgatatcgctcacacacctggtgtggcagcagatctgagtcacattgagaccagagcaaatgtgaaaggctaccttggaccggagcagttgccagattgcctcaaaggttgtgatgtggtggtcatcccagccggagtgcccaggaaaccaggaatgacacgggatgacctgttcaacaccaacgctaccattgtggccaccctgacggctgcctgtgcccagcactgtcctgaagccatggtttgcatcattgccaacccagtgaactccaccatccccatcacagcagaagttttcaagaagcacggtgtgtacaaccctaacaagatcttcggtgtgacaacccttgacatcgtcagagcgaacacgtttgtggcagagctaaagggtttggatccagctcgagtcaacgtgcctgtcattggcggccacgccgggaagacgatcatccccctgatctctcagtgtaccccgaaggttgactttccccaagaccagctggccacactcaccgggaggatccaggaggctggcacagaagtcgtgaaggccaaggctggagcaggttctgccactctgtccatggcttatgctggagcccgctttgtcttctccctcgtggacgccatgaacgggaaggaaggagtcgttgagtgttcttttgttcagtccaaagagacggaatgcacttacttctctacgcccttgctcttggggaaaaagggcctggagaagaacctgggcattggcaagatcactccttttgaggaaaaaatgattgccgaggctatccctgagctgaaagcctccatcaagaaaggcgaggactttgtcaagaacatgaagtga

SEQ ID NO: 45003 - protein, 338 aa, Mus musculus
MLSALARPAGAALRRSFSTSAQNNAKVAVLGASGGIGQPLSLLLKNSPLVSRLTLYDIAHTPGVAADLSHIETRANVKGYLGPEQLPDCLKGCDVVVIPAGVPRKPGMTRDDLFNTNATIVATLTAACAQHCPEAMVCIIANPVNSTIPITAEVFKKHGVYNPNKIFGVTTLDIVRANTFVAELKGLDPARVNVPVIGGHAGKTIIPLISQCTPKVDFPQDQLATLTGRIQEAGTEVVKAKAGAGSATLSMAYAGARFVFSLVDAMNGKEGVVECSFVQSKETECTYFSTPLLLGKKGLEKNLGIGKITPFEEKMIAEAIPELKASIKKGEDFVKNMK

SEQ ID NO: 45004 - DNA, 1026 bp, Arabidopsis thaliana
  CDS (1)..(1026)
atgttccgatcaatgattgttcgatctgcttccccagtgaagcagggtcttctccgcagaggattcgcctctgaatctgttcccgatcgcaaagtcgtcatcctcggtgccgccggtgggatcggccagccactttctcttctcatgaagcttaaccctctcgtctcttctctctccctctatgatatcgccaacactcccggcgttgctgctgacgtcggtcacatcaacacccgatctcaggtttctgggtacatgggtgatgatgatttggggaaagctctagaaggcgctgacctcgtcattattccagctggtgtcccaaggaagcctggcatgacccgtgatgatcttttcaacatcaatgctggcattgtcaagaacctcagcatcgccatcgccaagtattgcccacaagcacttgtcaacatgatcagcaaccctgtgaactccactgttccaattgcagctgagatttttaagaaggctggtacctatgatgagaagaaattattcggtgtcaccactcttgatgttgtcagggctaggactttctatgctggaaaatcggatgtcaatgttgcagaggttaatgttccagttgttggtggtcatgctggcatcacgattcttcctctcttttctcaggctagccctcaagccaacttgtcggatgatttaatcagggccctcacaaagcgtacccaggacggagggacagaagtcgtggaggcaaaagctggaaagggttcagctacattgtcaatggcctatgcgggagcactctttgctgatgcatgcttaaagggactcaacggtgttccaaatgtggtggaatgctcattcgtccaatctaccatcaccgagcttcctttcttcgcctcaaaggtaagactgggaaagaacggagtggaggaagtgctagatctagggccactctcagactttgaaaaggaaggcttagaagccctcaaggcagaactcaaatcctctatcgagaagggcatcaaatttgccaaccaatga

SEQ ID NO: 45005 - protein, 341 aa, Arabidopsis thaliana
MFRSMIVRSASPVKQGLLRRGFASESVPDRKVVILGAAGGIGQPLSLLMKLNPLVSSLSLYDIANTPGVAADVGHINTRSQVSGYMGDDDLGKALEGADLVIIPAGVPRKPGMTRDDLFNINAGIVKNLSIAIAKYCPQALVNMISNPVNSTVPIAAEIFKKAGTYDEKKLFGVTTLDVVRARTFYAGKSDVNVAEVNVPVVGGHAGITILPLFSQASPQANLSDDLIRALTKRTQDGGTEVVEAKAGKGSATLSMAYAGALFADACLKGLNGVPNVVECSFVQSTITELPFFASKVRLGKNGVEEVLDLGPLSDFEKEGLEALKAELKSSIEKGIKFANQ

SEQ ID NO: 45006 - DNA, 1212 bp, Arabidopsis thaliana
  CDS (1)..(1212)
atggcaacagcaacatcagcttctctgttttcaactgtttcttcatcttactccaaagctagctccataccacattcaagactccaatctgtgaaattcaactcagtccctagcttcaccggtctcaaatcaacctctctcatctccggatctgattcctcttccttagccaagactctacgcggttccgtaacgaaagcacaaacatctgacaagaagccttacggattcaaaatcaacgcttcatacaaagtagctgttcttggtgctgctggtggtataggtcagcctttatcacttctcatcaagatgtctccgttagtctctacgcttcatctttacgatatcgccaatgttaaaggagttgctgctgatctaagtcattgtaacactccttctcaagttcgtgatttcactggtccttctgagttagctgattgtttgaaagatgttaacgttgttgtcatccctgctggtgtgccgaggaaacccggtatgactcgtgacgatcttttcaacatcaatgccaatattgtcaagactcttgttgaagctgttgctgagaattgccctaatgctttcattcatattattagtaacccggttaactctacggtacctattgctgctgaagtgttgaagaagaaaggtgtttatgatcctaagaagctgtttggtgtcactactttggatgttgtgagggctaacacttttgtttctcagaagaagaatcttaagcttattgatgttgatgttccggttattggtggacatgctggaatcaccattttgcctctcctctcgaagacaaaaccgtctgttaactttactgatgaagagatccaagagctcactgttaggattcagaacgctggtactgaggttgttgatgctaaggcaggtgcaggttcagctactttgtcaatggcttatgctgctgctagatttgtagagtcatctcttcgtgctcttgatggagacggagatgtctacgagtgctcgtttgtggagtcgactctgactgatcttcctttctttgcatcacgggttaagatagggaagaacggtcttgaagctgtgattgagtcagaccttcagggattgactgagtatgagcagaaagcactagaagctcttaaggtagaattgaaagctagcattgacaagggtgtcgcatttgcaaacaaaccagctgctgcagcagctaactag

SEQ ID NO: 45007 - protein, 403 aa, Arabidopsis thaliana
MATATSASLFSTVSSSYSKASSIPHSRLQSVKFNSVPSFTGLKSTSLISGSDSSSLAKTLRGSVTKAQTSDKKPYGFKINASYKVAVLGAAGGIGQPLSLLIKMSPLVSTLHLYDIANVKGVAADLSHCNTPSQVRDFTGPSELADCLKDVNVVVIPAGVPRKPGMTRDDLFNINANIVKTLVEAVAENCPNAFIHIISNPVNSTVPIAAEVLKKKGVYDPKKLFGVTTLDVVRANTFVSQKKNLKLIDVDVPVIGGHAGITILPLLSKTKPSVNFTDEEIQELTVRIQNAGTEVVDAKAGAGSATLSMAYAAARFVESSLRALDGDGDVYECSFVESTLTDLPFFASRVKIGKNGLEAVIESDLQGLTEYEQKALEALKVELKASIDKGVAFANKPAAAAAN

SEQ ID NO: 45008 - DNA, 1059 bp, Agrobacterium tumefaciens str. C58
  CDS (1)..(1059): transl_table=11
ttgccaattttggccaatggggctaatcgaagtgcgacaatttggctgccggtttggcgcggtaaaattgaattgaagctcaagaggaagcattcgatggctcgcaaaaaaattgcacttattggttctggcatgatcggcggcacgctggcgcatctcgccagcctgaaggaactgggcgatatcgtcctcttcgacatcgccgacggcatcccgcagggcaagggtctggatattgcccagtccggcccggttgaaggcttcaatgcaaagctctccggcgcttccgattacgccgccatcgaaggcgcagacgtctgcatcgtcaccgcaggtgtcgcccgcaagcccggcatgagccgcgatgatcttcttggcatcaacctcaaggtcatggaacaggtcggcgccggcatcaagaaatatgctccgaacgctttcgtgatctgcatcaccaacccgctcgacgccatggtctgggcgctgcagaagttctccggcctgccgaagaacaaggtcgtcggcatggctggcgttctcgacagcgcacgcttccgcctgttccttgccgaagaattcaacgtttcggtccaggacgtcaccgccttcgttctcggcggtcatggcgacaccatggtgccgctcgcccgttattccaccgttggcggcgttccgcttaccgatctcgtcaagatgggctggttgaccgccgaacgtcttgagcagatcatccagcgcacccgtgacggcggcgcggaaatcgtcggcctcttgaagaccggctcggcctattacgcgccggccgcttcggctatcgaaatggccgaatcctacctcaaggacaagaagcgcgttctgcccgctgctgcccacctttcgggccagtatggcgtagacgacatgtatgtcggcgtgcccaccatcatcggtgccggcggtatcgagcgcgtcatcgagatcgaactgaacaaggaagaagaagccgccttccagaaatccgtcggcgctgtcgctggtctttgcgaagcctgcatcaacatcgctccgtcgctgaagtaa

SEQ ID NO: 45009 - protein, 352 aa, Agrobacterium tumefaciens str. C58
MPILANGANRSATIWLPVWRGKIELKLKRKHSMARKKIALIGSGMIGGTLAHLASLKELGDIVLFDIADGIPQGKGLDIAQSGPVEGFNAKLSGASDYAAIEGADVCIVTAGVARKPGMSRDDLLGINLKVMEQVGAGIKKYAPNAFVICITNPLDAMVWALQKFSGLPKNKVVGMAGVLDSARFRLFLAEEFNVSVQDVTAFVLGGHGDTMVPLARYSTVGGVPLTDLVKMGWLTAERLEQIIQRTRDGGAEIVGLLKTGSAYYAPAASAIEMAESYLKDKKRVLPAAAHLSGQYGVDDMYVGVPTIIGAGGIERVIEIELNKEEEAAFQKSVGAVAGLCEACINIAPSLK

SEQ ID NO: 45010 - DNA, 939 bp, Bacillus subtilis subsp. subtilis str. 168
  CDS (1)..(939): transl_table=11
atgggaaatactcgtaaaaaagtttctgttatcggagcaggttttaccggagctacaactgcatttttaatcgctcaaaaagagctggcagacgttgttcttgttgacattccgcaattggagaacccgacaaagggaaaagcgcttgatatgcttgaagcaagcccggttcaaggctttgacgcaaaaattacgggaacatccaattacgaggatacagccggctctgacattgttgtcattacagccggtatcgcaagaaaacctggtatgagcagagatgatctggtctctacaaacgaaaagattatgagaagcgttacgcaggaaatcgtgaaatattctcctgactctattattgtggtgctgacaaatcctgttgatgcaatgacatacgcggtgtacaaagaatcaggcttccctaaagagcgtgtaatcggccagtcaggtgtgcttgatacggcaagattcagaacatttgtggcagaggaattaaacctgtcagtgaaagatgtgactggtttcgtactcggcggacacggtgacgatatggttccgcttgtgcgttattcttatgctggcggtatcccgcttgaaactcttattccgaaagaacggattgacgcaattgtggagcgcactagaaaaggcggaggcgaaatcgtgaatcttcttggaaacggaagcgcgtattatgcgcctgcggcttctctgacagaaatggtcgaagcgatcttgaaagatcagcgccgcgtccttcctacaattgcttatcttgaaggggaatacggctatgaaggcatctaccttggtgttcctacaattgtaggcggcaacggtcttgagcaaatcattgaacttgaactgacagactatgaaagagcgcagctgaataaatcagttgaatctgtcaaaaatgtcatgaaagtattatcctaa

SEQ ID NO: 45011 - protein, 312 aa, Bacillus subtilis subsp. subtilis str. 168
MGNTRKKVSVIGAGFTGATTAFLIAQKELADVVLVDIPQLENPTKGKALDMLEASPVQGFDAKITGTSNYEDTAGSDIVVITAGIARKPGMSRDDLVSTNEKIMRSVTQEIVKYSPDSIIVVLTNPVDAMTYAVYKESGFPKERVIGQSGVLDTARFRTFVAEELNLSVKDVTGFVLGGHGDDMVPLVRYSYAGGIPLETLIPKERIDAIVERTRKGGGEIVNLLGNGSAYYAPAASLTEMVEAILKDQRRVLPTIAYLEGEYGYEGIYLGVPTIVGGNGLEQIIELELTDYERAQLNKSVESVKNVMKVLS

SEQ ID NO: 45012 - DNA, 981 bp, Brucella melitensis 16M
  CDS (1)..(981): transl_table=11
ttgaggaaagaaacaatcatggcacgcaacaagattgccctcatcggctccggcatgatcggcggtacgctcgctcacctggccggtctgaaggaactcggtgacgtcgtccttttcgacattgcggaaggcaccccgcagggcaaggggctggatatcgccgaatcttctccggtcgatggtttcgatgcgaagttcactggcgcgaacgattacgccgccattgaaggcgcagacgtcgtcatcgtcaccgcaggggtgccgcgcaagccgggcatgagccgcgacgatctcctgggcatcaacctgaaggtgatggaacaggtgggcgcgggcatcaagaaatatgcgccggaagctttcgtcatctgcatcaccaacccgctcgacgccatggtctgggcgctgcagaagttctccggccttccggcccacaaggttgtcggcatggctggcgttctcgacagcgcccgcttccgttatttcctctcggaagaattcaacgtttcggtcgaggacgtcacggcattcgtgctgggtggccacggcgattcgatggttccgctggcgcgctactcgaccgttgccggcattccgctgtctgatctcgtcaagatgggctggaccagccaggacaagctcgacaagatcatccagcgcacccgtgacggcggcgcggaaatcgtgggccttctcaagaccggctcggctttctacgctccggcggcatcggccatccagatggctgaatcctacctcaaggacaagaagcgcgtcctgccggtcgcagcccagctttcgggccagtatggcgtgaaggacatgtatgtgggcgttccgaccgtgatcggcgccaatggcgtggagcgcatcatcgagatcgatctcgacaaggacgagaaggcgcagttcgacaagtcggtggcctccgtcgccggtctgtgcgaagcctgcatcggtattgctccgtcgctgaaataa

SEQ ID NO: 45013 - protein, 326 aa, Brucella melitensis 16M
MRKETIMARNKIALIGSGMIGGTLAHLAGLKELGDVVLFDIAEGTPQGKGLDIAESSPVDGFDAKFTGANDYAAIEGADVVIVTAGVPRKPGMSRDDLLGINLKVMEQVGAGIKKYAPEAFVICITNPLDAMVWALQKFSGLPAHKVVGMAGVLDSARFRYFLSEEFNVSVEDVTAFVLGGHGDSMVPLARYSTVAGIPLSDLVKMGWTSQDKLDKIIQRTRDGGAEIVGLLKTGSAFYAPAASAIQMAESYLKDKKRVLPVAAQLSGQYGVKDMYVGVPTVIGANGVERIIEIDLDKDEKAQFDKSVASVAGLCEACIGIAPSLK

SEQ ID NO: 45014 - DNA, 1026 bp, Schizosaccharomyces pombe
  CDS (1)..(1026)
atgtttgccaaagtagctttcaaaaactttactccccttaagagtatcgctccccgttctttttctacgacctccagtcgcgcattcaaagtagccgttttgggtgctggaggaggtattggccagcctttgtcaatgcttttaaaactgaacgataaggttagtgaattggccttgttcgatattaggggagctcctggcgttgctgccgatattggacatatcaataccacttccaatgttgttggctatgctcctgatgacaagggacttgaaaaagccttgaacggtgctgatgtggtcattattcctgctggtgttccccgtaagcccggaatgactcgtgatgatctctttgctactaacgcatcgattgtgcgggaccttgcttttgcagcaggtgaaacttgtcccgaagccaaatatctcgttgtcactaaccccgtaaactctactgtgcccatctttaaaaaggctttagaacgtgttggcgttcatcaacccaaacatttgtttggtgtcaccacacttgactctgttcgtgccagccgtttcacctctcaagtcactaatggcaaggcagaacttcttcatattcctgttgttggcggtcattccggtgcgaccatcgtacctttgttgtcccaaggcggtgttgaattgactggtgaaaagcgtgacgcacttattcaccgtatccaatttggtggtgatgaggttgtaaaggcgaaggctggtgctggaagtgcgaccttgtctatggcctatgccggtgctcgtatggcctcctccgtactccgtgctttggctggtgagtctggcgttgaggaatgcacctttgtggagtcccctctgtacaaggatcaaggaattgatttctttgcctctcgtgtaactttgggtaaggatggggttgacaccattcaccctgttggtaaaatcaatgattatgaggagagccttcttaaggtagctttgggtgagctgaaaaagagcattacgaagggtgagcaatttgtagcataa

SEQ ID NO: 45015 - protein, 341 aa, Schizosaccharomyces pombe
MFAKVAFKNFTPLKSIAPRSFSTTSSRAFKVAVLGAGGGIGQPLSMLLKLNDKVSELALFDIRGAPGVAADIGHINTTSNVVGYAPDDKGLEKALNGADVVIIPAGVPRKPGMTRDDLFATNASIVRDLAFAAGETCPEAKYLVVTNPVNSTVPIFKKALERVGVHQPKHLFGVTTLDSVRASRFTSQVTNGKAELLHIPVVGGHSGATIVPLLSQGGVELTGEKRDALIHRIQFGGDEVVKAKAGAGSATLSMAYAGARMASSVLRALAGESGVEECTFVESPLYKDQGIDFFASRVTLGKDGVDTIHPVGKINDYEESLLKVALGELKKSITKGEQFVA

SEQ ID NO: 45016 - DNA, 1050 bp, Drosophila melanogaster
  CDS (1)..(1050)
atgttgttactgacaagtcttaaaagcctggcaaaaccagctacatggggagttgtggtccgcactttaaaggtcgccgttgtcggtgccggaggaggaattggacaaccgctatcgcttctgctccgtcgctgtcctggaatcgatgagctggctctacatgatctcagcgaaatgaagggaattgctacggatctatcccatataagccaaacgggaaaggtgataggttttaccggtgaaaaggaactggagtcggcggtgagtggagctgatgtggtggttgtggcggcagggatgccacgtctgccaggaatgcaaagggatcacctgatggccgccaatggaaatgttgcagtgaaagttgccactgccattagcaatgcctctccacgagctcatcttgcctttattaccaatccggtcaatatgattgtgcccgccgcagctgaggttcttatggcccatggaacttttgattctcgtcggctcttcggtattacgactttggatgtggtgcgatcgaaaaagttcattggtgattctatgaacatatcaccggatgacgtaaacattccagttattggtggccatgcggggattacaattctaccgctcatttcgcagtgtcagccgatatatagatgtgatctccaggagatccagaatctaactcatcgcattcaggaggcgggcacagaggtggtgaatgccaaagctggaaaaggatctgccaccctatcgatggcttatgctggcgcaactttcgtgaactccctgctgcgtggaattgctggacaggatggtctaatcgagtgcgcttttgtcgcctccaaactaaccgacgccccattctttgctagtccattggaattgggaaaggatggtatcaagcgctatataccacttccccagatgagtgactacgaaaaggaggctttggaaaagctactacctattctacgacagaatgctgatgagggtgtcaattttgcaaaaatgattttgagtggacaatcacattctcccattccagcggccttgccgtaa

SEQ ID NO: 45017 - protein, 349 aa, Drosophila melanogaster
MLLLTSLKSLAKPATWGVVVRTLKVAVVGAGGGIGQPLSLLLRRCPGIDELALHDLSEMKGIATDLSHISQTGKVIGFTGEKELESAVSGADVVVVAAGMPRLPGMQRDHLMAANGNVAVKVATAISNASPRAHLAFITNPVNMIVPAAAEVLMAHGTFDSRRLFGITTLDVVRSKKFIGDSMNISPDDVNIPVIGGHAGITILPLISQCQPIYRCDLQEIQNLTHRIQEAGTEVVNAKAGKGSATLSMAYAGATFVNSLLRGIAGQDGLIECAFVASKLTDAPFFASPLELGKDGIKRYIPLPQMSDYEKEALEKLLPILRQNADEGVNFAKMILSGQSHSPIPAALP

SEQ ID NO: 45018 - DNA, 1044 bp, Drosophila melanogaster
  CDS (1)..(1044)
atgtttttggcctctagattgttaagccatgttggcaacttgcctcccaaggtccagcagcttggatatatcaaccgaggtctcaaggtcgccgttgtgggatcggtgggtggaatcggtcagccgctgtcccttcttctcaagcataatccgcaaatctcgaccctgtctctgtacgacattaagaatacaaccggtgtaggagtagacttatctcatatcaacacccgtgcttcagtgtgcccattcgagggtaagaatggtttaaaaaaagctatggataaggctgatatagtggtgataccggcgggtttgccacgtaagcccggaatgaagcgcgaagatttggtggacgtgaatgccagcgttgcctgcgaagtggcttttgcggctagcgaagtttgtcccggtgccatgcttgccttcatcacgaaccccatcaacgtgatagtacccatcgtggccacgatccttaaagcaaagggtacatacgatccgaatcgactatttggtgtcaccactctggatgtggtacgagcccagacctttgtagcggacattctcaacgttgatccccagaaagtgaatatacccgtaatcggtggccatacaggtcggaccatcctgcccatactgtcgcagtgtgatcccccctttaagggtaccgataaggagcgcgaagcgttgatccaacgcatccaaaatgcgggcacagaagtggttaatgccaaggatggcctgggctcggccaccctatcgatggcctttgcagccactcagtttgtaagctcgttgataaagggtatcaagggttcaaaggacgagtgcattgtggaatgtgcctatgtggagtctgatgtcacggaggcccagttcttcgccaccccactgatactgggaccccagggtgtcaaggaaaacacaggattgcccgatttggacgatgaggaaaggaaggctctaaatggtatgctacccattttgaaggagagtatcgcaaagggcatcaaattgggcgagggtatgatatgcagttgtgcataa

SEQ ID NO: 45019 - protein, 347 aa, Drosophila melanogaster
MFLASRLLSHVGNLPPKVQQLGYINRGLKVAVVGSVGGIGQPLSLLLKHNPQISTLSLYDIKNTTGVGVDLSHINTRASVCPFEGKNGLKKAMDKADIVVIPAGLPRKPGMKREDLVDVNASVACEVAFAASEVCPGAMLAFITNPINVIVPIVATILKAKGTYDPNRLFGVTTLDVVRAQTFVADILNVDPQKVNIPVIGGHTGRTILPILSQCDPPFKGTDKEREALIQRIQNAGTEVVNAKDGLGSATLSMAFAATQFVSSLIKGIKGSKDECIVECAYVESDVTEAQFFATPLILGPQGVKENTGLPDLDDEERKALNGMLPILKESIAKGIKLGEGMICSCA

SEQ ID NO: 45020 - DNA, 1011 bp, Drosophila melanogaster
  CDS (1)..(1011)
atgctgaagcaagtgacgaagcaattggccctgcagggagtgcgcaccttctcggttggccagcagaacaactacaaggtgaccgtttgcggtgccgctggaggaatcggccagccgctgtcgctgctcctcaagcagaatcccctggtcaccgacttggcgctctacgatatcgttcatacgcccggtgtggccgccgatctgtcgcatatcgacaccaagagcaagaccgccggattcatcggagccgaccagctgggtgactccctgaagggatccgatgtggtggtcattcccgctggtgtgccccgcaagccgggcatgacccgcgatgatctgttcaacgtgaacgccggcatcatcaaggacatctccaactccattgccaagaactgccccaaggccctggtggccatcatcaccaacccggtgaacacctgcgtgcccatcgctgccgagatcctcaagaaggctggtgtttacgatcccaagcgtctgttcggagtctccaccttggatgtggtgcgtgcccgtgccttcatcggccatgcccttggtgtggatccccagaccgtgcagatccccgtgatcggcggccactccggcgtgaccatcctgcctgtgctctcccagagccagcccctgttcaagggcaaccaggacaccatcgagaagcttaccgtgcgcatccaggaggccggtactgaggtcgttaaggccaaggccggagccggttccgccactctgtcgatggcctacgctggtgcccgtttcgccggctccctgctgaagggactgaacggcgagaagaacgttatcgagtgctcctacgtgcagtccaccgtcacggaggctaccttcttctccacacccctggtgctgggcaagaacggcgtccaggagaacctcggcctgcccaagctcaacgactacgagaagaagctgctggaggccgccattcccgagctgaagaagaacatccagaagggcattgactttgccaacgcctaa

SEQ ID NO: 45021 - protein, 336 aa, Drosophila melanogaster
MLKQVTKQLALQGVRTFSVGQQNNYKVTVCGAAGGIGQPLSLLLKQNPLVTDLALYDIVHTPGVAADLSHIDTKSKTAGFIGADQLGDSLKGSDVVVIPAGVPRKPGMTRDDLFNVNAGIIKDISNSIAKNCPKALVAIITNPVNTCVPIAAEILKKAGVYDPKRLFGVSTLDVVRARAFIGHALGVDPQTVQIPVIGGHSGVTILPVLSQSQPLFKGNQDTIEKLTVRIQEAGTEVVKAKAGAGSATLSMAYAGARFAGSLLKGLNGEKNVIECSYVQSTVTEATFFSTPLVLGKNGVQENLGLPKLNDYEKKLLEAAIPELKKNIQKGIDFANA

SEQ ID NO: 45022 - DNA, 1215 bp, Oryza sativa (japonica cultivar-group)
  CDS (1)..(1215)
atggaactgttcctgcagttaggcatggcatcaactgttgccatcaatttgattggtgctcaggctggcattatctcaaagttaaggaattgcgacatcacaagctacagtggcttaaaggcaagatcatctattagttttgagtcaaggtcatcattcctgggtcagaatgcatctcttcgatcatctatctctccaaggattgtaccaaaggcaaactctggatctcacatttctcctgaggcatcttacaaagtggcagttctcggtgctgctggtggcattggtcaaccgttgggcttgttaattaagatgtctcctctggtctctgcactacatctgtatgatattgcaaatgtcaaaggagttgctgctgatctgagccactgcaacacaccttctcaggttctggactttactgggccctcggaattagccaactgcttgaaaggtgtggatgttgttgtcatccctgctggagtcccaaggaagccaggaatgactcgtgatgatctttttaacatcaatgcgagcattgtcaagacacttgttgaggctgttgcagacaattgtccagaagcctttatccatatcattagcaacccagtaaactcaacagtgcccattgctgctgaggttctgaaacagaagggtgtctataaccccaagaagcttttcggagttaccaccctagatgttgtcagagctaacacatttatagctcagaagaagaacctgaagctcattgatgttgatgtcccagttgttggtggtcatgctgggattactatcctaccattgctgtcaaaaaccagaccatctgtcaccttcacaaatgaggaaactgaagagctgacaaggaggatacagaatgctgggacagaggtggtggaggcgaaagctggtgctggatctgctaccctgtcgatggcctatgcagctgccagatttgttgagtcatccctccgtgcattggctggtgatccagatgtttacgagtgcacatttgttcaatctgaattaactgagctgctgttctttgcatctagggttaagcttggtaagaatggtgttgagtccatcatttcttccgaccttgagggagtgactgaatatgaggccaaggcccttgagtcattgaagcctgagttgaaggccagcattgagaagggcatcgagttcgtccacaaacagcaggctgccgctacttcttga

SEQ ID NO: 45023 - protein, 404 aa, Oryza sativa (japonica cultivar-group)
MELFLQLGMASTVAINLIGAQAGIISKLRNCDITSYSGLKARSSISFESRSSFLGQNASLRSSISPRIVPKANSGSHISPEASYKVAVLGAAGGIGQPLGLLIKMSPLVSALHLYDIANVKGVAADLSHCNTPSQVLDFTGPSELANCLKGVDVVVIPAGVPRKPGMTRDDLFNINASIVKTLVEAVADNCPEAFIHIISNPVNSTVPIAAEVLKQKGVYNPKKLFGVTTLDVVRANTFIAQKKNLKLIDVDVPVVGGHAGITILPLLSKTRPSVTFTNEETEELTRRIQNAGTEVVEAKAGAGSATLSMAYAAARFVESSLRALAGDPDVYECTFVQSELTELLFFASRVKLGKNGVESIISSDLEGVTEYEAKALESLKPELKASIEKGIEFVHKQQAAATS

SEQ ID NO: 45024 - DNA, 1023 bp, Oryza sativa (japonica cultivar-group)
  CDS (1)..(1023)
atgaggccgtcgctgatgagatccgcctcgcaggtcctccgccgccgccgcggctactcctccgcctccggccagccggagcggaaggtcgccatcctcggcgcggccggcggcatcgggcagccgctctccctcctcatgaagctgaacccgctcgtctcctccctctccctctacgatatcgccggcacccccggcgtcgccgccgacgtctcccacatcaacgccccggcccaggtgaaggggttcatgggggatgaccagctcggggaggcgttggaggggtcggacatcgtgatcatcccggccggcgtgccgaggaagcccggcatgaccagggacgacctcttcaacatcaacgccggcatcgttaagaacctctgcaccgccattgccaagtactgcccgaatgctcttgtcaacatgatcagcaacccagtgaattcaacggtcccaattgctgccgaggttttcaagaaggctgggacttacgatgagaagaagttgtttggtgtgactactcttgatgttgttcgtgctaagactttctatgctggaaaggccaatgtaccagttactgatgtgaatgtcccagttgttggtggtcatgcgggtatcaccatcctgccactgttctcacaggcaactcctgcaactaatgcgttgtctgatgaagacatcaaggctcttaccaagagaacacaggatggtgggactgaagttgttgaagcaaaggctggaaagggctctgcaaccttgtccatggcgtatgctggtgctgttttcgcaaatgcttgcttaaagggtctgaatggagtgccggacgttgttgaatgctcttttgtgcaatcaactgtaacagagctgccattctttgcctccaaggtgaagcttgggaagaatggagttgaggaagttcttgggttgggccagctgtcagactttgagaaggaaggactggagaatcttaagggcgagctcaaggcttcaattgagaagggtatcaaatttgcaaatgcgtag

SEQ ID NO: 45025 - protein, 340 aa, Oryza sativa (japonica cultivar-group)
MRPSLMRSASQVLRRRRGYSSASGQPERKVAILGAAGGIGQPLSLLMKLNPLVSSLSLYDIAGTPGVAADVSHINAPAQVKGFMGDDQLGEALEGSDIVIIPAGVPRKPGMTRDDLFNINAGIVKNLCTAIAKYCPNALVNMISNPVNSTVPIAAEVFKKAGTYDEKKLFGVTTLDVVRAKTFYAGKANVPVTDVNVPVVGGHAGITILPLFSQATPATNALSDEDIKALTKRTQDGGTEVVEAKAGKGSATLSMAYAGAVFANACLKGLNGVPDVVECSFVQSTVTELPFFASKVKLGKNGVEEVLGLGQLSDFEKEGLENLKGELKASIEKGIKFANA

SEQ ID NO: 45026 - DNA, 1215 bp, Oryza sativa (japonica cultivar-group)
  CDS (1)..(1215)
atggcatcagcagcaatgtctactctgaacctgagttcatctcctctgaccaagcagcagctccgatttggagccagcacactcagtgcagaacacgtcagtggcttcagctctgcaaggccagctccatcgttgtgctgctccagctctcactggcgagcggtcaagctgagaccgagacggcggccatggcggcgcgccgggaaccgggtcgtcgcgcaggccggcggctacaaggtcgccatcctcggcgccgccggtgggatcgggcagccgctctcgctcctcgtcaagatgtcgccgctcgtctcggcgctgcacctgtacgacattgcgaacgtcgatggtgtcaccgccgatcttggacactgcaacacgccggcgaaggtcgccgggttcaccggaaaggaggagctcgccggttgtcttgccggcgtggacgtcgtcgtcatccccgccggcgtgccgaggaagccagggatgacgcgggatgacctgttcggcatcaacgccggcatcgtgagggagctcgtcgaggccgtggcggaccacgcgccggcggcgctggtgcacgtcatctccaacccggtgaactccaccgtgccgatcgccgccgaggtgctgaagcggaagggcgtgtacgacccgcggaagctgttcggcgtcacgacgctggacgtcgtgcgcgccaacacgttcgtcgcggagatgaagggcctcccgctcgccgacgtcgacgtcccggtggtcggcggccacgcggcggccaccatcctcccgctgctgtccaaggcgaggcccaagacggcgttcaccgatgaggaggtggaggcgctgacgaggcggatccagaacgccgggaccgaggtggtggaggccaaggcgaaggccggcggcgggtccgcgacgctgtcgatggcgtacgcggcggcgaggttcctggaggcgtcgctgcgcgggctcgacggcgacgccgacgtgtacgagtgctcgtacgtgcagtgccaggcggtgccggagctgccgttcttcgcgtgccgggtgaagctgggcagggacggcgtcgaggaggtggcggcggcgggggcggagctccgggggctcacggagttcgaggcgcgcgcgctggaggcgctcaagccgcagctcaagaagagcatcgacaagggcgtcgcctacgcgcagcagcagccagcgacggtggcgatgggttga

SEQ ID NO: 45027 - protein, 404 aa, Oryza sativa (japonica cultivar-group)
MASAAMSTLNLSSSPLTKQQLRFGASTLSAEHVSGFSSARPAPSLCCSSSHWRAVKLRPRRRPWRRAGNRVVAQAGGYKVAILGAAGGIGQPLSLLVKMSPLVSALHLYDIANVDGVTADLGHCNTPAKVAGFTGKEELAGCLAGVDVVVIPAGVPRKPGMTRDDLFGINAGIVRELVEAVADHAPAALVHVISNPVNSTVPIAAEVLKRKGVYDPRKLFGVTTLDVVRANTFVAEMKGLPLADVDVPVVGGHAAATILPLLSKARPKTAFTDEEVEALTRRIQNAGTEVVEAKAKAGGGSATLSMAYAAARFLEASLRGLDGDADVYECSYVQCQAVPELPFFACRVKLGRDGVEEVAAAGAELRGLTEFEARALEALKPQLKKSIDKGVAYAQQQPATVAMG

SEQ ID NO: 45028 - DNA, 1065 bp, Oryza sativa (japonica cultivar-group)
  CDS (1)..(1065)
atgcagcccgactccgcctcccaccgcatcgcccgcgtcgccgcccacctcagcccgtcgccgcgcccccagatggaggagggggtgaggccggcgccatgcagggccaagggcggcgcgccggggttcaaggtggccgtgctgggcgcggcgggagggatcgggcagccgctgtcgctgctcatgaagttgaacccgctcgtctctgtgctccacctctatgatgtcgtcaacacgcccggtgtcaccgccgatgtcagccacatggacaccaccgccgtggtccgtggtttccttgggcccaaccagcttgaggcagcacttacaggaatggatcttgtcattatccctgctggtctcccaaggaaaccaggaatgacaagggatgatttgttcaacaaaaacgctgggattgttcgctcactttgtgaaggcgttgccaagtgctgtccaaatgcaattgtgaacttgatcagcaacccagtgaactcaaccgtccccattgcagcagaggttttcaagaaagctggaacttatgatcccaaacgtctccttggagttacaacactggatgtagcaagggcaaacacctttgtggctgaagtacttggaattgacccaaaagatgtcaatgttccagttgttggtgggcatgctggagtgactatattacccctcctctcccaggtccaccccccatgctcatttaccccagatgaaatcagctatttgactaaacgcatacagaatggtggcacagaagttgttgaggcaaaggcaggagcaggctctgcaactttgtcaatggcttttgctgcagcaaaatttggtgatgcatgcttgcgagcaatgcgtggtgatgctggcgttgtggaatgttcatatgttgcatctgcggtgaccgagttgccgttctttgcaacaaaagtgaggttaggtcgtgctggagccgaagaggttctccctctggggccgttgaatgattttgagagagctggcttggagatggcaaagaaagagctgatggagagcattcagaagggcatcgatttcatgaacaagtga

SEQ ID NO: 45029 - protein, 354 aa, Oryza sativa (japonica cultivar-group)
MQPDSASHRIARVAAHLSPSPRPQMEEGVRPAPCRAKGGAPGFKVAVLGAAGGIGQPLSLLMKLNPLVSVLHLYDVVNTPGVTADVSHMDTTAVVRGFLGPNQLEAALTGMDLVIIPAGLPRKPGMTRDDLFNKNAGIVRSLCEGVAKCCPNAIVNLISNPVNSTVPIAAEVFKKAGTYDPKRLLGVTTLDVARANTFVAEVLGIDPKDVNVPVVGGHAGVTILPLLSQVHPPCSFTPDEISYLTKRIQNGGTEVVEAKAGAGSATLSMAFAAAKFGDACLRAMRGDAGVVECSYVASAVTELPFFATKVRLGRAGAEEVLPLGPLNDFERAGLEMAKKELMESIQKGIDFMNK

SEQ ID NO: 45030 - DNA, 1146 bp, Eremothecium gossypii
  CDS (1)..(1146)
atgcaagcaagcacttactacgtgatctcaaacatgccacacactacagccgactcttccactcagcgcgtgcgcgtcgcagtcctaggcgcagccggcggaattggacagccactgtccctgctactaaaaacccagcttgcccaggtgctcggcgacgcaaatgcgtccctggagctggctctctacgatgttgcagcagacgcgctggccggcgtggcggcagacctgtcgcacgtcaacacaccggttgaggtgtcgcaccacgtgcccagtagccgggaggacgaggaggcgttgcgcgaggcgctgacgggtgcgagtgtggttgtgattccagcgggtgtcccgcggaagccgggcatgacgcgcgacgacctgatcaacatcaacgccgggatcatcaagacgctggcgaagggcattgcaggcgcgtgcgacctcgagaaggtgttcgtgctggtgatctcgaaccccgtcaactcgctggtgcctgtgatggtgcgccagctgatccgccatgcggaagccaagcaggccccccacgccggcgtggagcgccgcgtgttcggggtgacacagctggatatggtgcgtgcgtctgcattcgtgcgctcgctcggcgagcttggcaacgaggtgccttccgtgccggtgattggcgggcactccggcgagacgatcctgccgctgttcgggcctgtgcaacagcgcctgcagttttcgctggagcagcgcaagaagctcacgcaccgcgtgcagtacggcggcgacgagatcgtggctgcgaagaagggggctgggtctgcaacgctttccatggcctacgcggcctacgtggtcgcggagcgctttaccaacctcgtgctgggcaacgtttcggagatccaggagaccctctacgtttcgctgtacgaccgcgagaacaagcccattgcggaaggcgctgcggagcttttgtccaatattggggagaccccgtactttgcggtccccgtaaaaatctccgctgacgcaggcgttgtgcgcgttgagcacgaggtctggcagcaattagacgactacgacagggagcacctgcttccagcgtgtctggagggcttgcgcaagaacatcgagaccggggagaccttgggcagcaattag

SEQ ID NO: 45031 - protein, 381 aa, Eremothecium gossypii
MQASTYYVISNMPHTTADSSTQRVRVAVLGAAGGIGQPLSLLLKTQLAQVLGDANASLELALYDVAADALAGVAADLSHVNTPVEVSHHVPSSREDEEALREALTGASVVVIPAGVPRKPGMTRDDLININAGIIKTLAKGIAGACDLEKVFVLVISNPVNSLVPVMVRQLIRHAEAKQAPHAGVERRVFGVTQLDMVRASAFVRSLGELGNEVPSVPVIGGHSGETILPLFGPVQQRLQFSLEQRKKLTHRVQYGGDEIVAAKKGAGSATLSMAYAAYVVAERFTNLVLGNVSEIQETLYVSLYDRENKPIAEGAAELLSNIGETPYFAVPVKISADAGVVRVEHEVWQQLDDYDREHLLPACLEGLRKNIETGETLGSN

SEQ ID NO: 45032 - DNA, 999 bp, Eremothecium gossypii
  CDS (1)..(999)
atgttttgccgggtagctagacgtggattcagggcagatggcgtgcgcgcataccgggtgtccgtgctgggagccaacggcggtatcggacagcctttgtcacttctgttgaagctcaacaagcgggttaccgacctgcgcctgtatgatctcaagggtgccaagggtgtagcagcagacctgtcccacatccctacgaactcgcaggtaagcgggtacactgcggagaaccccgaggcgctgcgcgaggcgcttacgggtgcggacgtagtagtggttccagccggcgtgccccgcaagccgggcatgacgcgggacgacctgttcgccattaacgcgggcgtcgtgcagcagcttgctggggcgattgggcagcatgcgccgggcgcagcagtgcttgtaatctctaacccggtcaactcgacggtgcctatcatggccgcggagctgcgcaagctgggggtgtacgacccacgtaaactgttcggcgtgaccaccctggacagcatccgggcgtcgcgcttcatctctgaggtgcaggggacggaccccacgcgggagcgcgtgcccgtgatcggcggccactccgggatcacaatcatcccggtgttgtcgcagacgcagcacacgggcatcgacaaggccacccgcgacgcgttgattcaccggatccagtttggcggcgacgaggtcgtgaaggccaagaacggcgcgggctctgccacgctatcgatggcgcgcgcaggagcgaagttcgcggacgccgtgttggccggtctggcgggcgagcagggcgtggtggaaccggccttcgtcgactcgcctctctacaagagcgagggcattgagttcttcgcctctgccgtcacgctcggcccacgcggtgtcgaggaggtccaccctgtcggcaccctgtcagccgaggaggaggagatgctagctaagtgcaaggagactttgaagcagaacatcgagaagggtatcaacttcgccaagtaa

SEQ ID NO: 45033 - protein, 332 aa, Eremothecium gossypii
MFCRVARRGFRADGVRAYRVSVLGANGGIGQPLSLLLKLNKRVTDLRLYDLKGAKGVAADLSHIPTNSQVSGYTAENPEALREALTGADVVVVPAGVPRKPGMTRDDLFAINAGVVQQLAGAIGQHAPGAAVLVISNPVNSTVPIMAAELRKLGVYDPRKLFGVTTLDSIRASRFISEVQGTDPTRERVPVIGGHSGITIIPVLSQTQHTGIDKATRDALIHRIQFGGDEVVKAKNGAGSATLSMARAGAKFADAVLAGLAGEQGVVEPAFVDSPLYKSEGIEFFASAVTLGPRGVEEVHPVGTLSAEEEEMLAKCKETLKQNIEKGINFAK

SEQ ID NO: 45034 - DNA, 1458 bp, Eremothecium gossypii
  CDS (1)..(1458)
atggctcgcgtaaccgtccttggcgccgccggtggcatcggccagccgctctctctgctactcaagacctgcagcctcgtttccgagctgaacctctacgacttgcgcaacgcccccggcgtcgcagccgacgtctcgcacgtcaacaccgactgccgcgttgccggcttcgagggccccgccgagctgggccgcgcgctgcgcggcgcggacctcgtcgtcatcccggccggcgtcccgcgcaagcccggcatgactcgcgacgacctcttcggcatcaacgccggcatcgtccagagcctggtgaccgccgtcgcgaagcactgtcccgccgcccgcctgctcatcatctccaaccccgtcaacagcaccgtgcccatcgctgtcgagaccctcaagcgcctcggcaagcttaacgccgcgcgcgtcttcggcgtcaccaccctagacctcgtgcgcgcccagagcttcctcgccgacgcgctgggtcgcgacgcccaccgcgtcgccgacctcgcgtcccacgtgaccgtcgtcggaggccacgccggccgcaccatcgtcccgctgctggccgacgctcagctgcgcgagctacagcgccgcggcctctacgactcctacgtccaccgcgtgcagttcggcggcgatgaggtcgtcaaggccaaggccggcgccggctccgccaccctctccatggccctggcaggcttccacttcgccgagctgctgctgcgctcgctggctggtgaggccgtcgcccccgagcctgccttcgtctacctgccgggcctcccaggcggtgccgacctcgcccgcgcgctagccgccacggaacccgtagactactttgcggcccccgtgcgcctggccgccggcgacgccgccgtcgtcgacactgcctttgtggccgacctggctcccgagcagcgcgctctggtcgacgccgcgcttcccgagcttgccgcgagtatccgcaagggcgtcgactttgtgcacgccccaaggcccgcctttagtcgccgtctttacatagccccggtaagctcggctccgccgtcacatataagagtcgtcctaaccgccttcttcgcgggtcgtaccacccgtgcgcggccccgttcaccgctcttccggcctccttttgcccgcccaaacggcaccgcgtgggcgcgcgggctgcaggcggacacccaggggatgcgtctcgccccccaagctgttataatagtaaaccaatcagctccacgttatcgctacagcctaactatcaagagagtggtcgtccacacacacaccacaggcagacttctgcttttcactttcgcctactacacgcccaagcgtgcacttcctgcgcaggacggaccaagacaagcgcgcatcacgagctcgcgacgaccaaccactgccagactacgcttgctgggtgggcacagggtatatacggctttataa

SEQ ID NO: 45035 - protein, 485 aa, Eremothecium gossypii
MARVTVLGAAGGIGQPLSLLLKTCSLVSELNLYDLRNAPGVAADVSHVNTDCRVAGFEGPAELGRALRGADLVVIPAGVPRKPGMTRDDLFGINAGIVQSLVTAVAKHCPAARLLIISNPVNSTVPIAVETLKRLGKLNAARVFGVTTLDLVRAQSFLADALGRDAHRVADLASHVTVVGGHAGRTIVPLLADAQLRELQRRGLYDSYVHRVQFGGDEVVKAKAGAGSATLSMALAGFHFAELLLRSLAGEAVAPEPAFVYLPGLPGGADLARALAATEPVDYFAAPVRLAAGDAAVVDTAFVADLAPEQRALVDAALPELAASIRKGVDFVHAPRPAFSRRLYIAPVSSAPPSHIRVVLTAFFAGRTTRARPRSPLFRPPFARPNGTAWARGLQADTQGMRLAPQAVIIVNQSAPRYRYSLTIKRVVVHTHTTGRLLLFTFAYYTPKRALPAQDGPRQARITSSRRPTTARLRLLGGHRVYTAL

SEQ ID NO: 45036 - DNA, 1014 bp, Danio rerio
  CDS (1)..(1014)
atgttctcccgcgtcgcaagaccaacagcctccctcgtccgaagcttgtccacctcatcccagaacaatgcaaaagtagctgttctgggtgcctcaggtggcatcgggcagccactgtccctcctgctgaagaacagccctttagtaagcgagctgtccctctttgatatcgcccacactcctggagtggctgctgacctcagtcacatcgagaccagagcccatgtcaaagggtacattggagcagatcagctaggtgatgcactgaaaggctgtgaggttgtcgtcatccctgctggcgtcccaaggaaacctggtatgacccgtgatgatctgtttaacaccaatgcaaccattgtggccacactcgttgatggctgtgcccgtcactgccctcaagccatgatctgcatcatttcaaacccagtgaactccactatcccaatcacatcagaggtgatgaagaaacatggcgtctacaaccccaacaaaatctttggcgtcacaacgttggacattgtcagggcaaacacttttgttgctgagctcaaaggccttgatcccgccagagtcaatgtacccgttgttggaggtcatgctggaataaccatcattcctctcatttcacagtgcactcctaaggttgagttccctgcagatcagctctctgctttgacaggcaggatccaggaagcaggaactgaggttgtgaaggctaaagctggtgcaggctctgccactctgtccatggcctatgctggagccaggttcacattctccctcctcgatgccatgaatggaaaagagggtgttgttgaatgctcatttgtgagatctgaggaaaccgaatgcaaatatttctctacacctcttctgctcgggaaaaatggcattgaaaagaaccttggccttgggaagctctctgcatttgaggagaagcttgtggctgatgccatgactgagctgaagggctccatcaagaaaggagaagactttgtagcaaacatgaagtga

SEQ ID NO: 45037 - protein, 337 aa, Danio rerio
MFSRVARPTASLVRSLSTSSQNNAKVAVLGASGGIGQPLSLLLKNSPLVSELSLFDIAHTPGVAADLSHIETRAHVKGYIGADQLGDALKGCEVVVIPAGVPRKPGMTRDDLFNTNATIVATLVDGCARHCPQAMICIISNPVNSTIPITSEVMKKHGVYNPNKIFGVTTLDIVRANTFVAELKGLDPARVNVPVVGGHAGITIIPLISQCTPKVEFPADQLSALTGRIQEAGTEVVKAKAGAGSATLSMAYAGARFTFSLLDAMNGKEGVVECSFVRSEETECKYFSTPLLLGKNGIEKNLGLGKLSAFEEKLVADAMTELKGSIKKGEDFVANMK

SEQ ID NO: 45038 - DNA, 1011 bp, Neurospora crassa
  CDS (1)..(1011)
atgttcgccgcttccagaatccagacccgtgccttctcggcctctgcccgccagcttaccaaggtctccgtcctcggtgccgccggtggcattggccagcccctctccctcctcctcaagctcaaccccagagtctccgagctcgccctctacgatatccgtggcgcccccggtgtcggtgctgatctgtcccacatcaacaccaagagcaccgtcaagggctacgagcccaccgcctccggtctcgccgatgccctcaagggctccgaaatcgtcctcatccccgccggtgtcccccgcaagcccggcatgacccgtgacgacctcttcaacaccaacgcctccatcgtccgcgacctcgccaaggcctgcgccgagtcgtgccccgaggccaacatcctcgtcatctccaaccccgtcaactccaccgtccccatcgtctccgagatcttcaagaaggccggtgtctacaaccccaagcgcctcttcggtgtcaccaccctcgacgtcgtccgcgcctcccgcttcgtttccgagatcaagggcaccgaccccaaggacgagaacatcaccgtcgttggcggccactccggcgtcaccatcgtccccctcttctcccagagcaagcaccccgaactctccaagaacgagcagctcatccaccgcgtccagttcggtggtgacgaggtcgtcaaggccaaggacggtgccggttccgccaccctctccatggccatggccggtgcccgcatggccgagtccctcctccgcgccgcccagggcgagaagggcgtcatcgagcccacctttgtcgactcccctctctacaaggaccagggcatcgacttcttcgcctccaaggtcgagctcggccccaacggtgttgagaagatctaccccgtcggccccgtcgatgaggttgagcagaagctccttgatgcctgccttgttgacctcaagaagaacatccagaagggcaaggactttgtcgccgccaaccccggcaaataa

SEQ ID NO: 45039 - protein, 336 aa, Neurospora crassa
MFAASRIQTRAFSASARQLTKVSVLGAAGGIGQPLSLLLKLNPRVSELALYDIRGAPGVGADLSHINTKSTVKGYEPTASGLADALKGSEIVLIPAGVPRKPGMTRDDLFNTNASIVRDLAKACAESCPEANILVISNPVNSTVPIVSEIFKKAGVYNPKRLFGVTTLDVVRASRFVSEIKGTDPKDENITVVGGHSGVTIVPLFSQSKHPELSKNEQLIHRVQFGGDEVVKAKDGAGSATLSMAMAGARMAESLLRAAQGEKGVIEPTFVDSPLYKDQGIDFFASKVELGPNGVEKIYPVGPVDEVEQKLLDACLVDLKKNIQKGKDFVAANPGK

SEQ ID NO: 45040 - DNA, 993 bp, Neurospora crassa
  CDS (1)..(993)
atggtcaaggccgttgttgctggcgccgctggcggtatcggacagcccctgtccctcctcctcaagctgtctcctctcgttgacgagctcgccctctacgatgtcgtcaacacccccggtgttgctgccgatctctctcacatctcctcccccgccaaaaccaccggctaccttccccccaacgacggcgccaaggccgccttcaaggatgccgacatcattgtcatccccgccggtattcctcgcaagcctggcatgacccgtgatgatctcttcaacatcaacgccggtatcgtcaagggcttgattgaggttgctgctgatgtggcccccaacgcattcatcctcgtcatctccaaccctgtcaactcgactgtccccatttccgccgaggtcctcaaggccaagggtgtcttcaacgcccagcgcctcttcggtgtcaccaccctcgatattgtccgtgccgagaccttcgttgctgagattgctggcaatagcaacccccaggagctcgttgtccccgtcatcggtgggcactccggcgagaccatcgttcctctcttcagcaaggtgtccccctcggtcaccatccctgacgacaagtacgatgctcttgtcaaccgcgtccagttcggtggtgatgaggtcgtcaaggccaaggagggtctcggctctgccaccctctccatggcttatgccggttatcgcttcgctgagaagctcctcaaggccgccaagggcgccaagggccttgtcgagcccacctacgtctatctccccggtattcccggtggtaaggagatcgcggagaagactggtgttgacttcttctccgtccccgtcgagctcggccccaatggtgctgagaaggctattgacatcctcggcgacatcaccgagaaggagaagactctcctcgaggctgccatcaagggcctcaagggcaacatccagaagggcgttgactttgcccacaacccccctcagaagtag

SEQ ID NO: 45041 - protein, 330 aa, Neurospora crassa
MVKAVVAGAAGGIGQPLSLLLKLSPLVDELALYDVVNTPGVAADLSHISSPAKTTGYLPPNDGAKAAFKDADIIVIPAGIPRKPGMTRDDLFNINAGIVKGLIEVAADVAPNAFILVISNPVNSTVPISAEVLKAKGVFNAQRLFGVTTLDIVRAETFVAEIAGNSNPQELVVPVIGGHSGETIVPLFSKVSPSVTIPDDKYDALVNRVQFGGDEVVKAKEGLGSATLSMAYAGYRFAEKLLKAAKGAKGLVEPTYVYLPGIPGGKEIAEKTGVDFFSVPVELGPNGAEKAIDILGDITEKEKTLLEAAIKGLKGNIQKGVDFAHNPPQK

SEQ ID NO: 45042 - DNA, 993 bp, Magnaporthe grisea 70-15
  CDS (1)..(993)
atggtcaaggccgttgttgctggtgccgccggtggcattggacagcccctttcgctgctcctgaagctctgccctttggtcgatgagcttgccctttacgatgtcgtcaatacccccggtgttgccgctgatctctctcacatctcctctaacgcgaaaatcgccggttaccttcccaaggacgatggtggcaagaaggccctcaaggatgccgacctgattgtcattcctgctggcgttccccgcaagcctggaatgacccgtgatgatctcttcaacatcaacgccggcatcgtgaagggacttatcgagatcgctgccgaggtcgcccccaaggccttcatcctggttatttctaaccccgtcaactcaacggttcccatctcggccgaggttctcaaggccaagggtgtcttcaacccgcagcgcctctttggtgtcaccaccctggacattgtccgcgccgagaccttcgtcgctgagatcgccggcaagtccaacccccaggagttgaccgtccccgtcattggcggtcactcgggcgagaccatcgtgccccttttcagccaagtcaagcctgccgtcaccatccctgacgacaagtacgacgctctcgtcaaccgtgttcagtttggcggtgacgaggtcgtcaaggccaaggatggcgctggctcggcaaccctcagcatggcatatgctggctaccgatttgccgagaagctgctcaaggccatcaagggtgccaagggtctcgttgagcccagctatgtctatctccccggtgtccccggtggcgaggcaattgccaagaagaccggttgcgactttttctcggttcccatcgagctcggtcccaacggagctgagaaggcacatgacgtgctcggcgagctgaccagcaaggagcagacgcttctggaggcagccgtcaacggactcaagggcaacatccagaagggtgttcagttcgtcaacagccctcctcaaaagtaa

SEQ ID NO: 45043 - protein, 330 aa, Magnaporthe grisea 70-15
MVKAVVAGAAGGIGQPLSLLLKLCPLVDELALYDVVNTPGVAADLSHISSNAKIAGYLPKDDGGKKALKDADLIVIPAGVPRKPGMTRDDLFNINAGIVKGLIEIAAEVAPKAFILVISNPVNSTVPISAEVLKAKGVFNPQRLFGVTTLDIVRAETFVAEIAGKSNPQELTVPVIGGHSGETIVPLFSQVKPAVTIPDDKYDALVNRVQFGGDEVVKAKDGAGSATLSMAYAGYRFAEKLLKAIKGAKGLVEPSYVYLPGVPGGEAIAKKTGCDFFSVPIELGPNGAEKAHDVLGELTSKEQTLLEAAVNGLKGNIQKGVQFVNSPPQK

SEQ ID NO: 45044 - DNA, 1011 bp, Magnaporthe grisea 70-15
  CDS (1)..(1011)
atgtttgctgcatcaaggatccagacccgtgccttttcggctgcggcgcgcaacctctccaaggttaccgttctcggcgccgccggtggcatcggtcagcctctctccctcctcctcaagctcaaccccagggttactgagcttgcgctgtacgacattcgtggaggccccggtgtcgctgccgacatctcgcacatcaacaccaagtcaaacgtcaagggctacgaccccacgccctccggccttgctgccgccctcaagggctccgaggttgtcctcatccccgccggtgtcccccgcaagcccggcatgacccgtgacgacctcttcaacaccaacgcctccatcgtccgcgacctggccaaggcctgcgccgagtcttgccccgaggccaacatcctggtcatcagcaaccccgtcaactcgaccgtccctatctgcgccgaggtcttcaaggcccgtggtgtctacaaccccaagcgcctctttggtgtcaccaccctcgacgtcgtccgtgcctcgcgcttcgtctccgagatcaagggctccgaccccaaggacgagaacatcaccgtcgtgggcggccactctggtgtgaccatcgttcccctcttcagccagagcaaccaccccgacctgtctgccaacgaccagctcgtcaaccgcgtccagttcggtggtgacgaggtcgtcaaggccaaggacggtgccggttccgccaccctctccatggccatggccggtgcccgcatggccgagtcggtcctgcgcgccgctcagggcgagaagggcgtcatcgagcccacctttgtcgactcgcccctctacaaggaccagggcatcgagttcttcagctcaaaggtcgagctcggccccaacggtgtcgagaagatcctgcccattggcgagattgacgccaacgagcagaagctgctcgacgcctgcgtgggcgacctgaagaagaacattgagaagggtgttgcctttgttgcctccaaccccggcaaataa

SEQ ID NO: 45045 - protein, 336 aa, Magnaporthe grisea 70-15
MFAASRIQTRAFSAAARNLSKVTVLGAAGGIGQPLSLLLKLNPRVTELALYDIRGGPGVAADISHINTKSNVKGYDPTPSGLAAALKGSEVVLIPAGVPRKPGMTRDDLFNTNASIVRDLAKACAESCPEANILVISNPVNSTVPICAEVFKARGVYNPKRLFGVTTLDVVRASRFVSEIKGSDPKDENITVVGGHSGVTIVPLFSQSNHPDLSANDQLVNRVQFGGDEVVKAKDGAGSATLSMAMAGARMAESVLRAAQGEKGVIEPTFVDSPLYKDQGIEFFSSKVELGPNGVEKILPIGEIDANEQKLLDACVGDLKKNIEKGVAFVASNPGK

SEQ ID NO: 45046 - DNA, 1011 bp, Gibberella zeae PH-1
  CDS (1)..(1011)
atgttcgccgcttctcgcatccagcgccgtgctttctccgccaccgcccgggacctttccaaggtcaccgttctcggtgctgctggtggtatcggccagcctctctctctcctcctcaagatgaacccccgcgtcactgacctcgccctctacgatatccgtggcggacccggtgttgctgctgacatctcccacgtcaacaccaagtccagcgtcaagggatacgagcccaacgcggctggtctcaaggaggctctctccggcgctgaggtcgtcctcatccccgctggtgtcccccgcaagcccggtatgacccgtgacgatcttttcaacaccaacgcctctatcgtccgcgacctcgccaaggccgccgctgaggctgcccccaaggccaagctcctgatcatctccaaccccgtcaactccaccgtccccatcgtcaaggaggtttacaaggctgccggtgtctacaaccccaagaccctcttcggtgtcaccaccctcgacgttgtccgtgcctcccgattcgtttccgagatcaagggcaccgaccccaaggacgagaacatcaccgtcgttggtggccactccggtgtcaccatcgtccctctcttctctcagtccaaccaccccgacctctcctccaacgctgagctcgtcaagcgtgtccagttcggtggtgacgaggttgtcaaggccaaggacggtgctggctctgccactctctccatggccatggctggtgcccgcatggctgactccgtcctccgcgccgtccagggcgagaagggtgtcaaggagcccgctttcgtcgagtctcctctctacaaggaccagggtattgagttcttcagctctcaggtcgagctcggccccgagggtgttgagaagatccaccctctcggcaagctcgacgccaacgaggagaagctcgttgacgccgctctcgtcgacctcaagaagaacattgagaagggtgttgccttcgttgcctccaaccctcccaaataa

SEQ ID NO: 45047 - protein, 336 aa, Gibberella zeae PH-1
MFAASRIQRRAFSATARDLSKVTVLGAAGGIGQPLSLLLKMNPRVTDLALYDIRGGPGVAADISHVNTKSSVKGYEPNAAGLKEALSGAEVVLIPAGVPRKPGMTRDDLFNTNASIVRDLAKAAAEAAPKAKLLIISNPVNSTVPIVKEVYKAAGVYNPKTLFGVTTLDVVRASRFVSEIKGTDPKDENITVVGGHSGVTIVPLFSQSNHPDLSSNAELVKRVQFGGDEVVKAKDGAGSATLSMAMAGARMADSVLRAVQGEKGVKEPAFVESPLYKDQGIEFFSSQVELGPEGVEKIHPLGKLDANEEKLVDAALVDLKKNIEKGVAFVASNPPK

SEQ ID NO: 45048 - DNA, 993 bp, Gibberella zeae PH-1
  CDS (1)..(993)
atggtcaaggctgttgttgctggcgcctctggtggcattggccagcccctctctctcctcctcaagacctctcctcacattgacgagctcgccctgtacgatgtcgtcaacacccccggtgtcgctaccgatctctctcacatctcctcccgtgccaagaccactggctaccttcccgccaacgatggcgctaaggctgccttcaaggacgctgacattattgtcatccccgctggcattcctcgcaagcctggaatgacccgtgatgatctcttcaatatcaatgctggcattgtcaagggtctcatcgaggtcgctgctgaggtcgcccccaaggctttcatcctcgtcatctccaacccagtcaactcgactgtccccatctctgccgaggtcctcaaggccaagggggttttcaaccctcagcgtctctttggtgtcaccaccctcgacatcgtccgtgccgagaccttcgttgctgagatcactggcaaggccaacccccaggagctgaccatccccgtcattggtggtcactctggcgagactattgttcccctcttcagcaaggcctctccttcagttcagatccccgacgacaagtacgatgctctcgtaaaccgcattcagttcggcggtgacgaagttgtcaaggccaaggacggtgctggttccgccaccctgtccatggcctatgccggtttccgattcgccgagaaggttctccgtgccgtcaagggcgagaagggccttgttgagcccagctacgtctaccttcccggtgttcccggaggcgaggccattgctaaggaaactggctgcgacttcttctctgtccccatcgagcttggccccaacggtgctgagaaggccaccaaccccttcgagggcattaccgagaaggagaaggctctgctagccaaggccaccgagggcctcaagggcaacatcaccaagggtgtcagctttgtccacaaccctccccaaaagtga

SEQ ID NO: 45049 - protein, 330 aa, Gibberella zeae PH-1
MVKAVVAGASGGIGQPLSLLLKTSPHIDELALYDVVNTPGVATDLSHISSRAKTTGYLPANDGAKAAFKDADIIVIPAGIPRKPGMTRDDLFNINAGIVKGLIEVAAEVAPKAFILVISNPVNSTVPISAEVLKAKGVFNPQRLFGVTTLDIVRAETFVAEITGKANPQELTIPVIGGHSGETIVPLFSKASPSVQIPDDKYDALVNRIQFGGDEVVKAKDGAGSATLSMAYAGFRFAEKVLRAVKGEKGLVEPSYVYLPGVPGGEAIAKETGCDFFSVPIELGPNGAEKATNPFEGITEKEKALLAKATEGLKGNITKGVSFVHNPPQK

SEQ ID NO: 45050 - DNA, 1683 bp, Apis mellifera
  CDS (1)..(1683)
atgtcaactgtaagtcaaatttcggctaaaaaatatatttttgaaagtaataaaaatattcctgtcaagtattttctaccgacagaagttgcagtacataatacagagattgattgttggatctcatatcatggtgaagtatatgatctaagtgatctttgtaaaatttgggctaacaaaagagagattaaaccaatactggcttatgctggtaaggatataagtcattggtttgatcacgaaaagaatgatattaaacattatgtgcatcctattactggagtattggtaccatattgtcctcatggtccgattccggatgtaatatcttctgtggtacctgctaatgactggcgagcattagacaaatgtccttggtggttagacgaaaaatataaaataggaaaattaactaaaaaagcacgtccatgtaggattttaaatgttttaatcggcatacaagttgttataatggtctgtgaagaagattctattagacgtatccaagaacgtgctcttatttataattcaaattgcatgttttatacgtggaaattcgaaggaaaggatttaaatctcgatttaactttgacagaaaatggtattccagacgaacaagatcgttttgccgcttgcggtcttcccgatgattactatgtcccgtgtcttatatctcgtttttttttaacaaacaaaaatattttaccaattaataacacgcaaattaacgatttctcatcaaaatctatgaaagtagctattttgggtgctcgtagcaagacaggaaattgcctttcattatttttaaaacaatcacctttgatcgatgaattggcaatttttgataacaactcgtctacttacggtcttgcgttggatttaaattatatcgacacgaaatgtaaggttagcacgtgtaatcatcctgaaaaatgtctcgaggagacgcttcaaggagcgaagatagtgatgatcgtgaccgatagaacatccaacgaatcgaacgaagttttaaaatctaatgcaattatattatcagatctgttaccgaatattattaaattttcacctcagaaagctggaatttacgagtacaatcgcatctttggcgtaatgaatttcgagtgtcttaaagcgaacagcttcaccgcggatttgattaatatcgagccggaatgcacaatgatacccgtgattggcgggggctgttccgaaacgtgcattccacttttttcacaagcgaaaccttccaacaaaatatctcaggtggaagcaagaagattgacatacgcgataaggatgtccaataataatacgttgaatccaagcgaaaataaagaaacgaattctttcgctttgtcttacgctgccgctagattttgcatgtccctttgcaaagctttgcggcatcaaggaaacgtggtggaatgcgcttacgttagatcctgcgcgataccggaattgacgtatttcgctgcccccttggaattaggcccgaacggaattcagaagcatttggatatcccaccattgaacgattacgagtgtgagcttctcaaagcagctgtaccccgtataaaaaaggctattaaattaggagagactctcgcactcggagacgacaattcctcttccgaattgtgcttgaataatttaatgtcaaatcctaaatgtttctcgtaa

SEQ ID NO: 45051 - protein, 560 aa, Apis mellifera
MSTVSQISAKKYIFESNKNIPVKYFLPTEVAVHNTEIDCWISYHGEVYDLSDLCKIWANKREIKPILAYAGKDISHWFDHEKNDIKHYVHPITGVLVPYCPHGPIPDVISSVVPANDWRALDKCPWWLDEKYKIGKLTKKARPCRILNVLIGIQVVIMVCEEDSIRRIQERALIYNSNCMFYTWKFEGKDLNLDLTLTENGIPDEQDRFAACGLPDDYYVPCLISRFFLTNKNILPINNTQINDFSSKSMKVAILGARSKTGNCLSLFLKQSPLIDELAIFDNNSSTYGLALDLNYIDTKCKVSTCNHPEKCLEETLQGAKIVMIVTDRTSNESNEVLKSNAIILSDLLPNIIKFSPQKAGIYEYNRIFGVMNFECLKANSFTADLINIEPECTMIPVIGGGCSETCIPLFSQAKPSNKISQVEARRLTYAIRMSNNNTLNPSENKETNSFALSYAAARFCMSLCKALRHQGNVVECAYVRSCAIPELTYFAAPLELGPNGIQKHLDIPPLNDYECELLKAAVPRIKKAIKLGETLALGDDNSSSELCLNNLMSNPKCFS

SEQ ID NO: 45052 - DNA, 1035 bp, Ustilago maydis 521
  CDS (1)..(1035)
atgttcgctcgtcaggctcttcgcttggctgtgcccaaggccgccgcgcctcgtttcttctcgtcatcgaccgccaacaaccgcgccgtcgccgttctcggtgcttctggcggtatcggacagccgctttctcttctgctcaagcagaaccctttggtctcggacctgcgcctgtacgatgttcgtctcgctcccggtgtcgccgccgacatttcgcacgtcaacaccccctccaccaccaccggttaccaggctgaccagctcggtgaggcgctcaaggatgtcgaggtcatcgtcatccctgctggtgtcccccgtaagcccggaatgactcgtgacgaccttttcaacaccaacgcctcgatcgtccgtgatctcgccaagaaggccgccgaagtcgcccccaaggctcacctcctgatcatctcgaaccctgttaactcgactgtccccatcgtcgccgaggtgttcaagaaggccggtgtctacgaccccaagaagctgtacggtgtcaccaccctcgatgtcactcgtgcttccaccttcctttcgggcatctcgggcaagaagccctcggagaccattgtgcctgtcgtcggtggtcactcgggtgtcacgattgtacccttgctctcgcaggccaacggcggtgacgccgttgccaagggcgagcagtacgagaagctcgtccaccgcatccagttcggtggtgacgaggtcgtcaaggccaaggacggtgccggttcggctaccctctcgatggcttatgctgccgccgtattctccgactcgctcctcaaggctctcaacggtgagaagggcatcaaggagtgcgcctacgtcgagtcgcccctgtacaaggaccagggcgccaccttcttcgccagccccgtcacgctcggcaaggatggtgttgaggagatccactcggtcggcaaggtctcggctgaggaggagaagctcctcgaggctgctatccccgagcttgccaagaacatcaagaagggtgtcgactggtacgccgcctcgccctaa

SEQ ID NO: 45053 - protein, 344 aa, Ustilago maydis 521
MFARQALRLAVPKAAAPRFFSSSTANNRAVAVLGASGGIGQPLSLLLKQNPLVSDLRLYDVRLAPGVAADISHVNTPSTTTGYQADQLGEALKDVEVIVIPAGVPRKPGMTRDDLFNTNASIVRDLAKKAAEVAPKAHLLIISNPVNSTVPIVAEVFKKAGVYDPKKLYGVTTLDVTRASTFLSGISGKKPSETIVPVVGGHSGVTIVPLLSQANGGDAVAKGEQYEKLVHRIQFGGDEVVKAKDGAGSATLSMAYAAAVFSDSLLKALNGEKGIKECAYVESPLYKDQGATFFASPVTLGKDGVEEIHSVGKVSAEEEKLLEAAIPELAKNIKKGVDWYAASP

SEQ ID NO: 45054 - DNA, 1374 bp, Ustilago maydis 521
  CDS (1)..(1374)
atggtcaaggctacggttatcggcgccgctggtggtatcggccagcctctctcgcttctgctcaagcagtcttcgctggtcaccgacctggcgctctacgatgtcgtcaacgcgcctggcgtcgctgccgatctttcgcacatcaacaccccctcgatcgtcactggctacctccccgccgatggcggtctgggcaaggcgctcaagggtgccgacattgtcgtcatccctgccggtgttccccgcaagcctggtatgacgcgtgatgaccttttcaacctgatttccaagattgagcacgcgtatcgagagagtcgagagagtcgagagatgttgcgtgtttccaagctcgatttttgggaagcaaattatcttgttggtccaagcgcagagtcacgaatcgtcgcgctctcgaaaaagccggcagttggtcagaggacgcagctcgcaaacctcgagcaagctgccactcggcagagaaagcagctactgacaacatggcttgccatttttatccctccttctcactcggcgacgttggtgcgcactcgaatgttgcacgatcgacacggtgccattttcgattcgacggatgctgcacccccaacatttcttgacactcttgcatccacctgcatccgccaaacaaccacgacgatcaacgctggtatcgttcgcgacattgccgtcggcatcgctgagcattcgcccaaggcctttgtgctcgtcatctcgaaccctgtcaattcgacggtgcccatcgttgccgaggtgctcaagaagaagggcgtttacgatgccaagcgtctctttggtgtgaccacgctcgacgtggtgcgtgcgtcgacgttcatctcggaggcggctggcaagcccaccgaatcgctcaactaccgcatccccgtggtaggcggacactctggtgtcacgattgtccccttgatcagccagtcgcagccaccgatctcggtggaccaggccaagatcgagcagctcaccaaccgcatccagttcggcggtgacgaggtggtcaaggccaaggacggtgccggatcggctacgctgtccatggcctacgctggtgcgcgctttgccatcgccgtcctcgaggcggcttctggcaagtcgctcgctcaccccgagatgggctacgtcgacctcacctcggacgccgctggcgccaagcagatcaccgccgtcatcggcaacgacactcccttcttctccgtgccgcttcagctcggtcccagcggtgttgagaagatccttcccctcggtaagctcaacgactacgagtctgagcttatcaagaaggccgtcgtcgacctcaacggcaacatcagcaagggtgttcagttcactgctaacctttga

SEQ ID NO: 45055 - protein, 457 aa, Ustilago maydis 521
MVKATVIGAAGGIGQPLSLLLKQSSLVTDLALYDVVNAPGVAADLSHINTPSIVTGYLPADGGLGKALKGADIVVIPAGVPRKPGMTRDDLFNLISKIEHAYRESRESREMLRVSKLDFWEANYLVGPSAESRIVALSKKPAVGQRTQLANLEQAATRQRKQLLTTWLAIFIPPSHSATLVRTRMLHDRHGAIFDSTDAAPPTFLDTLASTCIRQTTTTINAGIVRDIAVGIAEHSPKAFVLVISNPVNSTVPIVAEVLKKKGVYDAKRLFGVTTLDVVRASTFISEAAGKPTESLNYRIPVVGGHSGVTIVPLISQSQPPISVDQAKIEQLTNRIQFGGDEVVKAKDGAGSATLSMAYAGARFAIAVLEAASGKSLAHPEMGYVDLTSDAAGAKQITAVIGNDTPFFSVPLQLGPSGVEKILPLGKLNDYESELIKKAVVDLNGNISKGVQFTANL

SEQ ID NO: 45056 - DNA, 972 bp, Aspergillus nidulans FGSC A4
  CDS (1)..(972)
atggtcaaaattgcactcctcggtgctgccggccagatcggcacaccactgagccttctctgcaaggcaagtgacctctttgctgagattagcctgtacgatattgtgcatgtgccaggtattgccacggacctgatgcacattgacactagggcaagggtgacgggtcatctgccggacgactctggtctcaagaaggccctcactggcgccgatattgtcgtggtaactgccggtattgcgaggaagcctggaatgaccagagatgcgcagacaaacgcgagtatcatccgggacatctttgccgaaattgcagcgacatgcccgaacgcagtaagctgtgtagtcactaacccggtcaactccacactccccgttgcagcggaaacgctcaagaaggcaggtgtcttcgagccaactcgtctgttcggtataacgacgcttgacgtcgtgcgcgcctcaacctttgccgcacacgccttggacagcaacagcgacccaaaagccttcaaggtacctgtcatcggtggccatagcggcgcaacaatcctgccactctacagtcaagcggagcctccggtgaacctggataaggagaccctggctgcagtcatccaccgtgtgcaattcggcggtgacgagattgtcaagtccaaacagggcgcgggtagcgcaacaacatgcatggcgtacgccggcttccggttcgtcaaagccattgtcgctgccatgaacggtgaatccgtaacagaggaggcctacgtctacctccccggtattgcagggggccaggaaattgcacaggagctgggcgttgattacttcgccctcaaggtcaccttgggccgcacaggcgctaaccaggtcttgcccattggggagatatctgagaacgagagtacactgctgaaggttgctatcaatgatttgaaggccaacatcgtcactggggtgtcattcatggcggcttga

SEQ ID NO: 45057 - protein, 323 aa, Aspergillus nidulans FGSC A4
MVKIALLGAAGQIGTPLSLLCKASDLFAEISLYDIVHVPGIATDLMHIDTRARVTGHLPDDSGLKKALTGADIVVVTAGIARKPGMTRDAQTNASIIRDIFAEIAATCPNAVSCVVTNPVNSTLPVAAETLKKAGVFEPTRLFGITTLDVVRASTFAAHALDSNSDPKAFKVPVIGGHSGATILPLYSQAEPPVNLDKETLAAVIHRVQFGGDEIVKSKQGAGSATTCMAYAGFRFVKAIVAAMNGESVTEEAYVYLPGIAGGQEIAQELGVDYFALKVTLGRTGANQVLPIGEISENESTLLKVAINDLKANIVTGVSFMAA

SEQ ID NO: 45058 - DNA, 963 bp, Aspergillus nidulans FGSC A4
  CDS (1)..(963)
atgcctctatcccttttgctcaaggcatccccctttattgacgagctcgccctttacgatgttgtcaacacccccggtgttgccgctgacctctcccacatttcttctgttgctaaaatctcaggttacctgcccaaggaagatggcctgaaaaacgccttgactggcactgacattgtcgttatcccagctggaattcctcgtaagcctggtatgactcgtgatgaccttttcaagatcaacgctggcattgtccgtgaccttgtcaagggcattgccgaatacagccccaaggctttcatcttgatcatttcaaaccccgtcaactccaccgtacccattgctgccgaaatcctcaaagccgctggcgtctttgacccggcgcgtctctttggcgttacaactttagatgttgtccgcgcagaaaccttcacccaggagttctccggccagaaggacccatccgcagtgactgtccctgttgttggtggtcactccggcgaaactattgtccccctcttcagcaaggtttctcctgccttccagattccggcagacaaatacgatgcgcttgtcaaccgcgtccagttcggtggcgacgaggtcgtcaaagccaaggacggcgccggctctgccaccctttccatggctttcgctggcttcaggtctggcatcctgtttgcagagagcgtgatcaaagcctccaagggccagtctggcattgtcgagccaagctacgtctacctaccaggtgtgcctggtggcgcggatattgccaaggctaccggcgttaactttttctcgactcctgtcgaacttggaccgaatggtgttcaaaaggccataaacattctcgacggtattacagatgctgagaaaaagctccttgatacggctatcaagggtctcaagggcaacattgacaagggcgtcgaattcgctcagagtcccccaccaaagtaa

SEQ ID NO: 45059 - protein, 320 aa, Aspergillus nidulans FGSC A4
MPLSLLLKASPFIDELALYDVVNTPGVAADLSHISSVAKISGYLPKEDGLKNALTGTDIVVIPAGIPRKPGMTRDDLFKINAGIVRDLVKGIAEYSPKAFILIISNPVNSTVPIAAEILKAAGVFDPARLFGVTTLDVVRAETFTQEFSGQKDPSAVTVPVVGGHSGETIVPLFSKVSPAFQIPADKYDALVNRVQFGGDEVVKAKDGAGSATLSMAFAGFRSGILFAESVIKASKGQSGIVEPSYVYLPGVPGGADIAKATGVNFFSTPVELGPNGVQKAINILDGITDAEKKLLDTAIKGLKGNIDKGVEFAQSPPPK

SEQ ID NO: 45060 - DNA, 1077 bp, Aspergillus nidulans FGSC A4
  CDS (1)..(1077)
atgttcgctgctcgccaatctttcggtttccttcagaagcgggccttctcggcctctgctagccaggcctccaaggttgctgtcctcggtgccagtggcggcattggccagcctctgtccctgctcctcaagcttaacccccgtgtttccgagcttgctctctacgatatccgcggtggacctggtgtcgctgctgatatcagccacatcaacactaacagcaccgttaagggctacgagcctactgagagcggcctcgccgatgccctcaagggctccgagatcgtcctcattcctgccggtgttccccgtaagcccggcatgacccgtgacggtaaggaggatgactgtgaaaatctacgaataggcactgatcttttgatgacagacctcttcaacaccaacgcttccatcgttcgcgaccttgctaaggccgctgccaaggcttcccccgaggctaacatcctcgtcatttctaaccctgtcaactccaccgtccccatcgtctctgaggtcttcaaggccgctggcgtctacaaccccaagcgcctctttggtgtcaccacccttgatgtcgtccgtgcttcccgcttcatctctcaggtccagggtaccgacccctctaaggaggccgttcccgttgtcggtggacactctggcgtgaccatcgttcccctgctttcccagtccaaccaccccaacattgatggcaagacccgcgatgagcttgtccaccgcatccagtttggtggtgacgaggttgtcaaggctaaggacggtgctggctccgccactctctccatggccatggccggtgctcgcttcgccgagtctctcctccgcgctgcccagggcgagaagggtgtcgttgagcccactttcgtcgagagccctctctacaaggaccagggcgtcaacttcttcgcttccaaggttgagcttggccccaacggtgctgagaagatcaaccccgttggcgaggttaacgaattcgagcagaagctccttgaggcctgcctcgttgacctgaagaagaacatccagaagggtattgacttcgtcaaggccaacccttaa

SEQ ID NO: 45061 - protein, 358 aa, Aspergillus nidulans FGSC A4
MFAARQSFGFLQKRAFSASASQASKVAVLGASGGIGQPLSLLLKLNPRVSELALYDIRGGPGVAADISHINTNSTVKGYEPTESGLADALKGSEIVLIPAGVPRKPGMTRDGKEDDCENLRIGTDLLMTDLFNTNASIVRDLAKAAAKASPEANILVISNPVNSTVPIVSEVFKAAGVYNPKRLFGVTTLDVVRASRFISQVQGTDPSKEAVPVVGGHSGVTIVPLLSQSNHPNIDGKTRDELVHRIQFGGDEVVKAKDGAGSATLSMAMAGARFAESLLRAAQGEKGVVEPTFVESPLYKDQGVNFFASKVELGPNGAEKINPVGEVNEFEQKLLEACLVDLKKNIQKGIDFVKANP

SEQ ID NO: 45062 - DNA, 1056 bp, Gallus gallus
  CDS (1)..(1056)
atgcgcggcgcagtggaggtcgttggagtcacagccgccgccatgctgtcccgcctcgcccgtcccgccgctgtcctgtgccgcggcctggccaccagcgcccagaacaatgccaaggtggcagtgctgggagcatcaggagggattgggcagcctctctcccttctcctgaagaacagcccgctggtgagcaggctcaccctttacgatattgcgcacactcctggtgttgcagctgacctcagtcacatcgagacaagagcgaatgttaaaggtttcctgggacctgagcagctgccagaatgtttgaagggctgtgatgttgtagtgattcctgcaggagtccctaggaaaccaggtatgacccgtgatgacctgttcaacaccaatgctagcattgttgctactttaacaactgcctgtgcaaagcactgcccagaagccatgatctgtattatttccaacccggtaaattcaaccatacccataacttcagaagttttcaagaagcatggtgtgtataatcccaatagaatctttggtgtaacaacactggacatcgtcagagcgaatacttttgtggctgagctaaagggtttagatccagctcgagtaagtgttccagttattggtggccatgcagggaaaaccatcatccctctgatctcccagtgcacaccgaaagtggacttccctcaggatcaactggaaaagcttacagggagaattcaagaagctggcactgaagttgtcaaagccaaagcaggagcaggatctgccaccttgtctatggcctatgctggcgctcggtttgtgttctctctggtggatgccatgaatggaaaggaaggagttattgaatgttcctttgttcgctcggaagagacggagagcccatacttctctacacctctgctactgggaaaaaatggaattgagaagaacctaggcattggcaagatcaccccctttgaagagaagatggttgctgaggccatggctgagctgaaggcttctattaagaaaggagaggattttgcgaagaacttcaagtaa

SEQ ID NO: 45063 - protein, 351 aa, Gallus gallus
MRGAVEVVGVTAAAMLSRLARPAAVLCRGLATSAQNNAKVAVLGASGGIGQPLSLLLKNSPLVSRLTLYDIAHTPGVAADLSHIETRANVKGFLGPEQLPECLKGCDVVVIPAGVPRKPGMTRDDLFNTNASIVATLTTACAKHCPEAMICIISNPVNSTIPITSEVFKKHGVYNPNRIFGVTTLDIVRANTFVAELKGLDPARVSVPVIGGHAGKTIIPLISQCTPKVDFPQDQLEKLTGRIQEAGTEVVKAKAGAGSATLSMAYAGARFVFSLVDAMNGKEGVIECSFVRSEETESPYFSTPLLLGKNGIEKNLGIGKITPFEEKMVAEAMAELKASIKKGEDFAKNFK

SEQ ID NO: 45064 - DNA, 1089 bp, Candida glabrata CBS138
  CDS (1)..(1089)
atgcctcatattactggaaacaacgaagctgatctgaaagtgtctattctaggtgccgcaggcggtatcgggcagtcgctgtcgctgctggtgaagacgcaattgcaagtgctcgctggctctgcagacaagaacctgaagctagcacttttcgatgtcaacaaggacgctgtcaacggtgttggcacagacttgtcgcacattgacacgcaggtcgaggtgtccatgcacaacccacaggaaggtgacggtatcaactcgtgtctgaaaggcgctgacatcgtggtgatccctgccggtgtgccaagaaagccaggtatgacccgtgacgacctgttcaacatcaacgccaagatcatcacacagctgaccgactccatcctcgagaactgtgacttgaccagggtggtcgtgctgctgatctccaacccagttaactccttggtcccagttatggtcaacagaatgagccagaaggtgaaccacaagaacacaggcatcgagaagagagtcttcggtgtcacgaacctggacctggtcagagcctccactttcctaagagaagtctccgaggacaagatcgaaaagatgccttacgtgccagtcatcggtggccactcgggcgaaacaatcatcccactgttctcccagaaccctcactccaaggccgtgccatctgagaaactcggcccactggtacacagagtccaatacggtggtgacgaggtcgtcaaggccaagaacggcgcgggttccgctactttgtccatggcccacgccggcttccagtgcgtggtcaagttcgctaagctgttcctaggtggcgaaaaggagttcaaaggcacttactacatctccttgaaagacttcaacaaccaacccatcgctaagaacgccgacgctttgctcccactggtcaacaacgtcccattcttcgctctgccaatgacattgaccctggacggtgtccagtctgtcgacagcgacatcatcgaaaacatgaacatccacgaacgcaaggaactactgccaatctgtctagaccaactagaaaagaacatcgctaagggcctagacttctctgcataa

SEQ ID NO: 45065 - protein, 362 aa, Candida glabrata CBS138
MPHITGNNEADLKVSILGAAGGIGQSLSLLVKTQLQVLAGSADKNLKLALFDVNKDAVNGVGTDLSHIDTQVEVSMHNPQEGDGINSCLKGADIVVIPAGVPRKPGMTRDDLFNINAKIITQLTDSILENCDLTRVVVLLISNPVNSLVPVMVNRMSQKVNHKNTGIEKRVFGVTNLDLVRASTFLREVSEDKIEKMPYVPVIGGHSGETIIPLFSQNPHSKAVPSEKLGPLVHRVQYGGDEVVKAKNGAGSATLSMAHAGFQCVVKFAKLFLGGEKEFKGTYYISLKDFNNQPIAKNADALLPLVNNVPFFALPMTLTLDGVQSVDSDIIENMNIHERKELLPICLDQLEKNIAKGLDFSA

SEQ ID NO: 45066 - DNA, 1011 bp, Candida glabrata CBS138
  CDS (1)..(1011)
atgttgtctagaattagcagaagggcattttcctctacacgtatcaatccatacaaggttacagttctcggtgccaatggtggtattgggcagccattgtcgttgctgttgaagttgaaccagaaggttactgatctgaggttgtacgatcttagaggtgctcctggtgttgccagtgacttgtcgcacatcccaacgaactctactgtgaagggtttcactcccgaggaggccgatggtttgaagaatgctttgaaggacaccgacctggtgttgattcctgctggtgtgcctagaaagccaggtatgactcgtgatgacttgtttgccatcaatgccggtatcgtgcgtgacttggccaccgctgctgccgagtctgctccaaacgctgccatcctggtgatctctaacccagttaactctaccgtgccaattgtcgccgaggtcttgcaaaagaaaggtgtgtacaaccctaagaagttgttcggtgtcaccacattggactccatcagagcttccagattcatctccgaagttgtcggcactgacccaacccaggagaaagtaaacgttgttggtggtcactctggtatcacaattatcccacttctatctcagaccaagtacggtgataaattggacaaggaccaaaaggacgccttgatcaagagaatccagttcggtggtgacgaagtcgtcaaggccaagaacggtgctggttccgctactctatccatggcccaggccggtgctttgttcgccaacgctgtcctatccggtttcgccggtgaacaaaacgtcgtcgaaccatctttcgtcgactcccctctatacaagggcgaaggtatcgagttctttgcttccccagttactctaggaaaggaaggtgttgttaagatccacccaattggtaccatctccgctgaagaggaagagatgttggccacttgtaaggagaccttgaagaagaacatcgaaaagggtatcaacttcgtcaagtccagcaattaa

SEQ ID NO: 45067 - protein, 336 aa, Candida glabrata CBS138
MLSRISRRAFSSTRINPYKVTVLGANGGIGQPLSLLLKLNQKVTDLRLYDLRGAPGVASDLSHIPTNSTVKGFTPEEADGLKNALKDTDLVLIPAGVPRKPGMTRDDLFAINAGIVRDLATAAAESAPNAAILVISNPVNSTVPIVAEVLQKKGVYNPKKLFGVTTLDSIRASRFISEVVGTDPTQEKVNVVGGHSGITIIPLLSQTKYGDKLDKDQKDALIKRIQFGGDEVVKAKNGAGSATLSMAQAGALFANAVLSGFAGEQNVVEPSFVDSPLYKGEGIEFFASPVTLGKEGVVKIHPIGTISAEEEEMLATCKETLKKNIEKGINFVKSSN

SEQ ID NO: 45068 - DNA, 1122 bp, Candida glabrata CBS138
  CDS (1)..(1122)
atggtaaaagttgcagttctgggcgcatctggtggtgtcgggcagccattgtcgctgttgttgaagttgaacacaatgatatctgagctggctctctatgatatcaagctcgctgagggtgttgctactgatctttcgcatatcaacaccaatgctgattgtgttgggtacagtacggatgacataggccaggcgttgaaaggtgctgccgtggtggttatcccagccggtgttcctagacgtccagggatcactagagatgacctgttcaagttgaatgctggtattgtgaagaaccttgtctccaatgttgccaagcattgtccaaatgccaggttactgatcatctccaacccagtaaacagtctgatccctgttgccgtggagaccctgaagagatgtggggtattccaagcaggcaacgtcatgggtgtcactaccctggaccttgtacgtgcggagacgttccttgcagagtacctgaacacgcacgaggccaaggaaattggcggtattgcaggtgagaggacttatgacaagagcaagatgtacaaatatgtaggtgtcatcggtggtcattctggagagaccattgtccccttggttttcaaccacatgatgaccaggacactggaaaagaccaacaaatacgacgagttcatcaacagggtccagtacggtggtgacgaagttgtgaaggccaaggccaaagacggcagcggatccgcaacattgagcatggcccttgcgggttccaagtttgtcaatgaggtcctacagagcgtccaccgccgtgacgagcaccgcaagcgtgtgaaccgcaccagcgaccgcaagaacgtcaccatctcgtccacatacgtctatctaccgggactgtccaacggtaaggaagtacaggagaaactgaagaacttggccggcataagggacgccagcgtgcgttgtgagtactttgcactacccgtagtgctagaggacggccgtgtgacgcgcgtggacaagagcatcctagacagcatctcgccaaaggagaaagagatggtcaagatcgccatccaagagctagagaagaacgtgaacaaaggaaaggacttcgtgtccgggcaaaccaagttatga

SEQ ID NO: 45069 - protein, 373 aa, Candida glabrata CBS138
MVKVAVLGASGGVGQPLSLLLKLNTMISELALYDIKLAEGVATDLSHINTNADCVGYSTDDIGQALKGAAVVVIPAGVPRRPGITRDDLFKLNAGIVKNLVSNVAKHCPNARLLIISNPVNSLIPVAVETLKRCGVFQAGNVMGVTTLDLVRAETFLAEYLNTHEAKEIGGIAGERTYDKSKMYKYVGVIGGHSGETIVPLVFNHMMTRTLEKTNKYDEFINRVQYGGDEVVKAKAKDGSGSATLSMALAGSKFVNEVLQSVHRRDEHRKRVNRTSDRKNVTISSTYVYLPGLSNGKEVQEKLKNLAGIRDASVRCEYFALPVVLEDGRVTRVDKSILDSISPKEKEMVKIAIQELEKNVNKGKDFVSGQTKL

SEQ ID NO: 45070 - DNA, 1215 bp, Kluyveromyces lactis NRRL Y-1140
  CDS (1)..(1215)
atgtctttctcttttgattctgtgtgtaatcgacaagtgctacgactaatcctcacagcacttattattaaaactattattaatttcaacttctttcataaagaaatgcctgctgttaacgctcaagaaaaggagatcttaaagatttctgtgctaggagcagctggtggtattggacaatctttgtcgctattgttaaaatcgaacgcagggtttttgttaccacatgaaacgtcaactcatattcgtttgtcgttatacgatgtcaacaaggacgccatcgtaggtacagcagcagatttatcccacatagatactccaatcacaacaacagcacactacccggatgacagcaatggtggtattggccaatgcttgagtaatgctagtgtggttatcattccagctggtgttccaagaaaaccgggtatgtcacgtgacgatttgattggtgtcaatgcaaagatcatcaaatcgctaggtgaagatatcgccaagtactgtgacttaaacaaagttcatgttttggttatatctaatcctatcaactctttggtcccgctattgactaatactttgattagaagcgatgcaaatggcaactcaaacatcgaatcaagagtgtacggtatcacccaattggatttggtcaggtcttccacttttgtccaacaactgaacggttttaaatcaaacacatcccctgtgattccagtcatcggtggtcactctggggataccattattcctgttttctctacgttggagagggatccggaatatgctaatttgttggataatggcatgagactgaaaatggttcacagagttcagtacggtggtgatgaaatcgtcaaggctaagaacggtaatggtagcgcaacactgtctatggcatatgctggattcaaaatcgcagctaaattcattgacttattagttggtaacacagataccatcgacgacattgtcatgtacgttccactcacaaacagaaatcatcaagaaattgcacctggatccaatgaattgagatctagatacatcaacgatttactatacttttctatcccattatccattaatcgaaacggtatcaagaagattcactatgaaattttggaaaatcttgattcttacgaacgtgacactttgttgccaatttgcttgaaaacactagaggggaacatcgaaactggtctaaaattggtataa

SEQ ID NO: 45071 - protein, 404 aa, Kluyveromyces lactis NRRL Y-1140
MSFSFDSVCNRQVLRLILTALIIKTIINFNFFHKEMPAVNAQEKEILKISVLGAAGGIGQSLSLLLKSNAGFLLPHETSTHIRLSLYDVNKDAIVGTAADLSHIDTPITTTAHYPDDSNGGIGQCLSNASVVIIPAGVPRKPGMSRDDLIGVNAKIIKSLGEDIAKYCDLNKVHVLVISNPINSLVPLLTNTLIRSDANGNSNIESRVYGITQLDLVRSSTFVQQLNGFKSNTSPVIPVIGGHSGDTIIPVFSTLERDPEYANLLDNGMRLKMVHRVQYGGDEIVKAKNGNGSATLSMAYAGFKIAAKFIDLLVGNTDTIDDIVMYVPLTNRNHQEIAPGSNELRSRYINDLLYFSIPLSINRNGIKKIHYEILENLDSYERDTLLPICLKTLEGNIETGLKLV

SEQ ID NO: 45072 - DNA, 1017 bp, Kluyveromyces lactis NRRL Y-1140
  CDS (1)..(1017)
atggtaagtgttacagttcttggctcatctggtggtattggtcaaccactttcgttgttgttgaaactagaccctcatgtatcaagtttgagattgtacgatttgaagctgtcccacggtaatgctaccgatttgtctcatatcgacactaactccacgtctgaaggtttcaataccgcagagattggtcaagcgttgaaaggtgcccaattggtcataatcccggccggtattccaaggaagccaggtatgtcacgtgacgacttgttcaagatcaacgccaagatcatcaagtctctaactgtgcaaattgctgaacatgcaccagatgccagaatccttgtcatttcaaacccagtgaactcgttggttccaattgtttacgaaactttgcaaagcatgggcaagttccaagccggtaaggttatgggtatcactactttggatatcatcagatctcacactttcctagtagacatcattggccgtaaagcttactccgttgaaaaattgaaggatgcagttaccgtggttggtggtcattctggtgagaccatcattccaatctttactgaccaaaaattctacagacgtttaagagactccaacgtttacgaatcttacgtacacagggttcagtttggtggtgatgaagttgtgaaggccaaggacggtagcggtagtgctactttgtccatggcttgggccggttacacatttgctaagaaattgttgaacagtttgcatttgaacaccgctggtgaccaacatccaatcccaactttcgtttacttacctggtttgccaggtggtaaggaattacaaaagaagttaaatacttctgttgaattcttctctgctccagtgaaattagagaaaggtatcgttgtcgctgtagaacacgaatgggtcgataagttgaacgatgacgaaaagaagttgatcgccaagtgcttgccaatcttagaaaagaacatcaagaagggtctagctttctcgaagcaaaccaagttgtaa

SEQ ID NO: 45073 - protein, 338 aa, Kluyveromyces lactis NRRL Y-1140
MVSVTVLGSSGGIGQPLSLLLKLDPHVSSLRLYDLKLSHGNATDLSHIDTNSTSEGFNTAEIGQALKGAQLVIIPAGIPRKPGMSRDDLFKINAKIIKSLTVQIAEHAPDARILVISNPVNSLVPIVYETLQSMGKFQAGKVMGITTLDIIRSHTFLVDIIGRKAYSVEKLKDAVTVVGGHSGETIIPIFTDQKFYRRLRDSNVYESYVHRVQFGGDEVVKAKDGSGSATLSMAWAGYTFAKKLLNSLHLNTAGDQHPIPTFVYLPGLPGGKELQKKLNTSVEFFSAPVKLEKGIVVAVEHEWVDKLNDDEKKLIAKCLPILEKNIKKGLAFSKQTKL

SEQ ID NO: 45074 - DNA, 1017 bp, Kluyveromyces lactis NRRL Y-1140
  CDS (1)..(1017)
atgcttagaagcatcgctcgtcgtcaattttcatccaccgcattcaatccatacaaagttaccgttttaggtgctggtggtggtattggtcaacctttgtctttactattgaagttgaaccacaaggtcactgatttgagactatatgatttgaagggcgctaagggtgttgccgctgatttgtcccacattccaaccaattctaccgtgactggtttcactccagaatctaaggaatcccaagctgaactagcagctgctttgaaggataccgaagttgtcttgattccagcaggtgttccaagaaagccaggtatgacacgtgacgacttgttctctatcaatgctggtattgttcgtgatttggctggtgccattgccaagaatgctccaaacgctgccatcttggtcatctctaacccagttaactctacagttccaattgttgccgaagtgttgaaacaaaacggtgtttacaacccaaagaagttgttcggtgtcaccacattggatgtgatccgttcctccagatttatttctgagataaggaacaccgatccaaccaccgaacgtgtcaccgttgtcggtggtcactctggtattaccattctaccattgatctctcaaactaaacacaagtcgatgattcaaggtgaaactttggacaaattggtccacagaatccaattcggtggtgatgaagttgtccaagccaagaacggtgccggttctgctactctatctatggctgaagctggtgctcgtttcgccaacagcgtgttggctggtttcgaaggtgaaagagacgttgtcgaatccactttcgtggactctcctctatacaagagcgaaggtatcgaattctttgcttccccagtgactttgggtccagaaggtgttgaaaagattcacggaattggcgctttgtctgaaaaggaagaagaaatgttggccaaatgtaaggaaactttgaagaagaacattgaaaagggtcaaaaattcgtcaccggtaactaa

SEQ ID NO: 45075 - protein, 338 aa, Kluyveromyces lactis NRRL Y-1140
MLRSIARRQFSSTAFNPYKVTVLGAGGGIGQPLSLLLKLNHKVTDLRLYDLKGAKGVAADLSHIPTNSTVTGFTPESKESQAELAAALKDTEVVLIPAGVPRKPGMTRDDLFSINAGIVRDLAGAIAKNAPNAAILVISNPVNSTVPIVAEVLKQNGVYNPKKLFGVTTLDVIRSSRFISEIRNTDPTTERVTVVGGHSGITILPLISQTKHKSMIQGETLDKLVHRIQFGGDEVVQAKNGAGSATLSMAEAGARFANSVLAGFEGERDVVESTFVDSPLYKSEGIEFFASPVTLGPEGVEKIHGIGALSEKEEEMLAKCKETLKKNIEKGQKFVTGN

SEQ ID NO: 45076 - DNA, 1017 bp, Debaryomyces hansenii CBS767
  CDS (1)..(1017)
atggttaaagttacagtttgcggtgctgccggtggtattggtcaaccattatcattattattaaagttaaacccaaagatcgatgaattgtcattgttcgatgttgtcaatgttccaggtgtcggagctgatttatctcacatttgctccaattcatccacatcttctcacttaccatcttccagggaagacaaatcagcattggctgaatccttgaagggtagtgacttagttatcatcccagctggtgtcccaagaaagccaggtatgaccagagatgatttattcaacatcaatgcctctattgttagagacttggcccaaggaattgctgaaaacgcgccaaaggctttcgttttgatcatttcaaatccagtcaactccactgttccgattgttgccgaaaccttaaagaagaacggtgtttacaacccacaaagattattcggtgttactaccttggatatcgtcagagccaacactttcatctcccaaaagtacgctaaggaaaccaaggctactgacttcaacatcaacgtcattggtggtcactccggtgaaaccattgttccattgtactctatcggtaactccaaatcgtactacgacaagttatcggaagaagacaagaaggctttgattaacagagtccaattcggtggtgatgaagtcgtcaaggccaaggacggtgctggttccgccactttgtccatggcttacgccggttacaagttagccgaatccatcttgaaggcattgacctctaagggtgaagaagttgtcgaatgtaccttcttgaacttggacgactccatcaagggtgccgctgaagccaagaagttggtcaaaaacttggatttcttctccttgccagtcagattaggtgctaacggtatcgaggaagtcaagtacgacatcttaaacaacatcagtgctgatgaaaagaaattattagaagttgccatcgaacaattgtctggtaacatcgacaagggtgttgcattcatcaagaaatag

SEQ ID NO: 45077 - protein, 338 aa, Debaryomyces hansenii CBS767
MVKVTVCGAAGGIGQPLSLLLKLNPKIDELSLFDVVNVPGVGADLSHICSNSSTSSHLPSSREDKSALAESLKGSDLVIIPAGVPRKPGMTRDDLFNINASIVRDLAQGIAENAPKAFVLIISNPVNSTVPIVAETLKKNGVYNPQRLFGVTTLDIVRANTFISQKYAKETKATDFNINVIGGHSGETIVPLYSIGNSKSYYDKLSEEDKKALINRVQFGGDEVVKAKDGAGSATLSMAYAGYKLAESILKALTSKGEEVVECTFLNLDDSIKGAAEAKKLVKNLDFFSLPVRLGANGIEEVKYDILNNISADEKKLLEVAIEQLSGNIDKGVAFIKK

SEQ ID NO: 45078 - DNA, 999 bp, Debaryomyces hansenii CBS767
  CDS (1)..(999)
atgtttactaaagttgctgccagatcattctcctcttctgcctcttctgcctacaaggttgctgttttaggtgctaacggtggtattggtcaaccattatctttattattaaagttaaaccacaaagttaccgacttagctttatacgatttaaagggtgctccaggtgtcgctgctgatgtttcgcacattccaactaactccactgtcagtggatacgacccagaaggcttagaacaagctttaaccggatcagacataattgttatcccagctggtgttccaagaaagccaggtatgaccagagatgatttattcaacaccaatgcttctattgttagagacttagccaaggctgctgctgactacgctccagatgctgctgtttgtgttatttctaacccagtcaactccactgttccaattgtggccgaagttttgaagtctaagggtacctacaacccaaagaagttgttcggtgtcaccaccttagatgtcttaagagcttccagatttgtttctgaagttgctggttccaacccagttcacgaaaaggtcaccgttgttggtggtcactccggtatcaccattgttccattattgtcccaaactgaacacaaatctttggaccaagaaaccagagatgctttgatccacagaatccaattcggtggtgacgaagttgtccaagccaagaacggtgctggttccgccaccttatccatggcccaagctggtgctagattcactggtgctgtcttagacggtttagccggtgaaagagatattgttgaaccatctttcgtcgactctccattattcaagagcgaaggtgttgaattcttctcctctaaggtcaccttaggccaagatggtgtcagtactgttcacccattaggtggattatctgaccacgaagaaagcttagtcaaggaagccaaggacaccttgatcaagaacatccaaaagggtgttgacttcgttaagcaaaacccataa

SEQ ID NO: 45079 - protein, 332 aa, Debaryomyces hansenii CBS767
MFTKVAARSFSSSASSAYKVAVLGANGGIGQPLSLLLKLNHKVTDLALYDLKGAPGVAADVSHIPTNSTVSGYDPEGLEQALTGSDIIVIPAGVPRKPGMTRDDLFNTNASIVRDLAKAAADYAPDAAVCVISNPVNSTVPIVAEVLKSKGTYNPKKLFGVTTLDVLRASRFVSEVAGSNPVHEKVTVVGGHSGITIVPLLSQTEHKSLDQETRDALIHRIQFGGDEVVQAKNGAGSATLSMAQAGARFTGAVLDGLAGERDIVEPSFVDSPLFKSEGVEFFSSKVTLGQDGVSTVHPLGGLSDHEESLVKEAKDTLIKNIQKGVDFVKQNP

SEQ ID NO: 45080 - DNA, 1041 bp, Debaryomyces hansenii CBS767
  CDS (1)..(1041)
atggttaaagttacagtttgcggagcagcaggaggcattgggcaaccattgtcgttattattaaagttaaacccgcaagtgagcgaattgtcgttatttgatgtggttaatgcaaatggggttgcagcagatttgtcgcacatttgtagtccagctaaagttacaggatatcagcctagcagcaaggaagaccgtgacacaatccaaaaggcgttggtgaattcagatttggtggtgattccggcaggagttccaagaaagccgggaatgactcgtgcagacttattcaatatcaatgcgtctattatcagggatattgttggaagtatcggtaaggcgtgtcctaatgctgcgatcttgattatttcgaacccggtgaactcgaccgtgccaattgcagccgaagtgttgaagaaattgggtgtatttaacccaaaaaagcttttcggggtcacgacattggattcggtgagagcagaaactttcttgggcgaattgatcaaagaaactccgacctcgttgaagggtcagatctctgtgattgggggccattcgggtgacacaattgtgcctttggtacatgctacagcactggttgcgaagaaagtatcgggtctctccaagagtcagtacaacgaatttatccacagagtccaatttggcggtgacgaggttgttaaggccaagaacggtgcaggatctgcaaccttgtctatggcatatgctggttataggttcgccgagaaggtcattggttcgttgaacggccaatctgaaagttcctccgaaatccctgattcgtcttatatatatttagcgggtgttccaaacggaaaagaattatcacaaaagtacttgaaaaattctgaattcttctccgtgccagttatccttgaaaagggtcaaatcaaagctttcgttaacccattcgataagttgaatgtcacctcagaggaatctaaattagttgatatcgcattaggtggtttacaaaactctatcgaccagggtactacattcgtaactggttcgaaattatag

SEQ ID NO: 45081 - protein, 346 aa, Debaryomyces hansenii CBS767
MVKVTVCGAAGGIGQPLSLLLKLNPQVSELSLFDVVNANGVAADLSHICSPAKVTGYQPSSKEDRDTIQKALVNSDLVVIPAGVPRKPGMTRADLFNINASIIRDIVGSIGKACPNAAILIISNPVNSTVPIAAEVLKKLGVFNPKKLFGVTTLDSVRAETFLGELIKETPTSLKGQISVIGGHSGDTIVPLVHATALVAKKVSGLSKSQYNEFIHRVQFGGDEVVKAKNGAGSATLSMAYAGYRFAEKVIGSLNGQSESSSEIPDSSYIYLAGVPNGKELSQKYLKNSEFFSVPVILEKGQIKAFVNPFDKLNVTSEESKLVDIALGGLQNSIDQGTTFVTGSKL

SEQ ID NO: 45082 - DNA, 1023 bp, Oryza sativa (japonica cultivar-group)
  CDS (1)..(1023)
atgaggccgtcgctgctgagatacgccgcgcaggcgctccgccgccgcgactactcctccgccgccgcggccgctgagcggaaggtggccatcctcggggcggcgggcgggatcggccagccgctcgcgctcctcatgaagctcaacccgctcgtctcgtccctctccctctacgatatcgccggaacccccggcgtcgccgccgatgtctcccacatcaactcgccggcgctggtgaaaggcttcgtcggggaggagcagctcggggaggcgttggagggttcggacgtcgtaatcatcccggccggtgtgccgaggaagcccggcatgaccagggacgacctcttcaacatcaacgccggcattgttaagggcctctgcactgccatctccaagtactgccccaacgctcttgtcaatatgatcagcaaccctgtcaactcgactgtccccatcgcagcggaggtgttcaagaaggctggtacttacgatgagaagaaactgtttggtgtgaccacgcttgatgttgtgcgcgctaaaactttctatgctggaaaggctaatgtgccagttactgaagtgaatgtccctgtggttggtggccatgctggtattactatcctgccactgttctcgcaggcaacccctgcaagtaatgcattgtcgcatgaggacattaaggctctgaccaagaggacacaagatggtgggacggaagttgttgaagcaaaggctggaaagggttctgcaacattgtctatggcatatgctggtgcggtatttgcagatgcgtgcttgaaggggcttaatggagttcctgatgttgtagagtgctcttttgtgcaatcaacagtaacagagctgccattcttcgcctcaaaggtaaggcttggcaagaacggagtggaggaagtacttgggctgggccagctttccgagtttgagaaggagggtctggagaacctgaagggtgagctcaagtcttcgattgagaagggcatcaagtttgctcacgcgaactag

SEQ ID NO: 45083 - protein, 340 aa, Oryza sativa (japonica cultivar-group)
MRPSLLRYAAQALRRRDYSSAAAAAERKVAILGAAGGIGQPLALLMKLNPLVSSLSLYDIAGTPGVAADVSHINSPALVKGFVGEEQLGEALEGSDVVIIPAGVPRKPGMTRDDLFNINAGIVKGLCTAISKYCPNALVNMISNPVNSTVPIAAEVFKKAGTYDEKKLFGVTTLDVVRAKTFYAGKANVPVTEVNVPVVGGHAGITILPLFSQATPASNALSHEDIKALTKRTQDGGTEVVEAKAGKGSATLSMAYAGAVFADACLKGLNGVPDVVECSFVQSTVTELPFFASKVRLGKNGVEEVLGLGQLSEFEKEGLENLKGELKSSIEKGIKFAHAN

SEQ ID NO: 45084 - DNA, 1194 bp, Oryza sativa (japonica cultivar-group)
  CDS (1)..(1194)
atggcatcagctgttaccatcagttcggttggcgctcaggctggcatgatctcaaagccaaggaatcatggcttcacaagctacagtggcctgaaggcagcatcatccgttagctttgaatcagggtcgtcattcctgggtaggaatgcatctctccgggcatctgttgctccaaggattgtaccaaaggcgaagtctggttctcaaatttctcctgaggcttcgtacaaagtggcagtgctcggtgctgctggtggtattggccaaccattgggccttttgattaagatgtctcctctggtctcagagctgcatctgtatgatattgcaaatgttaagggagttgctgctgatctcagccactgcaacacaccttctcaagttctggacttcactgggccctcggaactagccaactgcttgaaaggtgtggacgttgttgtcatccctgctggggtcccaaggaagccaggcatgactcgcgatgacctttttaacatcaatgcgagcattgtcaagtcgcttgttgaggctgttgcagacaattgtccagaggccttcatccatattatcagcaacccagtaaactccacggtgccaattgctgccgaggttctgaaacaaaagggtgtgtacaatcccaagaagctctttggagttaccaccctagatgttgttagagctaacacatttgtagctcagaagaagaacctcaagctcatcgatgttgatgttccagttgtcggtggtcatgctgggatcacaattctaccactgctgtcaaagaccatgccatctgtcaccttcacagatgaagaaactgaacagctgacaaagaggatacagaatgctggaacagaggtggtggaggcgaaagctggtgctggctccgctaccctctccatggcctacgctgctgccagattcgtcgagtcatctctgcgtgcacttgctggcgaccctgatgtttatgagtgcacattcgttcagtctgagttaaccgagctgccgttctttgcatccagagttaagcttggaaagaacggtgtcgagtccatcatttctgctgaccttgagggagtgaccgagtacgaggccaaggcacttgaggcattgaagtctgagttgaaggccagtatcgagaagggcatcgagttcgtccacaaacagcagacagcagcggcatctgtttga

SEQ ID NO: 45085 - protein, 397 aa, Oryza sativa (japonica cultivar-group)
MASAVTISSVGAQAGMISKPRNHGFTSYSGLKAASSVSFESGSSFLGRNASLRASVAPRIVPKAKSGSQISPEASYKVAVLGAAGGIGQPLGLLIKMSPLVSELHLYDIANVKGVAADLSHCNTPSQVLDFTGPSELANCLKGVDVVVIPAGVPRKPGMTRDDLFNINASIVKSLVEAVADNCPEAFIHIISNPVNSTVPIAAEVLKQKGVYNPKKLFGVTTLDVVRANTFVAQKKNLKLIDVDVPVVGGHAGITILPLLSKTMPSVTFTDEETEQLTKRIQNAGTEVVEAKAGAGSATLSMAYAAARFVESSLRALAGDPDVYECTFVQSELTELPFFASRVKLGKNGVESIISADLEGVTEYEAKALEALKSELKASIEKGIEFVHKQQTAAASV

SEQ ID NO: 45086 - DNA, 1017 bp, Yarrowia lipolytica CLIB99
  CDS (1)..(1017)
atgttccgaacccgagttaccggctccaccctgcgatccttctccacctccgctgcccgacagcacaaggttgtcgtccttggcgccaacggaggcattggccagcccctgtctctgctgctcaagctcaacaagaacgtgaccgacctcggtctgtacgatctgcgaggcgcccccggcgttgctgccgatgtctcccacatccccaccaactccaccgtggccggctactctcccgacaacaacggcattgccgaggccctcaagggcgccaagctggtgctgatccccgccggtgtcccccgaaagcccggcatgacccgagacgatctgttcaacaccaacgcctccattgtgcgagacctggccaaggccgtcggtgagcacgcccccgacgcctttgtcggagtcattgctaaccccgtcaactccaccgtccccattgtcgccgaggtgctcaagtccaagggcaagtacgaccccaagaagctcttcggtgtcaccaccctcgacgtcatccgagccgagcgattcgtctcccagctcgagcacaccaaccccaccaaggagtacttccccgttgttggcggccactccggtgtcaccattgtccccctcgtgtcccagtccgaccaccccgacattgccggtgaggctcgagacaagcttgtccaccgaatccagtttggcggtgacgaggttgtcaaggccaaggacggtgccggatccgccaccctttccatggcccaggctgccgcccgattcgccgactctctcctccgaggtgtcaacggcgagaaggacgttgttgagcccactttcgtcgactctcctctgttcaagggtgagggcatcgacttcttctccaccaaggtcactcttggccctaacggtgttgaggagatccaccccatcggaaaggtcaacgagtacgaggagaagctcatcgaggctgccaaggccgatctcaagaagaacattgagaagggtgtcaactttgtcaagcagaacccttaa

SEQ ID NO: 45087 - protein, 338 aa, Yarrowia lipolytica CLIB99
MFRTRVTGSTLRSFSTSAARQHKVVVLGANGGIGQPLSLLLKLNKNVTDLGLYDLRGAPGVAADVSHIPTNSTVAGYSPDNNGIAEALKGAKLVLIPAGVPRKPGMTRDDLFNTNASIVRDLAKAVGEHAPDAFVGVIANPVNSTVPIVAEVLKSKGKYDPKKLFGVTTLDVIRAERFVSQLEHTNPTKEYFPVVGGHSGVTIVPLVSQSDHPDIAGEARDKLVHRIQFGGDEVVKAKDGAGSATLSMAQAAARFADSLLRGVNGEKDVVEPTFVDSPLFKGEGIDFFSTKVTLGPNGVEEIHPIGKVNEYEEKLIEAAKADLKKNIEKGVNFVKQNP

SEQ ID NO: 45088 - DNA, 936 bp, Erwinia carotovora subsp. atroseptica SCRI1043
  CDS (1)..(936)
atgaaagttgcagttctcggagcagcaggtggtatcggtcaggcactcgcactcctcctcaaaacccagcttccttcaggttcagaactatccctctacgatatcgctccggtaacgccgggtgttgccgtcgatctgagccatattcctacagcagtgaagatcaaaggctatagcggtgaagatgctaaaccggcgcttgctggtgcggatatcgtgctgatttctgccggtgtggcacgtaaacctggcatggatcgttccgatctgttcaacgtcaatgctggcattgtacgtaacctggttgagcaaatcgcgattacctgcccgaaagcctgtatcggtataatcaccaacccagtgaacacgaccgttgccatcgcagcagaagtgctgaaaaaagcaggcgtgtatgacaaaaacaaactgttcggtgtaactacgctggatatcatccgttccaacacgtttgttgctgaattgaaaggcaagcagccgcaggatattaacgtgccggttatcggcgggcactctggcgtgacaattctgcctctgctgtctcaggtttcaggcatcagcttcagcgagcaggaagtggccgatctgaccaaacgtatccagaatgcgggcaccgaggttgttgaagccaaagcaggtggcggatcggcaacgctgtctatgggtcaagccgctgcgcgttttggtctgtctctggtccgcgcgctgcaaggcgaaaacggtgtggtggaatgtgcatacgttgaaagtgacggcaaacatgcgcgcttctttgctcaaccaattctgttaggtaaagatggcgtcgctgagcgtaaagacatcggcacattaagtgcttttgagcaaaacgcgcttagcagcatgctggatacgctgaagcaggatattgagttaggcgagacgttcatcaagtaa

SEQ ID NO: 45089 - protein, 311 aa, Erwinia carotovora subsp. atroseptica SCRI1043
MKVAVLGAAGGIGQALALLLKTQLPSGSELSLYDIAPVTPGVAVDLSHIPTAVKIKGYSGEDAKPALAGADIVLISAGVARKPGMDRSDLFNVNAGIVRNLVEQIAITCPKACIGIITNPVNTTVAIAAEVLKKAGVYDKNKLFGVTTLDIIRSNTFVAELKGKQPQDINVPVIGGHSGVTILPLLSQVSGISFSEQEVADLTKRIQNAGTEVVEAKAGGGSATLSMGQAAARFGLSLVRALQGENGVVECAYVESDGKHARFFAQPILLGKDGVAERKDIGTLSAFEQNALSSMLDTLKQDIELGETFIK

SEQ ID NO: 45090 - DNA, 948 bp, Symbiobacterium thermophilum IAM 14863
  CDS (1)..(948): transl_table=11
atgaagcgcaagaagatcgcgattgtgggctccgggttcaccggccagggaaccgccctgtttgcggccgcccgcgacctgggcgacatcgtgctcgtcgacctgcccgcccgggagaactacgccaagggcgtggccctggacatgatggaggccatgcccgtctacggcagtgacacccgcctggtcggcacctcggactacgccgagatcgccggcgctgacgtggtcgtgatcaccgccggcgtcccccgcaagcccggcatgagccgggaggacctggtcaacaccaacgccggcatcgtcaaggatgtcgcggagaaggtggcccggtacgcccccgactcggtgatcatcgtcctgaccaaccccgtcgactccatgacctacgtggccctgaaggcctcgggcttccccaagaaccgggtgatcggccagtccggcgtgctggacaccgcccgcttccgcaccttcctggccaatgcgatcggctgctcgttccaggacgtcgtcggctgcgtgctcggcggccacggcgatgacatggtgccgctggttcggtacacctctgccggcggcatccccgtggagaagctgctgcccaaggagaccatcgacgccatcgtcgaacggacccgcaagggcggcggcgagatcgtcaacctcatgggcacctcggccggctacgccccgggcatggccctggtggagatgatcgacgccattctgaacgaccgcaagcgcatcctgccctcgatcgcctacctggagggcgagtacgggtacaccgacatgtgcctgggcgtgatgaccgtcctgggcgggggcggcctcgagaaggtcatcgagctcgacctcaccgacgaggagaaggtggcgctggacaagggcgcccagggcgtcaggaacctgatcgagatgctgaaggccggcatcctggcgcagtag

SEQ ID NO: 45091 - protein, 315 aa, Symbiobacterium thermophilum IAM 14863
MKRKKIAIVGSGFTGQGTALFAAARDLGDIVLVDLPARENYAKGVALDMMEAMPVYGSDTRLVGTSDYAEIAGADVVVITAGVPRKPGMSREDLVNTNAGIVKDVAEKVARYAPDSVIIVLTNPVDSMTYVALKASGFPKNRVIGQSGVLDTARFRTFLANAIGCSFQDVVGCVLGGHGDDMVPLVRYTSAGGIPVEKLLPKETIDAIVERTRKGGGEIVNLMGTSAGYAPGMALVEMIDAILNDRKRILPSIAYLEGEYGYTDMCLGVMTVLGGGGLEKVIELDLTDEEKVALDKGAQGVRNLIEMLKAGILAQ

SEQ ID NO: 45092 - DNA, 939 bp, Bacillus cereus ZK
  CDS (1)..(939): transl_table=11
atgacaatcaaacgcaagaaagtttcagtcatcggtgcaggatttacaggagcaacaacagcattcttattagcacaaaaagaacttgcagatgttgtattagtggacattccacagctggaaaatccaacaaaagggaaagcgttagatatgttagaagcgagcccagtacaaggttttgatgctaacattattggaacatctgattacgcagatactgctgattctgacgttgttgtgattacagcaggtattgcgcgtaagcctggtatgagccgtgatgatttagtagcaacaaactccaaaattatgaaaagtattacgcgcgacattgcaaaacattcaccaaatgcgattattgttgtattaacaaatccagttgatgcaatgacatattctgtatttaaagaagcaggattcccgaaagagcgtgttatcggtcaatcgggcgtattagatacagctcgtttccgtacattcatcgcacaagaattaaatttttctgtgaaagacattacaggatttgttcttggtggacacggtgacgatatggtacctcttgtacgttattcatatgcaggtggcattccgttagaaacgttaattccgaaagagcgtttagaagcaatcgtagaacgtacccgtaaaggtggcggcgagattgtaggcttattaggaaacggtagtgcatattacgcaccagctgcttctttagttgaaatgacagaagcaatcttaaaagatcaacgccgtgtattaccggctattgcgtaccttgaaggtgaatacggttatagtgacctttacttaggggtaccagtaattctaggtggtaacggaattgaaaaaattattgaattagaacttcttgcagatgaaaaagaagcgttagatcgctctgtagaatctgtacgtaatgttatgaaggttcttgtttaa

SEQ ID NO: 45093 - protein, 312 aa, Bacillus cereus ZK
MTIKRKKVSVIGAGFTGATTAFLLAQKELADVVLVDIPQLENPTKGKALDMLEASPVQGFDANIIGTSDYADTADSDVVVITAGIARKPGMSRDDLVATNSKIMKSITRDIAKHSPNAIIVVLTNPVDAMTYSVFKEAGFPKERVIGQSGVLDTARFRTFIAQELNFSVKDITGFVLGGHGDDMVPLVRYSYAGGIPLETLIPKERLEAIVERTRKGGGEIVGLLGNGSAYYAPAASLVEMTEAILKDQRRVLPAIAYLEGEYGYSDLYLGVPVILGGNGIEKIIELELLADEKEALDRSVESVRNVMKVLV

SEQ ID NO: 45094 - DNA, 939 bp, Mannheimia succiniciproducens MBEL55E
  CDS (1)..(939): transl_table=11
atgaaagttgcagttctaggtgccgcaggcggcattggtcaagcgttggctttattattaaagttacaattaccggctggttcatctttatctctgtatgatgtcgcacccgtcaccccgggtgttgctaaagatcttagccatatcccaacagatgttgtggttgaaggttttgccggtacggatccttcagaagcattaaaaggggcggatattgtgttaatttctgcgggtgtggcacgtaaaccgggcatgacacgtgcggatttattcggtgttaatgcgggtattattcgtagtctgaccgaaaaagtggcggaacaatgcccgaaagcctgtgtgggtattatcaccaacccggttaatgcgatggttgccattgcggccgaagtattgaaaaaagcgggtgtttacgacaaacgtaaattattcggcattactaccttagatattcttcgagcggaaacctttatcgccgaattaaaaggcttagatcctactcgggttacaattcctgttatcggcggtcattcgggtgtaaccattcttccgttattgtctcaagttcaaaatgttgaatggagcagtgaagaggaaatcattgctttaacgcatcgtatccaaaatgcaggtacggaagtggttgaagcaaaagcgggcggcggttctgcaaccttatctatggcgcaggcggcggcacgttttgcattagcattagtgaaagcctcgcaaggtgcgaaagttgttgaatgcgcttatgtggaaggcgacggcaaatatgcccgtttctttgcacaaccggttcgtttaggtacagaaggtgttgaagaatacttaaccctgggtaaattaagtgcatttgaagaaaaagcgttaaatgctatgttagaaactttacaaggtgacattaagtcaggtgaagattttattaacggttaa

SEQ ID NO: 45095 - protein, 312 aa, Mannheimia succiniciproducens MBEL55E
MKVAVLGAAGGIGQALALLLKLQLPAGSSLSLYDVAPVTPGVAKDLSHIPTDVVVEGFAGTDPSEALKGADIVLISAGVARKPGMTRADLFGVNAGIIRSLTEKVAEQCPKACVGIITNPVNAMVAIAAEVLKKAGVYDKRKLFGITTLDILRAETFIAELKGLDPTRVTIPVIGGHSGVTILPLLSQVQNVEWSSEEEIIALTHRIQNAGTEVVEAKAGGGSATLSMAQAAARFALALVKASQGAKVVECAYVEGDGKYARFFAQPVRLGTEGVEEYLTLGKLSAFEEKALNAMLETLQGDIKSGEDFING

SEQ ID NO: 45096 - DNA, 942 bp, Bacteroides fragilis YCH46
  CDS (1)..(942): transl_table=11
atgtcaaaagtaaccgtagtaggcgcaggtaacgtaggtgctacatgtgcaaatgtactggccttcaatgaagtggcagacgaagtagtaatgctggacgtaaaagaaggcgtttcagaaggtaaagcaatggatatgatgcagactgctcagttgttgggtttcgacacaacaatcgttggttgcacaaatgattatgctcaaactgctaactctgacgtggttgtgatcacttctggtattcctcgtaaaccgggcatgactcgtgaagaactgatcggtgtaaatgctggtatcgtaaaatcagtagcagaaaatcttttgaaatactctccgaacgcaatcatcgtagttatctctaacccgatggatacaatgacttacttggcattgaaatcactcggattgccgaaaaaccgtgtaatcggtatgggcggtgctttggatagctcacgtttcaaatatttcttgtctcaggctttaggttgcaacgcaaacgaagtagaaggtatggtgatcggtggtcacggtgatactactatgattccgttggctcgtctggctacttacaaaggacagccggttagcacattgctgagcgaagaaaaactgaacgaagtagttgcttctactatggtaggtggtgctactctgactaagttgctgggtacttctgcatggtatgcaccgggtgcagcaggagcttatgtagtagaatctatcatccacaaccagaaaaagatggttccttgctcagtaatgcttgaaggcgaatatggcgaatctgatctttgcatcggtgttcctgtaattctgggtaaaaacggtatcgaaaaaatcgttgaactggaactgaatgctgatgaaaaagctaaatttgctgccagtgccgctgctgttcacaaaacaaatgctgctttgaaagaagttggcgctctctaa

SEQ ID NO: 45097 - protein, 313 aa, Bacteroides fragilis YCH46
MSKVTVVGAGNVGATCANVLAFNEVADEVVMLDVKEGVSEGKAMDMMQTAQLLGFDTTIVGCTNDYAQTANSDVVVITSGIPRKPGMTREELIGVNAGIVKSVAENLLKYSPNAIIVVISNPMDTMTYLALKSLGLPKNRVIGMGGALDSSRFKYFLSQALGCNANEVEGMVIGGHGDTTMIPLARLATYKGQPVSTLLSEEKLNEVVASTMVGGATLTKLLGTSAWYAPGAAGAYVVESIIHNQKKMVPCSVMLEGEYGESDLCIGVPVILGKNGIEKIVELELNADEKAKFAASAAAVHKTNAALKEVGAL

SEQ ID NO: 45098 - DNA, 963 bp, Rhodobacter sphaeroides 2.4.1
  CDS (1)..(963)
atggccagacccaagattgcgctgatcggtgcggggcagatcggcggcacgctcgcccatctcgccgcgatcaaggaactgggcgacgtcgtcctgttcgacatcgccgaaggcacccctcagggcaaggctctggacatcgcgcaatcgggcccctcggaaggcttcgacgccgtgatgaagggcgcgaacagctacgaagagatcgcgggcgccgacgtctgcatcgtgaccgcgggcgtgccgcgcaagcccggcatgagccgcgacgacctgatcggcatcaacctcaaggtgatgaaatcggtcggcgagggcatcaaggcccatgcgccgaacgccttcgtgatctgcatcaccaacccgctcgacgcgatggtctgggcgctgcagcaattctcgggcctgccggccgagaaggtggtgggcatggcgggcgtgctcgactcggcgcgcttccggcatttcctgtcggtcgagttcaacgtctcgatgcgcgacgtgacggcgttcgttctgggcggccatggcgacacgatggtgccgctcgtccgctactcgacggtggccggcatcccgctgcccgatctcgtgcagatgggctggaccacgcaggagaagctcgaccagatcgtgcagcgcacccgtgacggcggcgccgagatcgtgggcctgctgaagaccggctcggccttctacgcgcccgccacctcggccatcgagatggcggaagcctatctcaaggaccagaagcgtctgctgccctgcgcggcctatgtggacggcgccttcggcctgaacggcatgtatgtgggcgtgcccaccatcatcggcgcgggcgggatcgagaagatcgtcgacatcaagctcaacgacgacgagcaggcgatgttcgacaagtcggtcaatgcggtgaagggcctcgtcgaggcctgcaagggcatcgactcctcgctcgcctga

SEQ ID NO: 45099 - protein, 320 aa, Rhodobacter sphaeroides 2.4.1
MARPKIALIGAGQIGGTLAHLAAIKELGDVVLFDIAEGTPQGKALDIAQSGPSEGFDAVMKGANSYEEIAGADVCIVTAGVPRKPGMSRDDLIGINLKVMKSVGEGIKAHAPNAFVICITNPLDAMVWALQQFSGLPAEKVVGMAGVLDSARFRHFLSVEFNVSMRDVTAFVLGGHGDTMVPLVRYSTVAGIPLPDLVQMGWTTQEKLDQIVQRTRDGGAEIVGLLKTGSAFYAPATSAIEMAEAYLKDQKRLLPCAAYVDGAFGLNGMYVGVPTIIGAGGIEKIVDIKLNDDEQAMFDKSVNAVKGLVEACKGIDSSLA

SEQ ID NO: 45100 - DNA, 960 bp, Magnetospirillum magnetotacticum MS-1
  CDS (1)..(960)
atggcacgcaagaagatcgctctcgtagggtccggcaatatcggcggcacgctcgcccatctgatcggcctcaaggaactgggtgatgtcgtcatgttcgacatcgccgagggcatcccccagggcaagggtctcgacatcctcgagtccaccccggtcgagggcgtggactgccgctattccggtgccaacgactactccgccatcaagggcgccgatgtggtcatcgtcaccgctggcgtgcccaggaagcccggcatgagccgcgacgatctggtcggcatcaacctcaaggtcatggccgccgtcggcgagggcatcaagaagaactgccccggcgctttcgtgatctgcatcaccaatccgctggacgtgatggtctgggcgctgcagcactattccggcgtgcccgccaacatgatcgtcggcatggctggcgtgctggattcggcccgtttccgcaccttcctgtgtgaagagttcaacgtctcggtcgaggacgtcaccgccttcgtgctgggcggccacggcgacaccatggtcccgctggtccgttactccaccgtcgccggcatcccgctgcccgacctggtgaagatgggctggaccacgcaggagaagctggaccagatcgtgcagcgcacccgtgacggcggcgccgagatcgtcaacctgctgaagaccggctcggcctactacgccccggccgcttcgggcgtcgccatggccgaagccttcctcaaggacaagaagcgcgtcctgcccgtcgccaccctggtcaagggcggcacctacggccagcccgacgacgtgttcgtcggcgtgccggtggtcatcggcgaaggcggcgtggagcgcatcgtcgagatcgagctgaacgccgccgagcaggccgagttcaacaagtcggccgacgccgtccgcggcctggtcaaggtcgccaagggcctgatgggctaa

SEQ ID NO: 45101 - protein, 319 aa, Magnetospirillum magnetotacticum MS-1
MARKKIALVGSGNIGGTLAHLIGLKELGDVVMFDIAEGIPQGKGLDILESTPVEGVDCRYSGANDYSAIKGADVVIVTAGVPRKPGMSRDDLVGINLKVMAAVGEGIKKNCPGAFVICITNPLDVMVWALQHYSGVPANMIVGMAGVLDSARFRTFLCEEFNVSVEDVTAFVLGGHGDTMVPLVRYSTVAGIPLPDLVKMGWTTQEKLDQIVQRTRDGGAEIVNLLKTGSAYYAPAASGVAMAEAFLKDKKRVLPVATLVKGGTYGQPDDVFVGVPVVIGEGGVERIVEIELNAAEQAEFNKSADAVRGLVKVAKGLMG

SEQ ID NO: 45102 - DNA, 909 bp, Desulfitobacterium hafniense DCB-2
  CDS (1)..(909)
atgctggctatgaaagggttgggagatattgttttactggatacccaggcaaacgaaaatccgacgaaagggaaagctctggatatcatggaagccggtcctttgactcgttccagtgtccgcgtaacgggtacctcagattatcaggatacacttgattcggatgttgtggtgatcacggccggtatcgcccgtaagccgggaatgtcgcgcaacgaactatgcgatatcaatgctggaatcgtcacccatgtcgtccggcaggttgttcaacattcgcccaatagtactctgatcattttaagcaatcccgtggatattatgacctacgttgctttcaaagagtcggggtttaaacggaacaggattattggacaatcgggagttcttgattcagcgcgtttccgctattttgtagccagcgagcttaaggtatctgccgaagatgtaacaggatttgttctgggggttcatggggacgatatggtaccgctggtacgctattgttctgtccatggtatacccattcagcagctattgccggaagctgaaattgaaaaaattatggaacggacacgtcaggccggttcggaaatcgtcaatttattaggcaatggcagtgcttattatgctcccgctgccgccttaacagaaatgatcgagtctatcctgctggataagcatcgggtcatgccttgtatagttcacttggaaggtgaactgggctatcaagacctggtgctgaatgttcccgctgtgattgggcggcagggagtggaaaagatattgcccatcgatttactgccggaagaggaggacttgatcgaacgctctgttgcatccataagacgtggtattgatgcagttttagaggggaagacaaataagcgatgcagtttaatcagttag

SEQ ID NO: 45103 - protein, 302 aa, Desulfitobacterium hafniense DCB-2
MLAMKGLGDIVLLDTQANENPTKGKALDIMEAGPLTRSSVRVTGTSDYQDTLDSDVVVITAGIARKPGMSRNELCDINAGIVTHVVRQVVQHSPNSTLIILSNPVDIMTYVAFKESGFKRNRIIGQSGVLDSARFRYFVASELKVSAEDVTGFVLGVHGDDMVPLVRYCSVHGIPIQQLLPEAEIEKIMERTRQAGSEIVNLLGNGSAYYAPAAALTEMIESILLDKHRVMPCIVHLEGELGYQDLVLNVPAVIGRQGVEKILPIDLLPEEEDLIERSVASIRRGIDAVLEGKTNKRCSLIS

SEQ ID NO: 45104 - DNA, 936 bp, Haemophilus somnus 129PT
  CDS (1)..(936)
atgaaaatagctgttttaggtgcggctgggggtattggtcaagcattggctctgttattaaaactacaattacctgcgggttcagaattatcattatatgatattgcacctgttacaccgggtgttgcggctgatgtaagccatattccaacagcggtgaagatacaaggttttgcaggggaagatccaactcccgctttagaaaacgctgatgttgtactaatttctgccggtgttgctcgtaaaccgggaatggatcgttcagatttatttaatattaatgcaggtattgtgaaaaatttaattgaaaaagtcgctaaaacttgtcctaaagcctgtgtgggtattattaccaatccggttaatacaacagtagcaattgctgctgaagtgctgaaaaaagcaggcgtttatgataaacgtaaattatttggggtaacaacattagatgtattacgttctgaaacttttgttgctgaattgaaaggactcaatgtttcacgcattgcggtaccggtaattggcggacattccggtgtgacgattcttccattgttatcccaagtgcaatatgccgaatgggaagaggacgaaatagcaccattaacaaaacgtattcaaaatgccggtactgaggttgttgaagcgaaagcgggtggcggttctgctacactttcaatggctcaagcagcagcacgttttgctctctcactggtacaggggctaagtggtgaaactgttgtggaatgtacgtatgttgaaggtgatggtaaatatgctcgtttctttgcacaacctgttcgcttaggaaaagaaggggtagaggaaattttaccggtgggtaccttaagtgcatttgaacaaaaagccttagaagatatgttgccaactttacgagctgatattgaattaggcgaaaaatttgtcaataactaa

SEQ ID NO: 45105 - protein, 311 aa, Haemophilus somnus 129PT
MKIAVLGAAGGIGQALALLLKLQLPAGSELSLYDIAPVTPGVAADVSHIPTAVKIQGFAGEDPTPALENADVVLISAGVARKPGMDRSDLFNINAGIVKNLIEKVAKTCPKACVGIITNPVNTTVAIAAEVLKKAGVYDKRKLFGVTTLDVLRSETFVAELKGLNVSRIAVPVIGGHSGVTILPLLSQVQYAEWEEDEIAPLTKRIQNAGTEVVEAKAGGGSATLSMAQAAARFALSLVQGLSGETVVECTYVEGDGKYARFFAQPVRLGKEGVEEILPVGTLSAFEQKALEDMLPTLRADIELGEKFVNN

SEQ ID NO: 45106 - DNA, 954 bp, Actinobacillus pleuropneumoniae serovar 1 str. 4074
  CDS (1)..(954)
atgaaagttgcacttttaggcgcagcgggcgggattggtcaaaccttagccctattattaaaacttcgtttacctgtcggcaccgacttagcgttatatgatatttcccccgtaacgccggggattgcggtcgatatcagccacataccgacttcggttagtgcggtaggttactccggtgaagatccgagtgaggcgttaaaaggcgcaaatcttgtgattattaccgccggcgtagcgcgtaaaccgggtatgacgcgtgcggatttattcaatatcaatgcggatatcgttaaaaatctagtcgaaaaagtagcggaagtttgcccgaaagcttgtatcggtatcgtaaccaatccggtcaatacccttgtgccgattgcggcggaagtactacgtaaagccggtgtttatgataaacgtaaattattcggtgtaacgacgcttgacgtggttcgcgccaaaacatttacttccgaattaaaagagaaacatgtcgaaacggttaaagttccggtaatcggcggtcactcaggtccgactatccttcctcttctttctcaagcattgtccgaaggtcttccgctttcatttactcaagaagaaatcgaggctttaacttatcgtatccaaaatgccggtactgaagtagtagaagctaaagccggcggcgggtcggcaacgctttctatggcggaatccggcgcacgttttgccgttgcggtatttaaagcgttattaggtgaagattgcgtacgttacgcctatgtagaaagtaaagagggttctggttatcccgaattctttgctcatccggtacgtttcggattaaccggtgtggaagaactgttacctatcggcaaattaagcgaatatgaacaagcaaaactgggcgagttaaaacctgtgcttgaagcggatattgctctcggtaaaaattttgtaaatccataa

SEQ ID NO: 45107 - protein, 317 aa, Actinobacillus pleuropneumoniae serovar 1 str. 4074
MKVALLGAAGGIGQTLALLLKLRLPVGTDLALYDISPVTPGIAVDISHIPTSVSAVGYSGEDPSEALKGANLVIITAGVARKPGMTRADLFNINADIVKNLVEKVAEVCPKACIGIVTNPVNTLVPIAAEVLRKAGVYDKRKLFGVTTLDVVRAKTFTSELKEKHVETVKVPVIGGHSGPTILPLLSQALSEGLPLSFTQEEIEALTYRIQNAGTEVVEAKAGGGSATLSMAESGARFAVAVFKALLGEDCVRYAYVESKEGSGYPEFFAHPVRFGLTGVEELLPIGKLSEYEQAKLGELKPVLEADIALGKNFVNP

SEQ ID NO: 45108 - DNA, 975 bp, Anabaena variabilis ATCC 29413
  CDS (1)..(975)
atgtcttcttctccagactcccccccaattttgcatcgtctacctcgtgtcgccattattggtgctggtagggttggtagcactttagctcaacgtattgctgaaaaaaatctagcagatgtggtgctattagatattgttgagggtatgcctcaaggattggcactagatttattagaagctaggggtattgaactgcataatcgtcagattatcggcacaaataattatgctgatacctctggttcacaaattgtcgttataacagccggatttccccgcaagccagggatgagtcgggatgacttgttgagaactaacgccaaaattgttgtggaagcagcaaagcaagcgatcgcctactctccctgtgctatttttatcgtagtcactaatcctctggatgtaatgacctatttagcttgggaagctacaggtttaccccgtaaccgcatcatgggtatggctggggtgttagactcggcaagatttgaaacttttatagccttggaattaggagtattacctgcggatgtcaaagcgatggtattgggtagtcatggggatttgatggttcccctgtctcgtcatgccacagttaatggtatcccgattacagaattgttagatgcagccacaatagaaaggttggtggagagaacccgtaatggtggtgcggaaattgtggaacttatgcagactggtggcgcattttttgcacctgcatcagctacaagtttgatggtggaatcgattttattgaatcagtcgcgcctgttacctgtgtctgtatatctgcaaggcgaatatggtttaaaagatgtagtgattggtgttccttgtcgcctgggattaaatggaattgagagtgtaatcgaattaaatctcagtgatagtgaaagagaagctttacaaacttcggctcaatcggtgcagaaaaatattgagcgatggcattctacccagcatagctga

SEQ ID NO: 45109 - protein, 324 aa, Anabaena variabilis ATCC 29413
MSSSPDSPPILHRLPRVAIIGAGRVGSTLAQRIAEKNLADVVLLDIVEGMPQGLALDLLEARGIELHNRQIIGTNNYADTSGSQIVVITAGFPRKPGMSRDDLLRTNAKIVVEAAKQAIAYSPCAIFIVVTNPLDVMTYLAWEATGLPRNRIMGMAGVLDSARFETFIALELGVLPADVKAMVLGSHGDLMVPLSRHATVNGIPITELLDAATIERLVERTRNGGAEIVELMQTGGAFFAPASATSLMVESILLNQSRLLPVSVYLQGEYGLKDVVIGVPCRLGLNGIESVIELNLSDSEREALQTSAQSVQKNIERWHSTQHS

SEQ ID NO: 45110 - DNA, 972 bp, Crocosphaera watsonii WH 8501
  CDS (1)..(972)
atgactgtcccttatgacccccttcttctttgtcaatctctccgtgtagctatcatcggcgcaggtaatgtggggcgaactttagcccaacggatcgttgaaaaagacttagctgatgttgtcctcttggatgtaatagagggactcccccaaggagtggccctagatttaatggaggctcaggggctagaatatcataactgtgagatagtggggacaaacaactatgaagatacagctaacgctgatttagtcgtcattaccgcaggccgagccagaacccctggtatcagtagagatgaccttttggcgattaatgctaaaattgtggctgacgtggctgaaaaagcctttaaatactctcctaatgccattttcatagtcattgccaaccccctcgatgtgatgacctatttaacccgcaaagtgatcggtttaccgccacaaagggtgatggggatggctggtgtcttggactcttctcgtctgcaaacttttatcgctatggagttgggcatttctactgccaatgtgacggccatggtattgggtggccacggggatttaatggtgcctttagcccgttattgcaccgtcaacggcattcctattactgaattattagactcccaaactatcgatcgcttaatggagagaacccgtaaaggaggggcagaggtggttaaattattgaaaacaggaggggcttattatgcaccagcttctgcggcttatgtcatggtggaaagcatagtcagggatcaatctcgtttattgccaacggcggcttatttacaaggtgaatatggattaaatgatatttatatcggggttccctgctttttgggttgtcgtggagttaagaaaatattagaagtacaattaacatctgaggaaaaagaagccctacacatttctgctaactctgtcagggaaaatgtcaagcttgctttagaaagtgttggcatttaa

SEQ ID NO: 45111 - protein, 323 aa, Crocosphaera watsonii WH 8501
MTVPYDPLLLCQSLRVAIIGAGNVGRTLAQRIVEKDLADVVLLDVIEGLPQGVALDLMEAQGLEYHNCEIVGTNNYEDTANADLVVITAGRARTPGISRDDLLAINAKIVADVAEKAFKYSPNAIFIVIANPLDVMTYLTRKVIGLPPQRVMGMAGVLDSSRLQTFIAMELGISTANVTAMVLGGHGDLMVPLARYCTVNGIPITELLDSQTIDRLMERTRKGGAEVVKLLKTGGAYYAPASAAYVMVESIVRDQSRLLPTAAYLQGEYGLNDIYIGVPCFLGCRGVKKILEVQLTSEEKEALHISANSVRENVKLALESVGI

SEQ ID NO: 45112 - DNA, 966 bp, Mesorhizobium sp. BNC1
  CDS (1)..(966)
atggctcgccacaaaatcgctctcatcggctcaggcatgatcggcggcactcttgcccatctcgtcggccttaaggaacttggtgacgtagttctcttcgacatcgccgaaggcattccgcagggcaaagggctcgacatcgcggaatccgcgccggtcgaaggctttgacgccaagtttcttggcaccaacgactacgccgcgatcgagggggcggatgtctgcatcgtcaccgctggcgtgccgcgcaagcctggcatgagccgtgacgacctcctggggatcaacctcaaggtgatggagcaggtcggggccgggatcaagaaatacgcgccgaacgcattcgtgatctgcatcaccaatccgctcgacgccatggtctgggcgctgcagaagttctccggcctgccgaaaagccatgtggtgggtatggcgggtgtgctcgactccgcccgcttccgttatttcctggcggaggagttcaaggtctcggtcgaggacgtgaccggtttcgtcttgggcggacacggcgattccatggtgccgctcatccgctattccaccgtcgccggtatcccaattccggatctcgtgaagatgggctggacgacgcaggagaaaatcgaccagatcgtgcagcgcacgcgcgacggcggcgcggaaattgtcggccttttgaagagcggctcggcgttctacgctccagcctcctcggcgatcgcaatggcggaagcctatctgaaagacaagaagcgcgttctgccctgcgctgcccatgtgtctggtcaatatggcgtgaaggacctctatgtgggcgtaccgacggtgatcggcgccggcggcgtggagcgcatcatcgaaatcgacctgaacaagaccgagcagaagatgttcgaaaactcggtggcctctgtcgaggggctgtgcaaagcgtgtggcgatatcgccccgagcttgaagaactag

SEQ ID NO: 45113 - protein, 321 aa, Mesorhizobium sp. BNC1
MARHKIALIGSGMIGGTLAHLVGLKELGDVVLFDIAEGIPQGKGLDIAESAPVEGFDAKFLGTNDYAAIEGADVCIVTAGVPRKPGMSRDDLLGINLKVMEQVGAGIKKYAPNAFVICITNPLDAMVWALQKFSGLPKSHVVGMAGVLDSARFRYFLAEEFKVSVEDVTGFVLGGHGDSMVPLIRYSTVAGIPIPDLVKMGWTTQEKIDQIVQRTRDGGAEIVGLLKSGSAFYAPASSAIAMAEAYLKDKKRVLPCAAHVSGQYGVKDLYVGVPTVIGAGGVERIIEIDLNKTEQKMFENSVASVEGLCKACGDIAPSLKN

SEQ ID NO: 45114 - DNA, 942 bp, Ehrlichia canis str. Jake
  CDS (1)..(942)
atgattaagcgtaaaaaaattgctcttattggtgctggtaatattggtggtatgatagcctatttgattaggctgaaaaatttaggagatgtagttttattagacgttaatgatggcatagctaagggaaaagcacttgatatggctgaatcttctccagtaggaaaatataatggtgaaatattagggactaataattatgctgatattgaaggtgctgatgccattgtcgttacagctggcattactagaaaacctggaatgagtcgtgaagatttgattaatactaatgtaaatatcataaaagaagtagcagacaatataggtaaatatgcacctaatgcatttgtggttgtagttactaatccacttgatgtaatggtttttgctatgcataagtattcgaaattatcaagtaacatggttgttggtatggctggtatacttgattcggcgagattttcttattttattgcaaaggaattgaacgtatcggttgataatgttaattctttggtattaggtggccatggagacctaatgcttcctttagtaaaatattcttcagttgctggaatatctatagctgatttgataaaaattgatttgattactcaagataaagttgatgcaattatagaaagaactagaaaaggtggagaagaaatagtaagtttactaaaaataggttcagcttattatgctcctgctgagtctgcattattaatgatagattcttatttaaatgatagaaggctaatattaccttgttctgtttatttaaaaggtgaatatggcgtaagcaatttatttgtgggtgttcctgttattattggaagaaatggagtggaaaaaataatcgagttggaattaaccgaacaagaaaaaaacatatttgataattctgtaaaattaatcaaaaatttagtaagtaatgtttaa

SEQ ID NO: 45115 - protein, 313 aa, Ehrlichia canis str. Jake
MIKRKKIALIGAGNIGGMIAYLIRLKNLGDVVLLDVNDGIAKGKALDMAESSPVGKYNGEILGTNNYADIEGADAIVVTAGITRKPGMSREDLINTNVNIIKEVADNIGKYAPNAFVVVVTNPLDVMVFAMHKYSKLSSNMVVGMAGILDSARFSYFIAKELNVSVDNVNSLVLGGHGDLMLPLVKYSSVAGISIADLIKIDLITQDKVDAIIERTRKGGEEIVSLLKIGSAYYAPAESALLMIDSYLNDRRLILPCSVYLKGEYGVSNLFVGVPVIIGRNGVEKIIELELTEQEKNIFDNSVKLIKNLVSNV

SEQ ID NO: 45116 - DNA, 957 bp, Rhodospirillum rubrum
  CDS (1)..(957)
atggcacgcaagaagatcgcccttgtcggcgccggcaatatcggtggcacgcttgcccatctcatcggtctcaaggaattgggcgatgtggtgctcttcgacatcgccgaggggactcctcagggcaaggctctggatatcgccgaatccaccccgatcgaaggggtcgacgccagctactcggggtccaacgattacgccgcgatcaaggacgccgatgtggtgatcgtcaccgccggcgtgccgcgcaagccgggcatgagccgcgacgacctgatcggcatcaacgccaaggtgatgtcggccgtcggccagggcatccgcgccaattgccccaacgccttcgtcatctgcatcaccaacccgctcgacgccatggtctgggtgttgcgcgaggtttcggggctgccccacaacaaggtggtcggcatggccggcgtgctcgacagcgcccgcttccgctatttcctgtccgaggaattcaatgtctcggtcaaggacgtcaacgccttcgtgctcggcggccacggcgacaccatggttccgctgccgcgctattcgaccgtcgccggtattccgctgcccgatctggtgaagatgggctggaccacccaggagaagctcgaccagatcatccagcgcacccgcgacggtggcgccgagatcgtcggcctgctcaagaccggatcggccttctatgccccggccgccgccgccgtgcagatggccgaagcctatctcaaggaccagaagcgcgttctgccctgcgccgcctgggttgagggccagtatggtctggacggcatctatgtcggcgtccccaccatcatcggcgccggcggcatcgagaaggtgatcgagatcgaactgaacgccgacgaaaaggcggcgttcgccaaatccgtcgacagcgtgcgcgggctgatcgccgcgtcgaaggaactgatgccgaaataa

SEQ ID NO: 45117 - protein, 318 aa, Rhodospirillum rubrum
MARKKIALVGAGNIGGTLAHLIGLKELGDVVLFDIAEGTPQGKALDIAESTPIEGVDASYSGSNDYAAIKDADVVIVTAGVPRKPGMSRDDLIGINAKVMSAVGQGIRANCPNAFVICITNPLDAMVWVLREVSGLPHNKVVGMAGVLDSARFRYFLSEEFNVSVKDVNAFVLGGHGDTMVPLPRYSTVAGIPLPDLVKMGWTTQEKLDQIIQRTRDGGAEIVGLLKTGSAFYAPAAAAVQMAEAYLKDQKRVLPCAAWVEGQYGLDGIYVGVPTIIGAGGIEKVIEIELNADEKAAFAKSVDSVRGLIAASKELMPK

SEQ ID NO: 45118 - DNA, 924 bp, Methanosarcina barkeri str. fusaro
  CDS (1)..(924)
atggctaaaatttccgtgattggtgcaggaaacgtaggggcaactacagtccagcgactagctgaacttgaacttggcgaaattgtcatgacggatattgtggaaggactaccacaaggaaaagcactcgaccttatacaggcaggggcaataaaaggttatgatacgtcaataattgggaccaacgattatgcagaaatcgtagactctgatcttgtaataattacagcagggattgcaagaaaacctgggatgactcgggaagatctgattaaaacgaattctaaaataatagcagaggtttccagaaatattgcaaagtatgctccagactccatagtaattaatgtcacaaatccgcttgacattataacgtacatagctatgaaatcaacaggatttgagacaaagaaagtattcggaatgagcggagttctggattcgggacgttttgcaagctttattgcagaagaactgaagtgttcaaaaaaagatgttcaggcaatggttataggtggtcatggagatctgatggtgcctcttcctcaatatacaacagtgtcaggagttccactcacggacctgcttccgggggatagaattgccaggctggtagagaggacagtaaacggaggagcagagatcgtagagctccttaaacagggcagtgctttttatgcaccgtccgcggctattgtctcaatggcggaagccgttattaaaaattcaaagagaattttgcctgcttcggcttatcttgaaggacattacggacaggaaggtatttacttcggtgtacccgtaaagcttggggcatcaggagtagaagaaatccttgaactcaagctcgatgaaagccagtacgagactctcagaaaatcctcggaaactattcgaaacacgatttcacagctagaaatataa

SEQ ID NO: 45119 - protein, 307 aa, Methanosarcina barkeri str. fusaro
MAKISVIGAGNVGATTVQRLAELELGEIVMTDIVEGLPQGKALDLIQAGAIKGYDTSIIGTNDYAEIVDSDLVIITAGIARKPGMTREDLIKTNSKIIAEVSRNIAKYAPDSIVINVTNPLDIITYIAMKSTGFETKKVFGMSGVLDSGRFASFIAEELKCSKKDVQAMVIGGHGDLMVPLPQYTTVSGVPLTDLLPGDRIARLVERTVNGGAEIVELLKQGSAFYAPSAAIVSMAEAVIKNSKRILPASAYLEGHYGQEGIYFGVPVKLGASGVEEILELKLDESQYETLRKSSETIRNTISQLEI

SEQ ID NO: 45120 - DNA, 963 bp, Novosphingobium aromaticivorans DSM 12444
  CDS (1)..(963)
atggcacgcaagaagatcgcgctgatcggcgcgggcaacatcggtggcactcttgcccacctcgccgcccagaaggaacttggcgacatcgtcctgttcgacgtcgttgaaggcgtgccccagggcaaggcgctcgacctttcgcagtgcggtccggtcgaaggcttcgacgccaacatcatcggcaccaacgactacaagggcatcgcaggcgcggacgtgatcatcgtcaccgccggcgtcgcccgcaagcccggcatgagccgcgacgacctgctcggcatcaacctcaaggtgatgaaggccgtcggcgaaggcatccgcgacaacgcgcccgacgcgttcgtgatctgcatcaccaacccgctcgacgcgatggtctgggcgctgcgcgagttctcgggcctgcccgcgaacaaggtcgtcggcatggccggcgtgctcgactcggcgcgcttcagcacgttcctggcatgggaattcggcgtctcgatccgcgacgtgaacacgttcgttctcggcggccacggcgacaccatggttccggtcacccagtactcgaccgtcaacggcatcccggtgcccgacctcgtcaagatgggcctgtccacccaggaaaagatcgacgcgatcgtgcagcgcacccgttcgggcggcggcgagatcgtcgggctgctcaagaccggttcggcgttctacgcgcctgccgcatcgggcatcgcgatggccgaagcctatctcaacgaccagaagcgcatcctgccctgcgccgcctacgttgacggcgaatacggcgtgaacggtctttacgtcggcgtgccggtgctgatcggcgcgaacggcgtcgagaaggtgatcgagatcgaactcgacgacgaagccaagggcaacctccaggtctccgtcgacgcggtcaaggaactgctggaagcctgcaagggcatcgaccccagcctcgcctga

SEQ ID NO: 45121 - protein, 320 aa, Novosphingobium aromaticivorans DSM 12444
MARKKIALIGAGNIGGTLAHLAAQKELGDIVLFDVVEGVPQGKALDLSQCGPVEGFDANIIGTNDYKGIAGADVIIVTAGVARKPGMSRDDLLGINLKVMKAVGEGIRDNAPDAFVICITNPLDAMVWALREFSGLPANKVVGMAGVLDSARFSTFLAWEFGVSIRDVNTFVLGGHGDTMVPVTQYSTVNGIPVPDLVKMGLSTQEKIDAIVQRTRSGGGEIVGLLKTGSAFYAPAASGIAMAEAYLNDQKRILPCAAYVDGEYGVNGLYVGVPVLIGANGVEKVIEIELDDEAKGNLQVSVDAVKELLEACKGIDPSLA

SEQ ID NO: 45122 - DNA, 969 bp, Ferroplasma acidarmanus
  CDS (1)..(969)
atggacaagaagatttctattattggcgcaggagcagtaggtgcaagtgtagcacaggttctggctatcaagaatatcgcagatattagcatttttgatattgttgagggcgttgcagagggaaaagcactggatatacaggaaggagcaccacattttggctttgattgcaaattgcagggattttgcacccaggaccctaaggaatatgcaaatttaaaaggttcagatgtaatagtagttacagccgggcttgcaagaaggccaggaatgagcagggacgatcttctggtaaagaatataggaataatgaaggatgttggggaacagataaagaaatattcaccggattcaataatagttgctgtaacaaatccagcagatataatggcatacgcattgcagaaagcatccggaattagcccagagagaataataggattgggcgggtcgctggacagttccagattcaggactttcctggctgaagcacttaatgtatctgtaagggatgtaaatgctttcgtaataggtgggcatggtgacgatatggttccgtttatacattactccagtgtttcaggaatacccatatctgatcttcttagcgaagagaaaatacaggaaatcattaaaagaaccagatttggagggggagagatacttaacctttacaaaacaggaacagcattctatgcaccatcaatatccatttctgtaatggttgagtctgtagttaacgatcaacacagggtaattccatgtgcagcataccttacaggaaaacacgctgaaaattataaagtcagcaacgcctttatcggagtgccaataaaaattggaaagaatggcgttgaggaaatatatgatttaaaattcagtgaagccgatgcaaaggaatggatgaagagcgtagaatctgtaaagaaaaacaacaaacttgcagatgattacttcgcatcacactga

SEQ ID NO: 45123 - protein, 322 aa, Ferroplasma acidarmanus
MDKKISIIGAGAVGASVAQVLAIKNIADISIFDIVEGVAEGKALDIQEGAPHFGFDCKLQGFCTQDPKEYANLKGSDVIVVTAGLARRPGMSRDDLLVKNIGIMKDVGEQIKKYSPDSIIVAVTNPADIMAYALQKASGISPERIIGLGGSLDSSRFRTFLAEALNVSVRDVNAFVIGGHGDDMVPFIHYSSVSGIPISDLLSEEKIQEIIKRTRFGGGEILNLYKTGTAFYAPSISISVMVESVVNDQHRVIPCAAYLTGKHAENYKVSNAFIGVPIKIGKNGVEEIYDLKFSEADAKEWMKSVESVKKNNKLADDYFASH

SEQ ID NO: 45124 - DNA, 939 bp, Cytophaga hutchinsonii
  CDS (1)..(939)
atgaaagtaacagtagttggtgctggtaatgttggtgctacttgcgcagacgtattagcatacagagaaattgtaaatgaagtaattctacttgatattaaagaaggtgtagcagaaggcaaagctttggatatctggcagaaagctccaatcacacagtacgacactaaaacaacaggtgtaacaaatgattattctaaaacagctaattcagatgtagtcgtgatcacttcaggtttaccacgtaagccaggtatgacacgtgatgatttgatctctacaaacgctggtattgttagagctgtaactgaaagcgttgttaagtattctccgaatgcgatcattattgtggtatcaaacccgttagacgtaatgacgtattgcgcgcacatcacatcaaaattaccaagaaataaagttatcggcatggcgggtgttcttgacacagcccgttaccgtgcattccttgcagacgaaatcggctgttctccaaaagagattcagggtatgttattaggtggccatggtgatacaatggttccgcttccccgttacacaacggttggtggtattccggtaactgaattggtagaagcagataaattaaacgcaatcatcgaacgcactaaaaatggtggtggtgaattagtaaaattaatgggtacttctgcatggtatgcaccgggtgcagcggcagcccagatggttgaagcgatcgtaaaagatcagaaaaaaatcatcccggtttgtatcaagcttgaaggtgaatacggcatagacgactgttatttaggtgttcctgcagtaatcggtaaaaacggtattgaaaaagtaattgaattgaaattgaatgccgaagaaaaagcattgatggaaacttcaagaaaacacgttaaagaagtaatgaatgtactggatggtttaccgcaacaagcgtaa

SEQ ID NO: 45125 - protein, 312 aa, Cytophaga hutchinsonii
MKVTVVGAGNVGATCADVLAYREIVNEVILLDIKEGVAEGKALDIWQKAPITQYDTKTTGVTNDYSKTANSDVVVITSGLPRKPGMTRDDLISTNAGIVRAVTESVVKYSPNAIIIVVSNPLDVMTYCAHITSKLPRNKVIGMAGVLDTARYRAFLADEIGCSPKEIQGMLLGGHGDTMVPLPRYTTVGGIPVTELVEADKLNAIIERTKNGGGELVKLMGTSAWYAPGAAAAQMVEAIVKDQKKIIPVCIKLEGEYGIDDCYLGVPAVIGKNGIEKVIELKLNAEEKALMETSRKHVKEVMNVLDGLPQQA

SEQ ID NO: 45126 - DNA, 963 bp, Silicibacter sp. TM1040
  CDS (1)..(963)
atggcacgacccaaaatcgccctcatcggcgcaggtcagatcggtggcaccctcgcacatcttgtagccctcaaagaactcggcgacgtcgttttgttcgacatcgcagaaggcacccccgaaggcaaagcgctggacatcgcagaatccggtccttccgaaggctttgacgcaagcctcaaaggcacccaggattatgccgacatcgcgggcgcggacgtctgcatcgtgaccgcgggcgttccgcgcaagccgggcatgtcccgcgacgacctcctgggcatcaacctcaaggtgatgaaatccgtcggcgaaggcatccgcgacaacgcgccggacgcctttgtgatctgcatcaccaacccgctcgacgcgatggtttgggcgctgcgcgaattctccggcctgccgcacgaaaaagtctgcggcatggcgggtgttctggacagcgcgcgcttccgtcacttcctcgcggaggaattcaacgtctccatgaaagacgtcaccgcgtttgtgctcggtggccatggcgacaccatggtgccgtcggtgcgttactccaccgtagcaggcattccgctccccgacctgatcgagatgggctggaccacccaggacaagatggacgcgatcgttcagcgcacccgtgacggtggcgccgaaatcgtgggtctcctgaaaaccggctccgcctattacgcgcctgcgacctctgcaatcgagatggcagaagcctatctcaaggaccagaagcgcgtcctgccctgcgcggcctatgtggacggcgctctgggtctcaacggcatgtatgtcggcgttccgaccgtgatcggtgccggaggcatcgagcgtgtggtcgacatcaagctgaacgctgaagagcaggcgatgttcgacacctccgtcaacgcggtcaaaggcctcgtagacgcgtgcaaaggcatcgacagctcgctggcataa

SEQ ID NO: 45127 - protein, 320 aa, Silicibacter sp. TM1040
MARPKIALIGAGQIGGTLAHLVALKELGDVVLFDIAEGTPEGKALDIAESGPSEGFDASLKGTQDYADIAGADVCIVTAGVPRKPGMSRDDLLGINLKVMKSVGEGIRDNAPDAFVICITNPLDAMVWALREFSGLPHEKVCGMAGVLDSARFRHFLAEEFNVSMKDVTAFVLGGHGDTMVPSVRYSTVAGIPLPDLIEMGWTTQDKMDAIVQRTRDGGAEIVGLLKTGSAYYAPATSAIEMAEAYLKDQKRVLPCAAYVDGALGLNGMYVGVPTVIGAGGIERVVDIKLNAEEQAMFDTSVNAVKGLVDACKGIDSSLA

SEQ ID NO: 45128 - DNA, 945 bp, Rickettsia akari str. Hartford
  CDS (1)..(945)
atgaaaaaaaatccaaaaatctcattaataggtagcggtaacataggtggtacgcttgctcacctaattagccttagagaactcggtgatatcgtattatttgatgttgctgaaggagtaccgcaaggaaaagcattggatctcatgcaagccagtacaatagccgggtctgatatcaaaataacaggtacaaacgactataaagatattgaagggtctgatgcaataattattactgccggtttaccaaggaaaccagggatgagtagagacgatttaattagtattaataccggtattatgaaaaatgttgcagagaacgttaaaaaatacgctcctgatgcttttgtaatagtaattaccaatccgcttgatgttatggtatatgtcatgcttaaagcaagcggattacctcataatcaagtcataggtatggcaggcgtacttgactcatcaagatttaatctttttcttgccgaagagtttaaagtatcggtgagcaatgttaatagcacggttctcggcggtcatggtgatgctatggtacctcttgcaagatattctacaatatcaggcataccgatacctgacttgataaaaatgggcttatcaagtaatgaaaatattgaaaaaataatcgatcgtactaggaacggcggcggcgatattgttgcattacttaaaacaggttctgcttattatgcacccgcagcctcagcaatagaaatgcttgaagcatatttaaaagataaacgtcaaatgctaacttgtgccgcttatctacaaggtgaatatggggttcatgatttatatgtcggagtacctattattataggtaaagaaggtgtcataaaagtagtagaactacaattaactaaagaagaaaaaacattattcgacaaatcagttgagggagttaaaacactcattgagacgatacaataa

SEQ ID NO: 45129 - protein, 314 aa, Rickettsia akari str. Hartford
MKKNPKISLIGSGNIGGTLAHLISLRELGDIVLFDVAEGVPQGKALDLMQASTIAGSDIKITGTNDYKDIEGSDAIIITAGLPRKPGMSRDDLISINTGIMKNVAENVKKYAPDAFVIVITNPLDVMVYVMLKASGLPHNQVIGMAGVLDSSRFNLFLAEEFKVSVSNVNSTVLGGHGDAMVPLARYSTISGIPIPDLIKMGLSSNENIEKIIDRTRNGGGDIVALLKTGSAYYAPAASAIEMLEAYLKDKRQMLTCAAYLQGEYGVHDLYVGVPIIIGKEGVIKVVELQLTKEEKTLFDKSVEGVKTLIETIQ

SEQ ID NO: 45130 - DNA, 930 bp, Chloroflexus aurantiacus
  CDS (1)..(930)
atgcgcaagaagattagtattatcggggcaggatttgtcggttcgacgacagctcactggctggccgctaaagaattaggtgacattgttctgcttgattttgtcgagggtgtgcctcaaggcaaggctctcgatctctacgaggcatcaccaattgaagggtttgatgttcgggtgaccggcacgaacaactacgccgatactgccaactcggatgtcatcgttgttacgtcaggtgctccgcgcaagccgggcatgagccgtgaggatttgatcaaggtcaacgccgacatcacccgtgcctgtatcagtcaggctgccccgctctcgccgaatgccgtgattatcatggtcaataatcctctggatgcgatgacctatctggcggcggaggttagtggcttccccaaagagcgtgtcattggtcaggccggcgtcctcgatgcggcccgctatcgcaccttcattgccatggaggcgggtgtttcggttgaagatgttcaggcgatgctgatgggtggtcacggcgatgagatggtaccgctgccccggttttcaaccattagcggtattccggtgagcgagttcattgcgcctgatcgtctggctcagattgttgagcgcacccggaagggtggtggcgagattgtgaatctgctgaagaccggcagtgcgtattatgctcccgccgccgccacagcgcagatggtcgaagcggtgctcaaagacaagaagcgggtcatgccggtggcagcctacctgaccggtcagtacggcctgaatgatatttactttggtgtaccggtgatcctcggtgccggtggagtagagaaaattctcgaattgccgctcaacgaagaggagatggcactgctgaacgcatcggcgaaagcggtacgtgccaccctcgacacgctgaagtctctctaa

SEQ ID NO: 45131 - protein, 309 aa, Chloroflexus aurantiacus
MRKKISIIGAGFVGSTTAHWLAAKELGDIVLLDFVEGVPQGKALDLYEASPIEGFDVRVTGTNNYADTANSDVIVVTSGAPRKPGMSREDLIKVNADITRACISQAAPLSPNAVIIMVNNPLDAMTYLAAEVSGFPKERVIGQAGVLDAARYRTFIAMEAGVSVEDVQAMLMGGHGDEMVPLPRFSTISGIPVSEFIAPDRLAQIVERTRKGGGEIVNLLKTGSAYYAPAAATAQMVEAVLKDKKRVMPVAAYLTGQYGLNDIYFGVPVILGAGGVEKILELPLNEEEMALLNASAKAVRATLDTLKSL

SEQ ID NO: 45132 - DNA, 957 bp, Trypanosoma brucei
  CDS (1)..(957)
atgcgtaccagtgcaactctccagtttaaagttgccgtcctcggtgctgccggtggtattggtcaaccgttatcgcttatcctgaaaaccaatcctcttgtgtctcacttgagttgttatgacatacatggtgtgacgggcgtggctgcagacctctcgcacatttgttctccagctaaggtgactggtcacctgaaagatgaacttcacaaagcagttgacggagctgacgttgtcatcatccccgcaggcacaccgcgaaagccggggatgactcgcgaagatctcttcagtgttaatgcaacgatcgttcgagacctcgtatcggcttgtgcaaaacaatgccccaaggctcttatcggtgttgtttccaaccctgtcaacagtgttgtacctattgcttcggaggtgctcaaaaaggctggtgtctttgaccctgctcgcctctttggcataaccacgcttgatgtggtgagagctcgaacatttgtggctgaggccgctggtaagagtccgtatgacgttaatgttcaggtggtgggtggacacagtggtccgactattattccattattatctcaagctggtgtatcattgacggaggaacaagtcaaggctataacgcaccgagtacagtatggcggtgacgaagttgtgaaagctaaaggaggggcgggttcagcaactctttcaatggcgtacgccgctggggaatggatgtcctccgtgttgaaagggcttcgtggtgacaagggtatcgtggagtgtacgtatgttcagacggatattattcccggcgtgaactttttcggttgcccggtggaacttgggaaaggtggcgttgaaaagattcacaaacctgtgtttgacgcgtatgaacagagtcttttggagaaatgtgttgcggacttggagaaaaatatcgcagcaggttttgccttcggttccagacagtga

SEQ ID NO: 45133 - protein, 318 aa, Trypanosoma brucei
MRTSATLQFKVAVLGAAGGIGQPLSLILKTNPLVSHLSCYDIHGVTGVAADLSHICSPAKVTGHLKDELHKAVDGADVVIIPAGTPRKPGMTREDLFSVNATIVRDLVSACAKQCPKALIGVVSNPVNSVVPIASEVLKKAGVFDPARLFGITTLDVVRARTFVAEAAGKSPYDVNVQVVGGHSGPTIIPLLSQAGVSLTEEQVKAITHRVQYGGDEVVKAKGGAGSATLSMAYAAGEWMSSVLKGLRGDKGIVECTYVQTDIIPGVNFFGCPVELGKGGVEKIHKPVFDAYEQSLLEKCVADLEKNIAAGFAFGSRQ

SEQ ID NO: 45134 - DNA, 1077 bp, Medicago sativa
  CDS (1)..(1077)
atggagccaaattcatatgcaaattcacgaatcacaagaatcgccagccacctcaatcctcccaatctcaagatgaatgaacatggtggttcttctttgacgaatgttcattgccgtgccaaagggggtacaccaggattcaaagttgcgattttgggtgctgctggtggcataggacaacctctttctatgttgatgaagatgaatctcttggtttctgttcttcatctttatgatgtcgttaatactcctggtgttacttctgatatcagtcacatggatacttctgctgttgttcgaggattcttggggcaaaatcagcttgaggatgcacttacaggtatggatttggtaatcattcctgctggggttccccgtaaacctggaatgacaagagatgatctcttcaatattaatgctgggattgttaagacgctttgtgaagcgattgcaaagcgatgtcctaaggcgattgtaaacttgataagcaatccagttaactccactgttcctattgcggctgaggttttcaaaagagctggtacttatgatcccaagagactgttgggagtgacaatgcttgacgtggttagggccaatacgtttgtggctgaagttatgggtcttgatccaagggatgtggatgttcctgttgtcgggggacatgccggaatcacgattttacctcttctttctcaggttaaaccaccttcctctttcaccccaaaggaaattgagtacttgacagatcgcatacaaaatgggggaacagaagttgttgaggccaaagctggagctggatctgcaacactatcaatggcatatgctgctgttaaatttgcagatgcatgtcttcgtgcgttgaaaggagaggctgatatcattcaatgtgcatatgttgattcacaggtaactgaattgccattctttgcatcaaaagtacgacttggccgtaacggagttgaggaatttcttcctcttggtcccctaagtgattatgagagggcaagtttggaaaaggccaagaaagagttagcaacaagcgtggagaagggagtttctttcatcagaaaatga

SEQ ID NO: 45135 - protein, 358 aa, Medicago sativa
MEPNSYANSRITRIASHLNPPNLKMNEHGGSSLTNVHCRAKGGTPGFKVAILGAAGGIGQPLSMLMKMNLLVSVLHLYDVVNTPGVTSDISHMDTSAVVRGFLGQNQLEDALTGMDLVIIPAGVPRKPGMTRDDLFNINAGIVKTLCEAIAKRCPKAIVNLISNPVNSTVPIAAEVFKRAGTYDPKRLLGVTMLDVVRANTFVAEVMGLDPRDVDVPVVGGHAGITILPLLSQVKPPSSFTPKEIEYLTDRIQNGGTEVVEAKAGAGSATLSMAYAAVKFADACLRALKGEADIIQCAYVDSQVTELPFFASKVRLGRNGVEEFLPLGPLSDYERASLEKAKKELATSVEKGVSFIRK

SEQ ID NO: 45136 - DNA, 1032 bp, Medicago sativa
  CDS (1)..(1032)
atgatgaggccgtcgatactcagatccgtcaagtcagccgtgtcccgcagcataacccgccgtggctatgccaccgaaccggttcctgaacgcaaggtggccattctcggtgccgccggtgggatcggtcagcccctctctcttctcatgaagctcaaccctctcgtttcaaccctttctctttatgatattgctggtacccctggtgttgctgccgatgttagccacatcaactccagatctcaggtaactgggtacgcaggtgaagatgagcttggaaaagctttggagggtgctgacgttgttataattcctgccggcgtgcccagaaagcctggaatgactcgtgatgatcttttcaacattaacgctggcattgttaaatcacttgccactgctatttctaagtactgcccccatgctcttgttaacatgataagcaaccctgtgaactcaactgtccccattgctgctgaggttttcaagaaggcagggacatacgacgagaagagattgtttggggttacaactcttgatgtagttagggcaaaaactttttatgctgggaaagctaatgttccagttgcggaggtcaatgtacctgttataggaggccatgcaggagttactattctcccactattttctcaggcatcacctcaagccaatctggatgatgatgtcattaaggctctaactgcgaggacccaagatggaggaacagaggttgtgactgccaaggctggaaagggttccgcaactttgtcaatggcttatgctggagccatatttgctgatgcttgcctcaaaggtcttaatggagttccagatgttgttgagtgctcgtatgtgcaatccaatctcattgctgaacttcctttctttgcttccaaggtgaggattgggaagaatggtgtagaggaaattctgggcctaggttctctctcagattttgagaaacaaggccttgaaaacctcaagtctgaacttaagtcatctattgagaagggaatcaaatttgcctcccagtaa

SEQ ID NO: 45137 - protein, 343 aa, Medicago sativa
MMRPSILRSVKSAVSRSITRRGYATEPVPERKVAILGAAGGIGQPLSLLMKLNPLVSTLSLYDIAGTPGVAADVSHINSRSQVTGYAGEDELGKALEGADVVIIPAGVPRKPGMTRDDLFNINAGIVKSLATAISKYCPHALVNMISNPVNSTVPIAAEVFKKAGTYDEKRLFGVTTLDVVRAKTFYAGKANVPVAEVNVPVIGGHAGVTILPLFSQASPQANLDDDVIKALTARTQDGGTEVVTAKAGKGSATLSMAYAGAIFADACLKGLNGVPDVVECSYVQSNLIAELPFFASKVRIGKNGVEEILGLGSLSDFEKQGLENLKSELKSSIEKGIKFASQ

SEQ ID NO: 45138 - DNA, 1227 bp, Medicago sativa
  CDS (1)..(1227)
atggcggcagcagcatcagctacttttactattggaaccacccaaacagggaggtcacttcctcaatctagtccttttggtttgaaattcaattcccaggttaatttcaacaccttctctggcctcaaagccatgccatctctcagatgtgactctgaatcatctttctccggcaaagaaacttgtgccgctctgcgtgcaacttttgcacccaaagctcaaaaggaaaaccgaaacctcacccgcaacttgcagcctcaggcatcctacaaagtagcggttcttggtgctgcaggagggattggtcagccactggcacttctcatcaagatgtcgcctttggtttccgacctgcatctctatgatatcgcgaatgttaagggagttgctgctgatatcagtcattgcaacaccccttcgaaagttttggatttcacaggtgcttctgagttagcaaattgtttgaaaggtgtggatgttgttgttatccctgctggtgttcctaggaagcccggcatgactcgtgacgaccttttcaacatcaatgctggtatagtcagggacttggtcactgccgttgcagataattgccccaatgcttttattcatattatcagtaatccagtgaactctacagttcctattgccgctgaaattctaaaacagaagggtgtctatgatcctaagaagctctttggtgtttctacacttgatgttgtgagggcaaacacatttgttgctcagaagaagaacctgaggttgattgatgtggatgttccagttgttggaggtcatgccgggattacaattcttcctctcttgtcaaagacaaaaccctcagtgagtttcactgatgaagaaattgaggagctaactgtcaggattcaaaacgctggaactgaggttgttgaggcgaaggctggtgcagggtctgctactttgtcaatggcttatgcagcagcaagatttgttgaatcgtctcttcgtgcacttgacggagacgctgatgtgtatgagtgctcattcgtacagtcagatctgaccgaccttccgttttttgcttcaagggtgaagattggtaggaaaggagtcgaggctttaattccaactgatctccaaggattgagtgagtatgagcagaaggctttggaagcacttaagccagaacttaaggccagcatcgagaagggggttgcttttgctcaaaagcaaactgttactgcttag

SEQ ID NO: 45139 - protein, 408 aa, Medicago sativa
MAAAASATFTIGTTQTGRSLPQSSPFGLKFNSQVNFNTFSGLKAMPSLRCDSESSFSGKETCAALRATFAPKAQKENRNLTRNLQPQASYKVAVLGAAGGIGQPLALLIKMSPLVSDLHLYDIANVKGVAADISHCNTPSKVLDFTGASELANCLKGVDVVVIPAGVPRKPGMTRDDLFNINAGIVRDLVTAVADNCPNAFIHIISNPVNSTVPIAAEILKQKGVYDPKKLFGVSTLDVVRANTFVAQKKNLRLIDVDVPVVGGHAGITILPLLSKTKPSVSFTDEEIEELTVRIQNAGTEVVEAKAGAGSATLSMAYAAARFVESSLRALDGDADVYECSFVQSDLTDLPFFASRVKIGRKGVEALIPTDLQGLSEYEQKALEALKPELKASIEKGVAFAQKQTVTA

SEQ ID NO: 45140 - DNA, 972 bp, Trypanosoma cruzi
  CDS (1)..(972)
atggtgaatgtcgctgttattggtgccgctggaggcatcggccaatccctttccctgctgctccttcgggagctgccgtttggcagcaccctgtcactgtatgacgtggcaggggcacctggggttgccgctgacctgtcccacatcgaccgtgccggaattactgtgaagtacgccgcaggaaagctgccccccgtaccccgcgaccccgcactgactgaactggccgagggagttgatgtttttgtcattgtggctggtgtaccgcgcaagcccggtatgacgcgcgacgatctgttcaacgtgaacgccggcattgtcatggatcttgtcttgacatgcgcctctgtatcgcccagtgcctgcttctgtattgttacgaaccctgtgaacagcatggtgcccattgcagcccagacactgaggaagattggtgtgtacaacaaaaacaaactgcttggtgtgagcctgctcgatggactgcgagccacacgttttatcaacaatgctcgacacccacttgtcgttccatacgtcccagttgtcggtgggcacagcgatatcactattgtacccctgtattcgcagattcctggccctctgcctgatgaatctaccctgaaagagatccgcaaacgtgtgcaggtggcggggacggaggtggtgaaagcaaaggcgggtcgcggcagtgcgacgctctccatggcggaggcaggcgcccgcttcaccatgcatgtcgtgaaggcgcttatgggtctggatacgcccatggtttacgcgtatgttgacacggacggcaaacacgaatgcccatttctcgcaataccggtggttctaggaaagaatggcattgagaggcgccttcctattggccccatcacaacggtcgagaaggagatgcttgaagaggccgtcggcgtggtgaaaaagaatattgagaaggctgagacgtttgcgcggtcaaagttgtag

SEQ ID NO: 45141 - protein, 323 aa, Trypanosoma cruzi
MVNVAVIGAAGGIGQSLSLLLLRELPFGSTLSLYDVAGAPGVAADLSHIDRAGITVKYAAGKLPPVPRDPALTELAEGVDVFVIVAGVPRKPGMTRDDLFNVNAGIVMDLVLTCASVSPSACFCIVTNPVNSMVPIAAQTLRKIGVYNKNKLLGVSLLDGLRATRFINNARHPLVVPYVPVVGGHSDITIVPLYSQIPGPLPDESTLKEIRKRVQVAGTEVVKAKAGRGSATLSMAEAGARFTMHVVKALMGLDTPMVYAYVDTDGKHECPFLAIPVVLGKNGIERRLPIGPITTVEKEMLEEAVGVVKKNIEKAETFARSKL

SEQ ID NO: 45142 - DNA, 972 bp, Trypanosoma brucei
  CDS (1)..(972)
atggtcagcgttgccgtaattggagccgccggtggtattggccagtctctatcgctacttcttcttcgccaactgccgtacgggagcacgctctcgctgtacgacgtggcgggtgcccccggagtggccgccgatctctcacatgttgaccgcgccggcgtcaccgtcaaatatgctgctggaaagctccccccagtgaagcgggatcccgccctcgccgaacttgcgcgcggtgttgatgtttttgtcattgtcgccggtgtgccccgtaagcccggtatgtctcgtgacgacctcttcaacgtgaacgccggcatcattatggatcttgttctcacatgtggttcctcatcgccgcaggcatgtttctgcgtcgtgacgaaccccgtaaacagcaccgtgccgattgccgctgaggccttaaagaagcttggcatctacaacaagaacaaactcctgggcgtaactctgctggatgggctccgtgctacccgtttcatcaacaacgctcgccaccctcttgccgtcgcctccgtccccgttgttggtggccatagcgacgtaacgattgtcccactgttttctcaacttcctggtccactccctgaggagggggaactgacacagatccgcaagcgtgtgcaggtggcgggtacggaggtggtgaaggcaaaggcaggccgtggaagtgccaccttgtcgatggctgaggcaggtgcccgtttcgcgatgtttgttgtgaacgccatcacaggtcagtcttccccgatggtttatgcgtatgtggatacagatggcactcagaattgctcgttcctcgcaataccggtggttcttggcaagaatggcattgaaaagcgcctaccgataggtcccatgaatgctgtggagaaggaaatgcttaagcaatccatctccgttgtgaaggcgaacattgagaagggaatgaatttcgcgcgctcaaagttgtaa

SEQ ID NO: 45143 - protein, 323 aa, Trypanosoma brucei
MVSVAVIGAAGGIGQSLSLLLLRQLPYGSTLSLYDVAGAPGVAADLSHVDRAGVTVKYAAGKLPPVKRDPALAELARGVDVFVIVAGVPRKPGMSRDDLFNVNAGIIMDLVLTCGSSSPQACFCVVTNPVNSTVPIAAEALKKLGIYNKNKLLGVTLLDGLRATRFINNARHPLAVASVPVVGGHSDVTIVPLFSQLPGPLPEEGELTQIRKRVQVAGTEVVKAKAGRGSATLSMAEAGARFAMFVVNAITGQSSPMVYAYVDTDGTQNCSFLAIPVVLGKNGIEKRLPIGPMNAVEKEMLKQSISVVKANIEKGMNFARSKL

SEQ ID NO: 45144 - DNA, 1242 bp, Glycine max
  CDS (1)..(1242)
atggcagcggcaccagcagctaccttcactattggaaccaccggttccctaggccaaagaggaaactcgcttcctcaattaaagtcttctgggttgaaattcaactcccagaatcatttgaagagcttctgcggcctcaaggccatgtcatccgtgagatgtgagtcagaatcgtctttcttggttaacaaaactggtgctgctctgcgggcgtcttttgcatccaaggctcaaaaggaaaacgaccaaaacttcaactacaactcgcagcctcaggcttcgtacaaagttgcagttcttggtgctgctggagggataggtcagccactcgcgcttctcatcaagatgtcgcctctaatttccgacctccatctctatgatattgcgaatgtcaagggagttgctgctgatatcagtcactgcaacaccccctcacaagtcagggatttcactggagcttctgagttggcgaattgtttgaagagtgtgaatgttgttgtcatacccgccggtgttccaaggaagcctggcatgactcgtgatgaccttttcaacatcaatgccggcatagtcagggacttggtttctgctgttgcggataatagccctgatgcttttattcaaatcatcagtaaccctgtgaactccaccgtgcctattgccgcagaagttttgaaacagaagggtgtgtatgatcctaagaagctctttggtgttaccacactggatgttgtgagggcaaacacatttgttgctcagaggaagaaccttaagctgattgatgttgatgtccccgttgttggtgggcatgccgggattaccattcttcctctgttgtcaaagaccaagccctcagcgagtttcactgatgaagaaattgaggagttgactgtcaggattcaaaatgctggaactgaagttgttgaagcaaaggcaggtgcagggtctgctaccttgtcaatggcgtatgcagcagctagatttgttgaatcgtctcttcgtgcccttgatggagatggggatgtgtatgagtgctcatatgtggaatcagatttgactgaccttccattctttgcttcaagggtgaagcttggtaggaaaggagttgaggcattaattccatctgacctccaagggttgactgactatgagcagaaggctttggaatcacttaagccagaactcatggccagcatagagaaggggattgcttttgctcagaagcaagctgttgctgcttaa

SEQ ID NO: 45145 - protein, 413 aa, Glycine max
MAAAPAATFTIGTTGSLGQRGNSLPQLKSSGLKFNSQNHLKSFCGLKAMSSVRCESESSFLVNKTGAALRASFASKAQKENDQNFNYNSQPQASYKVAVLGAAGGIGQPLALLIKMSPLISDLHLYDIANVKGVAADISHCNTPSQVRDFTGASELANCLKSVNVVVIPAGVPRKPGMTRDDLFNINAGIVRDLVSAVADNSPDAFIQIISNPVNSTVPIAAEVLKQKGVYDPKKLFGVTTLDVVRANTFVAQRKNLKLIDVDVPVVGGHAGITILPLLSKTKPSASFTDEEIEELTVRIQNAGTEVVEAKAGAGSATLSMAYAAARFVESSLRALDGDGDVYECSYVESDLTDLPFFASRVKLGRKGVEALIPSDLQGLTDYEQKALESLKPELMASIEKGIAFAQKQAVAA

SEQ ID NO: 45146 - DNA, 1197 bp, Pisum sativum
  CDS (1)..(1197)
atggcaacagcagcatcagcagctactttttctattggaaccgcccaaacagggaggtcactttctccatcaaacccttttggtttcaaatccaattcccaggttaatttctctggcctcaaggccatgtcatctttctctggcaacgaaacttgtgctgctcttcgtgcaacttttgctcccaaagctgtaaaagaaaaccaaaaccgaaaccacatcttgcagccacaggcatcctacaaagtagcgcttctcggtgctgccggagggattggtcagccactggcacttctcatcaagatgtcgcctttggtatccgacctgcatctctatgatatcgcgaacgttaagggagttgctgctgatattagtcattgcaacactccttcaaaagttgcggatttcacaggagctgctgagttagccaattgtttgaaaggtgtggatgttgttgttatacctgctggtgttcctaggaaacccgggatgactcgtgatgatcttttcaacatcaatgccggtatagttagagacttggtctctgccgttgcagataattgccctggggcttttattcatattattagtaatccggtgaattctactgtgcctattgctgctgaaattctgaaacaaaaaggtgtctatgatcctaaaaagctctttggtgttagcacacttgatgttgtgagggcaaacacctttgttgctcagagaaagaacttgaggctgattgatgtagatgtccctgttgttggggggcatgctgggattaccattcttcctcttttgtcaaagacaaaaccctcggcgagtttcactgatgaagaaattgaggagctgactgtcaggattcaaaatgctggaactgaagttgttgaggcaaaagctggtgcagggtctgcaactttgtcaatggcttatgcagcagctagatttgttgaatcctctcttcgtgcgcttgacggagatgctgatgtgtacgagtgctcatatgtacagtcagatctgactgaccttccgttttttgcttcaagggtgaagattggtaggaaaggagtcgaggctttcattccaactgatctccaaggattgagtgagtacgagcagaaggctttggaagcactcaagccagaacttaaggccagtatcgagaagggggttgcttttgctcaaaagcaaactgttgtcgcttaa

SEQ ID NO: 45147 - protein, 398 aa, Pisum sativum
MATAASAATFSIGTAQTGRSLSPSNPFGFKSNSQVNFSGLKAMSSFSGNETCAALRATFAPKAVKENQNRNHILQPQASYKVALLGAAGGIGQPLALLIKMSPLVSDLHLYDIANVKGVAADISHCNTPSKVADFTGAAELANCLKGVDVVVIPAGVPRKPGMTRDDLFNINAGIVRDLVSAVADNCPGAFIHIISNPVNSTVPIAAEILKQKGVYDPKKLFGVSTLDVVRANTFVAQRKNLRLIDVDVPVVGGHAGITILPLLSKTKPSASFTDEEIEELTVRIQNAGTEVVEAKAGAGSATLSMAYAAARFVESSLRALDGDADVYECSYVQSDLTDLPFFASRVKIGRKGVEAFIPTDLQGLSEYEQKALEALKPELKASIEKGVAFAQKQTVVA

SEQ ID NO: 45148 - DNA, 1212 bp, Arabidopsis thaliana
  CDS (1)..(1212)
atggcaacagcaacatcagcttctctgttttcaactgtttcttcatcttactccaaagctagctccataccacattcaagactccaatctgtgaaatttaactcagtccctagcttcaccggtctcaaatcaacctctctcatctccggatctgattcctcttccttaaccaagactctccgcggttccgtaacgaatgcacaaacatctgacaagaagccttacggattcaaaatcaacgcttcgtacaaagtagctgttcttggtgctgctggtggtataggtcagcctttatcacttctcatcaagatgtctccgttagtctctacgcttcatctttacgatatcgccaatgttaaaggagttgctgctgatctaagtcattgtaacactccttctcaagttcgtgatttcactggtccttctgagttagctgattgtttgaaagatgttaacgttgttgtcatccctgctggtgtgccgaggaaacccggtatgactcgtgacgatcttttcaacatcaatgccaatattgtcaagactcttgttgaagctgttgctgagaattgccctaatgctttcattcatattattagtaacccggttaactctacggtacctattgctgctgaagtgttgaagaagaaaggtgtttatgatcctaagaagctgtttggtgtcactactttggatgttgtgagggctaacacttttgtttctcagaagaagaatcttaagcttattgatgttgatgttccggttattggtggacatgctggaatcaccattttgcctctcctctcgaagacaaaaccgtctgttaactttactgatgaagagatccaagagctcactgttaggattcagaacgctggtactgaggttgttgatgctaaggcaggtgcaggttcagctactttgtcaatggcttatgctgctgctagatttgtggagtcatctcttcgtgctcttgatggagacggagatgtctacgagtgctcgtttgtggagtcgactctgactgatcttcctttctttgcatcacgggttaagatagggaagaacggtcttgaagctgtgattgagtcagaccttcagggattgactgagtatgagcagaaagcactagaagctcttaaggtagaattgaaagctagcattgacaagggtgtcgcatttgcaaacaaaccagctgctgcagcagctaactag

SEQ ID NO: 45149 - protein, 403 aa, Arabidopsis thaliana
MATATSASLFSTVSSSYSKASSIPHSRLQSVKFNSVPSFTGLKSTSLISGSDSSSLTKTLRGSVTNAQTSDKKPYGFKINASYKVAVLGAAGGIGQPLSLLIKMSPLVSTLHLYDIANVKGVAADLSHCNTPSQVRDFTGPSELADCLKDVNVVVIPAGVPRKPGMTRDDLFNINANIVKTLVEAVAENCPNAFIHIISNPVNSTVPIAAEVLKKKGVYDPKKLFGVTTLDVVRANTFVSQKKNLKLIDVDVPVIGGHAGITILPLLSKTKPSVNFTDEEIQELTVRIQNAGTEVVDAKAGAGSATLSMAYAAARFVESSLRALDGDGDVYECSFVESTLTDLPFFASRVKIGKNGLEAVIESDLQGLTEYEQKALEALKVELKASIDKGVAFANKPAAAAAN

SEQ ID NO: 45150 - DNA, 951 bp, Piromyces sp
  CDS (1)..(951)
atggttaaggtcgctgttcttggtgctgctggtggtattggtcaaccactttctcttctccttaagtctcacccacaagttaccgaattaaatttatacgatatcgttaactctccaggtgttgctgctgatttatctcacatttgcactaaggctaaggttactggttacaagggtcaagaaaaccttgacgctgctcttgctggttgtgatattgttgttatcccagctggtattccacgtaagccaggtatgactcgtgacgatcttttcaacatcaatgccggtattgttaagggtcttgctgaaggtattgctaagaactgcccaaaggctttcgtttgcattatctctaacccagttaactctactgtcccaatctgtgccgaagtcttcaagaaggccggtacctacgacccaaagagactctttggtgttactcttcttgatatggttcgttcctctaccttcgtttctgaatgcaagggtaccagcccagctgatactaaggttactgttattggtggtcactctggtgttaccattgttccacttctttctcaagttaagggtttaaccttcactcaagaagaagttgaagctcttactcaccgtattcaattcggtggtgatgaagttgttaaggctaaggatggtgctggttctgccactctttccatggcttacgctgccgctcgtttcgtcgactctcttattgaaggtgccttcatgaagaagccagtcattgaatgtgcttacgtcgaatctccacttgctgttgatgatggttgctccttcttcgcttccgccattgaactcggtccatctggtgctgaaaagattctcccaattggtccactctctgaatacgaacaaggtctttacaaggcttgtgttgaacaacttaaggctaacattgccaagggtgtcaacttcgttaaccaagcttaa

SEQ ID NO: 45151 - protein, 316 aa, Piromyces sp
MVKVAVLGAAGGIGQPLSLLLKSHPQVTELNLYDIVNSPGVAADLSHICTKAKVTGYKGQENLDAALAGCDIVVIPAGIPRKPGMTRDDLFNINAGIVKGLAEGIAKNCPKAFVCIISNPVNSTVPICAEVFKKAGTYDPKRLFGVTLLDMVRSSTFVSECKGTSPADTKVTVIGGHSGVTIVPLLSQVKGLTFTQEEVEALTHRIQFGGDEVVKAKDGAGSATLSMAYAAARFVDSLIEGAFMKKPVIECAYVESPLAVDDGCSFFASAIELGPSGAEKILPIGPLSEYEQGLYKACVEQLKANIAKGVNFVNQA

SEQ ID NO: 45152 - DNA, 1068 bp, Chlamydomonas reinhardtii
  CDS (1)..(1068)
atgctgctcgcgaaccgtgttaacgccggtgccgcccgccgtgtgagcgggcgggccgctgctcccatcgcggtgcgtgcgggccgtcgctctcttgtgtgcgaggcgcgcaaggttgcgctgctcggcgctgccggtggcattggccagcctctggctctgctgctgaagatgaacaagtttgtgacggagctggcgctttacgatatcgcaaatgtcgtcggcgttgccgctgacctgagccactgcaacaccccggtgaaggttactggctacaccggccccgaggagctgggcgcctgcctgaagggtgctgatctcatcgttattccggctggcgtgccccgcaagcctggcatgacccgtgacgacctgttcaacaccaacgctggcatcgttaaggcgctggtggaggcggtcgccaagcacgctcccaacgccgtgctggagattatcaccaaccccgtcaactcgaccgtgcctatcgctgtggagaccctaaagctggcgggcgtgtatgaccccaagaaggttattggtgtgacctcgctggacattgtccgcgccaacacctttgtgtcggaggctaagggcctggacatgaaggacgtggacgtgccggtcattggtggccacgctggctccaccatcctgccgctgctgtctcagacgactccccccgtgaccttcactgaggctgagaagaaggccatgaccgacaagatcgccaacgccggcaccgtggtggtggaggccaaggctggcaagggctccgccaccttgtccatggcctacgccgccgcccgcatggctgagtcgacgctgctgggtctgaacggcgagcccaacatctacgagtgcgccttcgtgcagtcggacgttgttgcggactgccccttcttcgccagcaaggtgctgctgggccccaacggcgtggccaaggtgatgggcctgggcgagctggacgccttcgagcaggccgccatggccgccatgctgccgcagctcaagagcgagatccagaagggcctcgactttgtcaagagcccccccgcccccgcctcgtaa

SEQ ID NO: 45153 - protein, 355 aa, Chlamydomonas reinhardtii
MLLANRVNAGAARRVSGRAAAPIAVRAGRRSLVCEARKVALLGAAGGIGQPLALLLKMNKFVTELALYDIANVVGVAADLSHCNTPVKVTGYTGPEELGACLKGADLIVIPAGVPRKPGMTRDDLFNTNAGIVKALVEAVAKHAPNAVLEIITNPVNSTVPIAVETLKLAGVYDPKKVIGVTSLDIVRANTFVSEAKGLDMKDVDVPVIGGHAGSTILPLLSQTTPPVTFTEAEKKAMTDKIANAGTVVVEAKAGKGSATLSMAYAAARMAESTLLGLNGEPNIYECAFVQSDVVADCPFFASKVLLGPNGVAKVMGLGELDAFEQAAMAAMLPQLKSEIQKGLDFVKSPPAPAS

SEQ ID NO: 45154 - DNA, 939 bp, Actinobacillus succinogenes
  CDS (1)..(939): transl_table=11
atgaaagtaaccttattaggcgccagcggcggtatcggtcaacctctttcattgttgttaaaattacatcttccggcagaaagcgatttaagcttatacgatgttgcgccggtcacccccggtgtggcgaaagacatcagccatattccgacttcggttgaagtggaaggtttcggcggcgatgatccgtccgaggcattaaaaggggcggatatcgttttaatctgtgcgggtgtggcgcgtaagccgggtatgactcgtgcggatttgtttaatgttaacgccggtattatccagaatttagtggaaaaagttgcgcaagtttgcccgcaggcttgtgtttgcattatcactaatccggtgaactcgattattccgattgcggcggaagtgctgaaaaaagcgggcgtatacgataaacggaaattattcggtattactacgctggataccatccgttccgaaaaatttatcgtgcaagcgaaaaatattgaaatcaaccgtaacgatatttcagttatcggcggacattcaggtgtgacgattttacctttgttgtcacaaattccgcatgtggaatttaccgagcaggaattaaaagatttaactcaccgcatccaaaatgccggcaccgaagtggtagaagctaaagccggtgcgggttccgctacactttccatggcgtatgcggcaatgcgttttgtggtttccatggctcgcgcattaaacggcgaagtgattacggaatgcgcctatattgaaggcgacggtaaattcgcccgtttctttgcacaaccggttcgtttgggtaaaaacggcgtagaagaaattctgccgttaggtacattaagcgcatttgagcaacaagcgcttgaagcgatgttaccgaccttgcaaactgacattgataacggtgtgaaatttgttaccggcgaataa

SEQ ID NO: 45155 - protein, 312 aa, Actinobacillus succinogenes
MKVTLLGASGGIGQPLSLLLKLHLPAESDLSLYDVAPVTPGVAKDISHIPTSVEVEGFGGDDPSEALKGADIVLICAGVARKPGMTRADLFNVNAGIIQNLVEKVAQVCPQACVCIITNPVNSIIPIAAEVLKKAGVYDKRKLFGITTLDTIRSEKFIVQAKNIEINRNDISVIGGHSGVTILPLLSQIPHVEFTEQELKDLTHRIQNAGTEVVEAKAGAGSATLSMAYAAMRFVVSMARALNGEVITECAYIEGDGKFARFFAQPVRLGKNGVEEILPLGTLSAFEQQALEAMLPTLQTDIDNGVKFVTGE

SEQ ID NO: 45156 - DNA, 945 bp, Bacillus clausii
  CDS (1)..(945)
atggcaattaaacgaagaaaaatttctgtaatcggcagtggctttacaggagctaccactgcgcttatggttgcccaaaaagagctaggggatgttgttttattggacattccaaacatggaaggtcctacgaaaggaaaggcccttgatatgcttgaatcgacacctgtccaaggcgtcgattcaacgatcacgggtacctctagctacgaagatacgaaagattcggatgtcgttgtcattacggctggcattgcccgcaaaccgggaatgagccgtgatgatcttgtagccacaaatgcaaaaatcatgaagtctgtcacaaaagaagttgttaagtattcgcctaacagctacattatcgttttgaccaaccctgctgacgcgatgacgtatacggtttataaagaatcaggctttccgaaaaaccgtgtcatcggccagtctggcgttcttgacacagcacgtttccgcacgtttgtcgcccaagaactaaatgtatccgtagaggatgtcactggttttgtcttaggcggccatggagatgatatggttccgcttatccgttattcagcagcaggcggtgtgccgttaacaaaactgatcgctccagaacggattgaagaaattgttgaacgcacgcgcaaaggcggcggcgaaatcgttggcttattaggcaatggcagcgcctattacgcaccagctgcttcgcttacacaaatggtcgaagcgatcttgaaagacaaaaaacgcattatcccaacaattgcctacctcgaaggcgagtatgggcagcatgacctgtacttaggcgtaccgaccattcttggtggtgacggcattgagaaagtcattgagcttgacttgacagaggaagaaaaggcacaattggacaaatcagtacaatccgtgcgcaatgtaatggcagcattgccagcggagtaa

SEQ ID NO: 45157 - protein, 314 aa, Bacillus clausii
MAIKRRKISVIGSGFTGATTALMVAQKELGDVVLLDIPNMEGPTKGKALDMLESTPVQGVDSTITGTSSYEDTKDSDVVVITAGIARKPGMSRDDLVATNAKIMKSVTKEVVKYSPNSYIIVLTNPADAMTYTVYKESGFPKNRVIGQSGVLDTARFRTFVAQELNVSVEDVTGFVLGGHGDDMVPLIRYSAAGGVPLTKLIAPERIEEIVERTRKGGGEIVGLLGNGSAYYAPAASLTQMVEAILKDKKRIIPTIAYLEGEYGQHDLYLGVPTILGGDGIEKVIELDLTEEEKAQLDKSVQSVRNVMAALPAE

SEQ ID NO: 45158 - DNA, 1074 bp, Lycopersicon esculentum
  CDS (1)..(1074)
atgcagccatcaggtgcagaagttcaccaacgaatagccagaatttcagctcatctttacccttcaaatccccagatgggagatgggtctattttggaaagaacaaattgcagagcaaaaggtggagcagctggattcaaagttgctatactgggtgctgctggaggaattgggcagccacttgcaatgttgatgaagatgaatcctttagtctcagttcttcatctctatgatgttgttaatgctcctggtgttactgctgatattagccacatggacactggtgctgttgtgaggggttttctagggcaaagtgagcttgaaggtgcacttacaggaatggaccttgtgatcatacctgctggtattccaagaaaacctggaatgacaagagatgatctttttaagattaatgctggaattgtgaggaccctctgtgaaggaattgcaaagtgctgtcctaatgctattgtcaatttgattagtaatccagtgaactccacagttcctattgcagctgaagttttcaagaaagcaggcacttatgatccaaagaagcttcttggagttacctcacttgatgttgtgagagctaacacttttgtggcagaagtcttgggactagatcctagggaagtagaggttcctgtcgttggaggtcatgctggggtgacaattttgcctcttctctcacaggtcaagcctccttgctccttcacacacgaggaaacagaatatttgactaagcgcattcaagatggaggaacagaggttgttgaggcaaaaaaaggggctggatctgcaactctatctatggcatatgcagctgtaaaatttgcagatgtttgtctcaagggcttaagaggagatgccggtgtggtggcttgtgcttttgtagcttctcaggtcacagaactccctttctttgcctccaaagtacgacttggccgtactggagctgaagaagtctatcaacttggtcccctaaatgagtatgagaggattggactggagaaggccaagaaagagcttgctgagagcattcagaaaggaatttccttcatcaggaattag

SEQ ID NO: 45159 - protein, 357 aa, Lycopersicon esculentum
MQPSGAEVHQRIARISAHLYPSNPQMGDGSILERTNCRAKGGAAGFKVAILGAAGGIGQPLAMLMKMNPLVSVLHLYDVVNAPGVTADISHMDTGAVVRGFLGQSELEGALTGMDLVIIPAGIPRKPGMTRDDLFKINAGIVRTLCEGIAKCCPNAIVNLISNPVNSTVPIAAEVFKKAGTYDPKKLLGVTSLDVVRANTFVAEVLGLDPREVEVPVVGGHAGVTILPLLSQVKPPCSFTHEETEYLTKRIQDGGTEVVEAKKGAGSATLSMAYAAVKFADVCLKGLRGDAGVVACAFVASQVTELPFFASKVRLGRTGAEEVYQLGPLNEYERIGLEKAKKELAESIQKGISFIRN

SEQ ID NO: 45160 - DNA, 1041 bp, Lycopersicon esculentum
  CDS (1)..(1041): n means a or g or c or t/u, s means g or c
atgaggacctccatgttgaaatccatcgtccgccggagctccactgccggagcatcctatgtatctcgccgtggattcgcatcgggatccgcgccggagaggaaagttgcagttttgggggcagccggagggattggacagcctttatctcttctaatgaagcttaaccctttagtatccagcctttcactctacgatatcgccggtactcccggtgttgccgccgatgttagtcacatcaacaccagatctgaggttgccggttttgcaggagaagagcagctagggcaggcactggaaggagctgatgttgttatcattcctgctggtgtgccccgaaagcctggtatgacccgagatgatctgttcaacattaatgcgggtattgttaaatctctatgcacggccattgctaagtactgccccaatgctctggtcaatatgataagcaacccagtgaattccactgtccctattgctgctgaggtgtttaagaaagctggaacttatgatgaaaagaagctctttggagttaccatgcttgatgtggttagggccaagacattttatgctggaaaagctaaagtaaatgttgctgaggtcaatctcccagtagttggtggtcatgctggcataactatcctcccattattttctcaagccactccaaaggcaaatctatcatatgaggaaattgttgcactcacaaagcgaacccaagatggtgggacagaagttgtagaagccaaagctggaaagggttcanccaccctctcaatagcctatgctggggctatttttgccgatgcttgcttgaaggggttgaatggagttcccgatgttgttgaatgtgcttttgtgcagtccaatgtcaccgagcttcccttcttcgcatccaaggtaagacttgggaaaaatggagtggaggaagtcctagggttgggtccacttaacgactacgagaagcaaggacttgaggctcttaagccagagctgctctcctccattgaaaagggaatcaagtttgccaaagaaaactaa

SEQ ID NO: 45161 - protein, 346 aa, Lycopersicon esculentum
  Xaa in the position 256 is unknown
MRTSMLKSIVRRSSTAGASYVSRRGFASGSAPERKVAVLGAAGGIGQPLSLLMKLNPLVSSLSLYDIAGTPGVAADVSHINTRSEVAGFAGEEQLGQALEGADVVIIPAGVPRKPGMTRDDLFNINAGIVKSLCTAIAKYCPNALVNMISNPVNSTVPIAAEVFKKAGTYDEKKLFGVTMLDVVRAKTFYAGKAKVNVAEVNLPVVGGHAGITILPLFSQATPKANLSYEEIVALTKRTQDGGTEVVEAKAGKGSXTLSIAYAGAIFADACLKGLNGVPDVVECAFVQSNVTELPFFASKVRLGKNGVEEVLGLGPLNDYEKQGLEALKPELLSSIEKGIKFAKEN

SEQ ID NO: 45162 - DNA, 939 bp, Moritella japonica
  CDS (1)..(939): transl_table=11
atgaaagtcgctgtattaggtgctgctggtggtatcggtcaagctttagcccttcttttgaaaactcaactacctgcgggttctgaactgtcgctatatgatatcgcggcagtgacaccgggtgttgctgttgatttaagccatatccctacagacgttactattgctggttttgctggtacagatccaactgatgcacttgttggtgctgacgtggtacttatctctgcgggtgttgctcgtaaaccaggtatggaccgttcagatctattcaatatcaatgctggaattattaaaaacctagcaggtaaatgtgctgaagtatgtccaaacgcatgtatcggtattattactaacccagtaaacacaactgtgccaatcgctgctgaagtacttaagcaagcgggggtttacgacaagcgtaaactattcggtattactacgctggatgttattcgttctgaaacttttgtgagtgagctgaaaggtatttcacttgctgatgttgaagttcctgttatcggtggtcactcaggtgtcacaattctaccgctactttctcaagttaaaggtgttgaatttactgctgaagaaattgcgacgctaacgccacgtatccaaaatgcaggtactgaagttgttgaagctaaagcgggtggcggttctgcgacactttctatgggacaagcagcggcacgtttcggtctatctcttgtgcgcgcactacaaggtgaagaaggtatcgttgaatgtacttatgttgatggtggctctgagcacgcaacattcttcgcacaacctgtattattaggtaaaaatggcgttgaagaagtactagcgtacggtgagttaagcgaatttgaagctaacgcacgcgatgcaatgctagaagaactaaaagcgaacatcacgttaggtgaagaattcgttgctggttaa

SEQ ID NO: 45163 - protein, 312 aa, Moritella japonica
MKVAVLGAAGGIGQALALLLKTQLPAGSELSLYDIAAVTPGVAVDLSHIPTDVTIAGFAGTDPTDALVGADVVLISAGVARKPGMDRSDLFNINAGIIKNLAGKCAEVCPNACIGIITNPVNTTVPIAAEVLKQAGVYDKRKLFGITTLDVIRSETFVSELKGISLADVEVPVIGGHSGVTILPLLSQVKGVEFTAEEIATLTPRIQNAGTEVVEAKAGGGSATLSMGQAAARFGLSLVRALQGEEGIVECTYVDGGSEHATFFAQPVLLGKNGVEEVLAYGELSEFEANARDAMLEELKANITLGEEFVAG

SEQ ID NO: 45164 - DNA, 939 bp, Vibrio marinus
  CDS (1)..(939): transl_table=11
atgaaagtcgctgtattaggtgctgctggtggtatcggtcaagctttagccttacttttgaaaactcaactacctgcgggttctgatctgtcgctatatgatatcgcgccagttacaccgggtgttgctgttgatttaagccacatccctacagacgttactattgctggttttgctggtatggatccaacggatgcacttgttggtgctgacgtggtacttatctctgcgggtgttgctcgtaaaccaggtatggaccgttcagatctattcaatatcaatgctgggatcatcaaaaatctagcgggtaaatgtgctgaagtatgcccaaatgcatgtatcggtattattactaacccagtaaatacaactgtgccaatcgctgcagaagtacttaagcaagccggtgtttacgacaaacgtaaactattcggtattacaacgctggatgttatccgttctgaaactttcgtgagcgagcttaaaggcatttcacttgctgacgttgaagttccagttattggtggtcattcaggcgtaacaattctgccgctactttctcaagttaaaggcgttgaatttacagctgaagaaatcgcaacacttacaccacgcattcaaaacgcgggtactgaagttgttgaagcgaaagccggtggcggttctgcgacactttctatgggtcaagcagctgctcgtttcggtctatctcttgttcgcgcattacaaggtgaagaaggtatcgttgaatgtacttatgttgacggtggctctgagcacgcaacattcttcgcacaaccggtattattaggtaaaaacggcgttgaagaagtactcgcatatggcgagctaagcgagtttgaaaccaacgcacgcgatgcgatgttagaagaactaaaagcgaacatcacgttaggtgaagaattcgttgctggttaa

SEQ ID NO: 45165 - protein, 312 aa, Vibrio marinus
MKVAVLGAAGGIGQALALLLKTQLPAGSDLSLYDIAPVTPGVAVDLSHIPTDVTIAGFAGMDPTDALVGADVVLISAGVARKPGMDRSDLFNINAGIIKNLAGKCAEVCPNACIGIITNPVNTTVPIAAEVLKQAGVYDKRKLFGITTLDVIRSETFVSELKGISLADVEVPVIGGHSGVTILPLLSQVKGVEFTAEEIATLTPRIQNAGTEVVEAKAGGGSATLSMGQAAARFGLSLVRALQGEEGIVECTYVDGGSEHATFFAQPVLLGKNGVEEVLAYGELSEFETNARDAMLEELKANITLGEEFVAG

SEQ ID NO: 45166 - DNA, 1017 bp, Xenopus laevis
  CDS (1)..(1017)
atgttctctcgcatcgccagaccagctgctcatgggctcatccggggtctttccaccactgcacaggccaatgccagggtgacagtgcttggtgcttcaggaggaattgggcagccattatccctgctgcttaagaacagtccattgattagcaaccttgctttgtatgatattgcccacacaccaggtgtcgcagctgatctgagccacattgagactagagcaaaggttacaggttatcttggagcagaacagcttcctgaaagtctcaagagtgctgatgttgttgttattccagccggtgtgccaaggaaaccaggtatgacccgtgatgatctgtttaacactaatgcttccattgtggccaccctgactgatgcatgtgcaaagcattgcccagaagcaatgatctgtatcatttccaaccctgtaaattcaactatcccaatcacatcagaagtgtttaaaaaacatggtgtttacaaccccaaccgcatttttggtgtaaccacattggatattgttagagccaatacctttgttgctgagctcaagggcttggacccagcacgtgtgaatgtgcctgtgattggtggacatgctggcaaaacaattattcctcttatttctcagagcacaccaaaagtagagtttccccaagaccagctggaagtactgattggccgaattcaagaggctggtacagaggttgtcaaggctaaagcaggagcaggatcagccactctttccatggcatatgctggagcccgatttgtcttttccctcctggatgctatgaatggaaaggaaggtgtgattgagtgctcatttgtcaggtctgaggaaactgagagcccttacttctcaactcctctgctgctggggaaaaatggcattgagaagaatctgggactaggcaagctgactgcttatgaggagaaactggtttcagaagccatggcagaactaaaaggctccattaaaaagggtgaagaattcatcaagagccggaagtga

SEQ ID NO: 45167 - protein, 338 aa, Xenopus laevis
MFSRIARPAAHGLIRGLSTTAQANARVTVLGASGGIGQPLSLLLKNSPLISNLALYDIAHTPGVAADLSHIETRAKVTGYLGAEQLPESLKSADVVVIPAGVPRKPGMTRDDLFNTNASIVATLTDACAKHCPEAMICIISNPVNSTIPITSEVFKKHGVYNPNRIFGVTTLDIVRANTFVAELKGLDPARVNVPVIGGHAGKTIIPLISQSTPKVEFPQDQLEVLIGRIQEAGTEVVKAKAGAGSATLSMAYAGARFVFSLLDAMNGKEGVIECSFVRSEETESPYFSTPLLLGKNGIEKNLGLGKLTAYEEKLVSEAMAELKGSIKKGEEFIKSRK

SEQ ID NO: 45168 - DNA, 939 bp, Moritella sp
  CDS (1)..(939): transl_table=11
atgaaagtcgctgtattaggtgctgctggtggtatcggtcaagctttagcccttcttttgaaaactcaattacctgcgggttctgaactgtcgctatatgatatcgcgccagttacaccgggtgttgctgttgatttaagtcatatccctaccgacgttactattactggtttttcgggtacagatccaacggctgcactggttggtgctgacgtggtacttatctcggcgggtgttgctcgtaaaccaggtatggaccgttcagatctattcaatatcaatgctggcattatcaaaaatctagcgagtaaatgtgcggaagtatgcccaacggcatgtatcggtattattactaatccagttaacaccacggtgccaattgcggccgaagtacttaagcaagcgggcgtgtacgacaaacgtaaactattcggtatcacgactctggatgttattcgttctgagactttcgtcagtgcgcttaaaggcatttcacttgctgacgttgcagtaccggttatcggtggtcactcaggtgtaacaattctgccgctactttctcaagttaaaggtgttgaatttacggctgaagaaattgcgacactcacgacccgcattcaaaacgccggtactgaagtggttgaagctaaagcgggtggcggttctgcgacactttctatgggtcatgccgctgcacgtttcggtctctctctggtgcgcgcactacaaggagaaaaaggtattgttgagtgtacttatgttgacggtggctctgagcacgcgacattcttcgcccaaccggtattactcggtaaaaacggcgttgaagaagtactcgcatacggtgacttaagcgactttgaaaccaacgcacgcgatgcgatgttagaagaactaaaagcgaatatcaccttaggtgaagaattcgttgctggttaa

SEQ ID NO: 45169 - protein, 312 aa, Moritella sp
MKVAVLGAAGGIGQALALLLKTQLPAGSELSLYDIAPVTPGVAVDLSHIPTDVTITGFSGTDPTAALVGADVVLISAGVARKPGMDRSDLFNINAGIIKNLASKCAEVCPTACIGIITNPVNTTVPIAAEVLKQAGVYDKRKLFGITTLDVIRSETFVSALKGISLADVAVPVIGGHSGVTILPLLSQVKGVEFTAEEIATLTTRIQNAGTEVVEAKAGGGSATLSMGHAAARFGLSLVRALQGEKGIVECTYVDGGSEHATFFAQPVLLGKNGVEEVLAYGDLSDFETNARDAMLEELKANITLGEEFVAG

SEQ ID NO: 45170 - DNA, 936 bp, Shewanella sp
  CDS (1)..(936): transl_table=11
atgaaagttgctgtacttggtgccgctggtggtattggccaggctcttgccctattactcaaaacgcaattgccagccggttcaaaactatccctttatgatattgctcctgtaacacctggtgttgcggtcgatttaagccatatcccgacagcagtcgaagttaaaggctttgctggtcaagatccatctgctgcgctggaaggtgccgatgtggtgcttatttctgctggtgttgcacgtaagccgggcatggatcgttcagatctgtttaacatcaacgcaggtatcgtgagaaacctgatggagaaatgtgccgcaacttgtccaaaagctttgattggtattattactaacccagtcaacaccacagtcgctatcgccgctgaagtgttaaaagctgccggtgtttatgacaagaaccgtctattcggtataacgacactagacgttattcgttctgagacctttatcgccgaagcgaaaggactaaacgttgccgatgttaaagtcagtgttatcggtggccacagtggtgtgacgattcttccactactctctcaggtagaaggcgtaagctttaccgatgaagaagttgccgcaatgacgactcgtatccagaatgcgggtaccgaagtggttgaagctaaagccggtggcggcagcgcgacactttctatgggccaggctgcatgtcgcttcggtctatctttggttcgcggtcttcaaggtgaagagaatattgttgagtgtgcctatgtcgatggtggcagtgagcatgcagaattcttcgctcagccagttctactgggtaagaatggcgtagagaaagttctggcttacggtgacgtgagtgagttcgaagctaatgcccgtgatgctatgctagatacattgaaagcagatatcaccttaggcgttgatttcgttaagtaa

SEQ ID NO: 45171 - protein, 311 aa, Shewanella sp
MKVAVLGAAGGIGQALALLLKTQLPAGSKLSLYDIAPVTPGVAVDLSHIPTAVEVKGFAGQDPSAALEGADVVLISAGVARKPGMDRSDLFNINAGIVRNLMEKCAATCPKALIGIITNPVNTTVAIAAEVLKAAGVYDKNRLFGITTLDVIRSETFIAEAKGLNVADVKVSVIGGHSGVTILPLLSQVEGVSFTDEEVAAMTTRIQNAGTEVVEAKAGGGSATLSMGQAACRFGLSLVRGLQGEENIVECAYVDGGSEHAEFFAQPVLLGKNGVEKVLAYGDVSEFEANARDAMLDTLKADITLGVDFVK

SEQ ID NO: 45172 - DNA, 939 bp, Moritella sp
  CDS (1)..(939): transl_table=11
atgaaagtcgctgtattaggtgctgctggtggtatcggtcaagctttagcccttcttttgaaaactcaattacctgcgggttctgaactgtcgctatatgatatcgcgccagttacaccgggtgttgctgttgatttaagtcatatccctaccgacgttactattactggtttttcgggtacagatccaacggatgcactggttggtgctgacgtggtacttatctcggcgggtgttgctcgtaaaccgggtatggaccgttcagatctattcaatatcaatgctggcattatcaaaaatctagcgagtaaatgtgcggaagtatgcccaacggcatgtatcggtattattactaatccagttaataccacggtgccaattgcggccgaagtacttaagcaagcgggcgtgtacgacaaacgtaaactattcggtatcactactctggatgttattcgttctgagactttcgtcagtgcgcttaaaggcatttcacttgctgacgttgcagtacccgttatcggtggtcactccggtgcaacaattctgccgctactttctcaagttaaaggtgttgaatttacggctgaagaaattgcgacactcacgacccgcattcaaaacgccggtactgaagtggttgaagctaaagcgggtggcggttctgcgacactttctatgggtcatgccgctgcacgtttcggtctctctctggtgcgcgcactacaaggagaaaaaggtattgttgagtgtacttatgttgacggtggctctgagcacgcgacattcttcgcccaaccggtattactcggtaaaaacggtgttgaagaagtactcgcatacggtgacttaagtgagtttgaaaccaacgcacgcgatgctatgttagaagaactaaaagcgaatatcaccttaggtgaagaattcgttgctggttaa

SEQ ID NO: 45173 - protein, 312 aa, Moritella sp
MKVAVLGAAGGIGQALALLLKTQLPAGSELSLYDIAPVTPGVAVDLSHIPTDVTITGFSGTDPTDALVGADVVLISAGVARKPGMDRSDLFNINAGIIKNLASKCAEVCPTACIGIITNPVNTTVPIAAEVLKQAGVYDKRKLFGITTLDVIRSETFVSALKGISLADVAVPVIGGHSGATILPLLSQVKGVEFTAEEIATLTTRIQNAGTEVVEAKAGGGSATLSMGHAAARFGLSLVRALQGEKGIVECTYVDGGSEHATFFAQPVLLGKNGVEEVLAYGDLSEFETNARDAMLEELKANITLGEEFVAG

SEQ ID NO: 45174 - DNA, 939 bp, Moritella sp
  CDS (1)..(939): transl_table=11
atgaaagtcgctgtattaggtgctgctggtggtatcggtcaagctttagcccttcttttgaaaactcaattacctgcgggttctgaactgtcgctatatgatatcgcgccagttacaccgggtgttgctgttgatttaagtcatatccctaccgacgttactattactggttttgcgggtacagatccaacggatgcactggttggtgctgacgtggtacttatctcggcgggtgttgctcgtaaaccaggtatggaccgttcagatctattcaatatcaatgctggcattatcaaaaatctagcgagtaaatgtgcggaagtatgcccaacggcatgtatcggtattattactaatccagttaacaccacggtgccaattgcggccgaagtacttaagcaagcgggcgtgtacgacaaacgtaaactattcggtatcactactctggatgttattcgttctgagactttcgtcagtgcgcttaaaggcatttcacttgctgacgttgcagtaccggttatcggtggtcactcaggtgtaacaattctgccgctactttctcaagttaaaggtgttgaatttacggctgaagaaattgcgacactcacgacccgcattcaaaacgccggtactgaagtggttgaagctaaagcgggtggcggttctgcgacactttctatgggtcatgccgctgcacgtttcggtctctctctggtgcgcgcactacaaggagaaaaaggtattgttgagtgtacttatgttgacggtggctctgagcacgcgacattcttcgcccaaccggtattactcggtaaaaacggcgttgaagaagtactcgcatacggtgacttaagcgactttgaaaccaacgcacgcgatgctatgttagaagaactaaaagcgaatatcaccttaggtgaagaattcgttgctggttaa

SEQ ID NO: 45175 - protein, 312 aa, Moritella sp
MKVAVLGAAGGIGQALALLLKTQLPAGSELSLYDIAPVTPGVAVDLSHIPTDVTITGFAGTDPTDALVGADVVLISAGVARKPGMDRSDLFNINAGIIKNLASKCAEVCPTACIGIITNPVNTTVPIAAEVLKQAGVYDKRKLFGITTLDVIRSETFVSALKGISLADVAVPVIGGHSGVTILPLLSQVKGVEFTAEEIATLTTRIQNAGTEVVEAKAGGGSATLSMGHAAARFGLSLVRALQGEKGIVECTYVDGGSEHATFFAQPVLLGKNGVEEVLAYGDLSDFETNARDAMLEELKANITLGEEFVAG

SEQ ID NO: 45176 - DNA, 936 bp, Shewanella sp
  CDS (1)..(936): transl_table=11
atgaaagtttgtgtacttggtgccgctggcggtattggacaggcgctggccctgttactaaaaacacaattacctgttggttcaaaactatcactttatgatattgcaccggtaacacctggagttgcagtagacttaagtcatattcctactgacgttgaagttgaaggtttcgcaggtcaagatccaactgctgctctcgaaggcgctgatgtggtgttgatctcagccggtgttgcacgtaagccgggtatggatcgctctgatctattcaacatcaatgcaggcatcgtaagaaacctggttgaaaagtgcgcggcaacgtctcccaaggccttgattggcattattactaacccagtcaataccacggtcgctatcgctgcggaagtactaaagaaagccggtgtatacgataaaaaccgtttgttcgggatcacaacgttagatgtgcttcgttctgagacctttatcgccgaagctaagggtgtgaaggttgctgatgtcaaagttaatgtgatcggtggccatagcggcgtgactattttaccgctgttatcgcaagttgaaggcgtaagctttagcgaagaagaagctgcggcaatgaccaagcgtattcagaatgcgggtactgaagtcgtcgaagctaaagccggtggcggcagcgcaaccttgtctatgggtcaagcggcatgtcgtttcggcctatcattggttcgcggtctacaaggtgagtcaaatgtgattgagtgtgcttatatcgatggtggcagtgagcatgcagcattctttgctcaacctgtcttgcttggcaaaaatggcgtagagaaagtactgccttatggcaaactcagtgaatttgaagtcaatgcccgtgatgccatgctcgatactctgaaagcagatattaagttaggcgttgatttcgttaagtaa

SEQ ID NO: 45177 - protein, 311 aa, Shewanella sp
MKVCVLGAAGGIGQALALLLKTQLPVGSKLSLYDIAPVTPGVAVDLSHIPTDVEVEGFAGQDPTAALEGADVVLISAGVARKPGMDRSDLFNINAGIVRNLVEKCAATSPKALIGIITNPVNTTVAIAAEVLKKAGVYDKNRLFGITTLDVLRSETFIAEAKGVKVADVKVNVIGGHSGVTILPLLSQVEGVSFSEEEAAAMTKRIQNAGTEVVEAKAGGGSATLSMGQAACRFGLSLVRGLQGESNVIECAYIDGGSEHAAFFAQPVLLGKNGVEKVLPYGKLSEFEVNARDAMLDTLKADIKLGVDFVK

SEQ ID NO: 45178 - DNA, 939 bp, Moritella sp
  CDS (1)..(939): transl_table=11
atgaaagtcgctgtattaggtgctgctggcggtatcggtcaagctttagcccttcttttgaaaactcaattacctgctggttctgaactgtcgctatatgatattgcgccagttacaccgggtgttgctgttgatttaagtcatatccctacagacgttactattgctggctttgcgggtacagatccaacggatgcactgattggtgcagatgtggtgcttatctcggcgggtgttgctcgtaaaccgggtatggatcgttcagatttatttaatatcaatgcgggtattatcaaaaatctagcgagtaaatgtgcggaagtatgcccaacggcatgtatcggtattattactaatcccgtgaacaccacagtgccaattgcggccgaagtacttaagcaagcgggtgtgtacgacaaacgtaaactattcggtattaccacgctggatgttattcgttctgaaactttcgttagtgcgctgaaaggcattccacttgctgacgttacagtacccgttatcggtggtcactcaggtgtaacaattctgccgctactttctcaagttaaaggcgttgaatttacggctgaagaaatagcgacgctcacgccacgcattcaaaacgccggtaccgaagtggttgaagctaaagctggtggcggttctgcgacactttctatgggtcatgccgctgcacgtttcggtctctctctagtgcgcgcactacaaggtgaaaaaggtattgttgagtgtacttatgttgacggtggctctgagcacgcgaaattcttcgcccaaccggtattactcggtaaaaacggcgttgaagaagtactcgcatacggtgacttaagcgaatttgaaaccaaggcacgcgatgctatgttagaagaactaaaagcgaatatcaccttaggtgaagaattcgttgctggttaa

SEQ ID NO: 45179 - protein, 312 aa, Moritella sp
MKVAVLGAAGGIGQALALLLKTQLPAGSELSLYDIAPVTPGVAVDLSHIPTDVTIAGFAGTDPTDALIGADVVLISAGVARKPGMDRSDLFNINAGIIKNLASKCAEVCPTACIGIITNPVNTTVPIAAEVLKQAGVYDKRKLFGITTLDVIRSETFVSALKGIPLADVTVPVIGGHSGVTILPLLSQVKGVEFTAEEIATLTPRIQNAGTEVVEAKAGGGSATLSMGHAAARFGLSLVRALQGEKGIVECTYVDGGSEHAKFFAQPVLLGKNGVEEVLAYGDLSEFETKARDAMLEELKANITLGEEFVAG

SEQ ID NO: 45180 - DNA, 939 bp, Moritella sp
  CDS (1)..(939): transl_table=11
atgaaagtcgctgtattaggtgctgctggtggtatcggtcaagctttagcccttcttttgaaaactcaattacctgcgggttctgaactgtcgctatatgatatcgcgccagttacaccgggtgttgctgttgatttaagtcatatccctacagacgttactattactggttttgcgggtacagatccaacggatgcactagttggtgctgacgtggtacttatctcggcgggtgttgctcgtaaaccaggtatggaccgttcagatctattcaatatcaatgctggcattatcaaaaatctagcgagtaaatgtgcggaagtatgcccaacggcatgtatcggtattattactaatccagttaacacgacggtgccaattgcggccgaagtacttaagcaagcgggtgtgtacgacaaacgtaaactattcggtatcactactctggatgttattcgttctgagactttcgtcagtgcgcttaaaggcatttcacttgctgacgttgcagtacccgttatcggtggtcactccggtgcaacaattctgccgctactttctcaagttaaaggtgttgaatttacggctgaagaaattgcgacactcacgacccgcattcaaaacgccggtactgaagtggttgaagctaaagcgggtggcggttctgcgacactttctatgggtcatgccgctgcacgtttcggtctctctctggtgcgcgcactacaaggagaaaaaggtattgttgagtgtacttatgttgacggtggctctgagcacgcgacatccttcgcccaaccggtattactcggtaaaaacggcgttgaagaagtactcgcatacggtgacttaagcgaatttgaaaccaacgcacgcgatgctatgttagaagaactaaaagcgaatatcaccttaggtaaagaattcgttgctggttaa

SEQ ID NO: 45181 - protein, 312 aa, Moritella sp
MKVAVLGAAGGIGQALALLLKTQLPAGSELSLYDIAPVTPGVAVDLSHIPTDVTITGFAGTDPTDALVGADVVLISAGVARKPGMDRSDLFNINAGIIKNLASKCAEVCPTACIGIITNPVNTTVPIAAEVLKQAGVYDKRKLFGITTLDVIRSETFVSALKGISLADVAVPVIGGHSGATILPLLSQVKGVEFTAEEIATLTTRIQNAGTEVVEAKAGGGSATLSMGHAAARFGLSLVRALQGEKGIVECTYVDGGSEHATSFAQPVLLGKNGVEEVLAYGDLSEFETNARDAMLEELKANITLGKEFVAG

SEQ ID NO: 45182 - DNA, 939 bp, Moritella sp
  CDS (1)..(939): transl_table=11
atgaaagtcgctgtattaggtgctgctggtggtatcggtcaagctttagcccttcttttgaaaactcaattacctgcgggttctgaactgtcgctatatgatatcgcgccagttacaccgggtgttgctgttgatttaagtcatatccctacagacgttactattactggttttgcgggtacagatccaacggatgcactagttggtgctgacgtggtacttatctcggcgggtgttgctcgtaaaccaggtatggaccgttcagatctattcaatatcaatgctggcattatcaaaaatctagcgagtaaatgtgcggaagtatgcccaacggcatgtatcggtattattactaatccagttaacacgacggtgccaattgcggccgaagtacttaagcaagcgggtgtgtacgacaaacgtaaactattcggtatcactactctggatgttattcgttctgagactttcgtcagtgcgcttaaaggcatttcacttgctgacgttgcagtacccgttatcggtggtcactccggtgcaacaattctgccgctactttctcaagttaaaggtgttgaatttacggctgaagaaattgcgacactcacgacccgcattcaaaacgccggtactgaagtggttgaagctaaagcgggtggcggttctgcgacactttctatgggtcatgccgctgcacgtttcggtctctctctggtgcgcgcactacaaggagaaaaaggtattgttgagtgtacttatgttgacggtggctctgagcacgcgacattcttcgcccaaccggtattactcggtaaaaacggcgttgaagaagtactcgcatacggtgacttaagcgaatttgaaaccaacgcacgcgatgctatgttagaagaactaaaagcgaatatcaccttaggtgaagaattcgttgctggttaa

SEQ ID NO: 45183 - protein, 312 aa, Moritella sp
MKVAVLGAAGGIGQALALLLKTQLPAGSELSLYDIAPVTPGVAVDLSHIPTDVTITGFAGTDPTDALVGADVVLISAGVARKPGMDRSDLFNINAGIIKNLASKCAEVCPTACIGIITNPVNTTVPIAAEVLKQAGVYDKRKLFGITTLDVIRSETFVSALKGISLADVAVPVIGGHSGATILPLLSQVKGVEFTAEEIATLTTRIQNAGTEVVEAKAGGGSATLSMGHAAARFGLSLVRALQGEKGIVECTYVDGGSEHATFFAQPVLLGKNGVEEVLAYGDLSEFETNARDAMLEELKANITLGEEFVAG

SEQ ID NO: 45184 - DNA, 951 bp, Toxoplasma gondii
  CDS (1)..(951)
atgtctcgaagaaaaatcggcctcatcggcggcggcaacatcggcgccacgcttgcccttctctccgctgtcaaggaactcggcgacgtcgtcatgttcgacgtcgtccaggacctcccgcaaggaaaatgcctcgatctgtaccagttgactccgatctctggagttgacgttcgcttcgagggctcgaacgactacagcgtcctcaaggatgcggatgtcatcatcgtcactgcaggggtgcctcggaagccaggtatgtctcgcgacgacctgctggcgattaacgcgaaaatcatgggccaagttggagaagccatcaagcagtactgccccaacgcattcgtcatttgcatcacgaatccactcgatgtgatggtctacatcctccgcgaaaaatgcggcttgcctccccacaaagtttgcggcatggccggcgtcctcgactcagctcggcttcgcacgtttctctcggagcgtctcaacgtctccgtcgatgacatccacgccctcgtcatgggtggccatggagacaccatggtgcccctccctcgattcaccactgtgggaggcatccccctgcctgagctggtgaagatgggtatgatttctcaacaagaagtcgacgatatcgtccaacgcactcgcaatggaggtggagaaatcgtctcattgctgaagacgggctctgctttcttcgctcccgcggctgcgggcgtcttgatggccgaggcgtacctgaaggaccgcaaacgcgtgctgccttgtgccgcctatttgaacggagagtacggtgtcaaggacatgtatgtgggcgtgccgtgcgtgatcggcgcgggcggcgtcgagaagattgtcgaattggacttgacgcctgaggagaagaagatgttcgagcgctcggttgaaagtgtgaagacgcttctcgccgctgctccaaagtcagcctga

SEQ ID NO: 45185 - protein, 316 aa, Toxoplasma gondii
MSRRKIGLIGGGNIGATLALLSAVKELGDVVMFDVVQDLPQGKCLDLYQLTPISGVDVRFEGSNDYSVLKDADVIIVTAGVPRKPGMSRDDLLAINAKIMGQVGEAIKQYCPNAFVICITNPLDVMVYILREKCGLPPHKVCGMAGVLDSARLRTFLSERLNVSVDDIHALVMGGHGDTMVPLPRFTTVGGIPLPELVKMGMISQQEVDDIVQRTRNGGGEIVSLLKTGSAFFAPAAAGVLMAEAYLKDRKRVLPCAAYLNGEYGVKDMYVGVPCVIGAGGVEKIVELDLTPEEKKMFERSVESVKTLLAAAPKSA

SEQ ID NO: 45186 - DNA, 1017 bp, Homo sapiens
  CDS (1)..(1017)
atgctctccgccctcgtccggcctgtcagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtga

SEQ ID NO: 45187 - protein, 338 aa, Homo sapiens [sequence omitted]

SEQ ID NO: 45188 - DNA, 1017 bp, Xenopus laevis
  CDS (1)..(1017)
atgttctctcgcatcgccagaccagctgctcatgggctcatccggggtctttccaccactgcacaggccaatgccagggtggcggtgcttggtgcttcaggaggaattgggcagccattatccctgctgctaaagaacagtcctttgattagcaaccttgctttgtatgatattgcccacacaccaggtgtagcagctgatctgagccatattgagacccgagcaaaggttacaggttatcttggagcagagcaacttccagaaagtctcaaaggtgccgatgttgttgttataccagctggtgtgccaaggaaaccaggaatgacccgtgatgacctgtttaatactaatgcctccattgtggccaccctaactgaagcttgtgcaaaacattgcccagaagccatgatctgtatcattgctaaccctgtaaattctaccatcccaatcacatcagaagtgtttaaaaaacatggtgtttacaaccccaaccgcatttttggtgtgaccacattggatattgtaagagccaatacctttgttgctgagcttaagggcttagacccagcacgtgtgaatgtgcccgtgattggtgggcatgctggcaaaacaattattccccttatttctcagagcacaccaaaagtagagtttccccaagaccagctggcagtactgattggccgaattcaagaggctggtacagaggttgtcaaggctaaagcaggagcaggatcagccactctttccatggcatatgctggagcccgatttgtcttctcactcctggatgctatgaatggaaaggagggtgtaattgagtgctcatttgtcaggtctgaggaaactgagagcccatacttctcaactccactgctgctggggaaaaatggcatagagaagaatctgggactaggcaagctgactgcttatgaagagaaactgatttcagaagccatggcagagctaaaaggctccattaaaaagggtgaagaattcatcaagaatcggaagtga

SEQ ID NO: 45189 - protein, 338 aa, Xenopus laevis
MFSRIARPAAHGLIRGLSTTAQANARVAVLGASGGIGQPLSLLLKNSPLISNLALYDIAHTPGVAADLSHIETRAKVTGYLGAEQLPESLKGADVVVIPAGVPRKPGMTRDDLFNTNASIVATLTEACAKHCPEAMICIIANPVNSTIPITSEVFKKHGVYNPNRIFGVTTLDIVRANTFVAELKGLDPARVNVPVIGGHAGKTIIPLISQSTPKVEFPQDQLAVLIGRIQEAGTEVVKAKAGAGSATLSMAYAGARFVFSLLDAMNGKEGVIECSFVRSEETESPYFSTPLLLGKNGIEKNLGLGKLTAYEEKLISEAMAELKGSIKKGEEFIKNRK

SEQ ID NO: 45190 - DNA, 1005 bp, Saccharomyces cerevisiae
  CDS (1)..(1005)
atgttgtcaagagtagctaaacgtgcgttttcctctacagttgccaacccttataaagtgactgttttgggtgcaggcggtggtattggacaaccattgtctttgcttctaaagcttaaccataaagtcacggacttaagactgtacgacctaaagggcgcaaaaggtgttgccaccgatttgtctcatattccaacaaactccgtggtcaaggggtttactccagaagagccagacggattgaacaacgctttaaaggacacagacatggttttaattcctgctggtgtgcccagaaagcctggtatgacacgtgatgacttgttcgccatcaacgcaagcatcgttcgcgatttggcagcagcaaccgccgaatccgctcccaatgctgccattctggtcatttccaacccagtcaattctaccgttccaattgtcgcccaagtcttgaaaaacaagggtgtttacaacccaaagaaattgttcggtgtgactaccttggactctattagagccgccagattcatctcagaagtcgagaacaccgatccaactcaggaaagggttaacgtcatcggtggacattctggtattaccatcatcccattgatttcgcaaacaaaccataagttgatgtctgatgacaagagacacgagttgattcacagaatacagtttggtggtgacgaagtcgtcaaagcaaagaatggtgctggctctgctacgttgtcaatggcccatgctggtgctaaattcgctaacgctgttttgtccggtttcaaaggcgaaagagacgtcatcgagccttccttcgtggactctcccttgttcaaatccgaaggcatcgaattctttgcatctccggtcactttgggcccagatggtattgaaaagatccatccaataggtgagttattttcagaagaagaagaaatgttacaaaaatgtaaagaaactttgaagaagaatatcgaaaagggtgtcaactttgttgctagtaaatag

SEQ ID NO: 45191 - protein, 334 aa, Saccharomyces cerevisiae
MLSRVAKRAFSSTVANPYKVTVLGAGGGIGQPLSLLLKLNHKVTDLRLYDLKGAKGVATDLSHIPTNSVVKGFTPEEPDGLNNALKDTDMVLIPAGVPRKPGMTRDDLFAINASIVRDLAAATAESAPNAAILVISNPVNSTVPIVAQVLKNKGVYNPKKLFGVTTLDSIRAARFISEVENTDPTQERVNVIGGHSGITIIPLISQTNHKLMSDDKRHELIHRIQFGGDEVVKAKNGAGSATLSMAHAGAKFANAVLSGFKGERDVIEPSFVDSPLFKSEGIEFFASPVTLGPDGIEKIHPIGELFSEEEEMLQKCKETLKKNIEKGVNFVASK

SEQ ID NO: 45192 - DNA, 951 bp, Cryptosporidium parvum
  CDS (1)..(951)
atgagaaagaaaatttcaattattggagctggacaaattggctcaactatagcacttcttttaggacaaaaagatttaggagatgtttatatgtttgatattattgagggagttccacaaggaaaagctttagatttgaatcactgcatggcattgattgggtcaccagcgaaaatatttggtgaaaataactatgagtatttacaaaactctgatgtcgtcataataacagctggagttcctagaaaaccaaatatgacacgttcagatttacttactgttaatgcaaagattgttggttcagttgcagaaaatgtcggtaaatactgccctaatgcatttgtaatatgtattactaatcctctagatgcgatggtttactactttaaagaaaagagtggaataccagctaataaagtttgtggtatgtcaggtgtgcttgattccgctaggttcagatgtaatttaagtcgagcattaggtgtaaagccatctgatgtatcagccattgttgtaggtggccatggagatgagatgataccattaactagttcagttacaattggtggaattctgcttagtgattttgttgagcaaggaaaaattactcattcacaaatcaatgaaattattaagaagacagcatttggtggcggtgaaattgttgaacttttaaaaactggctcagcattctatgctccagccgcttcagctgtagctatggctcaagcttatttgaaagattctaaatcagtattagtttgttcaacatatcttactggccagtataatgttaacaatctttttgtcggtgttcctgttgttattggaaaaaatggtattgaagacgttgttattgtaaatttatctgatgacgaaaaatcattattttctaaatcagttgaatctattcaaaaccttgtccaagacttaaaaagccttaatctttaa

SEQ ID NO: 45193 - protein, 316 aa, Cryptosporidium parvum
MRKKISIIGAGQIGSTIALLLGQKDLGDVYMFDIIEGVPQGKALDLNHCMALIGSPAKIFGENNYEYLQNSDVVIITAGVPRKPNMTRSDLLTVNAKIVGSVAENVGKYCPNAFVICITNPLDAMVYYFKEKSGIPANKVCGMSGVLDSARFRCNLSRALGVKPSDVSAIVVGGHGDEMIPLTSSVTIGGILLSDFVEQGKITHSQINEIIKKTAFGGGEIVELLKTGSAFYAPAASAVAMAQAYLKDSKSVLVCSTYLTGQYNVNNLFVGVPVVIGKNGIEDVVIVNLSDDEKSLFSKSVESIQNLVQDLKSLNL

SEQ ID NO: 45194 - DNA, 1023 bp, Branchiostoma belcheri tsingtaunese
  CDS (1)..(1023)
atgttttccaggctagctcgcccccaaaacctcgccgccctggcaggggcactgaggaacttctctaccaccacagcatgtaacaacaaagttgcagtgctcggtgcctctggtggaatcggccaaccgctgagcctcttgctgaagcacaatgcagccatcacccagttggctctgtacgatatcgcacacacgcccggcgtggcctgcgatctcagccacatcgagaccgggtcagaggtcaagggttacctgggagatgcggagctgggggcgtgtctggaaggatgcgacgttgtggtgattcctgctggagtccccaggaagcctggtatgaccagagatgacctgttcaacaccaatgcctccatcgtacgagacctggtgaaggcctgtacccagcactgtcctactgccttcctcctcctcgtcactaaccctgtaaactccacagtgcccatcgcctccgaggtgtgcaaggctgctggtacctacgaccccggcagggtcattggggtcacgaccttggatgtggtcagagctaacacctttgtggctaacctgaagggtctgaacccagcagaggttaatgttccagtggtcggaggtcatgctggcaagaccatcatccctctcatttcacaggctactccatctgtggagtttgatccagagacactggacaacctgaccaagagaatccaggatgccggcactgaggtcgtcaatgctaaggctggagctgggtcagctacactgtccatggcatatgctggggccaggtttaccaactcactccttgctgcattgaatgggaaggaaggagtgattgaatgtggtttcatcaagtcctcggagactgagtcttcctacttctccactcctcttctcctcgggaaaaatggcattgagaagaatctgggtctggggaagctgagcgactttgagacgaagctggtggaagacgccatggatgaactcaagggttccatcgctaagggagagaaatttgcctcacaataa

SEQ ID NO: 45195 - protein, 340 aa, Branchiostoma belcheri tsingtaunese
MFSRLARPQNLAALAGALRNFSTTTACNNKVAVLGASGGIGQPLSLLLKHNAAITQLALYDIAHTPGVACDLSHIETGSEVKGYLGDAELGACLEGCDVVVIPAGVPRKPGMTRDDLFNTNASIVRDLVKACTQHCPTAFLLLVTNPVNSTVPIASEVCKAAGTYDPGRVIGVTTLDVVRANTFVANLKGLNPAEVNVPVVGGHAGKTIIPLISQATPSVEFDPETLDNLTKRIQDAGTEVVNAKAGAGSATLSMAYAGARFTNSLLAALNGKEGVIECGFIKSSETESSYFSTPLLLGKNGIEKNLGLGKLSDFETKLVEDAMDELKGSIAKGEKFASQ

SEQ ID NO: 45196 - DNA, 1017 bp, Echinococcus granulosus
  CDS (1)..(1017)
atgaattgtctgcgcaagattggctttgtcttgggacgctcagctaaactcttttccacctccacccaaaatccacagaagatcgcgattttgggtgcaagtggcggcattggccaaccactggcactcctcatgaaacaatccctattcgtttcggaaatagccctctacgatatcgcgaatgcagcaggagttgctgcggatctgagtcacatagagactcgtgctaaggtgactggtcacaccggacccgacaacctgaaggcggcgctggacggtgcgaaggtggtaatcattcctgcgggtgtgcctcgaaagcctggcatgactcgggatgacctcttttcgatgaatgcatcggttgtggcggatctttccagagcctgtgggaagtactgttctgatgcgatgatttgcatcatcacgaacccggtgaacagcacggtgccgatagcggcggagatactgaagaaagagggtttgtacaacccgaggagactgttcggtgtcactactctggacatcacccgatcgaataccttcatcgctgaggcgaagggtttggacgtttcgaaggtgtcctgtcccgtcatcggtggtcattcaggcaacactatagtcccagtactctcccaatgtactccatctgtaaacttcgctcagaaagcacgtgaggaattggtggctcgaatacaaaacgcaggcactgaagtggtcaatgcgaaggctggcgcgggatcggcaaccctgtcaatggcctatgcgggggcacttttcgccaactccctgttgcatgcaatgaaggggcacgcggacatagtggagtgcgcgttcgtggagtgtgatgtggcggagacggagttctttgcctcacctgtactccttgggccgaacggtgtggagaaggtgtttggtgctggcaagctgaatgagtatgagattgagttggtgaagaaggcaatgccagaactgaagaagagcatccagaaaggcaaggagtttgcagccgcctactag

SEQ ID NO: 45197 - protein, 338 aa, Echinococcus granulosus
MNCLRKIGFVLGRSAKLFSTSTQNPQKIAILGASGGIGQPLALLMKQSLFVSEIALYDIANAAGVAADLSHIETRAKVTGHTGPDNLKAALDGAKVVIIPAGVPRKPGMTRDDLFSMNASVVADLSRACGKYCSDAMICIITNPVNSTVPIAAEILKKEGLYNPRRLFGVTTLDITRSNTFIAEAKGLDVSKVSCPVIGGHSGNTIVPVLSQCTPSVNFAQKAREELVARIQNAGTEVVNAKAGAGSATLSMAYAGALFANSLLHAMKGHADIVECAFVECDVAETEFFASPVLLGPNGVEKVFGAGKLNEYEIELVKKAMPELKKSIQKGKEFAAAY

SEQ ID NO: 45198 - DNA, 1023 bp, Paracoccidioides brasiliensis
  CDS (1)..(1023)
atgtttgccgcccgcagagctttcggctttgcccagcgacgggccttctccgtctctgcgccccagtcttccaaagtggccattctaggtgccgcaggtggtattgggcagtcattgtctctgctgatgaagctcagtcctcgtgtcactcagctggctctgtacgatatccggggtggcccaggtgttgccgccgatcttagccatatcaacaccaacagcactgttacgggctatgatcctaccccctccggtctccgggacgctctcaaggactctgaaattgtcctcattcctgctggtgtgcctcgcaagcctggcatgacccgtgacgatctttttaacaccaacgcttcaattgtccgtgacttggcaaaggctgctgccgatgcctctcctaacgccaacatcctcgtcatcgccaaccccgtcaactccaccgtcccaattgtcgcagaggtcttcaagtccaagaatgtctacaaccccaagcgccttttcggtgtcaccaccctggacgtcatccgtgcctcccgcttcatctcccaagtcaaaggcaccgatccaaaggatgagaaagtcaccgtcgttggcggccactccggcgtcaccatcgtacccctgatctcccaatccaaccaccctgacatctccggcgagaaactcgaaaccctcgtcaaccgcatccagttcggtggtgacgaagtcgtcaaggccaaggacggtgctggttccgccaccctctccatggccatggctggtgcccggttcgctgagagccttctgaaggcctcccagggtgagaagggagtcatcgagcccactttcgttgacagtcccctctacaaggaccagggcatcgacttcttcgcgtcccgtgtcgagcttggacccaatggtgtcgagaagatcctccccgtcggcaaggtctctgagtacgagcagaagctcctcgatgcctgcctcgttgatctgaagaagaacatcgccaagggtgtcgagttcgtcaagacgaacccatga

SEQ ID NO: 45199 - protein, 340 aa, Paracoccidioides brasiliensis
MFAARRAFGFAQRRAFSVSAPQSSKVAILGAAGGIGQSLSLLMKLSPRVTQLALYDIRGGPGVAADLSHINTNSTVTGYDPTPSGLRDALKDSEIVLIPAGVPRKPGMTRDDLFNTNASIVRDLAKAAADASPNANILVIANPVNSTVPIVAEVFKSKNVYNPKRLFGVTTLDVIRASRFISQVKGTDPKDEKVTVVGGHSGVTIVPLISQSNHPDISGEKLETLVNRIQFGGDEVVKAKDGAGSATLSMAMAGARFAESLLKASQGEKGVIEPTFVDSPLYKDQGIDFFASRVELGPNGVEKILPVGKVSEYEQKLLDACLVDLKKNIAKGVEFVKTNP

SEQ ID NO: 45200 - DNA, 960 bp, Francisella tularensis subsp
  CDS (1)..(960): transl_table=11
atggctagaaaaaaaataacacttgttggtgctggtaatattggtggtacactagctcacttagcacttataaaacaattaggtgatgtagtcctttttgatatagctcagggcatgcctaatggcaaagcacttgatttactacaaacttgccctatcgagggagttgattttaaagtcaggggtacaaatgattacaaagatttagaaaattctgatgttgttattgtaactgctggtgttccgagaaagcctggcatgtctcgtgatgacctacttggtattaatatcaaagtaatgcaaacagtcggagaaggtatcaaacataactgtcctaatgctttcgtaatatgtatcacaaatccactagatattatggtaaatatgttacaaaaattctcaggcgtaccagataacaaaatcgttggtatggctggtgttttagattctgctagatttagaacatttttagcagatgaactaaatgtatcagtacaacaagtacaagcatatgtaatgggcggtcatggcgatactatggtccctctaactaaaatgtcaaatgttgcaggtgtgtcgttagagcagctagttaaagaaggtaaacttaaacaagagcgtttagatgctatagtatcgagaactagaagtggtggtggcgaaattgttgctttacttaaaacaggttcagcatattatgcaccagctgctgcaggtattcaaatggctgaaagcttcttaaaagataaaaagatgattttaccttgtgctgcaaaagtaaaagctggtatgtatggccttgatgaagatctatttgttggtgtaccaactgagatttctgcaaatggtgtcagacctattgaagtagagatttctgataaagaaagagaacaattacaagtatctataaacgctgtaaaagatcttaataaagcagctgctgaaattttagcaaaataa

SEQ ID NO: 45201 - protein, 319 aa, Francisella tularensis subsp
MARKKITLVGAGNIGGTLAHLALIKQLGDVVLFDIAQGMPNGKALDLLQTCPIEGVDFKVRGTNDYKDLENSDVVIVTAGVPRKPGMSRDDLLGINIKVMQTVGEGIKHNCPNAFVICITNPLDIMVNMLQKFSGVPDNKIVGMAGVLDSARFRTFLADELNVSVQQVQAYVMGGHGDTMVPLTKMSNVAGVSLEQLVKEGKLKQERLDAIVSRTRSGGGEIVALLKTGSAYYAPAAAGIQMAESFLKDKKMILPCAAKVKAGMYGLDEDLFVGVPTEISANGVRPIEVEISDKEREQLQVSINAVKDLNKAAAEILAK

SEQ ID NO: 45202 - DNA, 1035 bp, Solanum tuberosum
  CDS (1)..(1035)
atgaggacatccatgttgagaactctggctcgcagaacctcaaccgccggaacacgccggggattcgcatcggagtctgctccggacaggaaagttgctattttaggtgcagctggagggatcgggcagccgctgtcacttctcatgaaactgaatcctttagtttccagacttgcactctacgatattgctggaactcctggtgttgccgctgatgtcagccacatcaacaccagatctgagattttgggttatgcaggagaagaacagctagggaaggctttggagggagctgatgttgtcattattccagctggtgtgccacgaaagcctggtatgacccgtgatgatctgttcaacattaacgctggtattgttaagtctctttgcacagctattgcaaagtattgccctcatgcacttgtcaatgtgatcagcaaccccgtgaattccactgtcccaattgcatctgaggtgttcaagaaggctggaacctatgatgagaagagactctttggagtgaccacacttgatgttgttagggcaaagactttctatgctggaaaagctaaagttaatgttgctgatgtcattgtccccgttgttggtggtcacgctggcgtaactatcctcccgttattttcccaagccactccaagtgcaaatttgtcaagtgaagaaattgaggcactcaccaagcgcacccaagatggtggcactgaagttgtggaggccaaggctggaaagggttcagccaccctctcgatggcctatgctggtgccatctttgcagattgcttgcttgaatgggacttgaatggggttccaggatgtttgtacagttgtcattcgtacagtcaacttgtgacagaacctgccatctctttgcatccaaggttgagattcgggaaaaatggcgtggaagaagtcttgggattaggcgcactttcagactacgagaaagaaggacttgaagctcttaaaccagagctgaaatcgtccattgagaaaggaatcaaatttgccaatgcctaa

SEQ ID NO: 45203 - protein, 344 aa, Solanum tuberosum
MRTSMLRTLARRTSTAGTRRGFASESAPDRKVAILGAAGGIGQPLSLLMKLNPLVSRLALYDIAGTPGVAADVSHINTRSEILGYAGEEQLGKALEGADVVIIPAGVPRKPGMTRDDLFNINAGIVKSLCTAIAKYCPHALVNVISNPVNSTVPIASEVFKKAGTYDEKRLFGVTTLDVVRAKTFYAGKAKVNVADVIVPVVGGHAGVTILPLFSQATPSANLSSEEIEALTKRTQDGGTEVVEAKAGKGSATLSMAYAGAIFADCLLEWDLNGVPGCLYSCHSYSQLVTEPAISLHPRLRFGKNGVEEVLGLGALSDYEKEGLEALKPELKSSIEKGIKFANA

SEQ ID NO: 45204 - DNA, 1041 bp, Solanum tuberosum
  CDS (1)..(1041)
atgaggacctccatgttgaaatccatcgtccgccggagctccactgccggagaatcctatgtatcccgccgtggattcgcatcgggatccgcaccagagaggaaagttgcagttttgggggcagccggagggattggacagcctttatctcttctaatgaagcttaaccctttagtatccagcctttcactctacgatatcgccggcactcccggtgttgccgccgatgttagtcacatcaacaccagatctgaggttgtcggttttgcaggagaagagcagctagggaaggctctggaaggagctgatatagttatcattcctgctggtgtgccccgaaagcctggtatgacccgagatgatctgttcaacattaatgcgggtattgttaaatctctttgcacggccattgctaagtactgccccaatgctctggtcaatatgataagcaacccagttaattccactgtcccaattgctgctgaggtgtttaagaaggctggaacttatgatgaaaagaagctctttggagttaccatgcttgatgtggttagggccaagacattttatgctggaaaagctaaagtaaatgttgctgaggtcaatcttccggtagttggtggtcatgctggcataactatcctcccattattttctcaagccactccaaaggcaaatctgtcaaatgaggaaattgttgcactcacaaagcgaacacaagatggtggcacagaagtcgtggaggccaaggctggaaagggttcagccaccctctcaatggcctatgctggggctatttttgccgatgcttgcttgaagggtttgaatggagttcccgatgttgttgaatgtgcttttgtgcagtccaatgttaccgagcttcccttctttgcatccaaggtgagacttgggaaaaatggagtggaggaagtcctagggttgggtccacttaacgagtatgagaagcaaggacttgaggctctgaagccagagctgctctcctccattgaaaagggaatcaagtttgccaaagagaactaa

SEQ ID NO: 45205 - protein, 346 aa, Solanum tuberosum
MRTSMLKSIVRRSSTAGESYVSRRGFASGSAPERKVAVLGAAGGIGQPLSLLMKLNPLVSSLSLYDIAGTPGVAADVSHINTRSEVVGFAGEEQLGKALEGADIVIIPAGVPRKPGMTRDDLFNINAGIVKSLCTAIAKYCPNALVNMISNPVNSTVPIAAEVFKKAGTYDEKKLFGVTMLDVVRAKTFYAGKAKVNVAEVNLPVVGGHAGITILPLFSQATPKANLSNEEIVALTKRTQDGGTEVVEAKAGKGSATLSMAYAGAIFADACLKGLNGVPDVVECAFVQSNVTELPFFASKVRLGKNGVEEVLGLGPLNEYEKQGLEALKPELLSSIEKGIKFAKEN

SEQ ID NO: 45206 - DNA, 1041 bp, Solanum tuberosum
  CDS (1)..(1041)
atgaggacctccatgttgaaatccatcgtccgccggagctccactgccggagcatcctatgtatcccgccgtggattcgcatcgggatccgcaccagagaggaaagttgcagttttgggggcagccggaggaattggacagcctttatctcttccaatgaagcttaaccctttagtatccagcctttcactctacgatatcgccggcactcccggtgttgccgccgatgttagtcacatcaacaccagatctgaggttgtcggttttgcaggagaagagcagctagggaaggctctggaaggagctgatatagttatcattcctgctggtgtgccccgaaagcctggtatgacccgagatgatctgttcaacattaatgcgggtattgttaaatctctttgcacggccattgctaagtactgccccaatgctctggtcaatatgataagcaacccagtgaattccactgtcccaattgctgctgaggtgtttaagaaggctggaacttatgatgaaaagaagctctttggagttaccatgcttgatgtggttagggccaagacattttatgctggaaaagctaaagtaaatgttgctgaggtcaatcttccggtagttggtggtcatgctggcataactatcctcccattattttctcaagccactccaaaggcaaatctgtcaaatgaggaaattgttgcactcacaaagcgaacacaagatggtggcacagaagtcgtggaggccaaggctggaaagggttcagccaccctctcaatggcctatgctggggctatttttgccgatgcttgcttgaagggtttgaatggagttcccgatgttgttgaatgtgcttttgtgcagtccaatgttaccgagcttcccttctttgcatccaaggtgagacttgggaaaaatggagtggaggaagtccttgggttgggtccacttaacgagtatgagaagcaaggacttgaggctctgaagccagagctgctctcctccattgaaaagggaatcaagtttgccaaagagaactaa

SEQ ID NO: 45207 - protein, 346 aa, Solanum tuberosum
MRTSMLKSIVRRSSTAGASYVSRRGFASGSAPERKVAVLGAAGGIGQPLSLPMKLNPLVSSLSLYDIAGTPGVAADVSHINTRSEVVGFAGEEQLGKALEGADIVIIPAGVPRKPGMTRDDLFNINAGIVKSLCTAIAKYCPNALVNMISNPVNSTVPIAAEVFKKAGTYDEKKLFGVTMLDVVRAKTFYAGKAKVNVAEVNLPVVGGHAGITILPLFSQATPKANLSNEEIVALTKRTQDGGTEVVEAKAGKGSATLSMAYAGAIFADACLKGLNGVPDVVECAFVQSNVTELPFFASKVRLGKNGVEEVLGLGPLNEYEKQGLEALKPELLSSIEKGIKFAKEN

SEQ ID NO: 45208 - DNA, 1026 bp, Arabidopsis thaliana
  CDS (1)..(1026)
atgttcagatctatgctcgtccgatcttctgcctccgcgaagcaggcggctatccgccgtagcttctcctccggttccgtccccgagcgtaaagtcgccatccttggtgccgccggtggaattggtcagcctcttgctctcctcatgaagcttaatcctcttgtctcttctctctccctctacgatatcgctaacactcccggagttgctgctgatgtcggtcacatcaacaccagatctgaggttgttggatacatgggcgatgataacttggccaaagctctagaaggagctgatctcgttatcattccagctggtgtgccaaggaagcctggtatgacccgtgacgatcttttcaacattaatgctggaattgtcaagaacctttgcactgccatcgccaagtactgcccacatgcgcttattaatatgatcagcaaccctgtgaactctactgttccaattgcagctgagatatttaagaaggctggtatgtacgatgaaaagaaattgtttggtgttaccactcttgacgtcgtcagggccaggactttctatgctggaaaggcaaatgtcccagttgcagaagttaatgttccggtgattggtggtcatgctggggttactattctccctctcttctctcaggcaactcctcaagccaacttgtcaagtgacatacttaccgcccttactaagcgtacccaagatggaggtacagaagtcgtggaggcaaaagcaggaaaaggttcagctacattgtccatggcctatgccggagcattgttcgctgatgcatgcttgaaaggactcaacggtgttccagatgtcatagaatgctcatacgtgcaatctacaatcaccgagcttcctttctttgcctcgaaggtgaggttggggaagaatggtgtggaggaggttcttgacttgggaccactctcagactttgagaaggaaggcttggaagcattgaagccagaactcaagtcctccatagaaaagggagtcaagtttgccaaccagtga

SEQ ID NO: 45209 - protein, 341 aa, Arabidopsis thaliana
MFRSMLVRSSASAKQAAIRRSFSSGSVPERKVAILGAAGGIGQPLALLMKLNPLVSSLSLYDIANTPGVAADVGHINTRSEVVGYMGDDNLAKALEGADLVIIPAGVPRKPGMTRDDLFNINAGIVKNLCTAIAKYCPHALINMISNPVNSTVPIAAEIFKKAGMYDEKKLFGVTTLDVVRARTFYAGKANVPVAEVNVPVIGGHAGVTILPLFSQATPQANLSSDILTALTKRTQDGGTEVVEAKAGKGSATLSMAYAGALFADACLKGLNGVPDVIECSYVQSTITELPFFASKVRLGKNGVEEVLDLGPLSDFEKEGLEALKPELKSSIEKGVKFANQ

SEQ ID NO: 45210 - DNA, 1020 bp, Talaromyces emersonii
  CDS (1)..(1020)
atgttcgctactcgccaggccttcaacctcttccagaagcgggctttctccgcctctgctcgccagtcctccaaggtcgccatccttggtgccgctggtggcattggccagcccctttctctcttgatgaagctcaaccctcgcgtcaccgagctcgctctctacgacatccgcggaggccctggtgtcgctgctgacctgagccacatcaacacgaacagcaccgtcactggctaccagcccactcctgagggccttcgtgatgctctcaagggctctgagatcgtcctcattcccgccggtgttcctcgcaagcgtggtatgacccgtgacgacctcttcaacaccaacgcttctattgtccgtgacctcgccaaggctgctgctgatgcctgccctaacgccaacatcctggtgatctccaaccctgtcaactccactgtccccattgtcgccgaggtcttcaagtccaagggtgtctacaaccccaagcgcctcttcggtgtcacgaccctggacgttgtccgtgcctcgcgcttcatctccgaggtcaagaacaccgacccggccaacgaggaggtgaccgttgttggtggccactccggtgtcaccattgttcctctgatctcccagtccaaccaccccgatattgagggcgagactcgcgacaagctggtcaaccgcattcaatttggtggtgacgagggtgtcaaagcaaaggacggtgctggttctgccgccctctccatggcgttcgccggtgcccgttcgccgagtctttgctcaagcggccagggcgtcaagggcgttgtcgagcccagctttgtcgacagccctctgtacaaggaccagggcattgacttcttcgcctcccgtgttgagcttggccctaacggtgccgagaaggtcttgccggttggcaaggtctccccatacgaggagaagctgctggaggctgcctttgcggacctcaagaagaacatccagaagggtatcgactttgtcaagaacaacccctaa

SEQ ID NO: 45211 - protein, 339 aa, Talaromyces emersonii
MFATRQAFNLFQKRAFSASARQSSKVAILGAAGGIGQPLSLLMKLNPRVTELALYDIRGGPGVAADLSHINTNSTVTGYQPTPEGLRDALKGSEIVLIPAGVPRKRGMTRDDLFNTNASIVRDLAKAAADACPNANILVISNPVNSTVPIVAEVFKSKGVYNPKRLFGVTTLDVVRASRFISEVKNTDPANEEVTVVGGHSGVTIVPLISQSNHPDIEGETRDKLVNRIQFGGDEGVKAKDGAGSAALSMAFAGARSPSLCSSGQGVKGVVEPSFVDSPLYKDQGIDFFASRVELGPNGAEKVLPVGKVSPYEEKLLEAAFADLKKNIQKGIDFVKNNP

SEQ ID NO: 45212 - DNA, 1020 bp, Talaromyces emersonii
  CDS (1)..(1020)
atgttcgctactcgccaggccttcaacctcttccagaagcgggctttctccgcctctgctcgccagtcctccaaggtcgccatccttggtgccgctggtggcattggccagcccctttctctcttgatgaagctcaaccctcgcgtcaccgagctcgctctctacgacatccgcggaggccctggtgtcgctgctgacctgagccacatcaacaccaacagcaccgtcactggctaccagcccactcctgagggccttcgtgatgctctcaagggctctgagatcgtcctcattcccgccggtgttcctcgcaagcgtggcatgacccgtgacgacctcttcaacaccaacgcttctattgtccgtgacctcgccaaggctgctgctgatgcctgccctaacgccaacatcctggtgatctccaaccctgtcaactccactgtccccattgtcgccgaggtcttcaagtccaagggtgtctacaaccccaagcgcctcttcggtgtcacgaccctggacgttgtccgtgcctcgcgcttcatctccgaggtcaagaacaccgacccggccaacgaggaggtgaccgttgttggtggccactccggtgtcaccattgttcctctgatctcccagtccaaccaccccgatattgagggcgagactcgcgacaagctggtcaaccgcattcaatttggtggtgacgagggtgtcaaagcaaaggacggtgctggttctgccgccctctccatggcgttcgccggtgcccgttcgccgagtctttgctcaagcggccagggggtcaagggggttgtcaagcccagctttgtcgacagccctctgtacaaggaccagggcattgacttcttcgcctcccgtgttgagcttggccctaacggtgccgagaaggtcttgccggttggcaaggtctccccatacgaggagaagctgctggaggctgcctttgcggacctcaagaagaacatccagaagggtatcgactttgtcaagaacaacccctaa

SEQ ID NO: 45213 - protein, 339 aa, Talaromyces emersonii
MFATRQAFNLFQKRAFSASARQSSKVAILGAAGGIGQPLSLLMKLNPRVTELALYDIRGGPGVAADLSHINTNSTVTGYQPTPEGLRDALKGSEIVLIPAGVPRKRGMTRDDLFNTNASIVRDLAKAAADACPNANILVISNPVNSTVPIVAEVFKSKGVYNPKRLFGVTTLDVVRASRFISEVKNTDPANEEVTVVGGHSGVTIVPLISQSNHPDIEGETRDKLVNRIQFGGDEGVKAKDGAGSAALSMAFAGARSPSLCSSGQGVKGVVKPSFVDSPLYKDQGIDFFASRVELGPNGAEKVLPVGKVSPYEEKLLEAAFADLKKNIQKGIDFVKNNP

SEQ ID NO: 45214 - DNA, 1014 bp, Sphyraena idiastes
  CDS (1)..(1014)
atgttttcccgtgccgtgagacctaccgttagcctcgtgcggacgttgtccacctcgtctcagaacaacgccaaggtggcggtgctcggagcgtcgggcggcataggccagccgctctctctgctactcaagaatagccccctggtgagtcacctctccctctatgatatcgcccacacccccggtgtggctgcagacctgagccacatcgagacaagggcccaggtgaccggccacatgggtcccgaccagctcgatgccgctctgcagggctgcgaggtcgtggtcatccccgccggtgtgcccaggaaacccggcatgacccgtgatgacctcttcaacaccaacgccaccatcgtagccaccttggccgatgcttgcgcccgcaactgccccgaggctatgatctgcatcatcgccaaccccgtcaactccaccatccctattacatcagaggtcatgaagaagcgtggcgtgtacaaccccaacaaattgtttggtgttacaaccttggacattgtcagagcgaacaccttcgtggcagagctcaaaggccttgacccagctcgcgtcagcgtaccagtcattgggggtcacgctggaaagaccatcatccccctcatctcccagtgcacacccaaggtagagttccccgccgaccagctgtctgccctgaccggcagaatccaggaggccggcacagaggtggtgaaggccaaggccggagccggatctgccaccctctccatggcttacgccggcgcccgcttcaccttctctgtcctggatgccatgaatggcaaggagggtgtggtggagtgcgcctatgtcaggtctgaggaaacagagtccaagtatttctccacacctctcctcctggggaagaacggcatcgagaagaaccttgggctgggcaagctgaccgccttcgaagagaagctggtgattgacgccatgggcgagctgaaggcttcaatcaagaaaggagaggattttgtggcgaacatgaagtga

SEQ ID NO: 45215 - protein, 337 aa, Sphyraena idiastes
MFSRAVRPTVSLVRTLSTSSQNNAKVAVLGASGGIGQPLSLLLKNSPLVSHLSLYDIAHTPGVAADLSHIETRAQVTGHMGPDQLDAALQGCEVVVIPAGVPRKPGMTRDDLFNTNATIVATLADACARNCPEAMICIIANPVNSTIPITSEVMKKRGVYNPNKLFGVTTLDIVRANTFVAELKGLDPARVSVPVIGGHAGKTIIPLISQCTPKVEFPADQLSALTGRIQEAGTEVVKAKAGAGSATLSMAYAGARFTFSVLDAMNGKEGVVECAYVRSEETESKYFSTPLLLGKNGIEKNLGLGKLTAFEEKLVIDAMGELKASIKKGEDFVANMK

SEQ ID NO: 45216 - DNA, 1065 bp, Arabidopsis thaliana
  CDS (1)..(1065)
atggagtttcgtggagatgccaaccagaggattgctaggatttcagctcatctcactcctcagatggaggccaagaactctgtaatcggacgggaaaactgcagagctaaaggtggtaatccaggattcaaagtagcaattcttggagctgcaggtggaattggacaatctttatctttgctgatgaagatgaaccctcttgtctctttacttcatctctacgatgttgtcaatgctcctggcgtcactgctgacgtcagtcatatggacactggagctgttgtccgcgggttcttgggagcgaagcagcttgaggacgcgctaacgggtatggatcttgtgatcataccagccggtataccgaggaaaccagggatgacccgcgatgatctgtttaaaatcaatgctgggattgttaaaacactatgtgaaggtgtagcaaaatgttgtcctaatgctattgtcaacttgatcagcaaccctgtgaactctactatccccattgccgctgaggttttcaagaaagctggaacttatgatcctaagaagctccttggagttactacactcgatgttgctcgtgccaacacatttgtggcagaagttcttggccttgatccaagagaagtcgatgtgccagtagttgggggacacgccggagtcacaatcttgccactactgtcacaggttaaacctcctagcagcttcacacctcaagaaattgagtacctgacaaaccggattcaaaatggtggaactgaagttgtggaggcaaaagctggagctggttctgcaacactttcaatggcatatgctgcagccaagtttgcagatgcttgccttcgcgggttaagaggagatgcgaatgtcgtagaatgctcttttgttgcttcacaggtgacagaattagctttctttgcaacaaaagtgcgccttggccgtacaggagcagaggaagtgtatcagcttggacccttaaacgaatacgaaaggattggtctggagaaagcaaaagatgaattagccggaagtattcagaaaggtgttgaattcatcagaaaatga

SEQ ID NO: 45217 - protein, 354 aa, Arabidopsis thaliana
MEFRGDANQRIARISAHLTPQMEAKNSVIGRENCRAKGGNPGFKVAILGAAGGIGQSLSLLMKMNPLVSLLHLYDVVNAPGVTADVSHMDTGAVVRGFLGAKQLEDALTGMDLVIIPAGIPRKPGMTRDDLFKINAGIVKTLCEGVAKCCPNAIVNLISNPVNSTIPIAAEVFKKAGTYDPKKLLGVTTLDVARANTFVAEVLGLDPREVDVPVVGGHAGVTILPLLSQVKPPSSFTPQEIEYLTNRIQNGGTEVVEAKAGAGSATLSMAYAAAKFADACLRGLRGDANVVECSFVASQVTELAFFATKVRLGRTGAEEVYQLGPLNEYERIGLEKAKDELAGSIQKGVEFIRK

SEQ ID NO: 45218 - DNA, 1029 bp, Nucella lapillus
  CDS (1)..(1029)
atgttgtctcgggttgctcgtccttcacggttactctgcgtcgtcagggaacagttttctccaaaacgaaacctgacgaaggaggcgcgcgtggcagtgttgggggcggcggggggcatagggcagcccctgtccctgttgctgaagcagatgcccatcgtgtcccacctcaacctctacgacatcgcgcacgtcatgggcgtggcctcggacctgagccacatcgagtcacgcgccaaggtgcaggggttcctgggcccagacaacctgcggccctgtctggacggcgccgacatcgtcctcatacctgccggcgtgcccaggaaaccaggcatgacccgggatgacctgttcaacaccaacgcggccatcgtgcgtgacctgacggcagctgtggcagagtcgtgccccaaagctatgttgggcatcatcaccaacccagtgaactcgacggcgccaatagcgtccgaggtgctgaagaagcatggagtgtacgatccacgccgcgcgtttggcgtgacaacgctggacgtggttcgatccaacactttcatcgccgaggccaaggggctggatgtgagcaagacgaacgtgccggtgatcgggggtcacagcggcatcaccatcatccccctcatctcccagtgcacgccccctgtgtccttccccccggaggagcgggtcaagctgtccatgcgtatccagaatgcaggcacagaggtggtggatgccaaggcgggggctgggtcggccactctgtccatggcattcgcagcagcagagttctgcaagagtctgattgaggcgctgaatggacaggagggcaaagtgcagtgcgcatacgtgcgatcggaggagaccgaggccaagtactttgccactcccgtcttgttgggcaaagagggcatcgagaagaacctgggcatgggcaagctgctggacgttgaggtgaacctgctgaaggcggccatgccagagctgatcgccaacatccagaagggcgagcagtttgtcggcgactccaagtaa

SEQ ID NO: 45219 - protein, 342 aa, Nucella lapillus
MLSRVARPSRLLCVVREQFSPKRNLTKEARVAVLGAAGGIGQPLSLLLKQMPIVSHLNLYDIAHVMGVASDLSHIESRAKVQGFLGPDNLRPCLDGADIVLIPAGVPRKPGMTRDDLFNTNAAIVRDLTAAVAESCPKAMLGIITNPVNSTAPIASEVLKKHGVYDPRRAFGVTTLDVVRSNTFIAEAKGLDVSKTNVPVIGGHSGITIIPLISQCTPPVSFPPEERVKLSMRIQNAGTEVVDAKAGAGSATLSMAFAAAEFCKSLIEALNGQEGKVQCAYVRSEETEAKYFATPVLLGKEGIEKNLGMGKLLDVEVNLLKAAMPELIANIQKGEQFVGDSK

SEQ ID NO: 45220 - DNA, 969 bp, Phytomonas sp
  CDS (1)..(969)
atggcccatgtgtgtgttgttggtgcggctggtggtattggccaggccctctctctccttctcacgcgctcgcttccttatgggagcacactatccctctacgatgttgtgggagcgccaggcgtggcggcagacctgtcgcacattgacaacgccggtgtaactgtgaagtttgccgctggcaagattggcgttacacgtgacccagcccttgcagctcttgccaccggcgttgacgtgttcgtgttcgttgcgggagttgcgcgcaagcctgggatgacacgcgacgatctcttcagcattaacgcaggtattgtcctggatcttgttatgacgtgtgcctcttccagccccaaggctatgttctgcgtggtcgcaaaccctgtgaacagcaccgtccccattgctgctgaggttctcaagaagcttggcgtgtacaataagaatcgtctgtttggtgttaccacgcttgatatgctacgtgcgacccgcttcattaacgaagcccgcatgccgttggttgtggatagggttccggttgtcggtgggcacagtggaaactctattgtgccgctgttccatcaactgcagggtccgctgccacctaaggagcagctggacaagattacgctgcgcgtgcagatgggaggcgacgaagtggtcaaggcaaaggccgggcgtggatctgcgacgcttgccatgggtgaggctggcgctcgcttcgtgctggatgttgtgaaggggttgactggtgcgagcaacccactcgtgtatgcgtacgtggacaccgatggccagagcgaatcagagtttcttgctattcctgtcatactcggcaagagcggtattgagcgccgcctaccgatcggtcctatggctgagtcggaaaaagagctcctggacaaggctattccaatggtcaaagagaacattgaaaggggtaagaaatttgcgctctctaagctctaa

SEQ ID NO: 45221 - protein, 322 aa, Phytomonas sp
MAHVCVVGAAGGIGQALSLLLTRSLPYGSTLSLYDVVGAPGVAADLSHIDNAGVTVKFAAGKIGVTRDPALAALATGVDVFVFVAGVARKPGMTRDDLFSINAGIVLDLVMTCASSSPKAMFCVVANPVNSTVPIAAEVLKKLGVYNKNRLFGVTTLDMLRATRFINEARMPLVVDRVPVVGGHSGNSIVPLFHQLQGPLPPKEQLDKITLRVQMGGDEVVKAKAGRGSATLAMGEAGARFVLDVVKGLTGASNPLVYAYVDTDGQSESEFLAIPVILGKSGIERRLPIGPMAESEKELLDKAIPMVKENIERGKKFALSKL

SEQ ID NO: 45222 - DNA, 969 bp, Phytomonas sp
  CDS (1)..(969)
atggcccatgtgtgtgttgttggtgcggctggtggtgttggccaggccctctctctccttctcacgcgctcgcttccttatgggagcacactatccctctacgatgttgtgggagcgccaggcgtggcggcagacctgtcgcacattgacaacgccggtgtaactgtgaagtttgccgctggcaagattggcgttacacgtgacccagcccttgcagctcttgccaccggcgttgacgtgttcgtgttcgttgcgggaggtccaatcatgcctgggatgaagcgcgacgatctttttaactctacggccggtattgtcctggatcttgttatgacgtgtgcctcttccagccccaaggctatgttctgcatgatctcgaaccctgtgaacagcaccgtccccattgctgctgaggttctcaagaagcttggcgtgtacaataagaatcgtctgctgggcgttacacggcttgatatgctacgtgcgacccgcttcattaacgaagcccgcatgccgttggttgtggatagggttccggttgtcggtgggcacagcgataactctattgtgccgctgttccatcaactgcagggtccgctgccacctaaggagcagctggacaagattacgctgcgcgtgcagtcggcagcctatgaggtaattgacgcaaagggcgggcgtggatctgcgacgcttgccatgggtgaggctggcgctcgcttcgtgctggatgttgtgaaggggttgactggtgcgagcaaccccctcgtgtatgcgtacgtggacaccgatggccagagcgaatcagagtttcttgctattcctgtcatactcggcaagagcggtattgagcgccgcctaccgatcggtcctatgactgagtcggaaaagaaactcgtagacgtggctatttctatcgtcaaaaagaacattgaaaagggtaaggaatttgcgctctctaagctctaa

SEQ ID NO: 45223 - protein, 322 aa, Phytomonas sp
MAHVCVVGAAGGVGQALSLLLTRSLPYGSTLSLYDVVGAPGVAADLSHIDNAGVTVKFAAGKIGVTRDPALAALATGVDVFVFVAGGPIMPGMKRDDLFNSTAGIVLDLVMTCASSSPKAMFCMISNPVNSTVPIAAEVLKKLGVYNKNRLLGVTRLDMLRATRFINEARMPLVVDRVPVVGGHSDNSIVPLFHQLQGPLPPKEQLDKITLRVQSAAYEVIDAKGGRGSATLAMGEAGARFVLDVVKGLTGASNPLVYAYVDTDGQSESEFLAIPVILGKSGIERRLPIGPMTESEKKLVDVAISIVKKNIEKGKEFALSKL

SEQ ID NO: 45224 - DNA, 1059 bp, Vitis vinifera
  CDS (1)..(1059)
atgaaggcttcgttgttcagatctgcagaaactgctctaaggagggtctcatccccctccgcatcttcgcatctactccgccgatcttactgcgtggaatccaagccagaacgcaaggtcgccgttcttggagccgccggcggcattggacagccccttgccctcctcatgaagctcaatcctcttgtctcctcgctctctctctacgatatcgctggtactcctggcgtggccgctgatgtcagccacatcaacactcgttcccaagtcgcggggtacatgggcgacgatcagctagggcaagccttggagggagcagatttggtgattattccagccggtgttccaagaaagcccggtatgactcgtgacgatctgttcaacatcaatgccggaattgtgaagtccttatgcactgccattgccaagtactgtcccaatgcattggttaatatgataagcaaccctgtgaactcgactgtgccaattgccgctgaggttttcaagaaggctggaacttatgatgagaagaagctgtttggtgtgactacactagatgtggttagggctaagaccttctatgctgggaaggccaaggtcccagttgctgaggccaatgtaccagttgttggtggtcatgcaggcataacgatccttccactcttttctcaagccacaccgaaatccaacaatttgtcagatgaagatattgtggctctaacaaaacgaacacaagatggaggaacagaggttgtggaagccaaggctggaaaaggatctgcaaccctctcaatggcatatgctggagcagtctttgcagatgcttgcttgaaggttcttaatggcgttccagatgtagttgaatgctcttttgttcaatcaaccattgttcctgatttgccttactttgcctctaaggtaaagcttggaaagaatggtgtggaagaggtccttgggttgggtcctttgtcggactatgagaaacaaggtcttgaaagcctcaaacatgagctcaaagcctcaattgagaagggaatcaaatttgccactcaaagttaa

SEQ ID NO: 45225 - protein, 352 aa, Vitis vinifera
MKASLFRSAETALRRVSSPSASSHLLRRSYCVESKPERKVAVLGAAGGIGQPLALLMKLNPLVSSLSLYDIAGTPGVAADVSHINTRSQVAGYMGDDQLGQALEGADLVIIPAGVPRKPGMTRDDLFNINAGIVKSLCTAIAKYCPNALVNMISNPVNSTVPIAAEVFKKAGTYDEKKLFGVTTLDVVRAKTFYAGKAKVPVAEANVPVVGGHAGITILPLFSQATPKSNNLSDEDIVALTKRTQDGGTEVVEAKAGKGSATLSMAYAGAVFADACLKVLNGVPDVVECSFVQSTIVPDLPYFASKVKLGKNGVEEVLGLGPLSDYEKQGLESLKHELKASIEKGIKFATQS

SEQ ID NO: 45226 - DNA, 1026 bp, Nucella lapillus
  CDS (1)..(1026)
atgttttcaagaattgctcgtccgtcacaaactctgtgcctattcaggcatcacttttcgacaagcagcaaggtcgggaaggatgtgaaggtggctgtgctgggggcggcggggggcatcggccagcccctgtccctgctgctgaaggagatcccgctcatctcccacctcaacctgtacgacatcgcccacacgcccggggtggccgctgacctcagccacatcgagacccgcgccaaggtggccggcttcctggggcctgaggagctggacaagtgcctggagggggccaacatcgtgctcatccccgccggcgtgcccagaaagccaggtatgacgagagatgatctgttcaacaccaacgcgggcatcgtgagagatctgacagaaagggtggcccacgtctgcccaacagccatgctgggaatcatcacaaaccctgtgaactcgacagtgcccattgcctcagaagtgctgaagaagcacggcgtgtacgacccgaagcgagtgtttggcgtcaccacactggatgtggtccggtccaacaccttcatcgcagaggccaaggctttggatgtgagcaagacaaacgtgccggtgatcggaggtcacagcggggtcaccattatccccctcatctcccagtgcactccccctgtctcctttcctgagaatgagcgcgagaagctgtcggtgcgaatccagaatgcaggcactgaagtggtggaggcgaaggccggggcgggctcagcaacgttgtccatggcctatgccgctgcccagttctgcaagagtctgatcgatgccctcaacggcaagaatgaagtggtgcagtgtgcctttgtcaggtcggatgtcacggacgccacctacttttccacccctctcttgctcgggaaaaacggggtggagaagaacctgggcatgggcaagctgttggactacgaggtgaacctgctgaaggccgccttgcctgagctgattgccaacatcaagaagggagaggagtttgtggctaagagctag

SEQ ID NO: 45227 - protein, 341 aa, Nucella lapillus
MFSRIARPSQTLCLFRHHFSTSSKVGKDVKVAVLGAAGGIGQPLSLLLKEIPLISHLNLYDIAHTPGVAADLSHIETRAKVAGFLGPEELDKCLEGANIVLIPAGVPRKPGMTRDDLFNTNAGIVRDLTERVAHVCPTAMLGIITNPVNSTVPIASEVLKKHGVYDPKRVFGVTTLDVVRSNTFIAEAKALDVSKTNVPVIGGHSGVTIIPLISQCTPPVSFPENEREKLSVRIQNAGTEVVEAKAGAGSATLSMAYAAAQFCKSLIDALNGKNEVVQCAFVRSDVTDATYFSTPLLLGKNGVEKNLGMGKLLDYEVNLLKAALPELIANIKKGEEFVAKS

SEQ ID NO: 45228 - DNA, 1038 bp, Glycine max
  CDS (1)..(1038)
atgatgaagccatcgatgctcagatctctccactccgccgccacccgcggcgcctctcatctcttccgccgtgggtacgcctccgagccggtgccggagcgcaaggtagccgttctcggcgccgccggcgggatcgggcagcctctctcccttctcatgaagctcaatcccctcgtttcgagcctctccctttacgatatcgccggaacccccggcgtcgccgccgatatcagccacataaacaccagatctgaggtagtggggtaccaaggtgatgaagagcttggaaaagctttggagggtgccgatgttgttataattcctgctggtgtgcccagaaagcctggaatgactcgtgatgatctttttaacatcaatgctggcattgtaaagacgctgtgtactgctattgctaagtattgcccccatgcccttgttaacatgataagcaatcctgtgaactccactgttcctattgctgctgaagttttcaagaaggcaggaacttatgatgagaagagattgtttggtgttaccacccttgatgttgttagggcaaaaactttctatgctgggaaagccaatgttccagttgctggtgttaatgtacctgttgtgggcggccatgcaggcattactattctgccactattttctcaagccacaccaaaagccaatcttgatgatgatgtcattaaggctcttacaaagaggacacaagatggaggaacagaagttgtagaagctaaggctggaaagggttctgcaactttgtcaatggcctatgctggtgccctttttgctgatgcttgcctcaagggcctcaatggagtcccagatgttgtcgagtgctctttcgtgcaatccactgttactgaacttcccttctttgcttccaaggtgaggcttgggacggttggtgtggaggaagttctgggcttggggcacctctcagattttgagcaacaaggcctcgaaagccttaagcctgaactcaaatcatcaattgagaagggaatcaaatttgccaaccagtaa

SEQ ID NO: 45229 - protein, 345 aa, Glycine max
MMKPSMLRSLHSAATRGASHLFRRGYASEPVPERKVAVLGAAGGIGQPLSLLMKLNPLVSSLSLYDIAGTPGVAADISHINTRSEVVGYQGDEELGKALEGADVVIIPAGVPRKPGMTRDDLFNINAGIVKTLCTAIAKYCPHALVNMISNPVNSTVPIAAEVFKKAGTYDEKRLFGVTTLDVVRAKTFYAGKANVPVAGVNVPVVGGHAGITILPLFSQATPKANLDDDVIKALTKRTQDGGTEVVEAKAGKGSATLSMAYAGALFADACLKGLNGVPDVVECSFVQSTVTELPFFASKVRLGTVGVEEVLGLGHLSDFEQQGLESLKPELKSSIEKGIKFANQ

SEQ ID NO: 45230 - DNA, 969 bp, Leishmania major
  CDS (1)..(969)
atggtgaacgtgtgcgttgttggtgctgccggcggcattggccagtcgctgtcgctgctgttggtgcgccagctgccgtacgggagcacgttgtcgctgttcgacgttgtgggcgctgcaggcgtcgcagcagacctgtcgcatgtggacaacgccggtgtgcaggtgaagtttgcggagggcaagatcggccataagcgcgaccctgcgctggcagagcttgcgaagggcgtggatgtgtttgtaatggtggctggcgttccacgcaagccgggcatgacgcgcgacgaccttttcaaaatcaacgccggaatcatcctggaccttgtgctgacgtgcgcgtcgtcgagtccaaaggcggtgttctgcattgtgacgaaccctgtgaacagcacggtcgcgatcgcggcagaggcgctgaagagccttggcgtatacgaccgaaaccggctgcttggcgtgtcgctgctggacgggctgcgcgcgacgtgcttcatcaacgaggcgcgcaagcccttagtcgtgtcgcaggtaccagttgttggcgggcacagcgacacaacgattgtgccgttgttctaccagctaccggggccgttgccggagcaggcgacgctggacaagatcgtgaagcgcgtgcaggtcgcaggcacagaagtggtgaaggcgaaggccgggcgcgggtctgcgacgctgtcgatggcggaggctggcgcgcggttcgcgttgaaggttgtggagggtctgaccggcacgggtaacccgctggtgtacgcatatgtagacacagacgggcagcacgagacgacgttcctcgcgatccctgtggtgcttggcatgaatggaatcgagaagcgcctgccgattggtccgctgcactcgacggaggaaacgctgctgaaggcggcactgccggtgatcaagaagaatatcgtgaagggcagcgagttcgcgcgctcacacctgtag

SEQ ID NO: 45231 - protein, 322 aa, Leishmania major
MVNVCVVGAAGGIGQSLSLLLVRQLPYGSTLSLFDVVGAAGVAADLSHVDNAGVQVKFAEGKIGHKRDPALAELAKGVDVFVMVAGVPRKPGMTRDDLFKINAGIILDLVLTCASSSPKAVFCIVTNPVNSTVAIAAEALKSLGVYDRNRLLGVSLLDGLRATCFINEARKPLVVSQVPVVGGHSDTTIVPLFYQLPGPLPEQATLDKIVKRVQVAGTEVVKAKAGRGSATLSMAEAGARFALKVVEGLTGTGNPLVYAYVDTDGQHETTFLAIPVVLGMNGIEKRLPIGPLHSTEETLLKAALPVIKKNIVKGSEFARSHL

SEQ ID NO: 45232 - DNA, 1239 bp, Nicotiana tabacum
  CDS (1)..(1239): transl_table=11
atggcagcaacatcagcaactactttctcagttggctcagccacatctcttggctgcaaaggaagctcagtatctcaatcaaaagcctttagtgtgaaattctactccaaaaacagccttaaaagtttcagcggtttgaaggctgccacagatgtaagctgtgaatcagaatcgtcctttttaggaaaagaaagtgttgctgtccttaaacaatcttttactccaaaggctcaaaaagaaaacaagggatatgggaactgtgttcagcctcaagcatcttacaaagtggctgttcttggagccagcggcggtataggccagccactgtctcttctggtcaagatgtcaccattagtttcagagctgaacctttatgatatagctaatgttaaaggagttgcggctgatctaagtcactgcaacactccctccaaggtttcagatttcactggagcttctgaattggccaactgtttgaaaggtgtaaatgtggtggtcatacctgctggtgttccgagaaagccaggtatgacacgtgatgatctgttcaacattaatgcaaacattgtgaagacattggtcgaggctgttgctgataattgccctgatgcgtttatccacatcattagcaatccagtcaactccacagtgccaattgcagcagaggtgttgaagcgaaagggtgtttatgatcctaaaaaactttttggtgttaccaccctagatgtagtcagggcaaacacatttgtcgcgcagaagaaaagtttgaggcttattgacgtagatgtcccagttgtgggtggccatgctggtatcaccattttgcctttgctatcaaagacaaaaccatccactactttcactgacgaagaagtacaggagctaactgtgaggattcaaaatgctggcacagaagttgtggaggcaaaggctggtgcagggtctgctacactttccatggcgtacgcagcagcaagatttgttgagtcctcactccgcgcacttgatggagatagtgatgtgtatgagtgtgcttttgtccagtctgacctaacagagcttccattctttgcttcaagggttaaactaggaaagaacggggttgaggctttgattccatctgaccttcaaggtttgactgagtatgaacagaaagctctggatgctttaaagccagaactgaaatctagcatcgagaagggtataggtttcgttcagaaggaacctgtagctgcttag

SEQ ID NO: 45233 - protein, 412 aa, Nicotiana tabacum
MAATSATTFSVGSATSLGCKGSSVSQSKAFSVKFYSKNSLKSFSGLKAATDVSCESESSFLGKESVAVLKQSFTPKAQKENKGYGNCVQPQASYKVAVLGASGGIGQPLSLLVKMSPLVSELNLYDIANVKGVAADLSHCNTPSKVSDFTGASELANCLKGVNVVVIPAGVPRKPGMTRDDLFNINANIVKTLVEAVADNCPDAFIHIISNPVNSTVPIAAEVLKRKGVYDPKKLFGVTTLDVVRANTFVAQKKSLRLIDVDVPVVGGHAGITILPLLSKTKPSTTFTDEEVQELTVRIQNAGTEVVEAKAGAGSATLSMAYAAARFVESSLRALDGDSDVYECAFVQSDLTELPFFASRVKLGKNGVEALIPSDLQGLTEYEQKALDALKPELKSSIEKGIGFVQKEPVAA

SEQ ID NO: 45234 - DNA, 1029 bp, Malassezia furfur
  CDS (1)..(1029)
atgtttgctcgtgccgccctgcgtaacagcgtccgcgccccggcttcggcccgctacttctcgcagactgcggctgcgaaccgcaaggttgccgtgctcggtgcctcgggcggtattggccagcccctctcgctcctgatgaagctcaaccccaaggttaccgagctccgcctgtacgacatccgcctcgctccgggtgttgctgcggatctctcgcacatcaacacccccgcggtgacttcgggctacgcccaggacgacctcgagggtgccgtcgacggtgcggagattgtgctgatccccgccggtatgccgcgcaagcccggcatgacccgtgacgacctgttcaactcgaacgcctcgattgtccgtgacctcgccaaggtcgtggctaaggtcgccccaaaggcttacatcggcgtcatctcgaaccccgtcaactcgacggtgccgatcgtcgctgaggtgttcaagaaggccggtgtgtacgaccccaagcgcctcttcggtgtgaccacgctcgacaccacgcgcgcggccaccttcctgtcgggcattgctggctcggacccgcagaccaccaacgtccccgtcattggtggccactcgggtgtgaccattgtgcccctgatctcgcaggccgcccagggtgacaaggtgcaggctggcgagcagtacgacaagcttgtgcaccgcatccagttcggtggtgacgaggtcgtcaaggccaaggacggtgccggctcggcgacgctctcgatggcctacgccgccgctgtcttcaccgagggcctgctcaagggtctcgacggtgaggcggtgacgcagtgcaccttcgtcgagagccccctgttcaaggaccaggtcgacttcttcgcctcgcccgtcgagttcggccccgagggtgtgaagaacatccctgctctgccgaagctcaccgccgaggagcagaagctgctcgacgcctgcctgcccgaccttgccaagaacatcaagaagggcgttgcgtgggccgccgagaacccgtaa

SEQ ID NO: 45235 - protein, 342 aa, Malassezia furfur
MFARAALRNSVRAPASARYFSQTAAANRKVAVLGASGGIGQPLSLLMKLNPKVTELRLYDIRLAPGVAADLSHINTPAVTSGYAQDDLEGAVDGAEIVLIPAGMPRKPGMTRDDLFNSNASIVRDLAKVVAKVAPKAYIGVISNPVNSTVPIVAEVFKKAGVYDPKRLFGVTTLDTTRAATFLSGIAGSDPQTTNVPVIGGHSGVTIVPLISQAAQGDKVQAGEQYDKLVHRIQFGGDEVVKAKDGAGSATLSMAYAAAVFTEGLLKGLDGEAVTQCTFVESPLFKDQVDFFASPVEFGPEGVKNIPALPKLTAEEQKLLDACLPDLAKNIKKGVAWAAENP

SEQ ID NO: 45236 - DNA, 1008 bp, Aquifex aeolicus
  CDS (1)..(1008): transl_table=11
atgagaatgaaaaaaaccgttgctgtaatcggtgcggggaacgtgggggagcacgtcgcctccctcatccttttaaaaaacctcgcaaacgttaaaatgttcgaccttcccagaaaaacggaagagaaagtttttgagccagttaaagggaaggccctcgacatgaagcagatgctcgcagctatggacatagatgcgagggtagagggctatactgtgacacctgagggcgaaggctacgaacccttagaaggttccgacatagtggtaattaccgcgggttttcccagaagaccgggaatgagcagagaggaccttcttgaggcaaacataaggataatctcggttatagcggacaggattaagaggtacgcaccagacgcaatagtaattgttgttacgaatcccgtggacgtcatgacctacgtagcctacaagctccttaactttcctaagaaccgcgtaatggggatggcgggagtgcttgattccgcgaggttcaaaacttttatttccgaagaactcatggtttctccgaaagacatccacgcttacgtgataggcgggcacggtgatgagatggttcctcttatttcaatttctaacgtgggaggaatacctttaaaggatttacttccaaaggaaaagcttgaaaagattatagaaagaacacgctttggtggcggtgagatagtaaacctcatgggaacttccgcttattacgctcctgcggcggcaattgtggacatgatagaggctctcgtccagaacagcaagaggatactcccctgcagtgtttaccttgacggagaagcaggtgagtactacggagttcagggcttttgcgtgggagttcccgtgaaacttggttctaacggggttgaagaaataataaaagtgcctatgatagaagaagaaagggaaatgtggagacgttccgtcgagtctgttaagaaaaccgttgaagttgcggagggtatactaagtgcgggaagttcacgtcaatga

SEQ ID NO: 45237 - protein, 335 aa, Aquifex aeolicus
MRMKKTVAVIGAGNVGEHVASLILLKNLANVKMFDLPRKTEEKVFEPVKGKALDMKQMLAAMDIDARVEGYTVTPEGEGYEPLEGSDIVVITAGFPRRPGMSREDLLEANIRIISVIADRIKRYAPDAIVIVVTNPVDVMTYVAYKLLNFPKNRVMGMAGVLDSARFKTFISEELMVSPKDIHAYVIGGHGDEMVPLISISNVGGIPLKDLLPKEKLEKIIERTRFGGGEIVNLMGTSAYYAPAAAIVDMIEALVQNSKRILPCSVYLDGEAGEYYGVQGFCVGVPVKLGSNGVEEIIKVPMIEEEREMWRRSVESVKKTVEVAEGILSAGSSRQ

SEQ ID NO: 45238 - DNA, 1005 bp, Aquifex aeolicus
  CDS (1)..(1005): transl_table=11
gtgaaagggaaattgataaactcatttcttatgaaaaagccaaaaattagtgtaataggtgcgggaaaggtaggggaaaatgtagcctacctcctcacgatcctcggcctcggagacgtttacctatttgcgaggtataaaaaaggtttagaacctgcgaaagctaaggctcttgatctaaaacaaatggctgttttaatggacatagatataaacgttaaagggatttcctacgacaaagagggttttgaagaactaaagggttcagacatcgtggtaattaccgcgggaatacctcgaagggaggggatgagcagggaggatttactctacgaaaacttaaaaatcttgaaaaagttcacggatgcgataaaggaatacgcgaaggattcaataattatagtggtttcaaatcctgtggatacgctcacttacgccaccataaagttgacgggatttgaaccgagaagggttatcggaatggccggagttctcgattccgcaaggtttaaaaacttcgtaaaggaaaagataggtatatcaaacgctgatataaggactctggttctgggaactcacggggatttaatggtgccagtaacctcgcacagctttataggagacaaaccgatagaggaagttttcagtgcaagcgagatagatgaactcatagaaaagaccagaaaaggtggagcgcagatagtatcccttatgggcacttctgcctactatgcacccgccgcctcggttgtgataatggttgagtctataatcaacgacaggaaaagggtaatgccttgctccgtttacgttgaaggggaagctgcaaagcactacgaaatagaaggagtgtgcataggactgcccgtagttctcggaaagaagggagttgaagactttgagcttgtaaacctgagcggttacgaaaagagagaacttctgcgttctgcaaaaactttaaaagaaatggtaagcttagcggataaactcctgaatgagctttaa

SEQ ID NO: 45239 - protein, 334 aa, Aquifex aeolicus
MKGKLINSFLMKKPKISVIGAGKVGENVAYLLTILGLGDVYLFARYKKGLEPAKAKALDLKQMAVLMDIDINVKGISYDKEGFEELKGSDIVVITAGIPRREGMSREDLLYENLKILKKFTDAIKEYAKDSIIIVVSNPVDTLTYATIKLTGFEPRRVIGMAGVLDSARFKNFVKEKIGISNADIRTLVLGTHGDLMVPVTSHSFIGDKPIEEVFSASEIDELIEKTRKGGAQIVSLMGTSAYYAPAASVVIMVESIINDRKRVMPCSVYVEGEAAKHYEIEGVCIGLPVVLGKKGVEDFELVNLSGYEKRELLRSAKTLKEMVSLADKLLNEL

SEQ ID NO: 45240 - DNA, 1065 bp, Arabidopsis thaliana
  CDS (1)..(1065)
atggagtttcgtggagatgccaaccagaggattgctaggatttcagctcatctcactcctcagatggaggccaagaactctgtaatcggacgggaaaactgcagagctaaaggtggtaatccaggattcaaagtagcaattcttggagctgcaggtggaattggacaatctttatctttgctgatgaagatgaaccctcttgtctctttacttcatctctacgatgttgtcaatgctcctggcgtcactgctgacgtcagtcatatggacactggagctgttgtccgcgggttcttgggagcgaagcagcttgaggacgcgctaacgggtatggatcttgtgatcataccagccggtataccgaggaaaccagggatgacccgcgatgatctgtttaaaatcaatgctgggattgttaaaacactatgtgaaggtgtagcaaaatgttgtcctaatgctattgtcaacttgatcagcaaccctgtgaactctactgtccccattgccgctgaggttttcaagaaagctggaacttatgatcctaagaagctccttggagttactacactcgatgttgctcgtgccaacacatttgtggcagaagttcttggccttgatccaagagaagtcgatgtgccagtagttgggggacacgccggagtcacaatcttgccactactgtcacaggttaaacctcctagcagcttcacacctcaagaaattgagtacctgacaaaccggattcaaaatggtggaactgaagttgtggaggcaaaagctggagctggttctgcaacactttcaatggcatatgctgcagccaagtttgcagatgcttgccttcgcgggttaagaggagatgcgaatgtcgtagaatgctcttttgttgcttcacaggtgacagaattagctttctttgcaacaaaagtgcgccttggccgtacaggagcagaggaagtgtatcagcttggacccttaaacgaatacgaaaggattggtctggagaaagcaaaagatgaattagccggaagtattcagaaaggtgttgaattcatcagaaaatga

SEQ ID NO: 45241 - protein, 354 aa, Arabidopsis thaliana
MEFRGDANQRIARISAHLTPQMEAKNSVIGRENCRAKGGNPGFKVAILGAAGGIGQSLSLLMKMNPLVSLLHLYDVVNAPGVTADVSHMDTGAVVRGFLGAKQLEDALTGMDLVIIPAGIPRKPGMTRDDLFKINAGIVKTLCEGVAKCCPNAIVNLISNPVNSTVPIAAEVFKKAGTYDPKKLLGVTTLDVARANTFVAEVLGLDPREVDVPVVGGHAGVTILPLLSQVKPPSSFTPQEIEYLTNRIQNGGTEVVEAKAGAGSATLSMAYAAAKFADACLRGLRGDANVVECSFVASQVTELAFFATKVRLGRTGAEEVYQLGPLNEYERIGLEKAKDELAGSIQKGVEFIRK

SEQ ID NO: 45242 - DNA, 1077 bp, Brassica napus
  CDS (1)..(1077)
atggagttccgtggagatgcctacaagaggattgctatgatatcagctcatcttcaaccttctttcactcctcagatggaggccaagaactctgtgatgggactagaaagctgcagagcgaaaggagggaatccaggattcaaagtagccattcttggagctgcaggtggaataggacaatcactatccttgttaatgaagatgaaccctctcgtctctttacttcatctctacgatgtcgtcaatgctcctggagtcactgctgacgttagccatatggacactggagccgttgttagaggattcttgggagccaagcaacttgaggacgccctaactggtatggatcttgtgatcataccagctggtgtgccgaggaaaccagggatgacacgtgatgatctttttaaaatcaacgctgggattgttaggacactatgtgaaggagtagctaaatgctgtcctaatgctattgttaacttgattagtaaccctgtgaactctactgttgctattgctgctgaggttttcaagaaagctggaacttatgatcctaagaagctccttggtgttactacactagatgttgctcgtgccaacacatttgtggctgaagttcttggccttgatccaagagaagtcgatgtaccagtcgttggaggacatgctggagtcacaatcttgccactattgtcacaggttaaacctcctagcagcttcacaccatcagagattgagtaccttacaaacaggattcaaaacggtggaactgaagttgtggaggcaaaagctggagctggatctgcaacactttcaatggcatatgctgcagccaagttcgcagatgcttgccttcgcgggttaagaggagatgcgaatgtcattgaatgctcttttgttgcttcacaggtgacagagttagctttctttgcaaccaaagtgcgtcttggacgtacaggagcagaggaagtgtttcagcttgggcccttgaacgaatacgaaagggttggtctggagaaagcaaaagaagaactagctggaagcattcagaaaggtgtcgacttcatcaggaaatga

SEQ ID NO: 45243 - protein, 358 aa, Brassica napus
MEFRGDAYKRIAMISAHLQPSFTPQMEAKNSVMGLESCRAKGGNPGFKVAILGAAGGIGQSLSLLMKMNPLVSLLHLYDVVNAPGVTADVSHMDTGAVVRGFLGAKQLEDALTGMDLVIIPAGVPRKPGMTRDDLFKINAGIVRTLCEGVAKCCPNAIVNLISNPVNSTVAIAAEVFKKAGTYDPKKLLGVTTLDVARANTFVAEVLGLDPREVDVPVVGGHAGVTILPLLSQVKPPSSFTPSEIEYLTNRIQNGGTEVVEAKAGAGSATLSMAYAAAKFADACLRGLRGDANVIECSFVASQVTELAFFATKVRLGRTGAEEVFQLGPLNEYERVGLEKAKEELAGSIQKGVDFIRK

SEQ ID NO: 45244 - DNA, 1071 bp, Citrullus lanatus
  CDS (1)..(1071)
atgcagccgattccggatgttaaccagcgcattgctcgaatctctgcgcatcttcatcctcccaagtctcagatggaggagagttcagctttgaggagggcgaattgccgggctaaaggcggagctcccgggttcaaagtcgcaatacttggcgctgccggtggcattggccagccccttgcgatgttgatgaagatgaatcctctggtttctgttctacatctatatgatgtagtcaatgcccctggtgtcaccgctgatattagccacatggacacgggtgctgtggtgcgtggattcttggggcagcagcagctggaggctgcgcttactggcatggatcttattatagtccctgcaggtgttcctcgaaaaccaggaatgacgagggatgatctgttcaaaataaacgcaggaattgtcaagactctgtgtgaagggattgcaaagtgttgtccaagagccattgtcaacctgatcagtaatcctgtgaactccaccgtgcccatcgcagctgaagttttcaagaaggctggaacttatgatccaaagcgacttctgggagttacaatgctcgacgtagtcagagccaatacctttgtggcagaagtattgggtcttgatcctcgggatgttgatgttccagttgttggcggtcatgctggtgtaaccattttgccccttctatctcaggtgaagcctccaagttctttcacacaagaagagattagttacctgactgataggattcaaaatggtggaacagaagttgtcgaggccaaagcaggagctggctcagcaactctctcaatggcttatgctgccgttaagtttgcagatgcatgcctcaggggcttaagaggagatgctggtgtcattgaatgcgcgtttgtgtcttctcaggtgactgaacttccattctttgcatcaaaagtacgacttggtcgcaatggtatcgaagaagtatactcccttggcccgctaaatgagtatgagaggattggattggagaaagcgaagaaagagttggcaggaagcattgagaagggagtttccttcatcagaagctga

SEQ ID NO: 45245 - protein, 356 aa, Citrullus lanatus
MQPIPDVNQRIARISAHLHPPKSQMEESSALRRANCRAKGGAPGFKVAILGAAGGIGQPLAMLMKMNPLVSVLHLYDVVNAPGVTADISHMDTGAVVRGFLGQQQLEAALTGMDLIIVPAGVPRKPGMTRDDLFKINAGIVKTLCEGIAKCCPRAIVNLISNPVNSTVPIAAEVFKKAGTYDPKRLLGVTMLDVVRANTFVAEVLGLDPRDVDVPVVGGHAGVTILPLLSQVKPPSSFTQEEISYLTDRIQNGGTEVVEAKAGAGSATLSMAYAAVKFADACLRGLRGDAGVIECAFVSSQVTELPFFASKVRLGRNGIEEVYSLGPLNEYERIGLEKAKKELAGSIEKGVSFIRS

SEQ ID NO: 45246 - DNA, 1071 bp, Cucumis sativus
  CDS (1)..(1071)
atgcagccgattcctgatgttaatcaacgcattgctcgaatctctgctcatcttcatcctcccaagtatcagatggaggagagttcagttttgaggagggcgaattgccgggccaaaggcggagctcccgggttcaaagtcgcaatacttggggctgccggtggcattggccagccacttgcgatgttaatgaagatgaatcctctggtttctgttctgcatctatatgatgtagtcaatgcccctggcgtcactgctgatattagccacatggacacgggtgctgtggtgcgtggattcttggggcagcagcagctagagcgtgcgcttactggcatggatcttgttgtaatccctgcgggcgttcctcggaaaccaggaatgacaagggatgatctattcaaaataaacgcaggaattgtcaagactctttgcgaagggattgcaaagtgttgtcctacagccattgtcaacctgatcagtaatcctgtgaactccaccgtgcccattgcagctgaagttttcaagaaagctggaacttatgatccaaagcgacttctaggagttacaatgcttgacgtcgtcagagccaatacctttgtggcagaagtattgggtcttgatcctcgggatgttaatgttccagttgttggcggtcatgctggtgtaaccattttaccccttctatctcaggtcaagcctccaagttctttcacacaagaagagattaattacctgactgataggattcaaaatggtggaacagaagttgttgaggccaaagcaggagctggttcagcaactctctcaatggcatatgctgccgttaagtttgcagatgcatgcctcaggggcttaagaggagatgctggtgttgttgaatgcgcgttcgtgtcttctcaggtgaccgaacttccattctttgcaacaaaagtacgacttggccgcaatggtatagatgaagtatactcccttggcccgctaaatgagtacgagaggattggattggagaaagcaaagaaagagttggcaggaagcattgagaaaggagtttccttcatcagaggctga

SEQ ID NO: 45247 - protein, 356 aa, Cucumis sativus
MQPIPDVNQRIARISAHLHPPKYQMEESSVLRRANCRAKGGAPGFKVAILGAAGGIGQPLAMLMKMNPLVSVLHLYDVVNAPGVTADISHMDTGAVVRGFLGQQQLERALTGMDLVVIPAGVPRKPGMTRDDLFKINAGIVKTLCEGIAKCCPTAIVNLISNPVNSTVPIAAEVFKKAGTYDPKRLLGVTMLDVVRANTFVAEVLGLDPRDVNVPVVGGHAGVTILPLLSQVKPPSSFTQEEINYLTDRIQNGGTEVVEAKAGAGSATLSMAYAAVKFADACLRGLRGDAGVVECAFVSSQVTELPFFATKVRLGRNGIDEVYSLGPLNEYERIGLEKAKKELAGSIEKGVSFIRG

SEQ ID NO: 45248 - DNA, 1071 bp, Oryza sativa
  CDS (1)..(1071)
atggaggacgcagcagcagcagcaaggcggatggagaggcttgcctcccacctccgcccgcccgcttctcagatggaggaatcacccctcctgaggggctccaattgccgggcaaaaggtgccgctccgggtttcaaggtcgccatcttgggagcgtctggtgggattggccagcctcttgcattgctcatgaagatgaaccctcttgtttctgtgctccatctgtacgatgttgtcaacactcccggtgtcacagctgacattagccacatgaacactggtgctgtggtgcgtggtttcttgggccagccacagttggaaaatgcccttactggaatggatcttgtgatcattcctgctggtgttcctcgtaagcctgggatgacaagggatgatttgttcaacatcaatgccggaatcgtccggactctttgtgaaggaatcgcaaaatgctgccccaatgcaattgtgaatgtgatcagcaaccctgtcaattctactgttccgattgctgctgaggtttttaagaaagctgggacatatgaccctaagcgccttttgggggtgacgacacttgatgtagtgagagccaatacttttgtggcagaagttcttgggcttgaccccagagatgtaaatgtccctgtcattggtgggcatgcaggagtaacaatattaccactcctttcacaggtgaatcctccctgctcattcacctcagaagaaattagttatcttaccactcgcatacagaatggtgggacagaagtagtcgaggctaaagctggagcggggtctgcaaccctttcaatggcgtatgcagcttctaaatttgcagatgcttgcttgagaggattgcgtggcgacgctgggatagtggagtgctcttttgtagcttctcaggtgacagagctgcctttctttgcatccaaagtgcggttaggtcgctgtggcatcgaggagatcttatcacttggtccattgaatgaattcgaaagagctggactggagaaggctaagaaggagctggccgagagtatccaaaagggggtcgctttcatcaacaagtga

SEQ ID NO: 45249 - protein, 356 aa, Oryza sativa
MEDAAAAARRMERLASHLRPPASQMEESPLLRGSNCRAKGAAPGFKVAILGASGGIGQPLALLMKMNPLVSVLHLYDVVNTPGVTADISHMNTGAVVRGFLGQPQLENALTGMDLVIIPAGVPRKPGMTRDDLFNINAGIVRTLCEGIAKCCPNAIVNVISNPVNSTVPIAAEVFKKAGTYDPKRLLGVTTLDVVRANTFVAEVLGLDPRDVNVPVIGGHAGVTILPLLSQVNPPCSFTSEEISYLTTRIQNGGTEVVEAKAGAGSATLSMAYAASKFADACLRGLRGDAGIVECSFVASQVTELPFFASKVRLGRCGIEEILSLGPLNEFERAGLEKAKKELAESIQKGVAFINK

SEQ ID NO: 45250 - DNA, 1077 bp, Brassica napus
  CDS (1)..(1077)
atggagtttcgtggagatgccaacaagaggattgctatgatatcagctcatcttcaaccttctttcactcctcagatggaggccaagaactctgtaatgggacgagaaaactgcagagcgaaaggagggaatccaggattcaaagtagctattcttggagcggcaggtggaataggacagtctctatccttgttaatgaagatgaaccctctcgtctctttacttcatctctacgatgttgtcaatgctcctggagtcactgctgatgttagccatatggacactggagctgttgttagaggattcttgggagccaagcaactcgaggacgccctaaccggtatggatcttgtgatcataccagctggtgtgccgaggaaaccagggatgacacgtgatgatctctttaaaatcaatgctgggattgttaagacactatgtgaaggagtagcgaaatgctgtcctaatgctatagttaacttgattagcaaccctgtgaactctactgtcgctattgctgctgaggttttcaagaaagctggaacttatgatcctaagaaactccttggagttactacacttgatgttgctcgtgccaacacatttgtggctgaagttcttggccttgatccaagagaagtcgatgtaccagtggttggaggacatgctggagtcacaatattgccactgttgtcacaggttaaacctccaagcagcttcacaccttcagagattgagtacctcacaaacaggattcaaaacggtggaactgaagttgtggaggcaaaagctggagctggatctgcaacactttcaatggcatatgctgcagccaagtttgcagatgcttgccttcgcgggttaagaggagatgcgaatgtcattgaatgctcttttgttgcttcacaggtgacagagttagcattctttgcaaccaaagtgcgtcttggacgtacaggagcagaggaagtgttccagcttgggcccttgaacgaatatgaaagggttggtctggagaaagcaaaagaagaactagctggaagtattcagaaaggtgtcgacttcatcaggaaatga

SEQ ID NO: 45251 - protein, 358 aa, Brassica napus
MEFRGDANKRIAMISAHLQPSFTPQMEAKNSVMGRENCRAKGGNPGFKVAILGAAGGIGQSLSLLMKMNPLVSLLHLYDVVNAPGVTADVSHMDTGAVVRGFLGAKQLEDALTGMDLVIIPAGVPRKPGMTRDDLFKINAGIVKTLCEGVAKCCPNAIVNLISNPVNSTVAIAAEVFKKAGTYDPKKLLGVTTLDVARANTFVAEVLGLDPREVDVPVVGGHAGVTILPLLSQVKPPSSFTPSEIEYLTNRIQNGGTEVVEAKAGAGSATLSMAYAAAKFADACLRGLRGDANVIECSFVASQVTELAFFATKVRLGRTGAEEVFQLGPLNEYERVGLEKAKEELAGSIQKGVDFIRK

SEQ ID NO: 45252 - DNA, 1026 bp, Brassica napus
  CDS (1)..(1026)
atgttcagatccgcgcttgtccgatcctccgcctcggcgaagcagtcgcttctccgccgcagcttctcttccggatccgtccccgagcgtaaagtcgccatcttgggagccgccggtggaatcggtcagcctctggctctcctcatgaaactcaatcccctcgtctcaagcctctccctttacgatatcgccaacacacccggagtcgccgctgacgtcggtcacatcaacaccagatctcaggtggttgggtacatgggagatgataacttggcgaaagctcttgaaggagctgacctcgttatcattccagctggtgtccccaggaagcctggtatgacccgtgatgatcttttcaacatcaatgctggcattgtcaagaacctttggtctgccatcgccaagtactgccctcatgcacttgttaatatgattagcaacccggtcaactctactgttccgattgcagcagagattttcaagaaggctggtatgtacgatgaaaagaagctgtttggtgttaccactcttgacgttgttagggtcaagacttcctatgctggaaaggctaatgtccctgttgcagaagttaatgttccggcgattgttggtcatgctggggttacaatcctcccactcttctctcaggccactccccaagctatcttgtcaggtgacgcgctcactgtcaccaccaagcgtactcaagatggaggtacagaagttgaagaggctaaggcagggaaaggttcagctacattgtcaatggcgtatgctggagcactattcgctgacgcatgcttgaagggactcaatggtgtcccagatgtagtcgaatgctcatacgtgcagtccacaatcactgagcttcctttctttgcctcaaaggtgaggttggggaagaacggtgttgaggaggttcttgatttggggccactctctgacttcgagaaggaaggcttggaagcattgagaccgggaatcaagtctaccattgagaagggagttaagtttgccaaccaatga

SEQ ID NO: 45253 - protein, 341 aa, Brassica napus
MFRSALVRSSASAKQSLLRRSFSSGSVPERKVAILGAAGGIGQPLALLMKLNPLVSSLSLYDIANTPGVAADVGHINTRSQVVGYMGDDNLAKALEGADLVIIPAGVPRKPGMTRDDLFNINAGIVKNLWSAIAKYCPHALVNMISNPVNSTVPIAAEIFKKAGMYDEKKLFGVTTLDVVRVKTSYAGKANVPVAEVNVPAIVGHAGVTILPLFSQATPQAILSGDALTVTTKRTQDGGTEVEEAKAGKGSATLSMAYAGALFADACLKGLNGVPDVVECSYVQSTITELPFFASKVRLGKNGVEEVLDLGPLSDFEKEGLEALRPGIKSTIEKGVKFANQ

SEQ ID NO: 45254 - DNA, 1026 bp, Caenorhabditis elegans
  CDS (1)..(1026)
atgtctcttccagcaaagaccctcgtccaggctgccgccaactctggactccgtgctgtctccgtccgtcattccagccaagctccaaaggtcgctcttcttggagctgccggaggaattggacagccattgggtctccttctcaagcaggatccacttgttgctcacctcgccctctacgacgtcgtcaatactccaggagttgccgccgatctttcgcacattgattctaatgccaaggttaccgctcacactggcccaaaggaactttacgccgccgttgagaacgctgatgttatcgttattccagccggagttccacgtaaaccaggaatgactcgtgacgatctcttcaacaccaacgcaggaatcgttcgcgatttagctgccgttatcgccaaagcttcaccaaaggctctcatcgcaattatcaccaacccagtcaattctactgtcccaatcgcttccgaagttctcaagaaggctggtgtctatgacccaaaacgtgtcttcggagtgacaaccctcgacgtcgtcagatctcaagcattcgtttccgagcttaagggacatgacgcctccaagaccgttgttccagttgtcggaggacatgctggaatcaccatcattccacttctctcccaagtcaaaccatccaccaaattctcggaggaagaaatctccaagttgaccccaagaatccaggacgccggaactgaagtcgtcaacgccaaggctggagccggatccgctactctttcaatggctcttgctggagcccgtttcgccaatgctcttgttcgtggaattaagggagaaaagaacgtccaatgcgcatatgttgcttccgatgccgtcaagggagtcgaatacttctctaccccagttgagctcggaccaaatggagttgagaagattcttggagttggaaaggtttctgcttatgagcagaagcttatcgacgcatccgttccagaacttaacaagaacattgccaagggagtcgctttcgttaagggaaactaa

SEQ ID NO: 45255 - protein, 341 aa, Caenorhabditis elegans
MSLPAKTLVQAAANSGLRAVSVRHSSQAPKVALLGAAGGIGQPLGLLLKQDPLVAHLALYDVVNTPGVAADLSHIDSNAKVTAHTGPKELYAAVENADVIVIPAGVPRKPGMTRDDLFNTNAGIVRDLAAVIAKASPKALIAIITNPVNSTVPIASEVLKKAGVYDPKRVFGVTTLDVVRSQAFVSELKGHDASKTVVPVVGGHAGITIIPLLSQVKPSTKFSEEEISKLTPRIQDAGTEVVNAKAGAGSATLSMALAGARFANALVRGIKGEKNVQCAYVASDAVKGVEYFSTPVELGPNGVEKILGVGKVSAYEQKLIDASVPELNKNIAKGVAFVKGN

SEQ ID NO: 45256 - DNA, 1122 bp, Chlamydomonas reinhardtii
  CDS (1)..(1122)
atgtctttgcaatcgtcaatccgtgccgactcaaactgcacgctgccaaacaaccctgtctgtgtacttttacctgttgactttattgtagcagccatggcctcgtctacttcctctgctatggccaagtgggccgcgcaagccgcgcggggctttgctgctgctgctccgagctcgggcaagggccgcaaggtcgccgtgctgggtgctgctggcggtattggccagcccctgtccatgctcatgaagatgaacagccaggtgtcgtctctgtcgctctacgatattgctggcacccccggtgtggccgctgatgtcagccacatcaacaccaaggcgcaggtcaagggcttcgacaaggacggcctggctgaggccctgcgtgggtgcgacctggtcatcatccccgccggtgtgccccgcaagcccggcatgacccgcgacgacctgttcaagatcaacgccggcatcgtgcgtgacctggtcaccgccgtgggccagcactgccccggggccgtgctgaacatcatctccaaccccgtcaacagcactgtgcccatcgcggccgagcagctgaagaagatgggcgtgtacgacaagcggaaggtgatgggcgtgaccaccctggacgtggtgcgtgccaagaccttctacgccgagaagaacggcctggacgtggccagcgtggacgtgcccgtggtgggcggccacgccggcgtgaccatcctgccgctgttctcccaggccacccccaaggccaccatgtcggctgaggtgctggacgcgctcaccaagcgtacccaggacggcggcactgaggtggtgcaggccaaggccggcaagggctcggccaccctgtccatggcctacgccgccgccctgttcgcggactcgtgcctgcgcggcctgaacggcgcccccgtggtggagtgcacctacgtggagtccaccgtcacggacgcgccctacttcgcctccaaggtcaagctcagcaccgagggtgtggacaagatccacgacctgggcccgctgtcggactacgagaaggccggcctcaaggccatgatgcccgagctgctggcgtcgatcgagaagggtgtgcagttcgtcaagggcgcctaa

SEQ ID NO: 45257 - protein, 373 aa, Chlamydomonas reinhardtii
MSLQSSIRADSNCTLPNNPVCVLLPVDFIVAAMASSTSSAMAKWAAQAARGFAAAAPSSGKGRKVAVLGAAGGIGQPLSMLMKMNSQVSSLSLYDIAGTPGVAADVSHINTKAQVKGFDKDGLAEALRGCDLVIIPAGVPRKPGMTRDDLFKINAGIVRDLVTAVGQHCPGAVLNIISNPVNSTVPIAAEQLKKMGVYDKRKVMGVTTLDVVRAKTFYAEKNGLDVASVDVPVVGGHAGVTILPLFSQATPKATMSAEVLDALTKRTQDGGTEVVQAKAGKGSATLSMAYAAALFADSCLRGLNGAPVVECTYVESTVTDAPYFASKVKLSTEGVDKIHDLGPLSDYEKAGLKAMMPELLASIEKGVQFVKGA

SEQ ID NO: 45258 - DNA, 1044 bp, Citrullus lanatus
  CDS (1)..(1044)
atgaaggcctcaattctcagatccgttcgttccgccgtttccagatcctcatcgtcgaatcgcctcttgagccgtagctttgcgaccgaatcggtgccggaaaggaaagtggccgttctcggtgccgccggtgggattggacagccattggcgcttctcatgaagcttaacccacttgtctctaagcttgccctctacgatattgccggtacccctggtgttgctgctgatgtcggccatgttaacactagatccgaggttactggctacgtgggtgaggagcaactcggcaaagctttggagggatccgatgttgtcatcattcctgctggcgttccaagaaagccgggcatgactcgtgatgatctcttcaacattaatgctggcattgttaaatcactttgcaccgccattgctaagtactgccccaatgcactcattaacatgatcagtaaccccgtcaactcaactgtcccaattgctgctgaggttttcaagaaagctggtacttacgatgagaagaaattgtttggtgttactactctagatgttgtcagagctaagaccttctacgctgggaaagcaaatgttccagtagccgaggttaatgtgcctgttattggtggccatgctggcattaccattcttccactattttctcaggctacccccagagctaatttgtcagatgatactattgtggctctcaccaagcgaacacaagatggaggaacagaagttgtggaagcaaaggcaggaaagggttctgctacattatcaatggcctatgctggagccctttttgccgatgcttgtcttaagggactaaatggagttccagatgttgtggaatgttcatttgtgcaatcaactgtcaccgaacttccattctttgcttcaaaggtgaagcttggaaagaatggggtagagtctgttttggatttgggtcctctctcagacttcgagaaagaaggtttggaaaagctcaagcccgagctcaaagcttctattgagaagggaatccagtttgcaaatgcaaattag

SEQ ID NO: 45259 - protein, 347 aa, Citrullus lanatus
MKASILRSVRSAVSRSSSSNRLLSRSFATESVPERKVAVLGAAGGIGQPLALLMKLNPLVSKLALYDIAGTPGVAADVGHVNTRSEVTGYVGEEQLGKALEGSDVVIIPAGVPRKPGMTRDDLFNINAGIVKSLCTAIAKYCPNALINMISNPVNSTVPIAAEVFKKAGTYDEKKLFGVTTLDVVRAKTFYAGKANVPVAEVNVPVIGGHAGITILPLFSQATPRANLSDDTIVALTKRTQDGGTEVVEAKAGKGSATLSMAYAGALFADACLKGLNGVPDVVECSFVQSTVTELPFFASKVKLGKNGVESVLDLGPLSDFEKEGLEKLKPELKASIEKGIQFANAN

SEQ ID NO: 45260 - DNA, 1044 bp, Eucalyptus gunnii
  CDS (1)..(1044)
atgagggcttcaatgttgaggttgatccgatcgcggtcgtcctccgccgccccgcggccgcacctcctccgccgggcatacggctcggagtcggtgccggagcggaaggtggccgtgctcggcgccgcgggcgggatcggccagcccctcgctcttctcatgaagctcaaccctctcgtctcccagctcgccctctacgatatcgccggcactcccggcgtcgccgccgacgtcggccacatcaacaccagatctgaggttgctggatacgtgggtgaggagcagcttgggcaagctttggagggatcggatgttgtcatcattccggctggtgtgccaaggaagcctgggatgacccgcgatgatctcttcaacattaatgctggcattgtcaagtccttgtgtactgcaattgccaagtactgcccgaatgcagttgtgaacatgattagcaaccctgtgaactcaacagtgccaattgctgctgagatctttaagaaggcagggacctataatgagaagaagcttttgggagtgacaacccttgatgttgttagggccaaaactttctatgctgggaaggctaaagtccctgttgaagaggtaaatgtgcctgttgttggcggtcatgcgggcattacaatcctccctctgttttctcaagccgtgcccaaggccaatttggccgatgaagacatcaaggcgcttaccaagcgtacacaagatggagggacggaagtcgtggaagcaaaggctggaaagggatctgcaacattgtccatggcgtatgctggagcattatttgcagatgcttgcctgaagggcctaaatggtgtccccgatgtggtggaatgttcctttgtgcagtctagcatcatcactgaacttcctttctttgcttcaaaggtgaaactcggaaagaatggcgtggaggaagttttggagttgggtcccatgtctgactatgagaagcaagggctggaaatcctgattcctgagctcaaagcatctattgagaaggggatcaagtttgccaatcagtaa

SEQ ID NO: 45261 - protein, 347 aa, Eucalyptus gunnii
MRASMLRLIRSRSSSAAPRPHLLRRAYGSESVPERKVAVLGAAGGIGQPLALLMKLNPLVSQLALYDIAGTPGVAADVGHINTRSEVAGYVGEEQLGQALEGSDVVIIPAGVPRKPGMTRDDLFNINAGIVKSLCTAIAKYCPNAVVNMISNPVNSTVPIAAEIFKKAGTYNEKKLLGVTTLDVVRAKTFYAGKAKVPVEEVNVPVVGGHAGITILPLFSQAVPKANLADEDIKALTKRTQDGGTEVVEAKAGKGSATLSMAYAGALFADACLKGLNGVPDVVECSFVQSSIITELPFFASKVKLGKNGVEEVLELGPMSDYEKQGLEILIPELKASIEKGIKFANQ

SEQ ID NO: 45262 - DNA, 1005 bp, Saccharomyces cerevisiae
  CDS (1)..(1005)
atgttgtcaagagtagctaaacgtgcgttttcctctacagttgccaacccttataaagtgactgttttgggtgcaggcggtggtattggacaaccattgtctttgcttctaaagcttaaccataaagtcacggacttaagactgtacgacctaaagggcgcaaaaggtgttgccaccgatttgtctcatattccaacaaactccgtggtcaaggggtttactccagaagagccagacggattgaacaacgctttaaaggacacagacatggttttaattcctgctggtgtgcccagaaagcctggtatgacacgtgatgacttgttcgccatcaacgcaagcatcgttcgcgatttggcagcagcaaccgccgaatccgctcccaatgctgccattctggtcatttccaacccagtcaattctaccgttccaattgtcgcccaagtcttgaaaaacaagggtgtttacaacccaaagaaattgttcggtgtgactaccttggactctattagagccgccagattcatctcagaagtcgagaacaccgatccaactcaggaaagggttaacgtcatcggtggacattctggtattaccatcatcccattgatttcgcaaacaaaccataagttgatgtctgatgacaagagacacgaattgattcacagaatacagtttggtggtgacgaagtcgtcaaagcaaagaatggtgctggctctgctacgttgtcaatggcccatgctggtgctaaattcgctaacgctgttttgtccggtttcaaaggcgaaagagacgtcatcgagccttccttcgtggactctcccttgttcaaatccgaaggcatcgaattctttgcatctccggtcactttgggcccagatggtattgaaaagatccatccaataggtgagttatcttcagaagaagaagaaatgctacaaaaatgtaaagaaaccttgaagaagaatatcgaaaagggtgtcaactttgttgctagtaaatag

SEQ ID NO: 45263 - protein, 334 aa, Saccharomyces cerevisiae
MLSRVAKRAFSSTVANPYKVTVLGAGGGIGQPLSLLLKLNHKVTDLRLYDLKGAKGVATDLSHIPTNSVVKGFTPEEPDGLNNALKDTDMVLIPAGVPRKPGMTRDDLFAINASIVRDLAAATAESAPNAAILVISNPVNSTVPIVAQVLKNKGVYNPKKLFGVTTLDSIRAARFISEVENTDPTQERVNVIGGHSGITIIPLISQTNHKLMSDDKRHELIHRIQFGGDEVVKAKNGAGSATLSMAHAGAKFANAVLSGFKGERDVIEPSFVDSPLFKSEGIEFFASPVTLGPDGIEKIHPIGELSSEEEEMLQKCKETLKKNIEKGVNFVASK

SEQ ID NO: 45264 - DNA, 972 bp, Anabaena sp
  CDS (1)..(972)
atgttttcttctccagactccccaattttgcattgtctacctcgtgtcgccattattggtgctggtagggttggtagcactttagctcaacgtattgctgagaaaaatttagcagatgtggtgctattagatattgttgagggtatacctcaaggattagcactagatttattagaagctaggggtattgaattgcataatcgtcagattatcggcacaaataattatgctgatacctctggttcgcaaatcgttgtcataacagccggatttccccgcaagccagggatgagtcgggatgatttgttgagaactaacgccaagattgttattgaggcagcaaagcaagcgatcgcctactctccctatgctatttttatcgtagtcaccaatcctttggatgtgatgacttatttagcttgggaagccacaggtttaccccgtaaccgcatcatgggtatggctggggtgttagactcggcaagatttgaaacttttattgctttagaattaggggtattacctgcggatgtcaaagcaatggtattgggtagccacggggatttgatggttcccctgtctcgttacgccacagttaatggtatccccattacacaattgttggatgcagtcacaatagaaaggttagtggaaagaacccgtaatggtggtgcggaaattgtggaattgatgcagactggtggcgcgttttttgcacctgcatcagctacaagtttgatggtggaatcaattttattgaatcagtcccggctgttacctgtgtctatatatctgcaaggcgaatacgatttaaaagatgtagtgattggtgttccttgtcggttgggattaaatggaattgagagtgtaatagaattaaatctcagtgatagtgaaagagaagctttacatatctcggctaaatcagtgcagaaaaatattgagcgatggcgttctctccagaatagctga

SEQ ID NO: 45265 - protein, 323 aa, Anabaena sp
MFSSPDSPILHCLPRVAIIGAGRVGSTLAQRIAEKNLADVVLLDIVEGIPQGLALDLLEARGIELHNRQIIGTNNYADTSGSQIVVITAGFPRKPGMSRDDLLRTNAKIVIEAAKQAIAYSPYAIFIVVTNPLDVMTYLAWEATGLPRNRIMGMAGVLDSARFETFIALELGVLPADVKAMVLGSHGDLMVPLSRYATVNGIPITQLLDAVTIERLVERTRNGGAEIVELMQTGGAFFAPASATSLMVESILLNQSRLLPVSIYLQGEYDLKDVVIGVPCRLGLNGIESVIELNLSDSEREALHISAKSVQKNIERWRSLQNS

SEQ ID NO: 45266 - DNA, 939 bp, Bacillus cereus
  CDS (1)..(939): transl_table=11
atgacaatcaaacgcaagaaggtttcagtcatcggtgcaggatttacaggagcaacaacggcattcttattagcacaaaaagaacttgcagatgttgtattagtggacattccacaactggaaaatccaacaaaagggaaagcgttagatatgttagaagcgagcccagtacaaggttttgatgctaacattattggaacatctgattacgcagatactgctgattctgacgttgtcgttattacagcaggtattgcacgtaagcctggtatgagccgtgatgacttagtagcaacaaactctaaaattatgaaaagtattacgcgcgacattgcaaaacattcaccaaatgcaattattgttgtgttaacaaatccagttgatgcaatgacatattctgtatttaaagaagcaggattcccgaaagagcgtgtaatcggccaatcgggtgtattagatacagctcgtttccgtacattcatcgcacaagaattaaatctttctgtaaaagacattacaggatttgttcttggcggacacggtgacgacatggtacctcttgtgcgttattcttatgcaggcggtattccgttagaaacgttaattccgaaagagcgtttagaagcaatcgtagaacgtacacgtaaaggtggcggtgagattgtaggcttattaggaaacggtagtgcatattacgcaccagcagcttctttagttgaaatgacagaagcaatcttaaaagatcaacgccgtatattaccagctattgcgtaccttgaaggtgagtatggttatagtgacctttacttaggggtaccagtaattctaggtggtaacggaattgaaaaaattattgaattagaacttcttgcagatgaaaaagaagcgttagatcgctctgtagaatctgtacgtaatgtaatgaaagttcttgtttaa

SEQ ID NO: 45267 - protein, 312 aa, Bacillus cereus
MTIKRKKVSVIGAGFTGATTAFLLAQKELADVVLVDIPQLENPTKGKALDMLEASPVQGFDANIIGTSDYADTADSDVVVITAGIARKPGMSRDDLVATNSKIMKSITRDIAKHSPNAIIVVLTNPVDAMTYSVFKEAGFPKERVIGQSGVLDTARFRTFIAQELNLSVKDITGFVLGGHGDDMVPLVRYSYAGGIPLETLIPKERLEAIVERTRKGGGEIVGLLGNGSAYYAPAASLVEMTEAILKDQRRILPAIAYLEGEYGYSDLYLGVPVILGGNGIEKIIELELLADEKEALDRSVESVRNVMKVLV

SEQ ID NO: 45268 - DNA, 945 bp, Bacillus halodurans
  CDS (1)..(945)
atggcaattaaacgcagaaaggtctccgttattggggcgggtttcacaggtgctacgacagcgctaatggttgctcaaaaggaattaggtgatgtcgttcttgtggatattccgcaaatggaaggtccgactaaaggaaaagcgttagatatgctcgagtcaacgccggttcaaggggttgatgtgaacatcacaggtacgtctagctatgaatatacgaaggattctgatgtggttgtcattacggctggaattgctcgtaagcctggtatgagccgcgatgatctcgtatcaacaaatgcgggaattatgaaggctgttacgaaagaagtggtgaaacattcaccaaacgcctacattattgttttaacgaacccagcagatgcgatgacctataccgtttataaagaatctggtttcccgaaaaaccgcgtcatcggtcaatcgggcgttctagatacggcacgcttccgtacgttcgtcgcccaagagcttaacctatctgttgaagatattacaggttttgttcttggggggcacggggatgacatggtgccattgattcgttactcctatgcaggtgggattccgcttgaaaagctccttccacaagagcgcatcgatgcgattgtggaacgtacgcgcaaaggcggcggtgaaattgtcggcttgcttggaaatggcagtgcttattatgcaccagccgcttcacttgcagagatggtcgaagccattctgaaagataagaaacgcgtccttccaacgattgcttaccttgaaggtgagtatggatatgaagatatctatgttggagttccgacgattcttggcggagacggcattgaaaaggttattgagcttgatctaaccgatgaagagaaagcgacctttgctaagtccattgaatctgttcgcaacgtcatgtcggcactaccaaaagaataa

SEQ ID NO: 45269 - protein, 314 aa, Bacillus halodurans
MAIKRRKVSVIGAGFTGATTALMVAQKELGDVVLVDIPQMEGPTKGKALDMLESTPVQGVDVNITGTSSYEYTKDSDVVVITAGIARKPGMSRDDLVSTNAGIMKAVTKEVVKHSPNAYIIVLTNPADAMTYTVYKESGFPKNRVIGQSGVLDTARFRTFVAQELNLSVEDITGFVLGGHGDDMVPLIRYSYAGGIPLEKLLPQERIDAIVERTRKGGGEIVGLLGNGSAYYAPAASLAEMVEAILKDKKRVLPTIAYLEGEYGYEDIYVGVPTILGGDGIEKVIELDLTDEEKATFAKSIESVRNVMSALPKE

SEQ ID NO: 45270 - DNA, 939 bp, Bacillus israeli
  CDS (1)..(939): transl_table=11
atggcgattaaaagaaagaaaatttctgtcattggtgctggatttactggtgcgacaacagcttttttgctggcaaaaaaagagctgggagatgttgtgctcgttgacattccgcaagcagagaatccgacaaaagggaaagcgttggacatgcttgaatcaagccctgttcttggatttgatgcgaacattatcggaacatcaaactatgaggaaacggctgattccgatattgttgtgatcacggcaggaattgcaagaaaacctggaatgagtcgagacgatttagtgcagaccaaccaaaaagtaatgaaaagcgtcacaaaagaagttgtaaaatattccccaaattccattatcattgtgctgacaaatccggttgatgcaatgacttacactgtttataaagaatccggatttccaaaacaccgcgtcatcggtcaatctggagttttagataccgcaagattccgcacatttgttgctcaagaattgaatttatcagtcaaagacattacaggatttgtgttaggcggccacggagatgatatggtgccattagttcgctattcatacgcagggggcattccgttagaaaaattaatcccgaaagagcgcttggaagcgattgttgaaagaactagaaaaggcgggggagaaattgttaacctgcttggaaacggaagcgcatactacgcaccagccgcatctcttgtagagatggtggaagcgattgttaaagatcagcgccgcgtattgcctgccattgcatatttagaaggagaatacggttttgaaggtatttatttaggcgttccaacaattcttggaggcaatggcttagagcaaattattgagcttgaactgacggatgaagaaaaagcagctttggaaaaatctgcggaatctgtaagaaatgttatgaaagcattaatatag

SEQ ID NO: 45271 - protein, 312 aa, Bacillus israeli
MAIKRKKISVIGAGFTGATTAFLLAKKELGDVVLVDIPQAENPTKGKALDMLESSPVLGFDANIIGTSNYEETADSDIVVITAGIARKPGMSRDDLVQTNQKVMKSVTKEVVKYSPNSIIIVLTNPVDAMTYTVYKESGFPKHRVIGQSGVLDTARFRTFVAQELNLSVKDITGFVLGGHGDDMVPLVRYSYAGGIPLEKLIPKERLEAIVERTRKGGGEIVNLLGNGSAYYAPAASLVEMVEAIVKDQRRVLPAIAYLEGEYGFEGIYLGVPTILGGNGLEQIIELELTDEEKAALEKSAESVRNVMKALI

SEQ ID NO: 45272 - DNA, 942 bp, Bacteroides thetaiotaomicron
  CDS (1)..(942): transl_table=11
atgtcaaaagtaaccgtagtaggcgcaggtaacgtaggtgctacatgtgcaaatgtacttgctttcaatgaagtagcagacgaagtagtaatgctggacgttaaagaaggcgtttcagaaggtaaagcaatggatatgatgcagacagctcaactgttgggtttcgacacaactgtagtaggctgcactaacgactatgctcagactgctaactctgacgttgttgtaattacttcaggtattcctcgtaaaccgggtatgactcgcgaagaactgatcggtgtaaacgctggtatcgttaaatcagtggcagaaaacatcttgaaatattctcccaatgcaatccttgttgttatctctaacccgatggatacaatgacttacctgtcattgaaagctctgggcttgccgaagaaccgcatcatcggtatgggtggcgcactggacagctctcgtttcaaatatttcttgtctcaggctttgggctgcaacgccaacgaagtagaaggtatggttatcggtggtcacggtgatactactatgattcctttgactcgcttcgctacttacaaaggtatgcctgtaactaacttcatctctgaagaaaaactgaacgaagtggctgctgctactatggtaggtggtgctactctgactaagttactgggcacttctgcatggtatgcaccgggtgcagcaggagcattcgtagttgaatctatccttcacgaccaaaagaagatgatcccttgttcagtatatctggaaggagaatacggtgaatcagacatttgcatcggtgttcctgtaatccttggcaagaacggtatcgaaaagatcgtcgaactggatctgaacgctgacgaaaaagctaagttcgctgccagcgcaaaagctgttcacggaacaaacgctgctttgaaagaagtaggtgctctgtaa

SEQ ID NO: 45273 - protein, 313 aa, Bacteroides thetaiotaomicron
MSKVTVVGAGNVGATCANVLAFNEVADEVVMLDVKEGVSEGKAMDMMQTAQLLGFDTTVVGCTNDYAQTANSDVVVITSGIPRKPGMTREELIGVNAGIVKSVAENILKYSPNAILVVISNPMDTMTYLSLKALGLPKNRIIGMGGALDSSRFKYFLSQALGCNANEVEGMVIGGHGDTTMIPLTRFATYKGMPVTNFISEEKLNEVAAATMVGGATLTKLLGTSAWYAPGAAGAFVVESILHDQKKMIPCSVYLEGEYGESDICIGVPVILGKNGIEKIVELDLNADEKAKFAASAKAVHGTNAALKEVGAL

SEQ ID NO: 45274 - DNA, 963 bp, Bartonella henselae
  CDS (1)..(963): transl_table=11
atggcacgaaagaaaatagctcttattggttcgggtatgattgggggtactttagcacatataattggacttaaagaacttggtgatgtcgtcttatttgatattgcagaaggtataccacaaggtaaagctcttgatatcgccgaatcttcaccagttgacggttttgatgtcagtttaaccggtgctaattcctatgatgtgattgaaggtgccgatgttgttattgtaacagcaggtgttgcaagaaaacccggtatgagccgtgatgaccttttgggcattaatttaaaggtaatggaacaagttggtgcggggattaaaaaatatgcatcttcagcattcgttatttgtattacaaatcctcttgatgcaatggtctgggctttgcaaaaattttcaggtcttccaacacaaaaagtggttggtatggctggtattctcgattcagcacgttttcgtcatttcttatcagaggaatttaagatctctgttaaagatgtgactgcattcgttttaggaggacacggtgattcaatggtgcctttggtgcgttattcaacagttggtggtatttctctacccgatcttgtgaaaatgggctggacgacgcaagaaaagattgatcaaattattcaacgtacccgtgatggtggtgcagaaattgttagtttgttaaaaacaggttctgctttttatgcaccagcagcttctgctgtctctatggctgaagcctatttgaaagacaccaagcgtgttgttcctgtcgcagcttatctttcagggcaatatggggtcaaagatacctatgttggtgttccggttgtcattggtgctgggggcgttgagcgcgtgattgaaatcgatcttgataaagaggagaaagctgcttttgaaaaatcagtgagtgcagtgcaaaaactttgtgaagcttgtattgctgttgcaccaggactcaaataa

SEQ ID NO: 45275 - protein, 320 aa, Bartonella henselae
MARKKIALIGSGMIGGTLAHIIGLKELGDVVLFDIAEGIPQGKALDIAESSPVDGFDVSLTGANSYDVIEGADVVIVTAGVARKPGMSRDDLLGINLKVMEQVGAGIKKYASSAFVICITNPLDAMVWALQKFSGLPTQKVVGMAGILDSARFRHFLSEEFKISVKDVTAFVLGGHGDSMVPLVRYSTVGGISLPDLVKMGWTTQEKIDQIIQRTRDGGAEIVSLLKTGSAFYAPAASAVSMAEAYLKDTKRVVPVAAYLSGQYGVKDTYVGVPVVIGAGGVERVIEIDLDKEEKAAFEKSVSAVQKLCEACIAVAPGLK

SEQ ID NO: 45276 - DNA, 963 bp, Bartonella quintana
  CDS (1)..(963): transl_table=11
atggcacgaaagaaaatagctctcattggttcgggtatgattgggggtacgttagcacatatgatagggcttaaagaacttggtgatgttgtcttatttgatattgaagaaggcatgccacaaggtaaggctcttgatattgccgaatcttcaccagttgatggttttgatgtgagtttaacaggtgctaatgtttatgaggcaattgaaggtgctgatgttgtgattgtaacggcaggcgttgcacgaaaacctggtatgagccgtgatgatcttctgggcattaatttgaaagtgatggaacaagttggtgctgggattaaaaaatacgcatcttcagcattcgttatttgtattacgaaccctcttgatgcaatggtatgggcattgcaaaaattttcaggtcttcccaaacaaaaagtagttggtatggctggtgttcttgattcggcacgttttcgttatttcttatctaaggaatttaaggtctctgttaaagacgtgacagcgtttgttttaggaggacacggcgattcaatggtgcctttggtgcgttattcaacagttggtggtatttctttgcccgatcttgtgaaaatgggctggacgacacaagaaaagattgatcaaattatccaacgtgtccgtaatggtggtgcggaaattgtcggtttgttaaaaactggttctgctttttatgcacctgcagcctctgctatttctatggctgaagcttatttgaaggatattaagcgtgttgttcctgttgcaacctatctttcaggtgaatatggggtcaaagacacatatgttggtgttcctgttgttcttggtgcgggcggcgttgagcgggtcattgaaatcgatcttgataaaaaggaaagaagtgcttttgagcaatcagtaaatgcggtaaaaaaactttgtgaagcttgtatcgctattgcaccttgtctcaaataa

SEQ ID NO: 45277 - protein, 320 aa, Bartonella quintana
MARKKIALIGSGMIGGTLAHMIGLKELGDVVLFDIEEGMPQGKALDIAESSPVDGFDVSLTGANVYEAIEGADVVIVTAGVARKPGMSRDDLLGINLKVMEQVGAGIKKYASSAFVICITNPLDAMVWALQKFSGLPKQKVVGMAGVLDSARFRYFLSKEFKVSVKDVTAFVLGGHGDSMVPLVRYSTVGGISLPDLVKMGWTTQEKIDQIIQRVRNGGAEIVGLLKTGSAFYAPAASAISMAEAYLKDIKRVVPVATYLSGEYGVKDTYVGVPVVLGAGGVERVIEIDLDKKERSAFEQSVNAVKKLCEACIAIAPCLK

SEQ ID NO: 45278 - DNA, 969 bp, Bradyrhizobium japonicum
  CDS (1)..(969)
atggcgcgcgacaagattgctttgattggctccggtcagatcggcggaacgctggctcacctcatcggcctgaaagaactgggcgacgtcgtgatgttcgacatcgccgagggcgtgccgcagggcaaggcgctcgacattgcgcagtcctcgccggtcgacggcttcgacgcccactacaccggcgcgaactcctacgaggcgctcgacaacgccaaggtctgcatcgtcaccgccggcgtgccgcgcaagcccggcatgagccgcgacgatctcctctccatcaacctcaaggtcatggagcaggtcggcgccggcatcaagaagtatgcccccgacgccttcgtcatctgcatcaccaacccgctcgacgccatggtgtgggcgctccagaaggcctcgggcctgccgcacaagaaggtcgtcggcatggccggcgtgctggactcggcgcgcttccgctacttcctggccgacgaattcaacgtctccgttgaagacgtcaccgccttcgtgctcggcggccacggcgacaccatggtgccgctggtgaagtactccaccgtcgccggcatcccgctgcccgacctcgtcaagatgggctggacctcgcaggcgcgcctcgacgagatcgtcgaccgcacccgcaacggcggcgctgagatcgtcaacctgctcaagaccggctcggccttctacgccccggccgcttccgcgatcgcgatggccgagagctatctgcgtgacaagaagcgcgtgctgcccagcgccgcctacctcaacggcgaatacggcgtgaaggacatgtatgtcggcgtgcccgtcgtgatcggctccaagggtgtcgagcgcgtcgtcgagatcgagctcgccggcaaggaccgcgaggccttcgacaagtcggtcggcgcggtgcagggcttggtcgacgcctgcaagaagattgcccccgatcttctcggccgctaa

SEQ ID NO: 45279 - protein, 322 aa, Bradyrhizobium japonicum
MARDKIALIGSGQIGGTLAHLIGLKELGDVVMFDIAEGVPQGKALDIAQSSPVDGFDAHYTGANSYEALDNAKVCIVTAGVPRKPGMSRDDLLSINLKVMEQVGAGIKKYAPDAFVICITNPLDAMVWALQKASGLPHKKVVGMAGVLDSARFRYFLADEFNVSVEDVTAFVLGGHGDTMVPLVKYSTVAGIPLPDLVKMGWTSQARLDEIVDRTRNGGAEIVNLLKTGSAFYAPAASAIAMAESYLRDKKRVLPSAAYLNGEYGVKDMYVGVPVVIGSKGVERVVEIELAGKDREAFDKSVGAVQGLVDACKKIAPDLLGR

SEQ ID NO: 45280 - DNA, 963 bp, Brucella suis
  CDS (1)..(963)
atggcacgcaacaagattgccctcatcggctccggcatgatcggcggtacgctcgctcacctggccggtctgaaggaactcggtgacgtcgtccttttcgacattgcggaaggcaccccgcagggcaaggggctggatatcgccgaatcttctccggtcgatggtttcgatgcgaagttcactggcgcgaacgattacgccgccattgaaggcgcagacgtcgtcatcgtcaccgcaggcgtgccgcgcaagccgggcatgagccgcgacgatctcctgggcatcaacctgaaggtgatggaacaggtgggcgcgggcatcaagaaatatgcgccggaagctttcgtcatctgcatcaccaacccgctcgacgccatggtctgggcgctgcagaagttctccggccttccggcccacaaggttgtcggcatggctggcgttctcgacagcgcccgcttccgttatttcctctcggaagaattcaacgtttcggtcgaggacgtcacggcattcgtgctgggtggccacggcgattcgatggttccgctggcgcgctactcgaccgttgccggcattccgctgcctgatctcgtcaagatgggctggaccagccgggacaagctcgacaagatcatccagcgcacccgtgacggcggcgcggaaatcgtgggccttctcaagaccggctcggctttctacgctccggcggcatcggccatccaggtggctgaatcctacctcaaggacaagaagcgcgtcctgccggtcgcagcccagctttcgggccagtatggcgtgaaggacatgtatgtgggcgttccgaccgtgatcggcgccaatggcgtggagcgcatcatcgagatcgatctcgacaaggacgagaaggcgcagttcgacaagtcggtggcctccgtcgccggtctgtgcgaagcctgcatcggtattgctccgtcgctgaaataa

SEQ ID NO: 45281 - protein, 320 aa, Brucella suis
MARNKIALIGSGMIGGTLAHLAGLKELGDVVLFDIAEGTPQGKGLDIAESSPVDGFDAKFTGANDYAAIEGADVVIVTAGVPRKPGMSRDDLLGINLKVMEQVGAGIKKYAPEAFVICITNPLDAMVWALQKFSGLPAHKVVGMAGVLDSARFRYFLSEEFNVSVEDVTAFVLGGHGDSMVPLARYSTVAGIPLPDLVKMGWTSRDKLDKIIQRTRDGGAEIVGLLKTGSAFYAPAASAIQVAESYLKDKKRVLPVAAQLSGQYGVKDMYVGVPTVIGANGVERIIEIDLDKDEKAQFDKSVASVAGLCEACIGIAPSLK

SEQ ID NO: 45282 - DNA, 930 bp, Chloroflexus aurantiacus
  CDS (1)..(930): transl_table=11
atgcgcaagaagattagtattatcggggcaggatttgtcggttcgacgacagctcactggctggccgctaaagaattaggtgacattgttctgcttgatattgtcgagggtgtgcctcaaggcaaggctctcgatctctacgaggcatcaccaattgaagggtttgatgttcgggtgaccggcacgaacaactacgccgatactgccaactcggatgtcatcgttgttacgtcaggtgctccgcgcaagccgggcatgagccgtgaggatttgatcaaggtcaacgccgacatcacccgtgcctgtatcagtcaggctgccccgctctcgccgaatgccgtgattatcatggtcaataatcctctggatgcgatgacctatctggcggcggaggttagtggcttccccaaagagcgtgtcattggtcaggccggcgtcctcgatgcggcccgctatcgcaccttcattgccatggaggcgggtgtttcggttgaagatgttcaggcgatgctgatgggtggtcacggcgatgagatggtaccgctgccccggttttcaaccattagcggtattccggtgagcgagttcattgcgcctgatcgtctggctcagattgttgagcgcacccggaagggtggtggcgagattgtgaatctgctgaagaccggcagtgcgtattatgctcccgccgccgccacagcgcagatggtcgaagcggtgctcaaagacaagaagcgggtcatgccggtggcagcctacctgaccggtcagtacggcctgaatgatatttactttggtgtaccggtgatcctcggtgccggtggagtagagaaaattctcgaattgccgctcaacgaagaggagatggcactgctgaacgcatcggcgaaagcggtacgtgccaccctcgacacgctgaagtctctctaa

SEQ ID NO: 45283 - protein, 309 aa, Chloroflexus aurantiacus
MRKKISIIGAGFVGSTTAHWLAAKELGDIVLLDIVEGVPQGKALDLYEASPIEGFDVRVTGTNNYADTANSDVIVVTSGAPRKPGMSREDLIKVNADITRACISQAAPLSPNAVIIMVNNPLDAMTYLAAEVSGFPKERVIGQAGVLDAARYRTFIAMEAGVSVEDVQAMLMGGHGDEMVPLPRFSTISGIPVSEFIAPDRLAQIVERTRKGGGEIVNLLKTGSAYYAPAAATAQMVEAVLKDKKRVMPVAAYLTGQYGLNDIYFGVPVILGAGGVEKILELPLNEEEMALLNASAKAVRATLDTLKSL

SEQ ID NO: 45284 - DNA, 960 bp, Francisella novicida
  CDS (1)..(960): transl_table=11
atggctagaaaaaaaatagcacttgttggtgctggtaatattggtggtacactagctcacttagcacttttaaaacaattaggtgatgtagtcctttttgatatagctcagggcatgcctaatggcaaagcacttgatttactacaaacttgtcctatcgagggagttgattttaaagtcaggggtacaaatgattacaaagatttagaaaattctgatgttgttattgtaactgctggtgttccgagaaagcctggcatgtctcgtgatgacttacttggtattaatatcaaagtaatgcaaacagttggagaaggtatcaaacataactgtcctaatgcttttgtaatatgtatcacaaatccactagatattatggtaaatatgttacaaaaattctcaggcgtaccagataacaaaatcgttggtatggctggtgttttagattctgctagatttagaacatttttagcagatgaactaaatgtatcagtacaacaagtacaagcatatgtaatgggtggtcatggcgatactatggtccctttaactaaaatgtcaaatgttgcaggtgtgtcgttagagcagctagttaaagaaggtaaacttaaacaagagcgtttagatgctatagtatcgagaactagaagtggtggtggcgaaattgttgctttacttaaaacaggttcagcatattatgcaccagctgctgcaggtattcaaatggctgaaagcttcttaaaagataaaaagatgattttaccttgtgctgcaaaagtaaaagctggtatgtatggtcttgatgaagatctatttgttggtgtaccaactgagatttctgcaaatggtgtcagacctattgaagtagagatttctgataaagaaagagaacaattacaagtatctataaacgctgtaaaagatcttaataaagcagctgctgaaattttagcaaaataa

SEQ ID NO: 45285 - protein, 319 aa, Francisella novicida
MARKKIALVGAGNIGGTLAHLALLKQLGDVVLFDIAQGMPNGKALDLLQTCPIEGVDFKVRGTNDYKDLENSDVVIVTAGVPRKPGMSRDDLLGINIKVMQTVGEGIKHNCPNAFVICITNPLDIMVNMLQKFSGVPDNKIVGMAGVLDSARFRTFLADELNVSVQQVQAYVMGGHGDTMVPLTKMSNVAGVSLEQLVKEGKLKQERLDAIVSRTRSGGGEIVALLKTGSAYYAPAAAGIQMAESFLKDKKMILPCAAKVKAGMYGLDEDLFVGVPTEISANGVRPIEVEISDKEREQLQVSINAVKDLNKAAAEILAK

SEQ ID NO: 45286 - DNA, 954 bp, Geobacter sulfurreducens
  CDS (1)..(954): transl_table=11
atggcacgtaagaagattgctctcattggtggtggccagatcggtggtgtgcttgctcaactctgcgctctccgtgaacttggcgacgtcgtcctgttcgatatcgtagaaggccttccccaggggaaatgcctggatatcgccgaagcttctcctgttgacggctttgacgtctgcctgaagggtaccaacagctacgaggatatcgctggcgccgacgttgtcatcgtgactgcgggccttccccgtaagcccggcatgagccgtgacgacctcatcgaggtcaactccaagatcatgacgtcggttgccgaggggatcaagcagtacgcacccaattccttcgtgattgtaatttccaaccctctggacgccatggttaccctctgccagaaggtcaccggtttcccctacaaccgcgtcatcggtcaggccggagttctcgactccgcccgttttgccaccttcatcgcctgggaacttggcgtgtccgtaaaggacgtcaccgccatgactcttggcggccacggcgacgacatggtgccgctggttcgctacgccagcgtcaaaggtatcccggtcatggaactccttgagcgcaagtacggcagtaaggagaaggcgaaggaagtcatggacgccatggtcaaccgtacccgtctggcgggcggcgaagtcgttgccctcctcaagaccggttccgccttctacagccctgcgtccagcgccattgccatggccgagtctatcctcaaggatcagaagcgggttcttccgacctgtgcctacctccagggagagttcggtgtcaacggctactatgtgggcgtaccctgcgtgctcggcgagaagggtatcgagaatatcattgagttctctctcgacgcagaagaacaagcgatgatggacaagtcggtcgcagcggtaaagagcctcgtcgacagcctcaagtaa

SEQ ID NO: 45287 - protein, 317 aa, Geobacter sulfurreducens
MARKKIALIGGGQIGGVLAQLCALRELGDVVLFDIVEGLPQGKCLDIAEASPVDGFDVCLKGTNSYEDIAGADVVIVTAGLPRKPGMSRDDLIEVNSKIMTSVAEGIKQYAPNSFVIVISNPLDAMVTLCQKVTGFPYNRVIGQAGVLDSARFATFIAWELGVSVKDVTAMTLGGHGDDMVPLVRYASVKGIPVMELLERKYGSKEKAKEVMDAMVNRTRLAGGEVVALLKTGSAFYSPASSAIAMAESILKDQKRVLPTCAYLQGEFGVNGYYVGVPCVLGEKGIENIIEFSLDAEEQAMMDKSVAAVKSLVDSLK

SEQ ID NO: 45288 - DNA, 975 bp, Haemophilus ducreyi
  CDS (1)..(975): transl_table=11
atgaaagttactgtattaggcgctgcaggtgggataggacaaacgttatctctgttattaaagcttcgtttaccggcgggggcagatttagcactatatgatatttcgccggttacgccgggcattgcagttgatattagccatattccaacctcggtcaatgcgatagggtatgcgggtgaagatccgtccgtcgcactaaaagatccgtccgtcgcactaaaagatactaatttagtgatcattaccgcaggtattgcacgtaaaccgggtatgactcgtgctgacttatttaatattaatgccggtattgtgaaagatttagttgagaaagttgctgaggtttgcccaatggcttgcattggcattgtgactaatccggttaatacattggtgccgattgctgctgaagtattacgtaaagcgggggtatatgataaaagtaaattattcggtgtaacaacgttagacgttgtgcgtgctaaaacatttgtatcagaattaaaacacaaaaatgttgaaacagtcactgtgccagtcgtgggagggcattcagggacaactattttaccgcttctttcgcaagccttagcggaaggtcggttattagatttttcacaaacagaaattgagtcgcttactcagcggatcaaaaatgcagggacggaagtggtggaggctaaagcgggtggcggttcggcaacgctgtcaatggcagagtcaggtgcacgttttgcgctagctgtctttaaagcactattaggagaagattgcgtgcgttatgcttatgtccagagtaaagaaggctcaggatatccggagttttttgcacatcctgtccgctttggtttaaaaggtattgaagaaattctgccgattgcgccattaaatgaatatgaacaaacgcagtttgaagaacttaagcctatattagaggcggatattgaattgggtaagaaattcgttaatccataa

SEQ ID NO: 45289 - protein, 324 aa, Haemophilus ducreyi
MKVTVLGAAGGIGQTLSLLLKLRLPAGADLALYDISPVTPGIAVDISHIPTSVNAIGYAGEDPSVALKDPSVALKDTNLVIITAGIARKPGMTRADLFNINAGIVKDLVEKVAEVCPMACIGIVTNPVNTLVPIAAEVLRKAGVYDKSKLFGVTTLDVVRAKTFVSELKHKNVETVTVPVVGGHSGTTILPLLSQALAEGRLLDFSQTEIESLTQRIKNAGTEVVEAKAGGGSATLSMAESGARFALAVFKALLGEDCVRYAYVQSKEGSGYPEFFAHPVRFGLKGIEEILPIAPLNEYEQTQFEELKPILEADIELGKKFVNP

SEQ ID NO: 45290 - DNA, 936 bp, Haemophilus influenzae
  CDS (1)..(936): transl_table=11
atgaaagttgctgtattaggtgccgcaggtggtattggtcaagcattagcgttattactaaaacttcagttgccagcaggtaccgacttatcattgtatgatattgcccctgttaccccaggtgttgcagtggatgtgagccatattccaacggcagtgaatgtgaaaggtttttctggtgaagatccaactccagcacttgaaggtgcggatgttgtattaatttctgctggtgttgcacgtaaacctggtatggatcgttcagatttattcaatattaatgcaggtatcgtgcgtggtttaattgaaaaagtcgcggttacttgtccgaaagcatgcgttggtatcatcactaacccagtaaatactaccgttgcgattgcggctgaagtgctgaaaaaagcaggcgtttacgacaaacgtaaattatttggtgtgacaactttagacgtgttgcgttctgaaacctttgtggctgaattaaaaggtttaaatgtttctcgtacaagcgttcctgttattggtggtcactctggtgtgactattcttccattactttctcaagttcaatatgcaaaatggaatgaagatgaaatcgaaccattaacaaaacgtatccaaaatgcaggtacagaagtgctcaatgcaaaagcgggtggcggttctgcaaccctttcaatggcgcaagctgcagcacgttttgcgcgttctttagtgaaaggattaagtggcgagacagtggttgaatgtacttatgttgaaggtgatggaaaatatgctcgtttcttctctcagccagttcgtttaggtaaagaaggtgtagaagaaattttaccaattggtccattaagcaattttgaacaacaagccttagaaaatatgttgccaactttacgtgcagatattgaattaggcgaaaaatttattaatggttaa

SEQ ID NO: 45291 - protein, 311 aa, Haemophilus influenzae
MKVAVLGAAGGIGQALALLLKLQLPAGTDLSLYDIAPVTPGVAVDVSHIPTAVNVKGFSGEDPTPALEGADVVLISAGVARKPGMDRSDLFNINAGIVRGLIEKVAVTCPKACVGIITNPVNTTVAIAAEVLKKAGVYDKRKLFGVTTLDVLRSETFVAELKGLNVSRTSVPVIGGHSGVTILPLLSQVQYAKWNEDEIEPLTKRIQNAGTEVLNAKAGGGSATLSMAQAAARFARSLVKGLSGETVVECTYVEGDGKYARFFSQPVRLGKEGVEEILPIGPLSNFEQQALENMLPTLRADIELGEKFING

SEQ ID NO: 45292 - DNA, 948 bp, Helicobacter hepaticus
  CDS (1)..(948): transl_table=11
atgtttgagaaaattgctatcataggcggctctggcaatgtcggttctcatattgcattcttaggtgctatgcgacatattgcaaaagagattctcctttttagcaatgatattcctcgttgcaaaggtgtagggcttgatatttcccaagctgcagctatttttgatattcctattcttattaagggttgtaatagctatgaagaaatagctgaaagtgaagtggttattatcaccgctggatttccacgcacaccaaatatgacgcgtaatgatttgcttcttaaaaatgcaagtattatacaagaaatcagctcaaatgtcgctagaatcgctcctcaatccttactaattgttgtttcaaatccacttgatgcaatgtgtcttgtagcaaagcagtggagtaagtttgaaaaagaacgtgtcatcggtatggcagggattcttgatagtgcacgacttacctatgaaagcaaagtaatgcttggagattttaacaaacatatacaatcgtatgtaataggctctcatagcgatgatatgttacccttgctacgtcattgcctatgtgagggcaaagtttttactgatattttcactcctaaaatgcaagaggagctcatcaaggaaacaaaggggggtggagctaaaattgtaaattattatcagaaaggctcagcgtattttgctcctgcaagcggggtgataaaaatacttgaagctattagcactctaaatgaggaaatactcgtatgtagcgtatttacagagggtgaatatggaataaaagatatttatcttggacttccaattaaacttggcaaaaaaggagtagaacacattgtagaattaccactaaatcagcaagagcaggaaatgttaaatatttccacacaaggtatcaaagaacaagttgagattcttaaagataacaagttgttgtattaa

SEQ ID NO: 45293 - protein, 315 aa, Helicobacter hepaticus
MFEKIAIIGGSGNVGSHIAFLGAMRHIAKEILLFSNDIPRCKGVGLDISQAAAIFDIPILIKGCNSYEEIAESEVVIITAGFPRTPNMTRNDLLLKNASIIQEISSNVARIAPQSLLIVVSNPLDAMCLVAKQWSKFEKERVIGMAGILDSARLTYESKVMLGDFNKHIQSYVIGSHSDDMLPLLRHCLCEGKVFTDIFTPKMQEELIKETKGGGAKIVNYYQKGSAYFAPASGVIKILEAISTLNEEILVCSVFTEGEYGIKDIYLGLPIKLGKKGVEHIVELPLNQQEQEMLNISTQGIKEQVEILKDNKLLY

SEQ ID NO: 45294 - DNA, 924 bp, Methanosarcina acetivorans
  CDS (1)..(924): transl_table=11
atggctaaaatctctgtaattggtgcaggaaatgtaggtgcgaccacagttcagcggctggccgaactggaacctggcgaaattgtcatgacagatattgtggaagggttaccgcagggaaaagcccttgacctcatgcaggcaggggcaataaatggttatgatacgcaggtaacgggtactaacgattatgcagacattacagattctgacctggtgatcattacagccggaattgccagaaaacccggaatgaccagggaagatctgatgaaaaccaattcaaaaataataggggaggtctcccgaaacattgcagagtatgctccgaactctattgttataaatgtcacaaacccgcttgatgttataacttatgtggctatgaaaacaacaggctttgagacaaaaaaagtcttcggaatgagtggagtgcttgatgcagggcgttttgcaagctttatagcagaagaactgaattgttcgaaaaaagacatcgaggcaatggtaataggagggcacggagaccttatggtccccctcccccagtataccaccgtatcgggaattccgcttccggaactgctcccggaggagacaattgccaggcttgtagaaaggacggtgaacggaggagccgaaatagtagggcttctcaaacaggggagtgctttttatgccccgtctgcggccattgtgagcgttgcagaagccgtgcttaaggattcaaagcgcatccttccgacgtctgcatatcttgaagggcagtacgggcaagaaggaatttatttcggagtgctggcgaaactgggagcaaacggggtagaagaagtcctcgagctcaaacttgaggaaaaccagtacgagatcctcaggaagtcttcagaaacgatcaaaaggggaatctcaaaactgggaatatga

SEQ ID NO: 45295 - protein, 307 aa, Methanosarcina acetivorans
MAKISVIGAGNVGATTVQRLAELEPGEIVMTDIVEGLPQGKALDLMQAGAINGYDTQVTGTNDYADITDSDLVIITAGIARKPGMTREDLMKTNSKIIGEVSRNIAEYAPNSIVINVTNPLDVITYVAMKTTGFETKKVFGMSGVLDAGRFASFIAEELNCSKKDIEAMVIGGHGDLMVPLPQYTTVSGIPLPELLPEETIARLVERTVNGGAEIVGLLKQGSAFYAPSAAIVSVAEAVLKDSKRILPTSAYLEGQYGQEGIYFGVLAKLGANGVEEVLELKLEENQYEILRKSSETIKRGISKLGI

SEQ ID NO: 45296 - DNA, 963 bp, Methylobacterium extorquens
  CDS (1)..(963): transl_table=11
atggcacgcagcaagatcgcgctcatcggcgccggacagatcggcggcacgctggcccatctcgccggcctcaaggaactcggtgacgtggtgttgttcgacatcgtcgacggcgtgccgcagggcaaggcgctcgacatcgccgaatccgctcccgtcgacggcttcgatgccaagtattcgggcgccagcgactattccgcgatcgccggggccgacgtggtgatcgtgaccgcgggcgtgccgcgcaagcccggcatgagccgtgacgacctcatcggcatcaacctgaaggtgatggaggcggtcggcgccggcatcaagaagcacgcgcccgacgccttcgtgatctgcatcgccaacccgctcgatgcgatggtgtgggcgctgcagaagttctcggggctgcccaccaacaaggtcgtcggcatggccggcgtgctcgactccgcccgcttccgccacttcctggccgaagagttcggcgtctcggtcgaggacgtgaccgccttcgtgctcggcggccacggcgacgacatggtgccgctgacccgctactcgacggtggccggcgtgccgctgaccgatctggtcaagctcggctggaccacccaggagaagctcgacgccatggtcgagcgcacccgcaagggtggcggcgagatcgtcaacctcctgaagaccggctcggccttctacgcgcccgccgcctccgccatcgccatggccgagagctacctgcgcgacaagaagcgggttctgccctgcgccgcctacctcgacggccagtacggcatcgacggcctctatgtcggcgtgccggtggtgatcggcgagaacggcgtcgagcgtgtgctcgaagtgaccttcaacgacgacgagaaggcgatgttcgagaagtcggtcaattcggtgaagggcttgatcgaggcctgcaagagcgtcaacgacaagctcgcgtaa

SEQ ID NO: 45297 - protein, 320 aa, Methylobacterium extorquens
MARSKIALIGAGQIGGTLAHLAGLKELGDVVLFDIVDGVPQGKALDIAESAPVDGFDAKYSGASDYSAIAGADVVIVTAGVPRKPGMSRDDLIGINLKVMEAVGAGIKKHAPDAFVICIANPLDAMVWALQKFSGLPTNKVVGMAGVLDSARFRHFLAEEFGVSVEDVTAFVLGGHGDDMVPLTRYSTVAGVPLTDLVKLGWTTQEKLDAMVERTRKGGGEIVNLLKTGSAFYAPAASAIAMAESYLRDKKRVLPCAAYLDGQYGIDGLYVGVPVVIGENGVERVLEVTFNDDEKAMFEKSVNSVKGLIEACKSVNDKLA

SEQ ID NO: 45298 - DNA, 942 bp, Methanococcus jannaschii
  CDS (1)..(942): transl_table=11
atgaaagttacaattataggagcttctggtagagttgggagtgcaacagccttattattagctaaagaaccttttatgaaggatttggtgttaattggaagagaacattcaataaataaattggaaggattgagagaagacatctacgatgccttagctgggacaagaagtgatgcaaatatatacgttgagagtgatgaaaatctaaggataattgatgaaagtgatgttgttataataacaagcggtgttccaagaaaagagggaatgagtaggatggatttggcaaaaacaaatgcaaaaattgttgggaagtatgctaaaaaaatagctgaaatctgcgatacaaaaatatttgttataacaaaccctgtggatgtgatgacttataaagctctggtagattcaaaatttgaaagaaatcaagtttttggattagggactcatttagattctttgaggtttaaggttgctattgctaagtttttcggtgttcatattgatgaagttaggacgagaattattggagagcatggggacagcatggttccattgttaagtgctacctctatcggaggaattcctattcaaaaatttgaaagatttaaggaactgccaatagatgagattatagaggatgttaaaacaaaaggagagcagattattagattgaaaggaggttctgagtttggtccagcagcagccattttaaatgttgttaggtgtattgtgaataatgagaaaagattgctaactttatccgcttacgtagatggagagtttgatggaattagagatgtgtgtattggagttccagtaaagattggaagagatgggatagaagaggttgtatcaattgaattggataaagatgagataattgcatttagaaaatctgctgaaatcattaaaaaatactgtgaagaagttaaaaacttataa

SEQ ID NO: 45299 - protein, 313 aa, Methanococcus jannaschii
MKVTIIGASGRVGSATALLLAKEPFMKDLVLIGREHSINKLEGLREDIYDALAGTRSDANIYVESDENLRIIDESDVVIITSGVPRKEGMSRMDLAKTNAKIVGKYAKKIAEICDTKIFVITNPVDVMTYKALVDSKFERNQVFGLGTHLDSLRFKVAIAKFFGVHIDEVRTRIIGEHGDSMVPLLSATSIGGIPIQKFERFKELPIDEIIEDVKTKGEQIIRLKGGSEFGPAAAILNVVRCIVNNEKRLLTLSAYVDGEFDGIRDVCIGVPVKIGRDGIEEVVSIELDKDEIIAFRKSAEIIKKYCEEVKNL

SEQ ID NO: 45300 - DNA, 954 bp, Methanopyrus kandleri
  CDS (1)..(954): transl_table=11
gtgtccaaagtggccgtgatcggtgcgaccggacgtgtcggttcgaccgcggccgcccgcctcgcgttactggactgcgtgaacgaggtcaccctcatcgccaggcctaaaagcgtggataagctgcgcgggctccgccgtgatatcctggactcgttagcggccgcacaaaaagacgccgagatcacgatcgggtgcgagcgagacgactacgtcgatgcggacgtcatcgtgatgacggcggggatcccgaggaagcccggccagacccgtctcgacctcaccaaggataacgccgcgatcatcaagaagtacctggaaggtgttgcggaggagaaccccgaggcaatagtgctcgtggttacgaaccccgtcgacgtgcttacttacgtggctctgaaggtctccgggttacctaagaatcgcgtgatcggcctcggtactcaccttgactctatgcggttcaaagttctaattgccaaacatttcaacgtgcacatgagtgaagtgcacactcgcataatcggcgagcacggcgacaccatggtaccggtgatcagttccacgagcgtcggaggtatcccggtcaccaggatgccggggtgggaggatttcgacgtggaagaagccgtgagggaagtgaaggaagccggtcagcgcatcatcgagacctggggaggatcacagttcggaccggcgcaggcgatcaccaacctcgtccggacgatactgcaggacgaacgccgcgtgctgacggtctccgcgtacctggacggggagatcgacggtatccgcgacgtctgcatcggggtcccagccagactgggccgggagggtgtcctagagatagtaccgatagagctcgaagaagacgagatgagagcgttcagacggtcggttaaagtcgttaaggaggctacgagagaggcgatggaagcgatttctgaaagatga

SEQ ID NO: 45301 - protein, 317 aa, Methanopyrus kandleri
MSKVAVIGATGRVGSTAAARLALLDCVNEVTLIARPKSVDKLRGLRRDILDSLAAAQKDAEITIGCERDDYVDADVIVMTAGIPRKPGQTRLDLTKDNAAIIKKYLEGVAEENPEAIVLVVTNPVDVLTYVALKVSGLPKNRVIGLGTHLDSMRFKVLIAKHFNVHMSEVHTRIIGEHGDTMVPVISSTSVGGIPVTRMPGWEDFDVEEAVREVKEAGQRIIETWGGSQFGPAQAITNLVRTILQDERRVLTVSAYLDGEIDGIRDVCIGVPARLGREGVLEIVPIELEEDEMRAFRRSVKVVKEATREAMEAISER

SEQ ID NO: 45302 - DNA, 924 bp, Methanosarcina mazei
  CDS (1)..(924): transl_table=11
atggttaaaatttccgtaattggtgcaggaaatgtaggttcgacaacagtccagcggctggcagaactggagcctggcgaaattgtcatgacagatattgtggaagggatgccgcagggaaaagctcttgaccttatgcaggccggggcaattaacggttatgacactaggataacaggtactaacgattatgcagatatcgcaaattccgacctggtaattattacggcaggaatcgccagaaagcccggaatgagcagggaagacctgattaaaacgaattcaaaaataataggggatgtagcaggaaacattgcgaaatacgctccgaactctattgttataaacgtcacaaatccgcttgatatcataacatatgtagctatgaaggcaacgggctttgatccagaaaaagtcttcgggatgagtggagttcttgatgcaggacgttttgcaagctttatagcagaggaacttaagtgttcaaaaagggacgttgaggcaatggtcataggagggcatggagaccttatggttccgctcccgcagtacaccacagtatcgggaatcccgcttccggaactgcttccggaaaaaacaattgacaggcttgtggaaaggacagtaaatggaggagcagaaatagtagagcttctcaaacagggaagtgctttttatgctccctcagcagctatcgtacgcatggcagaagctgtaattaaggactccaggcgcgtacttccggcgtctgcatatcttgaaggacagtacgggcagaaaggaatttactttggagtgccagtaaaactgggagcaaatggcatagaagaaattcttgaactcaaacttgaagacagccagtgcgagatactcaaaaaatcctcagagactatccggaaagggatttcaaagctggaaatctaa

SEQ ID NO: 45303 - protein, 307 aa, Methanosarcina mazei
MVKISVIGAGNVGSTTVQRLAELEPGEIVMTDIVEGMPQGKALDLMQAGAINGYDTRITGTNDYADIANSDLVIITAGIARKPGMSREDLIKTNSKIIGDVAGNIAKYAPNSIVINVTNPLDIITYVAMKATGFDPEKVFGMSGVLDAGRFASFIAEELKCSKRDVEAMVIGGHGDLMVPLPQYTTVSGIPLPELLPEKTIDRLVERTVNGGAEIVELLKQGSAFYAPSAAIVRMAEAVIKDSRRVLPASAYLEGQYGQKGIYFGVPVKLGANGIEEILELKLEDSQCEILKKSSETIRKGISKLEI

SEQ ID NO: 45304 - DNA, 945 bp, Methanococcus maripaludis
  CDS (1)..(945): transl_table=11
atggacgtatcaattattggggcatcgggcaaaattgggagtgttttatcattgcttttagcaaaggaaagccatataaaaaatattaatttaattgcccgaagtagttccatcaataaattaaaaggacttaaaatggacctctatgatgcaatggccgccgcaggtcaggataccgacattgacatatgctgtgacgatgatttatcctgtactgctaactcagatattaccataattacagcaggtatggcaagaaccggagagatgtcgagaatcgaccttatgaagggaaatgcaaaaattgtaaaaaattatgtaaaaaatattgctaattttggggatacaaaaatattcatgatttcaaatcctgttgacctaatgacttacaaagcacttatcgaaagtggctatgaaaaaaatcaggtctttggacttggaacgcaccttgattcaatgcgatttaaagtagcagttgcaaaacatttcgaagtccaccttgatgatgttagaacaaggattgttggagaacatggcgacagcatggttccagtaatcagtgcgactgcagtaggcggtattccaatcaaaagattgccaaaatatgaagatttcccgtatgaaaagatacttgaaagaattaagggttatgggcaagaaatcataaatttaaaaaacggctctgaatacggccctgcatccgcaattgtaaacattgtaagatgtattgcacatgatgaaaaacgacttttaaccctttctacatacatcgaagacgaaatcgagggtattgaaggaggttgctgtataggggttcctgtaaaagttggcaaaaatggaattgaagaagtaatccatataaaaatggaagatgatgaaattgaaggatttaaaaaatcttttgaattagttaaaggatactgcagacagattgaatctatttaa

SEQ ID NO: 45305 - protein, 314 aa, Methanococcus maripaludis
MDVSIIGASGKIGSVLSLLLAKESHIKNINLIARSSSINKLKGLKMDLYDAMAAAGQDTDIDICCDDDLSCTANSDITIITAGMARTGEMSRIDLMKGNAKIVKNYVKNIANFGDTKIFMISNPVDLMTYKALIESGYEKNQVFGLGTHLDSMRFKVAVAKHFEVHLDDVRTRIVGEHGDSMVPVISATAVGGIPIKRLPKYEDFPYEKILERIKGYGQEIINLKNGSEYGPASAIVNIVRCIAHDEKRLLTLSTYIEDEIEGIEGGCCIGVPVKVGKNGIEEVIHIKMEDDEIEGFKKSFELVKGYCRQIESI

SEQ ID NO: 45306 - DNA, 939 bp, Moritella sp
  CDS (1)..(939): transl_table=11
atgaaagtcgctgtattaggtgctgctggtggtatcggtcaagctttagcccttcttttgaaaactcaattacctgcgggttctgaactgtcgctatatgatatcgcgccagttacaccgggtgttgctgttgatttaagtcatatccctacagacgttactattactggtttttcgggtatagatccaacggctgcactggttggtgctgacgtggtacttatctcggcgggtgttgctcgtaaaccaggtatggaccgttcagatctattcaatatcaatgctggcattatcaaaaatctagcgagtaaatgtgcggaagtatgcccaacggcatgtatcggtattattactaatccagttaacacgacggtgccaattgcggccgaagtacttaagcaagcgggcgtgtacgacaaacgtaaactattcggtatcactactctggatgttattcgttctgagactttcgtcagtgcgcttaaaggcatttcacttgctgacgttgcagtacccgttatcggtggtcactccggtgcaacaattctgccgctactttctcaagttaaaggtgttgaatttacggctgaagaaattgcgacactcacgacccgcattcaaaacgccggtactgaagtggttgaagctaaagcgggtggcggttctgcgacactttctatgggtcatgccgctgcacgtttcggtctctctctggtgcgcgcactacaaggagaaaaaggtattgttgagtgtacttatgttgacggtggctctgagcacgcgacattcttcgcccaaccggtattactcggtaaaaacggcgttgaagaagtactcgcatacggtgacttaagcgactttgaaaccaacgcacgcgatgctatgttagaagaactaaaagcgaatatcaccttaggtgaagaattcgttgctggttaa

SEQ ID NO: 45307 - protein, 312 aa, Moritella sp
MKVAVLGAAGGIGQALALLLKTQLPAGSELSLYDIAPVTPGVAVDLSHIPTDVTITGFSGIDPTAALVGADVVLISAGVARKPGMDRSDLFNINAGIIKNLASKCAEVCPTACIGIITNPVNTTVPIAAEVLKQAGVYDKRKLFGITTLDVIRSETFVSALKGISLADVAVPVIGGHSGATILPLLSQVKGVEFTAEEIATLTTRIQNAGTEVVEAKAGGGSATLSMGHAAARFGLSLVRALQGEKGIVECTYVDGGSEHATFFAQPVLLGKNGVEEVLAYGDLSDFETNARDAMLEELKANITLGEEFVAG

SEQ ID NO: 45308 - DNA, 945 bp, Myxococcus xanthus
  CDS (1)..(945): transl_table=11
atggctcagaatggcaagaagaagatcggcctcatcggcggcggtcagatcggcggcaacctggcgctgctcgccgtgcagaagtcgctcggtgacgtggtgctgtacgacatcccggcggccgagggtctggtcaagggcaaggcgctggacatcaaccagctggccgcggtcgacggttacgactgccgcgtgaagggcaccacggactggaaggacgtggctggctcggacgtgatcatcatcacggccggcatgccccgcaagccgggcatgtcccgcgaggacctgctcgagatcaacctgaagatcatgacggacgtggcgggcaacatcaagcagcacgcccccaacgccttcgtcatcaacgtggccaacccgctggacgcgatggtgttcgcgctccacaagatcgccggtctgcccaagcacatggtcgcgggcatggcgggcgtgctggacaccagccgcttcaagtgcttcgtcgccgaggcgctgggctgctccatccgcgacgtggaggccctggtgctgggcggccacggcgacgacatggtcccgctcgtccgccacagcacggtgggcggcgtgcccctgacggagctgatcgccaaggacaagctggacgccatcatcaagcgcacccgtgagggcggcgcggagctggtcggtctgtacaagacgggcagcgcctacttcggccccgcggcgtccgccatcgccatggcggagagcttcctgcaggaccgcaagcgcgtgctgccggccgccgccctcctggagggccagtacggcatcaacggctacttcttcggcgtccccgtgcagatcggcgcgggcggcgtggagaagatccacaccgtcgagctgaacgatggtgagaaggccgagctggagaagtccttccagtcggtgaagaagacggtcgactccgtcaagctgtag

SEQ ID NO: 45309 - protein, 314 aa, Myxococcus xanthus
MAQNGKKKIGLIGGGQIGGNLALLAVQKSLGDVVLYDIPAAEGLVKGKALDINQLAAVDGYDCRVKGTTDWKDVAGSDVIIITAGMPRKPGMSREDLLEINLKIMTDVAGNIKQHAPNAFVINVANPLDAMVFALHKIAGLPKHMVAGMAGVLDTSRFKCFVAEALGCSIRDVEALVLGGHGDDMVPLVRHSTVGGVPLTELIAKDKLDAIIKRTREGGAELVGLYKTGSAYFGPAASAIAMAESFLQDRKRVLPAAALLEGQYGINGYFFGVPVQIGAGGVEKIHTVELNDGEKAELEKSFQSVKKTVDSVKL

SEQ ID NO: 45310 - DNA, 939 bp, Oceanobacillus iheyensis
  CDS (1)..(939)
atgggtttaaaacgtaaaaaaatatcagtaattggttcaggtttcactggtgcaactactgctttaatggtggcgcaaaaagaattaggcgatgttgtattagttgatatacctgacatggaagaccctacaaaaggtaaagctctggatatggcagaagcagctcctgttcaagggtttgatgcaaaaattactggtacatctaattatgctgatacagaaggttctgatctcgttatcattacggctggaatcgctcgtaagccaggaatgagtcgtgatgatttagttaatacgaatgctaatataatgaaatccgttaccaaagaaattgtacattactcaccaaatacaacaattgttgtattaactaatccagtggatgcgatgacatatacagtatttaaagagtctgggttaccaaaagagcgtgtgattggacaatctggaattttagatactgcacgtttccgtacatttgtagcagaggagcttaatctttctgtcaaagatgtaactggctttgttttaggtggtcatggagacgatatggttccacttattcgttattcttatgctggtggaattccattagaaaaattaattcctcaagaacgtttagatgcaattgtccaacgtactcgtactggtggaggagaaattgttaatctattaggtaatggtagtgcctattatgcacctgcagcttctttaactgttatggctgaagcaattctaaaagatcaacgccgcgtgttacctactattgcatatcttgaaggtgaatatggatatcaagatatctatttaggcgttccaactatcttaggcggagaaggaattgaagaaattattgagttagacttaacgaaagaagaaaaggcacaacttgataagtctgctgactctgttaaaaatgtactaaatgtacttcaataa

SEQ ID NO: 45311 - protein, 312 aa, Oceanobacillus iheyensis
MGLKRKKISVIGSGFTGATTALMVAQKELGDVVLVDIPDMEDPTKGKALDMAEAAPVQGFDAKITGTSNYADTEGSDLVIITAGIARKPGMSRDDLVNTNANIMKSVTKEIVHYSPNTTIVVLTNPVDAMTYTVFKESGLPKERVIGQSGILDTARFRTFVAEELNLSVKDVTGFVLGGHGDDMVPLIRYSYAGGIPLEKLIPQERLDAIVQRTRTGGGEIVNLLGNGSAYYAPAASLTVMAEAILKDQRRVLPTIAYLEGEYGYQDIYLGVPTILGGEGIEEIIELDLTKEEKAQLDKSADSVKNVLNVLQ

SEQ ID NO: 45312 - DNA, 936 bp, Pasteurella multocida
  CDS (1)..(936): transl_table=11
atgaaagttgcagttctaggtgccgcaggtggtattggtcaagcgttagcattattattgaaattacaattaccagccggttcagagttatcattatatgatattgcccccgtgacaccaggtgttgctgcggatgtcagccatattccaacagctgtaaaagtgcaaggatttgccggtgaagatccaacacctgcattacaaggggctgatgtagtattaatttctgcaggtgttgcacgtaaaccgggtatggatcgttctgatttatttaatattaatgccggtatcgtgcgtaacttaattgagaaagttgcgcaagtttgtccaaaagcttgtgtggggattattactaatcctgtgaatacgacagtagcaattgcggctgaagtattgaaaaaagcgggtgtttacgataagcgtaaattattcggtgtaaccacattagatattattcgttctgaaacctttgtatcagaattgaaaaatttagagccagcgcgcacgacagtgcctgtgattggtgggcattctggtgtcaccattcttccattactttctcaagtccaatacgcagagtggaatgacgcggaaattgcaccattaacaaaacgtattcaaaatgcgggtaccgaagtggtcgaagcaaaagcgggtggtggttcagcaacgttatccatggcacaagccgcagcacgttttgcactttctttagttaaaggcttaaatggggaaaatgtagttgaatgtacttatgtggaaggtgatggcaaatatgcccgtttctttgctcagcctgttcgtttaggtaaagaaggcgttgaagaaattctaccattagggtcattgagtgcatttgaacaacatgcattagatgcaatgttagagacattacgtgcggatattgaattaggcgagaaatttgtcaatcaataa

SEQ ID NO: 45313 - protein, 311 aa, Pasteurella multocida
MKVAVLGAAGGIGQALALLLKLQLPAGSELSLYDIAPVTPGVAADVSHIPTAVKVQGFAGEDPTPALQGADVVLISAGVARKPGMDRSDLFNINAGIVRNLIEKVAQVCPKACVGIITNPVNTTVAIAAEVLKKAGVYDKRKLFGVTTLDIIRSETFVSELKNLEPARTTVPVIGGHSGVTILPLLSQVQYAEWNDAEIAPLTKRIQNAGTEVVEAKAGGGSATLSMAQAAARFALSLVKGLNGENVVECTYVEGDGKYARFFAQPVRLGKEGVEEILPLGSLSAFEQHALDAMLETLRADIELGEKFVNQ

SEQ ID NO: 45314 - DNA, 939 bp, Photorhabdus luminescens
  CDS (1)..(939): transl_table=11
atgaaagttgcagttctcggtgcagccggtggtattggtcaggctcttgctcttctactcaaaacccagcttccttcaggttcagaactttctttatatgatatcgctccagtaacacctggggtggctgttgatctgagccacattccaacggaagtgaaaattaaaggctttgctggtgaagatgcaactccagcgttggaaggagcaaatgttgtattgatttctgctggggttgcccgtaaaccaggcatggatcgttcagatctgtttaatattaatgcggggatcgttcgtaacctggtagaacaagtggctaaaacttgcccgaaatcactgattgggattattactaacccagtcaacacaacggtggctattgcagccgaagtgctgaaaaaagcgggtgtatatgacaaaaaccgcctgtttggtgttacaacgttggatgttattcgttctaatacttttgttgctgaattgaaaggtaaaaaaccacaggaaatcgaagtacccgttatcggtggtcattctggtgtgacaatcttacctctgttgtctcagatccctggtgtgaactttactgatggagagttggctgctttaactaagcgtattcagaatgctggtactgaagttgttgaggctaaggcaggtggaggatctgcaactctgtctatggggcaagctgcggctcgtctgggcctctctttggtccgtggcttacaaggcgaaagtgatgttgtagaatgcgcttatgttgaaggtgatggtaaatatgctcgcttcttcgctcagccagttcgtttgggtaaaaatggcgtagaagagcgtttgaacattggtgagttgagtgattttgaacagaaagcactggaaggcatgctagatgtattgagaaaagatatagaattaggcgaaaaatttattaataactaa

SEQ ID NO: 45315 - protein, 312 aa, Photorhabdus luminescens
MKVAVLGAAGGIGQALALLLKTQLPSGSELSLYDIAPVTPGVAVDLSHIPTEVKIKGFAGEDATPALEGANVVLISAGVARKPGMDRSDLFNINAGIVRNLVEQVAKTCPKSLIGIITNPVNTTVAIAAEVLKKAGVYDKNRLFGVTTLDVIRSNTFVAELKGKKPQEIEVPVIGGHSGVTILPLLSQIPGVNFTDGELAALTKRIQNAGTEVVEAKAGGGSATLSMGQAAARLGLSLVRGLQGESDVVECAYVEGDGKYARFFAQPVRLGKNGVEERLNIGELSDFEQKALEGMLDVLRKDIELGEKFINN

SEQ ID NO: 45316 - DNA, 975 bp, Picrophilus torridus
  CDS (1)..(975): transl_table=11
atggcaagaagcaaaatctcagttataggtgcaggcgctgttggtgctactgttgcacagacgcttgctatcaggcagacaggtgatatatacattttcgatattgttgatggccttgcagagggcaaggcacttgatatccttgaaggtgcaccccattggggctatgatcttgatataaagggattctgcactgcagatgaatcaaagtatgctgagatgaagggctcagacgtcatagttgttacggcaggccttgcaagaaagcccggaatgagcagggatgacctgcttttaaagaacataggcataatgaaatctgtgggagaggccataaaaaaatactcaccggaatcaaagatcgttgttgtaacaaaccctgctgatatcatggcatatgcaatatacaaggcatcaggaataagccctgaaagaataattggccttggtggctcactggacagcacaaggttcagaacattccttgcacaggagctaaacgtatcgtttgaggatgtaaatgcattcgttataggcggccatggggatgacatggtaccatttataagatattcaaatgtctctggaataccaatagaggatcttttgccaagggaaaaaatagatgagatagtaaaaaggacaagattcggcggcggtgagattgtcaacctttacaagaccggatccgcattctatgcaccgggcatatcaatagcggtaatggttgaatcaatagtaaatgaccgcaagcgcgtgataccgtgcgcggcttacataacaggcgagcattcaaagacatatctggtaaataatctcttcataggcgttccaattaagattggcaaaaatggtgttgaaaagatatacgatctaaaattcaatgaagatgagctcgaggcatggaagaaaagcgttgaatctgttaaaaagaacagtgcaatagccgatgattattttgcaaaaaatcaataa

SEQ ID NO: 45317 - protein, 324 aa, Picrophilus torridus
MARSKISVIGAGAVGATVAQTLAIRQTGDIYIFDIVDGLAEGKALDILEGAPHWGYDLDIKGFCTADESKYAEMKGSDVIVVTAGLARKPGMSRDDLLLKNIGIMKSVGEAIKKYSPESKIVVVTNPADIMAYAIYKASGISPERIIGLGGSLDSTRFRTFLAQELNVSFEDVNAFVIGGHGDDMVPFIRYSNVSGIPIEDLLPREKIDEIVKRTRFGGGEIVNLYKTGSAFYAPGISIAVMVESIVNDRKRVIPCAAYITGEHSKTYLVNNLFIGVPIKIGKNGVEKIYDLKFNEDELEAWKKSVESVKKNSAIADDYFAKNQ

SEQ ID NO: 45318 - DNA, 969 bp, Rhizobium loti
  CDS (1)..(969)
atggcacgcaacaagatagcgcttatcggctcgggcatgatcggcggcacgctggcccacatgatcggcctcaaggacctcggcgacgtggtgctgttcgatattgccgagggtattccgcaaggcaaggggctcgatatcgcgcagtcgtcgccggtcgatggtttcgattcccggctgaccggcgtcaacgactatgccggcatcgagggtgccgacgtctgcatcgttacagccggcgtgccgcgcaagcctggcatgagccgcgacgatctgctgggcatcaacctcaaggtcatggaacaggtcggcgccggtctgaagaagtatgcgcccaaggccttcgtcatctgcatcaccaatccgctcgacgccatggtgtgggcgctgcagaagttttccggcctgcccaagacccatgtcgtcggcatggccggcgtgctcgacagcgcgcgcttccgctatttcctggccgaggaattcaaggtctcggtcgaggacgtcaccgccttcgtgctcggcggccacggcgattccatggtgccgatgatccgctactcgacggtatcgggcatcccgctgcccgacctcgtcaagatgggctggacctcgaaggagaagctcgaccagatcgtccagcgcacccgtgatggcggcgccgagatcgtcggcctgctcaagaccggctcggcctattacgcgccggcggcctcggcgattgccatggccgaatcctacctcaaggacaagaagcgcgtgctgccctgcgctgcccacctttccggccagtatggcgtcaagggcacctatgtcggcgtccccgtggtgatcggcgccggcggcgtcgagcgcatcatcgagatcgacctcaacaagagcgaacagaaaatgttcgagagttcggtggcgaccgtgcagggcctgaccgaggcctgcgtcaagatcgcgccgcagctcgcttcgaagtga

SEQ ID NO: 45319 - protein, 322 aa, Rhizobium loti
MARNKIALIGSGMIGGTLAHMIGLKDLGDVVLFDIAEGIPQGKGLDIAQSSPVDGFDSRLTGVNDYAGIEGADVCIVTAGVPRKPGMSRDDLLGINLKVMEQVGAGLKKYAPKAFVICITNPLDAMVWALQKFSGLPKTHVVGMAGVLDSARFRYFLAEEFKVSVEDVTAFVLGGHGDSMVPMIRYSTVSGIPLPDLVKMGWTSKEKLDQIVQRTRDGGAEIVGLLKTGSAYYAPAASAIAMAESYLKDKKRVLPCAAHLSGQYGVKGTYVGVPVVIGAGGVERIIEIDLNKSEQKMFESSVATVQGLTEACVKIAPQLASK

SEQ ID NO: 45320 - DNA, 963 bp, Rhizobium leguminosarum
  CDS (1)..(963): transl_table=11
atggcgcgtaacaagatcgcactcattggttctggcatgattggtggcacgctggcgcacctcgccggcctgaaggaactgggcgacatcgttctcttcgacatcgcggacggcattccccagggcaagggtctcgatatttcccagtcgtcgccggtcgaaggcttcgacgtcaatctgacgggcgccagcgactattccgcgatcgaaggcgctgacgtctgcatcgtcacggcgggcgtcgcccgcaagcccggcatgagccgcgatgaccttctcggcatcaacctcaaggtcatggagcaggtcggcgccggcatcaagaagtatgcgccgaacgctttcgtgatctgcatcaccaatccgctcgacgccatggtctgggcgctgcagaagttttccggtcttccggccaacaaggtcgtcggcatggccggcgttctcgactcctcgcgcttccgtcttttcctcgccaaggaattcaacgtgtccgtacaggacgtcacggccttcgttctcggcggccacggcgacacgatggtgccgctcgcccgctactcgacggtcggcggcattccgctcaccgatctcgtcaccatgggctgggtcaccaaggagcgcctcgaagagatcatccagcgcacccgtgacggcggcgccgaaatcgtcggcctgctgaagaccggctcggcctattacgccccggccgcctcggcgatcgagatggccgaatcctacctcaaggacaagaagcgcgttctgccctgcgcggcccacctctccggtcagtacggcgtcaaggacatgtatgtcggcgttcccaccgtcatcggcgccggcggcgtcgagcgcatcatcgagatcgatctcaacaagaccgagaaggaagccttcgacaagtccgtcggcgccgttgccggtctctgcgaagcctgcatcaacatcgcgcctgccctcaagtag

SEQ ID NO: 45321 - protein, 320 aa, Rhizobium leguminosarum
MARNKIALIGSGMIGGTLAHLAGLKELGDIVLFDIADGIPQGKGLDISQSSPVEGFDVNLTGASDYSAIEGADVCIVTAGVARKPGMSRDDLLGINLKVMEQVGAGIKKYAPNAFVICITNPLDAMVWALQKFSGLPANKVVGMAGVLDSSRFRLFLAKEFNVSVQDVTAFVLGGHGDTMVPLARYSTVGGIPLTDLVTMGWVTKERLEEIIQRTRDGGAEIVGLLKTGSAYYAPAASAIEMAESYLKDKKRVLPCAAHLSGQYGVKDMYVGVPTVIGAGGVERIIEIDLNKTEKEAFDKSVGAVAGLCEACINIAPALK

SEQ ID NO: 45322 - DNA, 963 bp, Rhizobium meliloti
  CDS (1)..(963): transl_table=11
atggcgcgcaacaagatcgcacttatcggttcggggatgattggtggcacgctggcgcatctcgccggcctgaaggaactgggcgacatcgtcctcttcgacattgccgacggcattccccagggcaagggtctcgacatcgcgcagtcctccccggtcgagggcttcgatgcatcgctgaccggtgcgagcgactattccgcgatcgagggcgccgacgtctgcatcgtcaccgccggcgtgccgcgcaagcccggcatgagccgcgacgatctgctcggcatcaacctcaaggtcatggaacaggtcggcgccggcatcaagaaatacgctccgaacgccttcgtcatctgcatcaccaacccgctcgacgccatggtctgggcgctgcagaagttctccggcctgccgaagaacaaggtcgtcggcatggccggcgtgctcgactcttcgcgcttccggctcttcctcgccgaagagttcaacgtctctgtcaaggacatcaccgctttcgtgctcggcggccatggcgacaccatggtgccgctcgcgcgttattcgacggttgccggcatcccgctgcccgacctgatccagatgggttggaccaccaaggaaaagctcgaccagatcattcagcgcacccgtgacggcggcgccgagatcgtcggcttgctcaagaccggctcggcctattatgcgccggccgcctcggcgatcgaaatggccgaagcctatctcaaggacaagaagcgcgtgctgccctgcgccgctcatctctccggccagtatggcgtcaaggacatgtatgtcggcgtgcccaccgtgatcggtgccggcggcatcgagcgcatcatcgagatcgacctcaacaagggcgagaaggaagccttcgacaagtcggttgcggccgtcgccggcctttgcgaagcctgcatcaacatcgcacccagcctgaagtaa

SEQ ID NO: 45323 - protein, 320 aa, Rhizobium meliloti
MARNKIALIGSGMIGGTLAHLAGLKELGDIVLFDIADGIPQGKGLDIAQSSPVEGFDASLTGASDYSAIEGADVCIVTAGVPRKPGMSRDDLLGINLKVMEQVGAGIKKYAPNAFVICITNPLDAMVWALQKFSGLPKNKVVGMAGVLDSSRFRLFLAEEFNVSVKDITAFVLGGHGDTMVPLARYSTVAGIPLPDLIQMGWTTKEKLDQIIQRTRDGGAEIVGLLKTGSAYYAPAASAIEMAEAYLKDKKRVLPCAAHLSGQYGVKDMYVGVPTVIGAGGIERIIEIDLNKGEKEAFDKSVAAVAGLCEACINIAPSLK

SEQ ID NO: 45324 - DNA, 948 bp, Rhodopirellula baltica
  CDS (1)..(948): transl_table=11
atgcgtcgcgcaaagatcaccattgtcggagccggaaatgttggtgccacctgtgctcactggtgtgcggccgcagaactcggcgatgttgtcctgctggacattccccgaaccgaagacatgcctcgcggcaaggcactggacctaatgcaagcctcgccaatcatggggtttgactcgaacatcgtcggtaccaccgactacgccgacacggccgacagtgatgtgatcgtcgtcaccgctggattgccacgcaaacctggcatgagccgcgacgacttgctggccaccaacgcgaaaattgtgaccagcgttgcggaagaaatcaaagccaccagccctaacgctgtgatcattgttgtcagcaatccgctcgacgcgatggttcagcagatgttcaaagtcaccggcttcgaacctgccaaagtcatcggccaagccggcgttttggacaccgctcgctaccgcacattcctggcaatggaattgggcgtcagtgtcgaagacatcagcgctttgttgatgggcggacacggcgacacgatggtgcctgtcccaagctgcaccagcgttggcggcatccctgtcacccaactgatctccaaggaacgcttggacgaaatcgttgaccggactcgcaagggcggagccgaaatcgtttcgctgctgaagaccggcagcgcttactatgctcccgctgcggcttgtgcccaaatggtcgaagcgatcgtcaaagacaaaaagcgagtcatccctgtcgccgcatactgcgattccgaatacggcgtcggcggttactacgtcggcgtccctgttgtcctgggcagcggcggtgtagaacgcatcatcgaattgtcgctgaccgacgaagaaaccaaggcgttccagaacagcgtcgacgcggtcaaatcgctcgtttcgaccatggacgggctgctcgcggagtga

SEQ ID NO: 45325 - protein, 315 aa, Rhodopirellula baltica
MRRAKITIVGAGNVGATCAHWCAAAELGDVVLLDIPRTEDMPRGKALDLMQASPIMGFDSNIVGTTDYADTADSDVIVVTAGLPRKPGMSRDDLLATNAKIVTSVAEEIKATSPNAVIIVVSNPLDAMVQQMFKVTGFEPAKVIGQAGVLDTARYRTFLAMELGVSVEDISALLMGGHGDTMVPVPSCTSVGGIPVTQLISKERLDEIVDRTRKGGAEIVSLLKTGSAYYAPAAACAQMVEAIVKDKKRVIPVAAYCDSEYGVGGYYVGVPVVLGSGGVERIIELSLTDEETKAFQNSVDAVKSLVSTMDGLLAE

SEQ ID NO: 45326 - DNA, 969 bp, Rhodopseudomonas palustris
  CDS (1)..(969): transl_table=11
atggcgcgcgataaaattgctttgattggctccggccagatcggcggtacgctggcacatttggtcgggttgaaagagctcggcgacgtggtgctgttcgacattgccgagggcgtgccgcagggcaaggcgctcgacatcgcggagtcctcgccggtcgacggtttcgactccaagctgaccggtgccaactcctacgaggcgatcgaaggcgcccgcgtggtgatcgtcaccgccggcgtgccgcgcaagccgggcatgagccgtgacgatctgctcagcatcaacctcaaggtgatggagcaggtcggcgctggcatcaagaagtacgcgcccgacgcgttcgtgatctgcatcaccaacccgctcgacgcgatggtctgggcgctgcagaaggcctcgggcctgccggccaagaaggttgtcggcatggccggcgtgctcgactcggcgcggttccgttacttcctggccgacgagttcaacgtgtcggtcgaagacgtcaccgccttcgtgctcggcggccacggtgataccatggtgccgctggtgaagtactcgaccgtcgccggaattccgctgcccgacctggtcaagatgggctggacctcgcaggcgcgcctcgatgagatcgtcgaccgcacccgcaacggcggcgccgagatcgtcaacctgctgaagaccggctcggcgttctacgccccggcgtcgtcggcgatcgcgatggccgagagctatctgaaggacaagaagcgggtggtgccggtcgcggcccacctcaacggcgaatacggcgtcaaggacatgtatgtcggcgttccggtggtgatcggcgacaagggcgtcgagcgcatcgtcgagatcgagctggccggcaaggacaaggaagcgttcgacaggtcggtcgctgccgttcagggcctggtcgaggcctgcaagaagattgcgcccgatctgctcggtcgctga

SEQ ID NO: 45327 - protein, 322 aa, Rhodopseudomonas palustris
MARDKIALIGSGQIGGTLAHLVGLKELGDVVLFDIAEGVPQGKALDIAESSPVDGFDSKLTGANSYEAIEGARVVIVTAGVPRKPGMSRDDLLSINLKVMEQVGAGIKKYAPDAFVICITNPLDAMVWALQKASGLPAKKVVGMAGVLDSARFRYFLADEFNVSVEDVTAFVLGGHGDTMVPLVKYSTVAGIPLPDLVKMGWTSQARLDEIVDRTRNGGAEIVNLLKTGSAFYAPASSAIAMAESYLKDKKRVVPVAAHLNGEYGVKDMYVGVPVVIGDKGVERIVEIELAGKDKEAFDRSVAAVQGLVEACKKIAPDLLGR

SEQ ID NO: 45328 - DNA, 945 bp, Rickettsia conorii
  CDS (1)..(945): transl_table=11
atgaaacaaaacgcaaaaatctcattaataggtagcggtaacataggtggtacacttgctcacttaattagccttagagaactcggcgatatcgtgttatttgatgtgactgaaggagtaccgcaaggaaaagcattggatctcatgcaagccggtacaatagccgggtctgatatcaaaataaaaggcacaaacgactataaagatattgaaggatctgatgccataattattactgccggtttaccaagaaaaccagggatgagtagagaagatttaattagcattaacaccggtattatgaaaacggttgcagcaaatgttaaaaaatacgctcctgatgcctttgtaatagtaattaccaatccacttgatgttatggtatatgtcatgcttaaagaaagcggattgcctcacaataaagtaatcggtatggcaggagtacttgactcatcaagatttaatctttttcttgctgaagagtttaaagtatcggttaacaatgttaatagcatggttctcggcggtcacggcgatgctatggtacctcttgcaagatattctacaatatcaggcgtaccgatacctgacttgataaaaatgggcttatcaagtaatgaaaatattgaaaaaataatcgatcgtactagaaacggcggcggtgagattgttgcattacttaaaacaggttctgcttattatgctcccgcagcctcagcaatagaaatgcttgagtcatatttaaaagataaacgtcagattctaacttgtgccgctcatttacaaggtgagtacggcgtacatgatttatatgtcggagtgcctattatgatcggtaaagaaggtgttctaagagtaatagaactgcagttaaccgcagaggaaaaagcactatttgataaatcagtcgagggagttaaaaaactcattgagacgataaaataa

SEQ ID NO: 45329 - protein, 314 aa, Rickettsia conorii
MKQNAKISLIGSGNIGGTLAHLISLRELGDIVLFDVTEGVPQGKALDLMQAGTIAGSDIKIKGTNDYKDIEGSDAIIITAGLPRKPGMSREDLISINTGIMKTVAANVKKYAPDAFVIVITNPLDVMVYVMLKESGLPHNKVIGMAGVLDSSRFNLFLAEEFKVSVNNVNSMVLGGHGDAMVPLARYSTISGVPIPDLIKMGLSSNENIEKIIDRTRNGGGEIVALLKTGSAYYAPAASAIEMLESYLKDKRQILTCAAHLQGEYGVHDLYVGVPIMIGKEGVLRVIELQLTAEEKALFDKSVEGVKKLIETIK

SEQ ID NO: 45330 - DNA, 945 bp, Rickettsia prowazekii
  CDS (1)..(945): transl_table=11
atgaaaaaaaatccaaaaatctcattaataggtagtggtaacataggtggtacactcgctcacttaattagtcttaaaaaactcggtgatattgtattatttgacgtatctgaaggtctaccgcaaggaaaggcattagacctcatgcaagccgctacaatagaagggtctgatattaaaataaaaggtacaaacgattatagagatattgaaggctctgacgcagtaattattactgcaggtttaccaagaaaaccaggcatgagtagagatgatttaattagcgttaatacaaaaattatgaaagacgtagcacaaaatataaaaaaatatgctcagaatgcttttgtaatagtgattactaatccactagatattatggtatatgtcatgcttaaagaaagcggattacctcataataaagtaattggtatggcaggggtactcgactcctcaagatttaatctgtttcttgctaaagagtttaaagtatcagttaaaaatgttaatagtatagttctcggtggtcacggtgacactatggtaccactcttacgatattctacaatatcaggagtgccgatacctgacttaataaaaatgggcttatcaagtaataaaaatattgaaaaaataattgatcgtacaaaaaatggaggcggagagattgttaaattgcttaaaacaggttctgcttattatgctcctgcagcatcagcaattgcaatgcttgaatcatatttaaaagataaacgtcagattctaacttgtgccgcttatttacaaggtgaatatgacatacatgatttatatatcggagtcccgattattataggtaaagaaggtgtgataaaagtaatagaactacagttaacagaagaggaaaaaatactattttataaatcagtcacagaagtaaaaaaactcattgatacaatacaataa

SEQ ID NO: 45331 - protein, 314 aa, Rickettsia prowazekii
MKKNPKISLIGSGNIGGTLAHLISLKKLGDIVLFDVSEGLPQGKALDLMQAATIEGSDIKIKGTNDYRDIEGSDAVIITAGLPRKPGMSRDDLISVNTKIMKDVAQNIKKYAQNAFVIVITNPLDIMVYVMLKESGLPHNKVIGMAGVLDSSRFNLFLAKEFKVSVKNVNSIVLGGHGDTMVPLLRYSTISGVPIPDLIKMGLSSNKNIEKIIDRTKNGGGEIVKLLKTGSAYYAPAASAIAMLESYLKDKRQILTCAAYLQGEYDIHDLYIGVPIIIGKEGVIKVIELQLTEEEKILFYKSVTEVKKLIDTIQ

SEQ ID NO: 45332 - DNA, 939 bp, Salmonella typhimurium
  CDS (1)..(939): transl_table=11
atgaaagtcgcagtcctcggcgctgctggtggtatcggtcaggcgctggcattacttttaaaaaaccaactgccttcaggttcagaactctccctgtacgacatcgctccagtgactcccggtgtggccgttgatttgagccacatccccaccgctgtaaaaatcaaaggtttctccggtgaagacgcaaccccggcgcttgaaggcgctgacgtagtactgatttctgcgggtgtggcgcgtaagccgggtatggaccgttccgacctgtttaacgttaacgccggcatcgtgaaaaacctggtgcagcagatcgctaaaacctgcccgaaagcgtgcgtgggcattatcaccaacccggtgaacaccaccgttgcgattgcggcggaagtgctgaaaaaagcaggcgtatacgacaaaaacaaactgtttggcgttaccacgctggatatcatccgctctaatacctttgttgcagagctgaaaggtaagctgccaacggaagttgaagtgccggtgattggcgggcactccggcgtgacgattctgccgctgctgtcgcagattccaggcgtaagttttaccgaacaagaagcggccgagctgactaaacgtattcagaacgccggtactgaagtcgtcgaggcgaaagccggcggcggatcggcaaccctctctatgggccaggctgccgcgcgtttcggtctttctctggttcgcgctctgcagggcgagaagggcgtggtggaatgcgcctatgtggaaggcgacggtcagtatgcccgtttcttctctcagccgctgctgctgggtaaaaacggcgtagaagagcgtaaatccatcggcacactgagcgctttcgagcaacattcgctggacgctatgctggatacgctgaaaaaagatattcagttgggtgaagattttattaataaataa

SEQ ID NO: 45333 - protein, 312 aa, Salmonella typhimurium
MKVAVLGAAGGIGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAAELTKRIQNAGTEVVEAKAGGGSATLSMGQAAARFGLSLVRALQGEKGVVECAYVEGDGQYARFFSQPLLLGKNGVEERKSIGTLSAFEQHSLDAMLDTLKKDIQLGEDFINK

SEQ ID NO: 45334 - DNA, 936 bp, Shewanella oneidensis
  CDS (1)..(936): transl_table=11
atgaaagttgctgtacttggtgctgctggtggtatcggccaggctcttgccctactgttaaaaactcaattacctgcgggttctaaactgtctctatacgatatcgcaccggtaactccgggtgttgcggttgacttgagccatatccccactgcggttgaaatcaaaggttttgctggtgaagatccaacgcctgccctcgtgggtgctgacgttgtgctaatttctgctggtgttgcacgtaagcctggtatggatcgttcagatctgttcaatatcaacgctggtatcgttcgcaacctgatcgagaaagtggcagtcacttgccctaaagcgctcgtgggtattatcactaacccagtcaacactacggttgctatcgcagctgaagtgatgaaaaaagcgggtgtttacgataagaaccgtttattcggtgtgaccactctggacgttatccgttctgagactttcatcgctgaattaaaaggcttaaacgttgctgacgttaaaatcaacgtgattggcggccacagcggtgtgaccattctgccattactgtctcaagttgaaggcgtgactttctctgatgaagaagtggcttctttaactaaacgcatccaaaacgcgggtactgaagtggttgaagctaaagccggtggcggcagcgcgactctgtctatgggtcaagcggcttgccgttttggtatgtctctggttcgtggcctacaaggcgaagcgaatgttgttgaatgtgcctatgttgacggcggcagtgagcatgctgaattcttcgctcaaccagtactgttaggcaaaaacggtatcgaaaaagtactgccttacggtgaagtgagcgcattcgaagcaaatgcccgtgattctatgttagatacactgaaaggtgatatcaaactaggcgttgatttcgttaagtaa

SEQ ID NO: 45335 - protein, 311 aa, Shewanella oneidensis
MKVAVLGAAGGIGQALALLLKTQLPAGSKLSLYDIAPVTPGVAVDLSHIPTAVEIKGFAGEDPTPALVGADVVLISAGVARKPGMDRSDLFNINAGIVRNLIEKVAVTCPKALVGIITNPVNTTVAIAAEVMKKAGVYDKNRLFGVTTLDVIRSETFIAELKGLNVADVKINVIGGHSGVTILPLLSQVEGVTFSDEEVASLTKRIQNAGTEVVEAKAGGGSATLSMGQAACRFGMSLVRGLQGEANVVECAYVDGGSEHAEFFAQPVLLGKNGIEKVLPYGEVSAFEANARDSMLDTLKGDIKLGVDFVK

SEQ ID NO: 45336 - DNA, 948 bp, Staphylococcus epidermidis
  CDS (1)..(948): transl_table=11
ttgcttatggtcaatagaagaaagatatcaattattggcgcgggacatacaggtgggactctagcattcattcttgcacaaaaggaattaggagatattgtgttgattgaacgccagcaatcagagggtatggctaaaggaaaggcgttagatattttagaaagcggacccatttgggggtttgacacatctgtacatggttcagtaaatatagaagatattaaagattcagacatagtggtgatgactgcaggtatacctaggaaatcaggaatgacaagagaagaattagttcaaactaatgaacaaatagtacgagaaactgcattacaaattgcaacgtatgcacctcattcaataattattgtattgactaatccggttgatgttatgacatatactgcatttaaagcatcaggttttcctaaagaacgtattattggtcaatctggaattttagacgctgcaagatatcgaacttttattgctcaagaacttaacgtgtctgtcaaagatgtaaatgggtttgttttaggtggacatggtgatacgatgttacctttgattaataacacacacattaatgggattccagttaagcatcttatttctgaagaaaagattgatcaaattgttgaacgtacacgtaagggtggtgcagaaattgttgcattactaggtcaaggctcagcatattatgcaccagcaactgctatatatgaaactatagatgcaatttttaatgatcggaaacggttattaccaagtattgcttatctagagggagaatacggttgttcagatatttgtttcggagttcctactataataggatatcaaggaatagaaaagattatagaggtagatatgaataatgatgagtatcaacaactacaacactctgcgcaagctgtgagtgaagtcaaaaactcactaaaattcaaataa

SEQ ID NO: 45337 - protein, 315 aa, Staphylococcus epidermidis
MLMVNRRKISIIGAGHTGGTLAFILAQKELGDIVLIERQQSEGMAKGKALDILESGPIWGFDTSVHGSVNIEDIKDSDIVVMTAGIPRKSGMTREELVQTNEQIVRETALQIATYAPHSIIIVLTNPVDVMTYTAFKASGFPKERIIGQSGILDAARYRTFIAQELNVSVKDVNGFVLGGHGDTMLPLINNTHINGIPVKHLISEEKIDQIVERTRKGGAEIVALLGQGSAYYAPATAIYETIDAIFNDRKRLLPSIAYLEGEYGCSDICFGVPTIIGYQGIEKIIEVDMNNDEYQQLQHSAQAVSEVKNSLKFK

SEQ ID NO: 45338 - DNA, 978 bp, Thermoplasma acidophilum
  CDS (1)..(978): transl_table=11
atggcaagaaagaagatttctgtaataggcgccggaaatgtaggtgccacagtcgcacagttcttggccgcaaaacagctcggcgatgtttatctgtttgatgttgtagatggaattcctgagggaaaggctctggatattcaggagggagctccacactggagatacgatcttgatgtggtgggtttcagtacgagtgatgaaaccaagtacaagaacatggagggcagcgacgtcatagtcgttacggctggactggcaaggaagccagggatgagcagggacgatctctttgacaagaacgtggagataatatctgacgtttcgagaaacataaagaaatactcgccagattcaataatagtggtggtatcaaacccagccgatataatggcctatgcattgcagaagtttaccggcatagatccatcgaagataatgggtctcggcggatctcttgacagttcaaggttcagaacctttctcgcaaaggaattgaatgtgtctgttgaagacgttaacgcattcgtcattgggggacacggagatgatatggtgccgttcatacgatactccagcgttgccggcatacccatagagaacctgctttcaaaggagaagatcgatgagatagtgaagaggacgaggtttggcggcggagagatcgtgaactatctgaagacaggcagcgctttctacgcacctggcatatccataaccgcgatggtggaatctgtgatcatggacaagaaacgcgtcataccgtgcgcagcttacataaccggcaagcatgcggaccactacggaataagggacaagttcataggcgtgccgataaagatcggagagaagggtgtagaacagatatacgacatagacttcaagccggatgaacttgagctctggaagaagagtgtggcttcagttgaggccagctcaaagaaagtggacgagtggatcgcaaagcacgcccactga

SEQ ID NO: 45339 - protein, 325 aa, Thermoplasma acidophilum
MARKKISVIGAGNVGATVAQFLAAKQLGDVYLFDVVDGIPEGKALDIQEGAPHWRYDLDVVGFSTSDETKYKNMEGSDVIVVTAGLARKPGMSRDDLFDKNVEIISDVSRNIKKYSPDSIIVVVSNPADIMAYALQKFTGIDPSKIMGLGGSLDSSRFRTFLAKELNVSVEDVNAFVIGGHGDDMVPFIRYSSVAGIPIENLLSKEKIDEIVKRTRFGGGEIVNYLKTGSAFYAPGISITAMVESVIMDKKRVIPCAAYITGKHADHYGIRDKFIGVPIKIGEKGVEQIYDIDFKPDELELWKKSVASVEASSKKVDEWIAKHAH

SEQ ID NO: 45340 - DNA, 978 bp, Thermoplasma volcanium
  CDS (1)..(978)
atggcaagaaaaaagatttctgtaataggcgccggcaatgtaggcgcaacagttgcccagtttttagcaacaaaagagcttggcgatgtatacttattcgatgttgttgatgggattccagaaggaaaagctctagatattcaggaaggagcaccacactggggatatgatcttgacgttgtaggctttagtacatcagattcctcgaattacaaaaatatggagggatcagacgttatagtagtaactgccggaatggcaagaaaaccaggaatgagcagagaggacctatttgacaaaaatgtagagataattgcagatgtatctaagaacataaagaagtattcacctgattctataatagttgttgtttctaaccctgccgacataatggcatatgcccttcagaagatttccggtgttgatccgcaaagaataatgggtttaggcggttcattggatagttccaggttcaggacatttcttgctaaggagctcgacgtttcagtagaagacgtaaacgcttttgttattggaggccacggagatgatatggtgccatttataaggtactctagcgttgctggaattccaatagagaagctgcttcccaaagaaaagatagacgcaatcgtaaagaggaccaggtttggcggtggggaaatagtgaattacctcaaggcaggaagtgcttactatgcgcctgggatatccataacggctatggttgaatccgtcatcaaggataagaagagagtcataccatgcgcagcctatataacgggaaaacatgctgagcactacggaataaacaacaagttcataggtgttccaattaaaatcggtgaaagaggagttgaagagatctacgacatagacttcctgccagaggagcttgaactctggaagaagagtgtggcctctgttgaggcaagctcgaagaatgttgacgagtggttgaagaagcatccccagtag

SEQ ID NO: 45341 - protein, 325 aa, Thermoplasma volcanium
MARKKISVIGAGNVGATVAQFLATKELGDVYLFDVVDGIPEGKALDIQEGAPHWGYDLDVVGFSTSDSSNYKNMEGSDVIVVTAGMARKPGMSREDLFDKNVEIIADVSKNIKKYSPDSIIVVVSNPADIMAYALQKISGVDPQRIMGLGGSLDSSRFRTFLAKELDVSVEDVNAFVIGGHGDDMVPFIRYSSVAGIPIEKLLPKEKIDAIVKRTRFGGGEIVNYLKAGSAYYAPGISITAMVESVIKDKKRVIPCAAYITGKHAEHYGINNKFIGVPIKIGERGVEEIYDIDFLPEELELWKKSVASVEASSKNVDEWLKKHPQ

SEQ ID NO: 45342 - DNA, 933 bp, Vibrio vulnificus
  CDS (1)..(933): transl_table=11
atgaaagtagctgttattggtgccgctggtggcatcggtcaagccctagctcttttactgaaaaaccgccttccagcgggttctgatttagccctatatgatattgctccggttactccgggtgttgctgcagacctaagccacatcccaacccacgtttcgatcaaaggttatgccggtgaagatccaacgccagcactagaaggtgctgatgtggttcttatttctgctggtgttgcgcgtaagccaggtatggatcgtgcggatctatttaatgtcaatgctggtatcgtcaaatcacttgctgagcgcattgccgtggtttgtccaaatgcttgtattggtatcatcaccaacccggtgaacaccactgtgccaattgcagcagaagttctgaaaaaagcgggcgtttatgacaagcgtaaactttttggtgtgacgacgttggatgtgatccgttcagaaacgtttgttgctgagctgaaaggtcaagatccaggtgaagtccgtgtaccagtgattggtggtcactctggtgtgacgattctgcctcttctttctcaagtggaaggtgtcgagtttagcgacgaagaaattgcagccctaaccaaacgtatccaaaatgcaggtactgaagtggttgaagcgaaagcgggtggcggtagtgcaacactttcaatgggtcaggctgcgtgtcgctttggtcttgcgctcgtgaaagcactgcagggtgaagaagtgatcgaatacgcttacgttgaaggtaacggcgagcatgctagcttctttgcacagccagtgaaacttggcaaagagggtgttgaagagatcctaccttacggtgagctaagtgatttcgaaaaagcagcgctagatggcatgctagaaacgcttaacagtgacattcaaattggcgtggacttcgtaaagtaa

SEQ ID NO: 45343 - protein, 310 aa, Vibrio vulnificus
MKVAVIGAAGGIGQALALLLKNRLPAGSDLALYDIAPVTPGVAADLSHIPTHVSIKGYAGEDPTPALEGADVVLISAGVARKPGMDRADLFNVNAGIVKSLAERIAVVCPNACIGIITNPVNTTVPIAAEVLKKAGVYDKRKLFGVTTLDVIRSETFVAELKGQDPGEVRVPVIGGHSGVTILPLLSQVEGVEFSDEEIAALTKRIQNAGTEVVEAKAGGGSATLSMGQAACRFGLALVKALQGEEVIEYAYVEGNGEHASFFAQPVKLGKEGVEEILPYGELSDFEKAALDGMLETLNSDIQIGVDFVK

SEQ ID NO: 45344 - DNA, 951 bp, Wolbachia pipientis wMel
  CDS (1)..(951): transl_table=11
atgacagtacaaagaaaaaaaatatctttaatcggtgcaggaaatatcggtggaactctcacccatatgattgcactaagggaactcggtgatgttgttttacttgatattagtgatggaataccacaaggtaaagcactcgacatagcagaatcatcccctattgatggatttaatgtcaatattactggcacaaataggtatgaagatataaaaaactccgatgcaattataataaccgctggcatcgctagaaaacctggaatgagcagggatgacctcctgcaaaccaatgctaaagtaatgaaggaggttggcgaaaatattaaaaaatattctccaaacgcgtttgtaatagtggttaccaaccctttggatgccatggtttcagtggtgcataaattttcaaaccttccaactaatatgattgttggcatggcaggagtgcttgattcttcccgttttcgttactttcttgcaagtgagttaaatatctcagttgaagatatatctgcttttgtgcttggaggacatggcgacactatggtaccactaatcaattgtgcttcagttgctggagttccacttactcaaattatcgatatgggtcttatcacacagaaaaaagtcgatgaaatagttgaacgcactcgcaatggcggtaaagaaatagttgatctgcttaagtctggatctgcatactacgctcctgcatcttcagctatatgcatgttagaatcatatttaaaagataagaggcgcatattaccatgtgctgcttaccttaatggtgaatatggtgtagaagagttgtttattggtgttcctgtaattattggaaaaaacggaattgaaaagatcctagaagttaaaatgaatgatagtgaacaagaaatgtttaataagtctgtaaactcggtgagagagctggtgaaatctttaggttcataa

SEQ ID NO: 45345 - protein, 316 aa, Wolbachia pipientis wMel
MTVQRKKISLIGAGNIGGTLTHMIALRELGDVVLLDISDGIPQGKALDIAESSPIDGFNVNITGTNRYEDIKNSDAIIITAGIARKPGMSRDDLLQTNAKVMKEVGENIKKYSPNAFVIVVTNPLDAMVSVVHKFSNLPTNMIVGMAGVLDSSRFRYFLASELNISVEDISAFVLGGHGDTMVPLINCASVAGVPLTQIIDMGLITQKKVDEIVERTRNGGKEIVDLLKSGSAYYAPASSAICMLESYLKDKRRILPCAAYLNGEYGVEELFIGVPVIIGKNGIEKILEVKMNDSEQEMFNKSVNSVRELVKSLGS

SEQ ID NO: 45346 - DNA, 945 bp, Wolinella succinogenes
  CDS (1)..(945): transl_table=11
gtgggaatcatcggggcgggtcatgtgggatcaaccgtcgcctttatcttggcgactcaagggatttgtcaagagattatcatcaaagatctcaacctcgacaccgccagaggaatcgccctggatatgggtcacgccgcctcggcgacgaagactcacaccatcgtgcgtgttgccaatgaaccctcggatttgcgagggtgcgatgtggtggttttttgtgcaggctctccaagacagcctgggatgagtcgcgatgatcttttattggccaatgccaaggtgattcgtaccgttttatctgaagtgaagccctacatccaagagagcgttttggtgatggtctccaatccgctggatgccatggtttatacagcgattaaagagagcgggctctctcctttgcaggtgttgggaatggcaggaatcctagatagcgcccgaatggcctcctttatctttgagaaactcggctatggaagcgatcagattgtggcctcagtgatggggggacatggagatgatatggtgcccttgcctcgctatagtaatgtcgcaggggttcctatcacggagcttcttgagcctcaagagattgaagagatcatccatcgcacccgaaacgcaggagcagagattgtaggctatctcaaaaaaggctctgcctattttgctcccgccaaatcgaccgcgattatggttgaggcaattttgaaaaactctcatcaggtttttccctgctcggtgcttttgcagggcgagtatggctacagcgatgtggtggggggtgtgcccgtgaagcttggcagtcgaggggtctgtgagatcattgaacttgagcttcttcatgaggagagagagcgctttgaccagtcgatccagtcggttaaaagtctcattgatgccctctatcaccacgccttttttgtttctagtcgtccctag

SEQ ID NO: 45347 - protein, 314 aa, Wolinella succinogenes
MGIIGAGHVGSTVAFILATQGICQEIIIKDLNLDTARGIALDMGHAASATKTHTIVRVANEPSDLRGCDVVVFCAGSPRQPGMSRDDLLLANAKVIRTVLSEVKPYIQESVLVMVSNPLDAMVYTAIKESGLSPLQVLGMAGILDSARMASFIFEKLGYGSDQIVASVMGGHGDDMVPLPRYSNVAGVPITELLEPQEIEEIIHRTRNAGAEIVGYLKKGSAYFAPAKSTAIMVEAILKNSHQVFPCSVLLQGEYGYSDVVGGVPVKLGSRGVCEIIELELLHEERERFDQSIQSVKSLIDALYHHAFFVSSRP

SEQ ID NO: 45348 - DNA, 24 bp, Artificial sequence
  (1)..(24): primer
atggtcaaagtcgcaattcttggc

SEQ ID NO: 45349 - DNA, 24 bp, Artificial sequence
  (1)..(24): primer
tcatagcttggaagagtctaggat

SEQ ID NO: 45350 - protein, 533 aa, Artificial sequence
  Variant (2)..(2): xaa in position 2 is any amino acid
  Variant (6)..(6): xaa in position 6 is any amino acid
  Variant (9)..(10): xaa in position 9 to 10 is any amino acid
  Variant (13)..(13): xaa in position 13 is any amino acid
  Variant (16)..(22): xaa in position 16 to 22 is any amino acid
  Variant (23)..(34): xaa in position 23 to 34 is any or no amino acid
  Variant (36)..(36): xaa in position 36 is any amino acid
  Variant (41)..(44): xaa in position 41 to 44 is any amino acid
  Variant (45)..(49): xaa in position 45 to 49 is any or no amino acid
  Variant (51)..(51): xaa in position 51 is any amino acid
  Variant (53)..(53): xaa in position 53 is any amino acid
  Variant (56)..(75): xaa in position 56 to 75 is any amino acid
  Variant (76)..(84): xaa in position 76 to 84 is any or no amino acid
  Variant (86)..(88): xaa in position 86 to 88 is any amino acid
  Variant (94)..(94): xaa in position 94 is any amino acid
  Variant (98)..(98): xaa in position 98 is any amino acid
  Variant (107)..(232): xaa in position 107 to 232 is any or no amino acid
  Variant (235)..(237): xaa in position 235 to 237 is any amino acid
  Variant (240)..(240): xaa in position 240 is any amino acid
  Variant (243)..(244): xaa in position 243 to 244 is any amino acid
  Variant (246)..(253): xaa in position 246 to 253 is any amino acid
  Variant (254)..(255): xaa in position 254 to 255 is any or no amino acid
  Variant (257)..(257): xaa in position 257 is any or no amino acid
  Variant (259)..(259): xaa in position 259 is any or no amino acid
  Variant (261)..(261): xaa in position 261 is any or no amino acid
  Variant (268)..(270): xaa in position 268 to 270 is any or no amino acid
  Variant (272)..(272): xaa in position 272 is any amino acid
  Variant (273)..(285): xaa in position 273 to 285 is any or no amino acid
  Variant (287)..(287): xaa in position 287 is any amino acid
  Variant (288)..(288): xaa in position 288 is any or no amino acid
  Variant (290)..(295): xaa in position 290 to 295 is any amino acid
  Variant (297)..(301): xaa in position 297 to 301 is any amino acid
  Variant (304)..(305): xaa in position 304 to 305 is any amino acid
  Variant (307)..(309): xaa in position 307 to 309 is any amino acid
  Variant (313)..(324): xaa in position 313 to 324 is any amino acid
  Variant (325)..(342): xaa in position 325 to 342 is any or no amino acid
  Variant (348)..(351): xaa in position 348 to 351 is any amino acid
  Variant (353)..(354): xaa in position 353 to 354 is any amino acid
  Variant (356)..(365): xaa in position 356 to 365 is any amino acid
  Variant (366)..(378): xaa in position 366 to 378 is any or no amino acid
  Variant (380)..(385): xaa in position 380 to 385 is any amino acid
  Variant (388)..(388): xaa in position 388 is any amino acid
  Variant (392)..(393): xaa in position 392 to 393 is any amino acid
  Variant (394)..(398): xaa in position 394 to 398 is any or no amino acid
  Variant (400)..(400): xaa in position 400 is any or no amino acid
  Variant (402)..(402): xaa in position 402 is any or no amino acid
  Variant (404)..(408): xaa in position 404 to 408 is any or no amino acid
  Variant (410)..(411): xaa in position 410 to 411 is any or no amino acid
  Variant (413)..(413): xaa in position 413 is any or no amino acid
  Variant (415)..(415): xaa in position 415 is any amino acid
  Variant (417)..(424): xaa in position 417 to 424 is any or no amino acid
  Variant (426)..(432): xaa in position 426 to 432 is any amino acid
  Variant (433)..(435): xaa in position 433 to 435 is any or no amino acid
  Variant (438)..(439): xaa in position 438 to 439 is any amino acid
  Variant (440)..(466): xaa in position 440 to 466 is any or no amino acid
  Variant (468)..(485): xaa in position 468 to 485 is any or no amino acid
  Variant (487)..(487): xaa in position 487 is any or no amino acid
  Variant (489)..(490): xaa in position 489 to 490 is any amino acid
  Variant (492)..(492): xaa in position 492 is any amino acid
  Variant (495)..(496): xaa in position 495 to 496 is any amino acid
  Variant (497)..(499): xaa in position 497 to 499 is any or no amino acid
  Variant (503)..(507): xaa in position 503 to 507 is any amino acid
  Variant (508)..(513): xaa in position 508 to 513 is any or no amino acid
  Variant (515)..(517): xaa in position 515 to 517 is any amino acid
  Variant (519)..(528): xaa in position 519 to 528 is any amino acid
  Variant (530)..(532): xaa in position 530 to 532 is any amino acid
LXAAGXIGXXLAXLLXXXXXXXXXXXXXXXXXXXLXLYDIXXXXXXXXXGXAXDLXXXXXXXXXXXXXXXXXXXXXXXXXXXXXLXXXDVVVIXAGVXRKPGMTRDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDLXXXNAXIVXXLXXXXXXXXXXPXAXIXVISNPVXXXVXXXXXXXXXXXXXXKXXGXXXXXXLXXXXXLDXXRXXXFVAXXXXXXXXXXXXXXXXXXXXXXXXXXXXXXVIGGHXXXXIXXLXXXXXXXXXXXXXXXXXXXXXXXLXXXXXXGGXEVVXXXXXXXKXGXGXXXXXMXXAXAXFXXXXXXXXLXXXXXXXXXXVVXXXXXXXXXXXXXXXXXXXXXXXXXXXXXVXXXXXXXXXXXXXXXXXXFXAXXVXLGXXXXXGVEXXXXXXXXXXXLXXXEXXXXXXXXXXLXXXI

SEQ ID NO: 45351 - protein, 38 aa, Artificial sequence
  Variant (2)..(19): xaa in position 2 to 19 is any amino acid
  Variant (20)..(20): xaa in position 20 is any or no amino acid
  Variant (22)..(22): xaa in position 22 is any amino acid
  Variant (24)..(28): xaa in position 24 to 28 is any amino acid
  Variant (29)..(32): xaa in position 29 to 32 is any or no amino acid
  Variant (34)..(34): xaa in position 34 is any amino acid
  Variant (35)..(35): xaa in position 35 is Ala, Gly or Thr
  Variant (36)..(36): xaa in position 36 is any amino acid
  Variant (38)..(38): xaa in position 38 is Ile, Leu, Met or Val
GXXXXXXXXXXXXXXXXXXXLXDXXXXXXXXXGXXXDX

SEQ ID NO: 45352 - protein, 17 aa, Artificial sequence
  Variant (2)..(2): xaa in position 2 is any or no amino acid
  Variant (4)..(4): xaa in position 4 is any amino acid
  Variant (5)..(6): xaa in position 5 to 6 is any or no amino acid
  Variant (9)..(9): xaa in position 9 is Ile, Leu, Met or Val
  Variant (10)..(10): xaa in position 10 is Ala or Pro
  Variant (16)..(16): xaa in position 16 is Asp, Ser or Thr
VXIXXXAGXXRKPGMXR

SEQ ID NO: 45353 - protein, 32 aa, Artificial sequence
  Variant (3)..(3): xaa in position 3 is Phe, Ile, Leu or Val
  Variant (4)..(5): xaa in position 4 to 5 is any amino acid
  Variant (7)..(8): xaa in position 7 to 8 is any amino acid
  Variant (9)..(9): xaa in position 9 is Ile or Val
  Variant (10)..(11): xaa in position 10 to 11 is any amino acid
  Variant (12)..(12): xaa in position 12 is Ala, Asp, Glu, Gly, Asn, Gln, Ser or Thr
  Variant (13)..(20): xaa in position 13 to 20 is any amino acid
  Variant (21)..(21): xaa in position 21 is Ala, Cys or Ser
  Variant (22)..(22): xaa in position 22 is Pro or Ser
  Variant (23)..(23): xaa in position 23 is any amino acid
  Variant (25)..(28): xaa in position 25 to 28 is any amino acid
  Variant (29)..(29): xaa in position 29 is Ile, Leu or Val
  Variant (30)..(30): xaa in position 30 is Ala, Asn, Ser or Thr
DLXXXNXXXXXXXXXXXXXXXXXAXXXXXXNP

SEQ ID NO: 45354 - DNA, 1512 bp, Saccharomyces cerevisiae
  CDS (1)..(1512)
atgattgaaaaggataaaagaacgattgcttttattcatccagacctaggtattgggggcgctgaaaggttagtcgtcgatgcagcattaggtctacagcaacaaggacatagtgtaatcatctatactagtcactgtgataaatcacattgtttcgaagaagttaaaaacggccaattaaaagtcgaagtttatggtgattttttaccgacaaactttttgggtcgtttttttattgttttcgcaacaattagacagctttatttagttattcaattgatcctacagaaaaaagtgaatgcgtaccaattaattatcattgatcaactgtctacatgtattccgcttctgcatatctttagttctgccactttgatgttttattgtcatttccccgaccaattattggctcaaagagctgggctattgaagaaaatatacagactaccatttgacttaatagaacagttttccgtgagtgctgccgatactgttgtggtaaattcaaatttcactaagaatacgttccaccaaacgttcaagtatttatccaatgatccagacgtcatttatccatgcgtggatttatcaacaatcgaaattgaagatattgacaagaaatttttcaaaacagtgtttaacgaaggcgatagattttacctaagtataaatcgttttgagaaaaaaaaggatgttgcgctggctataaaggcttttgcgttatctgaagatcaaatcaatgacaacgttaagttagttatttgcggtggttatgacgagagggttgcagaaaatgtggagtacttgaaggaactacagtctctggccgatgaatacgaattatcccatacaaccatatactaccaagaaataaagcgcgtctccgatttagagtcattcaaaaccaataatagtaaaattatatttttaacttccatttcatcatctctgaaagaattactgctcgaaagaaccgaaatgttattgtatacaccagcatatgagcactttggtattgttcctttagaagccatgaaattaggtaagcctgtactagcagtaaacaatggaggtcctttggagactatcaaatcttacgttgctggtgaaaatgaaagttctgccactgggtggctaaaacctgccgtccctattcaatgggctactgcaattgatgaaagcagaaagatcttgcagaacggttctgtgaactttgagaggaatggcccgctaagagtcaagaaatacttttctagggaagcaatgactcagtcatttgaagaaaacgtcgagaaagtcatatggaaagaaaaaaagtattatccttgggaaatattcggtatttcattctctaattttattttgcatatggcatttataaaaattctacccaataatccatggcccttcctatttatggccacttttatggtattatattttaagaactacttatggggaatttactgggcatttgtattcgctctctcctacccttatgaagaaatataa

SEQ ID NO: 45355 - protein, 503 aa, Saccharomyces cerevisiae
MIEKDKRTIAFIHPDLGIGGAERLVVDAALGLQQQGHSVIIYTSHCDKSHCFEEVKNGQLKVEVYGDFLPTNFLGRFFIVFATIRQLYLVIQLILQKKVNAYQLIIIDQLSTCIPLLHIFSSATLMFYCHFPDQLLAQRAGLLKKIYRLPFDLIEQFSVSAADTVVVNSNFTKNTFHQTFKYLSNDPDVIYPCVDLSTIEIEDIDKKFFKTVFNEGDRFYLSINRFEKKKDVALAIKAFALSEDQINDNVKLVICGGYDERVAENVEYLKELQSLADEYELSHTTIYYQEIKRVSDLESFKTNNSKIIFLTSISSSLKELLLERTEMLLYTPAYEHFGIVPLEAMKLGKPVLAVNNGGPLETIKSYVAGENESSATGWLKPAVPIQWATAIDESRKILQNGSVNFERNGPLRVKKYFSREAMTQSFEENVEKVIWKEKKYYPWEIFGISFSNFILHMAFIKILPNNPWPFLFMATFMVLYFKNYLWGIYWAFVFALSYPYEEI

SEQ ID NO: 45356 - DNA, 1479 bp, Homo sapiens
  CDS (1)..(1479)
atggcggccggcgaaaggagctggtgcctgtgcaagttgttgaggtttttttattcattattcttccctgggctcattgtatgtggaactttatgtgtgtgtttggtcattgtcctttggggaatcagactgctgctacagagaaagaaaaaattagtgtcaactagcagaaatgggaaaaatcaaatggtgattgcattttttcatccatactgcaatgctggtggaggaggagaaagagttttatggtgtgctttaagagccctgcagaaaaagtatcctgaagcagtttatgttgtttataccggcgatgttaatgtcaacggtcaacagatactagaaggtgctttcagaagatttaacatcagattaattcacccagtgcagtttgtttttttaaggaaacgctatcttgtggaagattcactgtatcctcacttcacactgctgggccaaagtctaggatccatttttcttggctgggaagctctaatgcagtgtgttcctgatgtttacattgattcaatgggatacgcttttacgcttcctctgtttaagtatatagggggttgccaagttggaagctatgttcattatcctactatcagcaccgacatgctctctgtagtgaagaatcaaaatattggatttaataatgcagccttcattaccaggaatccttttctcagcaaagtaaagctcatctactactatttatttgcttttatttatggacttgttggttcttgcagtgatgtagtcatggtcaattcttcttggacactaaaccatattctctcactatggaaagttgggaattgcactaacattgtttatccaccttgtgatgtgcagacatttctggacattcccttacatgagaaaaagatgaccccaggacatttgctggtttctgttggccagtttaggccggaaaagaatcatccattgcagatcagagcctttgctaaattgctgaataagaagatggttgagtcacctccttcgcttaaacttgtcctcattggaggttgtcgtaacaaagatgatgaacttagggtaaaccaactgagaaggctgtctgaggatttaggagttcaagaatatgtggaatttaaaataaacattccatttgatgaattaaagaattatttgtctgaagcaacaattggtctgcataccatgtggaacgagcattttgggattggagttgtggagtgtatggcagctggcacaattatccttgcacacaattcggggggcccaaagcttgacattgtgattcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaa

SEQ ID NO: 45357 - protein, 492 aa, Homo sapiens
MAAGERSWCLCKLLRFFYSLFFPGLIVCGTLCVCLVIVLWGIRLLLQRKKKLVSTSRNGKNQMVIAFFHPYCNAGGGGERVLWCALRALQKKYPEAVYVVYTGDVNVNGQQILEGAFRRFNIRLIHPVQFVFLRKRYLVEDSLYPHFTLLGQSLGSIFLGWEALMQCVPDVYIDSMGYAFTLPLFKYIGGCQVGSYVHYPTISTDMLSVVKNQNIGFNNAAFITRNPFLSKVKLIYYYLFAFIYGLVGSCSDVVMVNSSWTLNHILSLWKVGNCTNIVYPPCDVQTFLDIPLHEKKMTPGHLLVSVGQFRPEKNHPLQIRAFAKLLNKKMVESPPSLKLVLIGGCRNKDDELRVNQLRRLSEDLGVQEYVEFKINIPFDELKNYLSEATIGLHTMWNEHFGIGVVECMAAGTIILAHNSGGPKLDIVIPHEGDITGFLAESEEDYAETIAHILSMSAEKRLQIRKSARASVSRFSDQEFEVTFLSSVEKLFK

SEQ ID NO: 45358 - DNA, 1215 bp, Xenopus tropicalis
  CDS (1)..(1215)
atgggcccttcggttctgtttgttcacccagacctcggcattgggggcgctgaaaggctggtggtggatgcggctttggcattgaagtcccgtggctgtcatgttcaggtgtggacaagtcattacgaccctgatcactgcttctcggagactcgtgattccggtattcctataagatgttgtggagactggcttccccggagcttgctgggcagatgccatgcactttgcgcctacatacgcatgatcttcctcactctctacatagtatttcttagtggggaggaattcgatgtagtattttgtgatcaggtgtcggcttgcattcctttttttaaactggccagagattcaaagaaagtacttttttattgccattttcccgaccagcttctgactcagaggctatcattggtaaaaaggatgtacagagccccaattgattggctggaagaaaaaactactggtatggcagactgcattcttgtcaacagctatttcacttctgcaattttcaaagaaacatttgcttcattagctcacatagagccaactgttctctatccatcactaaatgtgagcaactttgaatcaacagtgtttgaagatgtaagtgacctttttcctgcaaaaagacaaaatatatttctctcaatcaatcgatttgaaagaaagaaaaatcttcatcttgctttggaatcgatgtgtaagcttcgcaagaggcttagcttgttggaatgggaacgtgttcatctcatattggctggagggtatgatgagagagtattggaaaatgttgaacattatgttgaactcaaagaaagtgctgtcaaatatgacattagtaaccatgttacatttttaagatccttttcagatgaacaaaaacgtaatctactccataatgccatatgtgttctttatacaccaagcaatgaacattttggaatagttcctatagaggctatgtacatgcgctgcccagtcatagctgttaattcgggtggtcctttggaatctgttgaaaataacgtaacaggatttttgtgcagtcctaacccggagcaatttgctgatgcaatggaaaagtttgttaaaaatcctgatcttaaaaatagaatgggtgaatctggacatataagagttaagagcaagttctccactgaagcattttcagaccaaatttatgctcacgtttgcaaattaattcattaa

SEQ ID NO: 45359 - protein, 404 aa, Xenopus tropicalis
MGPSVLFVHPDLGIGGAERLVVDAALALKSRGCHVQVWTSHYDPDHCFSETRDSGIPIRCCGDWLPRSLLGRCHALCAYIRMIFLTLYIVFLSGEEFDVVFCDQVSACIPFFKLARDSKKVLFYCHFPDQLLTQRLSLVKRMYRAPIDWLEEKTTGMADCILVNSYFTSAIFKETFASLAHIEPTVLYPSLNVSNFESTVFEDVSDLFPAKRQNIFLSINRFERKKNLHLALESMCKLRKRLSLLEWERVHLILAGGYDERVLENVEHYVELKESAVKYDISNHVTFLRSFSDEQKRNLLHNAICVLYTPSNEHFGIVPIEAMYMRCPVIAVNSGGPLESVENNVTGFLCSPNPEQFADAMEKFVKNPDLKNRMGESGHIRVKSKFSTEAFSDQIYAHVCKLIH

SEQ ID NO: 45360 - DNA, 1248 bp, Mus musculus
  CDS (1)..(1248)
atggccgaaaacctgtaccgagcccgttcccgggtttacagcccatctgtgctgtttctgcacccagacatgggtataggcggagccgagcgcctagtgctggacgcggcgctggcgctgcaggagtacggctgtgatgtgaagatatggaccgcgcactacgacccgaaccactgcttcatcgagacccgcgagctctcggtgcaatgcgcaggggactggctgcctcgcagcctgggctggggcggccgcggcgccgccatctgctcctacgtgcgcatggtctttctggcgctctacgtgctgtttctctccggcgaggagttcgacgtggtggtgtgcgaccaggtgtctgcctgtatcccggtgttcaaactggccagacggcgtaagagggtcctattttactgtcacttcccagatctgctgcttactcagagaaattcagctctgaagaagttctacagggcccccatcgactggatcgaggaatacaccacaggcatggcagaccgcatcttggtcaacagccagtacactgcttccgtctttaaagaaaccttcaagaccctgtctcacagaaatcctgatgtgctctacccatctctgaatatcggcagctttgacttggctattcctgaaaagatagatgacctcgtccccaaggggaagcaattcctgttcctctctatcaaccgatacgaaaggaagaaaaatctgcccttggcactgagatccttggtgcagcttcggaatcggttaccatctcaagagtgggataaggttcatctcttcatggccggtggttatgacgataggatcccggagaacgtggagcactataaggagttgaagaaaatggtccaagagtcagaccttgagcgtcatgtgaccttcctgcggtccttctcggacagacagaagatctcactcctccacggctgcttgtgtgtgctgtacactccgagcaacgagcactttggcatcgtccctctggaggccatgtacatgcagtgcccagtgatcgctgttaataacggtgggcccctggagtccattgtccacaaggtcacggggttcctgtgtgagccagacccagtgcacttctcagaagccatggagaagttaatccacaaaccatccttaaaagccacgatgggcctcgctggaaaagccagggtggcggagaagttttcagctgatgcatttgcagaccagctgtaccagtatgtcacgaagctggtgtag

SEQ ID NO: 45361 - protein, 415 aa, Mus musculus
MAENLYRARSRVYSPSVLFLHPDMGIGGAERLVLDAALALQEYGCDVKIWTAHYDPNHCFIETRELSVQCAGDWLPRSLGWGGRGAAICSYVRMVFLALYVLFLSGEEFDVVVCDQVSACIPVFKLARRRKRVLFYCHFPDLLLTQRNSALKKFYRAPIDWIEEYTTGMADRILVNSQYTASVFKETFKTLSHRNPDVLYPSLNIGSFDLAIPEKIDDLVPKGKQFLFLSINRYERKKNLPLALRSLVQLRNRLPSQEWDKVHLFMAGGYDDRIPENVEHYKELKKMVQESDLERHVTFLRSFSDRQKISLLHGCLCVLYTPSNEHFGIVPLEAMYMQCPVIAVNNGGPLESIVHKVTGFLCEPDPVHFSEAMEKLIHKPSLKATMGLAGKARVAEKFSADAFADQLYQYVTKLV

SEQ ID NO: 45362 - DNA, 1092 bp, Archaeoglobus fulgidus DSM 4304
  CDS (1)..(1092): transl_table=11
gtgaaaatttgcgtttttcacgactacttcggagcaattggaggtggggagaaggttgcgctgacaatctcgaagctcttcaacgcagacgtaatcacaaccgacgtcgatgcagttccagaggagttcaggaacaaagttatcagcttgggtgagacgataaagctgccacctttaaagcagatagacgcttcccttaagttctacttttctgactttccagattacgacttctacatactttctggaaactgggtaatgttcgcctcgaagaggcacattcctaatctcttatactgttacactcctccaagagctttttacgatctctacggagattacctaaaaaagagaaatattttgacgaagcccgcttttatattatgggtaaagtttcacaggaaatgggctgagaggatgctaaaacacatagataaagtcgtttgcatctcgcaaaacataaaaagcagatgcaaaaatttttggggaatcgatgccgaagtcatctatccgcctgtggaaacttcgaagtttaagttcaagtgctacggagacttttggctttctgtaaacagaatttatccagaaaaaaggatagaattgcagcttgaagtttttaaaaagttgcaagatgagaagctttacatcgttggctggttctcaaagggggatcatgcggagaggtacgcgagaaagattatgaaaatagctccagacaacgttaagtttttgggaagtgtcagtgaagaagagttgatcgatctatattctcgatgcaagggtttgctatgcacagctaaggatgaggattttggacttacacctattgaggcaatggcttctggaaagcctgtaatcgccgtaaacgagggtggttttaaggagactgttataaacgaaaaaacaggatatctcgtcaatgcagatgttaatgagataattgatgcaatgaaaaaagtttcgaaaaatcctgataaatttaagaaagactgttttagaagggcaaaggagtttgacattagtatatttaaaaacaagataaaagatgcgataagaatcgtaaagaaaaattttaaaaacaacacatgctaa

SEQ ID NO: 45363 - protein, 363 aa, Archaeoglobus fulgidus DSM 4304
MKICVFHDYFGAIGGGEKVALTISKLFNADVITTDVDAVPEEFRNKVISLGETIKLPPLKQIDASLKFYFSDFPDYDFYILSGNWVMFASKRHIPNLLYCYTPPRAFYDLYGDYLKKRNILTKPAFILWVKFHRKWAERMLKHIDKVVCISQNIKSRCKNFWGIDAEVIYPPVETSKFKFKCYGDFWLSVNRIYPEKRIELQLEVFKKLQDEKLYIVGWFSKGDHAERYARKIMKIAPDNVKFLGSVSEEELIDLYSRCKGLLCTAKDEDFGLTPIEAMASGKPVIAVNEGGFKETVINEKTGYLVNADVNEIIDAMKKVSKNPDKFKKDCFRRAKEFDISIFKNKIKDAIRIVKKNFKNNTC

SEQ ID NO: 45364 - DNA, 1212 bp, Arabidopsis thaliana
  CDS (1)..(1212)
atggcgaaaaaagaaggttcaaagatgaacatcgccattatacatccagatcttggaataggcggagcagagagattgattgttgatgcggccgttgagcttgcctcgcacggtcataaagttcatatcttcacctctcaccacgacaaatccagatgcttcgaggaaactctttccggtatctttcaagttacggtgtatggatctttcctgccacggcatattttctaccgactacacgcagtgtgtgcatatttgcggtgcttgtttgttgctctctgtgttcttttgggttggtcttcattcgatgttgtactagcagaccaagtttcagtcgtagtcccattgctgaaactcaaaaggtcatctaaggttgttttctactgccatttcccggatctcttgctagctaagcatacaacaacacttagacggatgtatcggaaacccattgatttcattgaagaacaaacaacagggatggctgatatgatccttgttaacagtaacttcacggcatcaacatttgccaatacatttaaaaggctaaatgcacaagggagtcgcccagctgtactttaccccgcagtcaatattgatcagttcattgaaccccacacttataagttgaatttcctctccataaaccgctttgagaggaaaaagaacatcgatctagctgtttcagcttttgctatcctatgcaaacataagcaaaatctgagtgatgttacccttaccgttgcaggtggatatgacgagcgattgaaggagaatgttgagtacttggaggagctcagaagtttagccgagaaagaaggagtttctgatcgagttaactttatcacatcttgttcaaccgctgaaagaaatgaacttctctcaagctgcttgtgcgttctctacacccccacggatgaacattttggtattgttccattagaagcaatggctgcatacaaacccgtgatagcctgcaacagtggtggccccgtggagacggtaaagaatggagtaacaggctatctttgtgaaccaactccagaagatttcagttcggcgatggctagattcatcgagaatcctgagttggcgaatagaatgggagctgaagccaggaaccatgtcgttgaatcattctctgtgaagacgtttggacagaagttgaatcagtatctcgttgatgtcgtatcaagtcctaaagaagattga

SEQ ID NO: 45365 - protein, 403 aa, Arabidopsis thaliana
MAKKEGSKMNIAIIHPDLGIGGAERLIVDAAVELASHGHKVHIFTSHHDKSRCFEETLSGIFQVTVYGSFLPRHIFYRLHAVCAYLRCLFVALCVLLGWSSFDVVLADQVSVVVPLLKLKRSSKVVFYCHFPDLLLAKHTTTLRRMYRKPIDFIEEQTTGMADMILVNSNFTASTFANTFKRLNAQGSRPAVLYPAVNIDQFIEPHTYKLNFLSINRFERKKNIDLAVSAFAILCKHKQNLSDVTLTVAGGYDERLKENVEYLEELRSLAEKEGVSDRVNFITSCSTAERNELLSSCLCVLYTPTDEHFGIVPLEAMAAYKPVIACNSGGPVETVKNGVTGYLCEPTPEDFSSAMARFIENPELANRMGAEARNHVVESFSVKTFGQKLNQYLVDVVSSPKED

SEQ ID NO: 45366 - DNA, 2772 bp, Bacillus halodurans C-125
  CDS (1)..(2772): transl_table=11
atgagagaaggatatttttccctagtcttacatgcccacttgccttatgttcgtcatcaagaagaagatcgattggaggaacgttggctgtttgaagccatgtcggaaacgtatattcctcttttatgggccttagaaaaactgcccgtaaaacatgcagtcaccatttcctttacccctcctgttatggagatgctgagtgacccacttgtgcaaactcgttacttgaatcaccttgaaaataccgaacagcttttgaaaaaagaagagaaacgtacaaacgatcaacgaacgcaaaatctcgttcagttttataagcagcgctatgaaaagctaaaagcaacgtttttacagtgggatcggaatctactcatcggtttccgcagcttgatggagaacgagcaatgcacattaatgacgtccgctgccacgcatgccttttttccatacttaaaaacaaaagaagcgattcgcgcccaagttcgccacggaatcgcatgctttgaacaacattttggcaaaaaaccacttgggttctggctcccagaatgtgccttctctccaggcgttgaccgaattttatttgaggaaggcatccgttacacatttgtagatgaacacgctgttttgacggcagatccgactccgcataagggatcaagtgccccgatctatagcccgcatggaattgcgttgttccctcgccatacggaactttccgcaaaagtgtggagctcaacgcttgggtatcctggtgatgtcgattaccgtgaattttaccgtgacatcgcatatgaccgggaatgggattatattaagccgcacgtccacaaagacgggattcggatcgatacagggttgaagtatcatcggattacagggcatacggaggaaaaagacttgtatgtccgtgaatgggcggagaaacgtgtgcaagaacatgcgaatcattttataggtgcgattcatcatgagatcgatcaacatggtggacaaaactttccgccgtatgtcatggtcactccgtttgatgctgagttgttcggtcattggtggtttgaagggccagagtggatcgaggcattatatgagcaaggagcagaccgtgtgtccttcataacaccagagctctatttgcagcgtcactatcaagattttcagaccgctcatgtgagcttttcgacttgggggagagacggttatggtcacgtttggttaaatgaccataatgcttggatgtatagacattatcatcgcatggaaaaagatttagcgaaaatagtggctatgtatccacaacctacagttctcgaaaagcaggccattcagcaaatggttagagagtggatgctcgctgttagcagtgactgggcgtttattcttgacggtcaaacggctgcacagtatgcgtcagagcgtttccatgagcatgttcgtcgcttcgacacgattcagagcgccttgcttgaagatcgtatagattcccagtggcttaagcaaatgcttgcagcgtttccttttctggagacgatcgacgagcgcgtatttttaagcccccatgatcgttacgtgcaatcgaaaaaagagacccagccatttgaaggaacgtgctcgatccttatgctgagttgggaatatccgcctcatgttgtcggaggcctatcacgtcatgtggatgctttgtctcaagcattagcaaaaaaggggcatgaaattcacgtcgttacagccgctatggatggagctcccgagtacgaaaaaaatggggaggtccacatccatcgggtcagcgggttacaaccagagagggagccatttttagattgggtggccagcttgaacttagccatgtttgaacatgtgaaaaaattataccgttttcgtccgtttgatgtcattcatgctcatgattggctcgtatcaggagctgctttagcattaaaacacctttttcaaacatcgcttatggctactattcatgcaacggagcacgggcggaatcaaggtatccataccgagttacagcaagcgattcatgaacaggaaatgaagctcgtgacagaggctgatcaaatcattgtttgcagtcaatttatgaaagaacatgttcaatcattgtttgtgcctaatcctgataaagtggcagtaatcgcaaatggtgtggctcgtgagcaaattgaagctgcacgtcttcaaacgatttctcctgaaaatcgtttcattgtattttctgttgggcgaatcgttcaagaaaaaggattttctctcttgattgaagcagctgcaaaatgcaaagaactaggcgaaccgattcaatttgttgtggctgggcacgggcctctactagctgactatcaacaacaagtaaaggaacgtcaccttgaagcttggatttcctttgtcggctatattagtgatagtgagagaaatgaatggtaccatcgcgcggatgtctgcatttttcctagcttgtacgagccgttcggaatcgtcgcgttagaagcgatggctgcaggcacacctacgattgtatctgacacgggtggtttagcggaaattgttgagcatggagacaatgggctaaaagtacctactggtgatgtggacgcgattgtagctcaattgttgtccctctatcataaaccgcttttgcgggcacaaattggttttaaaggttcacaagacgtgatcgagcagtatagttgggagacgattgccgatcaaacggaagcgatcttagtgaaaaaaatgaagcgagacatctatgcctaa

SEQ ID NO: 45367 - protein, 923 aa, Bacillus halodurans C-125
MREGYFSLVLHAHLPYVRHQEEDRLEERWLFEAMSETYIPLLWALEKLPVKHAVTISFTPPVMEMLSDPLVQTRYLNHLENTEQLLKKEEKRTNDQRTQNLVQFYKQRYEKLKATFLQWDRNLLIGFRSLMENEQCTLMTSAATHAFFPYLKTKEAIRAQVRHGIACFEQHFGKKPLGFWLPECAFSPGVDRILFEEGIRYTFVDEHAVLTADPTPHKGSSAPIYSPHGIALFPRHTELSAKVWSSTLGYPGDVDYREFYRDIAYDREWDYIKPHVHKDGIRIDTGLKYHRITGHTEEKDLYVREWAEKRVQEHANHFIGAIHHEIDQHGGQNFPPYVMVTPFDAELFGHWWFEGPEWIEALYEQGADRVSFITPELYLQRHYQDFQTAHVSFSTWGRDGYGHVWLNDHNAWMYRHYHRMEKDLAKIVAMYPQPTVLEKQAIQQMVREWMLAVSSDWAFILDGQTAAQYASERFHEHVRRFDTIQSALLEDRIDSQWLKQMLAAFPFLETIDERVFLSPHDRYVQSKKETQPFEGTCSILMLSWEYPPHVVGGLSRHVDALSQALAKKGHEIHVVTAAMDGAPEYEKNGEVHIHRVSGLQPEREPFLDWVASLNLAMFEHVKKLYRFRPFDVIHAHDWLVSGAALALKHLFQTSLMATIHATEHGRNQGIHTELQQAIHEQEMKLVTEADQIIVCSQFMKEHVQSLFVPNPDKVAVIANGVAREQIEAARLQTISPENRFIVFSVGRIVQEKGFSLLIEAAAKCKELGEPIQFVVAGHGPLLADYQQQVKERHLEAWISFVGYISDSERNEWYHRADVCIFPSLYEPFGIVALEAMAAGTPTIVSDTGGLAEIVEHGDNGLKVPTGDVDAIVAQLLSLYHKPLLRAQIGFKGSQDVIEQYSWETIADQTEAILVKKMKRDIYA

SEQ ID NO: 45368 - DNA, 1119 bp, Clostridium acetobutylicum ATCC 824
  CDS (1)..(1119): transl_table=11
atgaaggttgcactagtacatgactggcttaccaatatgggtggagcagaaagagtaattataaatttaaaagaaatatataaggaagcacctatatatacttccttatataatccagataaattagatgatgagttaagaaatattgatgtaagaacatcatttcttcaaaagcctaaaaatattaaaagagggcatcagaagttacttccttttatgccaatggcttttgagagttttgatttaaatgagtatgatattgttttgagtagttgttcttcttgtgctaagggagtagttactaatcctaatactatgcatgtttgttattgccatacaccaatgagatatgcatgggaatattactatgaatatgcagatgagtggggactaaataagttaaaagggaaacttcttaaatatgtaatgaattatataagactatgggatggtgtttcatctaagagagttgattattatatagctaattctcaaaatgtagcaaaaagaatatggaaacattataagcgagaaagtgttgttattcatcctcctgtaaggtgcaagttattcgatataagtgatgttaatgaagagtattttttaatagtgtctaggttagttccatataaaagaatagatttagcagtagaggtttttaatgaattaggtttaccattagttgtaataggcggtggaaaagatttagatagattaaagaatatggcaaaggataatataaaattcttaggaagacagtctgatgaggttattaaagagtactactctaaatgcagggcttttatatttccaggagaagaggattttggtataacacctcttgaagctcaggcaagtggaaggccggttatagcttatggaaagggaggagcgttagaaactgtagttagtggagttactggagtattttttaaagagcagacagttgactcattaaaaagtgctgtcaatgaatttgaaaaaattaattttgataagagtgtcataagaagacatgcagaagagtttgatgaggagatatttaagaaaaagattagagaatatttaagtagatcatatgatgaatttaaaaaattaaaaaaatggaaggtaatataa

SEQ ID NO: 45369 - protein, 372 aa, Clostridium acetobutylicum ATCC 824
MKVALVHDWLTNMGGAERVIINLKEIYKEAPIYTSLYNPDKLDDELRNIDVRTSFLQKPKNIKRGHQKLLPFMPMAFESFDLNEYDIVLSSCSSCAKGVVTNPNTMHVCYCHTPMRYAWEYYYEYADEWGLNKLKGKLLKYVMNYIRLWDGVSSKRVDYYIANSQNVAKRIWKHYKRESVVIHPPVRCKLFDISDVNEEYFLIVSRLVPYKRIDLAVEVFNELGLPLVVIGGGKDLDRLKNMAKDNIKFLGRQSDEVIKEYYSKCRAFIFPGEEDFGITPLEAQASGRPVIAYGKGGALETVVSGVTGVFFKEQTVDSLKSAVNEFEKINFDKSVIRRHAEEFDEEIFKKKIREYLSRSYDEFKKLKKWKVI

SEQ ID NO: 45370 - DNA, 1203 bp, Caenorhabditis elegans
  CDS (1)..(1203)
atggtccgggtaaccattctccatccagatctaggcatcggtggagccgaacgattgattgttgatgctgctgttggattacaggatcgaggacactctgttcggattttcacgaatcaatatagtagatcgcattgtttccaagaaactctagatttggatatttgtactgtggttccatggataccccgttcaatttttggaaaaggtcatgctctttgtgcatatcttaaaatgatcattgctgctctctacattgtaatctaccacaaagatactgacgtcatactttcggattctgtatctgctagtcaatttgttcttcgtcatttctcaaaggcaaaactcgtattctattgtcatttcccggatcgacttttaacgaaacgtgatggaaatctgaaagctttctatagaaatattattgattggattgaagagtacacaactggacttgcagatgtcatttgtgtcaatagtaattttacaaaaaatgtggttcgtgaaacattcaagtcactggcatctcaggagctgaccgtactctatccttcgttgaacaccgagtttttcgattcgattgaagcttcggatgattttggtgaagaaattccacgtggtaccaaatatgttttcacctcactgaaccgatttgaacgaaagaagaatatcgttttggctctagacgcattcgagaaattgaaatcgaatcttcctgccgacgaattttcgcaatgtcatcttgttattgctggcggatatgatttgaaaaacccagaaaacatcgaacactatgatgaacttgttgaacatatgaagaaactggagctcccagctgatcagatcgtatttctccactcaccatctgacactcaaaaagtaaatctcattcggagaagtcgtgcggtactttacacgcctgatagagaacatttcggaattgttccagttgaagcaatgtacttgggaaccccagtaattgctgttaacactggaggtccctgtgaatcggttcggaataatgagacgggatttttggttgatcaaacggccgaagcgtttgctgagaaaatgattgatttgatgaaagatgaggaaatgtatcgaagaatgagtgaggaaggtccgaaatgggtgcaaaaagtgtttgcatttgaagcatttgcaagaaagctcgacgagattattcaatctacgctttaa

SEQ ID NO: 45371 - protein, 400 aa, Caenorhabditis elegans
MVRVTILHPDLGIGGAERLIVDAAVGLQDRGHSVRIFTNQYSRSHCFQETLDLDICTVVPWIPRSIFGKGHALCAYLKMIIAALYIVIYHKDTDVILSDSVSASQFVLRHFSKAKLVFYCHFPDRLLTKRDGNLKAFYRNIIDWIEEYTTGLADVICVNSNFTKNVVRETFKSLASQELTVLYPSLNTEFFDSIEASDDFGEEIPRGTKYVFTSLNRFERKKNIVLALDAFEKLKSNLPADEFSQCHLVIAGGYDLKNPENIEHYDELVEHMKKLELPADQIVFLHSPSDTQKVNLIRRSRAVLYTPDREHFGIVPVEAMYLGTPVIAVNTGGPCESVRNNETGFLVDQTAEAFAEKMIDLMKDEEMYRRMSEEGPKWVQKVFAFEAFARKLDEIIQSTL

SEQ ID NO: 45372 - DNA, 1314 bp, Caenorhabditis elegans
  CDS (1)..(1314)
atgcacgtggttattgtccatcctgaacaatggaacgggggctccgatcggtgcaccgttgcccttatcagacattttgtctcccaggggcatcgtgttacatggcttacaactatgattgatgagtactggaagaatcacacttttgatggagttgaaattcgagaggttgggctcaagcttcaccctggagattggtggtcgcagaatgttgctctcggctggcatatggtctttagcaacttgaatccagatgttgcgattattgatcactccgctagttgcgttccgatgatcaagtggcgattcccacagtgcaaaattttgttctactgccattttccacaacagttagtaacaccgtctcgatttttcctgtatagatggtatgcaaagctcatcggaatcgtcgaagaagaacttttcgggcacatcgatcaaattttcgtgaacagtaattttactgccactcaattctgcaaagtgatgccaaatattgagaagaacaaggttcgagtcgtttatccaccgtgtgatattgattggattgttagcgcgtctgagcgtcctgtcagtcgtgctcagcgcgccaagaacgaaacgtacacgttcctgtcaatgaacagattttggccagagaagcggcttgatatcattatcgaagctgcatcgattctgaaacaaaaaggatatcacttccatgttcaacttgccggatctgtcatgccacacattccggaaagtagaatatattatgaggttcttcagagaatgactgaggagctcaatgttactgatatggtcacattcatcccttcgccgactgacaaggtgaagtttcagctgtatcaacaatgtgatacagcgctctacacaccgcctaacgagcatttcggaattgtcccaattgaggctttggatcaaagaagaccggttattgtctgtgatagtggaggcccagctgaaaccgtcttggaagatattacaggaaccaagattgccaagccatgtggcgagcttttggccgaagccatgcttcaccatatgaacaaacgtgattggccagaactggacacagatgagggatacgctaaacagcggcatcgccttgaaaccgaattctccacgcgcggattttgtgggaatatcgaccgagccattgccgaaatgatgggaacgttggagatcagctcatcggagccaacgacaacgccgctcgtggacacaatagttcatcagccaactgccactgaagtctattcgaagcctcaacagtacaataaggcggctcacagcaggcgtgctcaagcttaa

SEQ ID NO: 45373 - protein, 437 aa, Caenorhabditis elegans
MHVVIVHPEQWNGGSDRCTVALIRHFVSQGHRVTWLTTMIDEYWKNHTFDGVEIREVGLKLHPGDWWSQNVALGWHMVFSNLNPDVAIIDHSASCVPMIKWRFPQCKILFYCHFPQQLVTPSRFFLYRWYAKLIGIVEEELFGHIDQIFVNSNFTATQFCKVMPNIEKNKVRVVYPPCDIDWIVSASERPVSRAQRAKNETYTFLSMNRFWPEKRLDIIIEAASILKQKGYHFHVQLAGSVMPHIPESRIYYEVLQRMTEELNVTDMVTFIPSPTDKVKFQLYQQCDTALYTPPNEHFGIVPIEALDQRRPVIVCDSGGPAETVLEDITGTKIAKPCGELLAEAMLHHMNKRDWPELDTDEGYAKQRHRLETEFSTRGFCGNIDRAIAEMMGTLEISSSEPTTTPLVDTIVHQPTATEVYSKPQQYNKAAHSRRAQA

SEQ ID NO: 45374 - DNA, 1215 bp, Thermoanaerobacter tengcongensis MB4
  CDS (1)..(1215): transl_table=11
ttgaagagctcaaaaaaccgcaggaaatgggggttagctatggataatttaaaagtcacggtgtttaccaatgaataccctcctaatatttatggaggagcaggtgttcatgtagactacctgaccagagagttgtccaagttaatgaaagtagatgtgaggtgttttggggaccagaaatttttttcggagaatttgactgtaaagggatataaagagtgggaggagttaaaagaagggttagatcctaggtatcaaaaagttttaggtcctttttcaatagatttggcgatggtgaaggaccctgttgattccgatgtccttcattgccacacctggtacaccttcatggcaggctttttagctaaaaagctttatgataagcctttagttgtgacaattcacagccttgagcccttaaggccgtggaaagaagaacagttggggaatgggtataaattgagttcctggatggaaaaaacaggaattaaagctgctgacaggattatagccgtctcccaaggctcaaaagaggacatattgaaatattacgacgttcctgaagaaaagatagaggtcatatacaatgggatagatttaaaggagtacaaaaagatagatagaaatgttgctagaaaaaagtacggaattgaaggaaggtacattctctttgtagggagaatatctaggcagaaagggattactcacttgatagatgcagtgaaatatttgcctaaggatgtaaaagtggtgctgtgcgccagctctccagacacgccagaggtgttggaagaggtagagcaaaaggtgaagttgcacgacaatataatttggataaacaaaatggtggaaaaagaagatatcgtagagctttatagcaatgcagaagtgtttgtgtgcccttctatttatgagccctttggcataataaatttggaagcgatggcttgtgagactcccgttgtggcaagcgctacaggtgggattaaagaagttgtggtgcatgaggagacaggctttttggtagagccgggaaactctgaagagcttgcgaaatatataaatattctcctggagaatagagagttggcaaagaaatttgggataaatggaaggaaaagagttgaggagatgttcagctggggaagtattgctaaaaagacctatgaaatgtataggaaggttgtacaagagtataaaaaagcgaaaaagtaa

SEQ ID NO: 45375 - protein, 404 aa, Thermoanaerobacter tengcongensis MB4
MKSSKNRRKWGLAMDNLKVTVFTNEYPPNIYGGAGVHVDYLTRELSKLMKVDVRCFGDQKFFSENLTVKGYKEWEELKEGLDPRYQKVLGPFSIDLAMVKDPVDSDVLHCHTWYTFMAGFLAKKLYDKPLVVTIHSLEPLRPWKEEQLGNGYKLSSWMEKTGIKAADRIIAVSQGSKEDILKYYDVPEEKIEVIYNGIDLKEYKKIDRNVARKKYGIEGRYILFVGRISRQKGITHLIDAVKYLPKDVKVVLCASSPDTPEVLEEVEQKVKLHDNIIWINKMVEKEDIVELYSNAEVFVCPSIYEPFGIINLEAMACETPVVASATGGIKEVVVHEETGFLVEPGNSEELAKYINILLENRELAKKFGINGRKRVEEMFSWGSIAKKTYEMYRKVVQEYKKAKK

SEQ ID NO: 45376 - DNA, 1275 bp, Drosophila melanogaster
  CDS (1)..(1275)
atggttcgagttctgttcctccacccggatttgggcatcggaggagctgagcgactggtggtggatgccgctctggcactcaaggagcggggtcaccaggttagcttcctaacgaatcaccacgacagcacgcactgcttcaaggagacggcggacggcacttttccggtccacgtagtgggcgactggttgccacgcgggctcttcggaagattctatgccatctgtgcctatctgcgcatgctctatgcggcgatctacgccagtttttttatgccccagcgggagcaagtggacgtggtggtgtgcgacctaatctctgtgtgcattccagttctccgcttcgcccctcatcgtccgaaggttctattctactgccactttccggatcagcttctcagcagccgtgaaggactgctaaagcggctgtaccgcctgcccatcaactggctggaggagcacacgatcggtctagcagacaaggtgctggtcaactccaaatttacgctacgtgtcttccaggacacctttcgccgactgagcacggtgccggatgtgctgtatccttcactgcacacccagtactttgaccagatgcagaaaaagctagaacagcggtctgctttactggacgagccagtgcatccgcgagtaccactcaacgcctttatctatctggacatcaatcgctacgagcgcaagaagaaccacgcccttgccttacattccctgcgccttctgggcgacatgctgcccgccacggacttcaagcgctgtcgcctgatcatcgccgggggttacgacaccagatgcatggaaaatgtggagcacttcgcggagctggagcaccttacggaggagttgaaacttcaggatcacgttgtgctgctacgctcgcctaccgacgaggagaaatgtcgcctgctctttgccgctcactgtctgctgtatacgccagagaacgagcacttcggcattgtgccgctggagggcatgtactgctcgaagccagtcgtggcattaaacagcggcggacccactgaaacggtggtgagcacttccactggctttctgtgcgaaaagaccgagaagagctttggtggagcaatgctccagcttttccgggacgagcagctgcgtgtaaagatgggagaccagggtcacaaacgggtgcagcaaaagttctctttccaagcattcgcagatcggctgaacggcattattagagatcttgttcctatctccagggagtcgagtgctaagaaaaataaataa

SEQ ID NO: 45377 - protein, 424 aa, Drosophila melanogaster
MVRVLFLHPDLGIGGAERLVVDAALALKERGHQVSFLTNHHDSTHCFKETADGTFPVHVVGDWLPRGLFGRFYAICAYLRMLYAAIYASFFMPQREQVDVVVCDLISVCIPVLRFAPHRPKVLFYCHFPDQLLSSREGLLKRLYRLPINWLEEHTIGLADKVLVNSKFTLRVFQDTFRRLSTVPDVLYPSLHTQYFDQMQKKLEQRSALLDEPVHPRVPLNAFIYLDINRYERKKNHALALHSLRLLGDMLPATDFKRCRLIIAGGYDTRCMENVEHFAELEHLTEELKLQDHVVLLRSPTDEEKCRLLFAAHCLLYTPENEHFGIVPLEGMYCSKPVVALNSGGPTETVVSTSTGFLCEKTEKSFGGAMLQLFRDEQLRVKMGDQGHKRVQQKFSFQAFADRLNGIIRDLVPISRESSAKKNK

SEQ ID NO: 45378 - DNA, 1428 bp, Drosophila melanogaster
  CDS (1)..(1428)
atgtttctgtttctgtttcttctctggttgttgttatcgcttgtgttggtggcagtactctctttccttttcctgaggcaatggttgcttggccggaagaataagttgcacacatcgtcggaaaatggcatcaacgtgggcatttttcacccgtattgcaacgcgggtggcggcggagaacgcgtcttgtggtgcgccgtgagagcactacaggaaaagtaccagaacgccaggatggtaatctacacaggcgacatagacgcttctcccaattccatactgcaaaaggccaagaatgtcttcaacattgccgtcgatagtgacaatgtgaagttcgtcttcctgaagcaacgccactggatcgaggccaagaactatcctcatttcactctgctgggccagagcattggatcgatggtcgtgggtctggaggcactctgcaggtttccgcccgacatctacatcgacaccatgggatacgcctttacgtatcctctgttccgctacttggcccagtccaaggtgggctgctatgttcactatccggttattagcaccgatatgctgaagagggttcagcagcgacagatgtcgcacaacaacaagaagtacgtggcgaggaacccctttctcacctggactaagcttgcctactaccgcctcttctcaagaatgtacaagtgggttggctgttgtgctgagactatcatggtgaactcctcgtggaccgagaatcatattctgcaactgtgggatgtgcccttcaaaacacaccgggtttaccctccgtgcgaggttagtcacctaaagagccttcagcacacggaaaaaggcgacgaattcatcatactgtctgtcggacagttccgcccggagaaagaccatcccctccagctgcaagccatatacgagctccgaactctcttggcccaagacgaggccctttggaaccaaattaagttggttattgtgggctcctgccgaaatgaagatgactacgagcggttgaaaaacatgcaggacctgacaaagcatctgtcgctagaaaacaatgtgcaatttagtgtgaatgtcccttacgaagaccttcttaagttgtatcaaactgcccacattggcattcacactatgtggaacgaacattttggcatcggcatcgtcgagtccatggctgctggccttataatggtggcccacaagtcagggggtcctttgcttgacattgtcgaaacttccgcgggaagtcagaacggattcctggctactgacgccgttgaatacgcagaaaacatattaaatattattgttaacaactcagaaatgaacggcattcgaaacgcagccagggcctccgtggaacggttttctgagcaagagtttgaaaaaaactttcttcgagctgtttcaacgctatttaccaacaattaa

SEQ ID NO: 45379 - protein, 475 aa, Drosophila melanogaster
MFLFLFLLWLLLSLVLVAVLSFLFLRQWLLGRKNKLHTSSENGINVGIFHPYCNAGGGGERVLWCAVRALQEKYQNARMVIYTGDIDASPNSILQKAKNVFNIAVDSDNVKFVFLKQRHWIEAKNYPHFTLLGQSIGSMVVGLEALCRFPPDIYIDTMGYAFTYPLFRYLAQSKVGCYVHYPVISTDMLKRVQQRQMSHNNKKYVARNPFLTWTKLAYYRLFSRMYKWVGCCAETIMVNSSWTENHILQLWDVPFKTHRVYPPCEVSHLKSLQHTEKGDEFIILSVGQFRPEKDHPLQLQAIYELRTLLAQDEALWNQIKLVIVGSCRNEDDYERLKNMQDLTKHLSLENNVQFSVNVPYEDLLKLYQTAHIGIHTMWNEHFGIGIVESMAAGLIMVAHKSGGPLLDIVETSAGSQNGFLATDAVEYAENILNIIVNNSEMNGIRNAARASVERFSEQEFEKNFLRAVSTLFTNN

SEQ ID NO: 45380 - DNA, 1353 bp, Mus musculus
  CDS (1)..(1353)
atggcggcggacactgggagctggtgcgtgtacgccgtgctgcggtttttctattcactcttctttcctggactgatgatatgcggagttttgtgtgtatatttggtcattggcctttgggttatcaggtggcatctacagagaaagaagaagtctgtgtcgaccagcaaaaatggaaaagaacaaacggtggttgcatttttccatccatactgtaatgcaggtggcggaggagagagagttctgtggtgtgctttgagagccctgcagaaaaagaaacgctaccttgtggaagattcccggtatcctcacttcacattgctaggccaaagtcttggatccattcttctcggctgggaagctctgatgcagcgcgttcctgatgtttacatcgactcaatgggatacgccttcacactccctctctttaagtatgtgggaggttgccgagtcggaagctatgttcactatcccacgatcagcactgacatgctgtctgtggtgaagaatcagaatcctggatttaataatgctgctttcattagcagaaatgctcttctcagcaaagcaaagctcatctattactatttatttgcttttgtttatggccttgttggatcttgcagtgacatagtcatggttaattcttcttggacattaaaccatatcctctcactgtggaaggttgggcattgcactaacattgtctatccaccttgtgatgtgcagacatttctggacatccctttacatgagaagaaggtgaccccagggcatttgctggtttccattggccagttcagacctgaaaagaatcatgctttgcagatcaaagcctttgctaaattgttaaatgagaaagcagctgagttaggccattctcttaaacttgtccttattggagggtgtcgcaacaaagatgatgagtttagagtaaaccaactgagaagtctatctgagaatttgggagttcaagaaaatgtggaatttaaaataaacatttcattcgatgaattgaagaattacttgtctgaagcgaccatcggtctgcatactatgtggaatgagcattttgggattggagttgtcgagtgtatggcagctggcacagttatccttgcacacaactcaggaggcccgaagctggacattgtcattcctcatgaaggacagataactggctttctggctgagagtgaagaaggctatgctgactctatggctcacattctttctctgtctgcagaagagagactccaaatcaggaagaatgctagagcgtctataagcagattctccgaccaggagtttgaagtagcattcctgtgttccatggagaagttacttacttag

SEQ ID NO: 45381 - protein, 450 aa, Mus musculus
MAADTGSWCVYAVLRFFYSLFFPGLMICGVLCVYLVIGLWVIRWHLQRKKKSVSTSKNGKEQTVVAFFHPYCNAGGGGERVLWCALRALQKKKRYLVEDSRYPHFTLLGQSLGSILLGWEALMQRVPDVYIDSMGYAFTLPLFKYVGGCRVGSYVHYPTISTDMLSVVKNQNPGFNNAAFISRNALLSKAKLIYYYLFAFVYGLVGSCSDIVMVNSSWTLNHILSLWKVGHCTNIVYPPCDVQTFLDIPLHEKKVTPGHLLVSIGQFRPEKNHALQIKAFAKLLNEKAAELGHSLKLVLIGGCRNKDDEFRVNQLRSLSENLGVQENVEFKINISFDELKNYLSEATIGLHTMWNEHFGIGVVECMAAGTVILAHNSGGPKLDIVIPHEGQITGFLAESEEGYADSMAHILSLSAEERLQIRKNARASISRFSDQEFEVAFLCSMEKLLT

SEQ ID NO: 45382 - DNA, 972 bp, Homo sapiens
  CDS (1)..(972)
atgcccctattaaaacttgtacatggctccccattggtttttggagaaaagttcaagctttttaccttggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataa

SEQ ID NO: 45383 - protein, 323 aa, Homo sapiens
MPLLKLVHGSPLVFGEKFKLFTLVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 45384 - DNA, 1464 bp, Xenopus tropicalis
  CDS (1)..(1464)
atggcagggattctgtgcttatgtgggatgatgcgactgttgactgccttgttcatcccagtactgattgccagcattggtttgtgcctcgtcttggtgttgctctttatttgcactcgattgtggattcagcgaaagaaaaagcagagcgtggaaataggaaaagatgggaaaaagaaaagagtggtggcgttttttcacccatactgcaatgctggaggtggaggagagagagtactgtggtgtgcactgagatctctgcaaaagaggtacaaagatgcgatctatgtcatttataccggtgacaaagatgtgtctgaggaacagatccttaatggcgcagctgcaaggtttaacatcaagctgtcccaccctgtaaagttcatcttcctggaaaagcgaggacttgtggaagcgagtttttatccccgttttactttgctgggccagagtctgggctctgttgttttaggctgggaagctcttacaaagtgtgtgccagatatttacattgattctatgggctatgcatttacattgcctcttttcaagtatgtcggaggatgccaagttggctgctatgtgcattaccctactatcagcatggatatgctgtctgttgtgcgcagccagaacgcgagattcaacaatgctgctttcatctctaacaatcctgttctgagcaggctcaaactgatttattattacctgtttgcagtaatctatggatgggttggttcatgtagtgacgtcatcatggttaactcaacatggactttcgcccacatccttgatctttggaagtgtagtgagcgtaccagcatcgtttatcccccttgtgatgttcagacatttttagatattaatttgaatcagcacaaagacatagaggagcattccattgtttctattgggcagtttaggcccgagaaggaccaccctttgcaaatatgcgcgtttgcagccttacttaaaaagaaaaccactgaaaaacttaagctgaaacttatcctaattgggggatgtcgaaacaatgaagatgaactacgtgtatcagaactgaaaaaactcagctctgaactcggaattcctgtggagttcaaagtaaacattccgtttgcagaactaaagaaacatttgagtgaagctaccattggcttgcacaccatgtggaacgagcactttggaattggcatagttgagtgcatggcagctggtaccataattctggctcataactctggaggcccaaaactggatattgtggtgccttatgaagaacatgagactggcttcttggcagatagcgtggagagctatgcagcagcaatggattatattctgtgtctgacaccagaacagaggctaactataaggcaaaatgcacgtcgttctgttgccagattttcagatcaggaatttgaagctaatttcctagcctcttcagagccactatttatgtga

SEQ ID NO: 45385 - protein, 487 aa, Xenopus tropicalis
MAGILCLCGMMRLLTALFIPVLIASIGLCLVLVLLFICTRLWIQRKKKQSVEIGKDGKKKRVVAFFHPYCNAGGGGERVLWCALRSLQKRYKDAIYVIYTGDKDVSEEQILNGAAARFNIKLSHPVKFIFLEKRGLVEASFYPRFTLLGQSLGSVVLGWEALTKCVPDIYIDSMGYAFTLPLFKYVGGCQVGCYVHYPTISMDMLSVVRSQNARFNNAAFISNNPVLSRLKLIYYYLFAVIYGWVGSCSDVIMVNSTWTFAHILDLWKCSERTSIVYPPCDVQTFLDINLNQHKDIEEHSIVSIGQFRPEKDHPLQICAFAALLKKKTTEKLKLKLILIGGCRNNEDELRVSELKKLSSELGIPVEFKVNIPFAELKKHLSEATIGLHTMWNEHFGIGIVECMAAGTIILAHNSGGPKLDIVVPYEEHETGFLADSVESYAAAMDYILCLTPEQRLTIRQNARRSVARFSDQEFEANFLASSEPLFM

SEQ ID NO: 45386 - DNA, 1248 bp, Rattus norvegicus
  CDS (1)..(1248)
atggccgaaaacctgtaccgaacccggtcccgggtttacagcccatccgtgctgtttctgcacccagatatgggtataggcggtgccgagcgcctagtgctggacgcggcgctggcgctgcaggagtacggctgtcaggtgaagatatggaccgcgcactacgacccaaaccactgtttcattgagacccgcgagctctcggtgcagtgcgcaggggactggctgcctcgcagcctgggctggggcggccgcggcgccgccatctgctcctacgtgcgcatggtctttctggcgctctacgtgctgtttctctccggcgaggagttcgacgtggtggtgtgcgaccaggtgtctgcctgcatccctgtgttcaaactggccagacggcggaagagggtcctcttttactgtcacttcccagatctgctgcttactcagagaaattcatctctgaagaagttctacagggcccccatcgactggatcgaggagtacaccacgggcatggcagatcgcatcttggtcaacagccagtacacagcttccgtctttaaggaaaccttcaagaccctgtctcacagaaatcccgatgtgctctacccatctctgaacatcggcagcttcgacttggccgttcctgaaaagatagatgacctagtccccaaggggaaacagttcctgttcctctccatcaaccggtacgagaggaagaaaaacctgcccttggccctgagctccctggtccagcttcgcgctcggttgccgcctcaagagtgggagaaggttcatctgttcatggctggcggctacgacgacagggtcctggagaacgtggagcactataaggagttgaagaaaatagtccaagagtcagatctcgagcggcacgtgaccttcctgcggtccttctcagacagacagaagatctcactcctccacggctgcttgtgtgtgctctacacgcccagcaatgagcactttggcatcgtccctctggaggccatgtacatgcagtgcccggtcatcgctgtcaattccggtgggcccttggagtctattgtccacaaggtcacggggtttctgtgtgagcccgacccagttcacttctcggaagccatggagaagttcatccacaaaccatccttaaaggcaacgatgggcctggccggaaaagccagggtggcagagaagttttccgctgatgcatttgcagatcagctctaccagtatgtcaccaaactggtgtag

SEQ ID NO: 45387 - protein, 415 aa, Rattus norvegicus
MAENLYRTRSRVYSPSVLFLHPDMGIGGAERLVLDAALALQEYGCQVKIWTAHYDPNHCFIETRELSVQCAGDWLPRSLGWGGRGAAICSYVRMVFLALYVLFLSGEEFDVVVCDQVSACIPVFKLARRRKRVLFYCHFPDLLLTQRNSSLKKFYRAPIDWIEEYTTGMADRILVNSQYTASVFKETFKTLSHRNPDVLYPSLNIGSFDLAVPEKIDDLVPKGKQFLFLSINRYERKKNLPLALSSLVQLRARLPPQEWEKVHLFMAGGYDDRVLENVEHYKELKKIVQESDLERHVTFLRSFSDRQKISLLHGCLCVLYTPSNEHFGIVPLEAMYMQCPVIAVNSGGPLESIVHKVTGFLCEPDPVHFSEAMEKFIHKPSLKATMGLAGKARVAEKFSADAFADQLYQYVTKLV

SEQ ID NO: 45388 - DNA, 1242 bp, Anopheles gambiae str. PEST
  CDS (1)..(1242)
atggtgcgtgtactgtttgttcatccggatctgggcattggcggtgcggaacgactggtcgtggatgctgcactggctttgcagagcaagggccacacggtcagctttctgacgaaccatcacgatccgaaccactgtttcgacgagacgaaggatggtcgtttgccggtgatgacggtcggcgactggctgccgagggacatctttggcaagttttacgccgtgtgcgcctacatacgcatgctgtacgctgccttctactacagtctgttcctgtccaagaaggaaccggtcgatgtcgtgttttgcgatttgatttcgctaggcattcccatttttcgactcgccaggcccaacccaaagatcctgttctactgtcactaccccgaccagctgctgtcgaagccgggcaacctgctgaaacagtgctaccgcatgccgctcaactacctcgaggaagtgactacggcccaggccgatggcatcctggtgaacagcaagttcaccagccgcgtgtttaaggaaacgttcaagcgcatcgcaaccgatccggatgtgctgtacccgtcgctaaacacccggttctttgacgaaaccgccatcgaagagtccgaccaggtggtgaagctaccgaacgacgcgttcgtcttcctgtccatcaatcggtacgagcggaagaaaaaccttgcactcgctttgcacgccttcaaggcgttgcaggacatggtgtcctcgagcgagtggcacaaggtgtgtctcatcatggccggcgggtatgacgatcgcgtgatggaaaacgtggaacattacgacgaactggaggagctggccgaagacatgcagatacgggccaaagtgcgcctgctacgatctccgaccgatcgtcaaaagctgttcctactgcatcgtgcccaagcgctaatttacacgcccgagttcgagcacttcggaatcgttccgctggagggaatgtacctttcgaagcccgtcattgccgccaacagtggcggaccgatggagaccatcattcacgagcagacgggctttttgtgcgaacccgtgccgaaggagtttgccgccgcaatggcaaagctggtgagagacgacaagcactgcgaacgcatgggtgccatggggcggaagcgcgttcagcagcgcttttccttcgaagcgttcagcaccaagctggacaacgttgtgaccgatctgattcagcgggatggcgagaaaaagttcaaatag

SEQ ID NO: 45389 - protein, 413 aa, Anopheles gambiae str. PEST
MVRVLFVHPDLGIGGAERLVVDAALALQSKGHTVSFLTNHHDPNHCFDETKDGRLPVMTVGDWLPRDIFGKFYAVCAYIRMLYAAFYYSLFLSKKEPVDVVFCDLISLGIPIFRLARPNPKILFYCHYPDQLLSKPGNLLKQCYRMPLNYLEEVTTAQADGILVNSKFTSRVFKETFKRIATDPDVLYPSLNTRFFDETAIEESDQVVKLPNDAFVFLSINRYERKKNLALALHAFKALQDMVSSSEWHKVCLIMAGGYDDRVMENVEHYDELEELAEDMQIRAKVRLLRSPTDRQKLFLLHRAQALIYTPEFEHFGIVPLEGMYLSKPVIAANSGGPMETIIHEQTGFLCEPVPKEFAAAMAKLVRDDKHCERMGAMGRKRVQQRFSFEAFSTKLDNVVTDLIQRDGEKKFK

SEQ ID NO: 45390 - DNA, 1479 bp, Rattus norvegicus
  CDS (1)..(1479)
atggcggcggacacagggagctggtgcgtgtacgcagtgctgcgatttttttattcactcttctttcctggactaattatatgtggagttctgtgcgtatatttggtcattggcctttgggttatcaggagacatctacagaggaagaaaaagtcagcctcaaccagcaaaaatggaaaagatcaaatggtggttgcatttttccatccatactgcaatgcaggcggaggaggagagagagttctgtggtgtgctttgagagccctgcagaaaaagtatcctgatgcagtctatgttgtgtatactggtgacattcatgtcagtggtcaacagatactggaaggtgctttcagaaggtttaacatcaagttggttcacccagtgcagtttgttttcttaaggaaacgctaccttgtggaagattctcgctatcctcacttcacattgctaggccaaagtctcggctccattcttcttggctgggaagctctgatgcagcgtgttcccgatgtgtacatcgattcgatgggctacgccttcacactgcctctgtttaaatatgtgggaggttgccgagttgggagctacgttcactatcccactatcagcacagacatgctgtctgtggtgaagaatcaaaatcctggatttaataacgctgctttcattagcagaaacgctctcctcagcaaagcaaagctcatctactactatttatttgcttttgtttatggccttgttggatcttgcagtgacatagtcatggttaattcttcatggacactaaaccatattctctcactgtggaaagtcgggcattgcactaacattgtttatccaccttgtgatgtgcagacatttctggacatccctttacatgagaaaaaggtgaccccagggcatttactggtttccattggccagttcaggccggaaaagaatcatgctttgcagatcaaagcctttgctaagttgctaaatgagaaggcagctgagtcccgccattctctaaaacttgtccttattggaggatgtcgcaacaaagatgatgagtttagagtaaaccaactgagaagactgtctgagaatttgggagttcaagaaaatgtggaatttaaaataaacatttcattcgatgaattgaagaattacttgtctgaagcaacaatcggtctgcataccatgtggaatgagcattttgggattggagttgtcgagtgtatggcggctggtacaattatcctcgcacacaattccggaggcccaaagcttgacatcgtcattcctcatgaaggacagataactggatttctggctgagagtgaagaaggctatgctgaaaccatggcccatattctctctctgtccccagaaaagagacttcgaatcagggaaactgctagagcatctctgagcaggttttccgaccaggagtttgaagtagcattcctgtgttccgtggggaagctgcttacttaa

SEQ ID NO: 45391 - protein, 492 aa, Rattus norvegicus
MAADTGSWCVYAVLRFFYSLFFPGLIICGVLCVYLVIGLWVIRRHLQRKKKSASTSKNGKDQMVVAFFHPYCNAGGGGERVLWCALRALQKKYPDAVYVVYTGDIHVSGQQILEGAFRRFNIKLVHPVQFVFLRKRYLVEDSRYPHFTLLGQSLGSILLGWEALMQRVPDVYIDSMGYAFTLPLFKYVGGCRVGSYVHYPTISTDMLSVVKNQNPGFNNAAFISRNALLSKAKLIYYYLFAFVYGLVGSCSDIVMVNSSWTLNHILSLWKVGHCTNIVYPPCDVQTFLDIPLHEKKVTPGHLLVSIGQFRPEKNHALQIKAFAKLLNEKAAESRHSLKLVLIGGCRNKDDEFRVNQLRRLSENLGVQENVEFKINISFDELKNYLSEATIGLHTMWNEHFGIGVVECMAAGTIILAHNSGGPKLDIVIPHEGQITGFLAESEEGYAETMAHILSLSPEKRLRIRETARASLSRFSDQEFEVAFLCSVGKLLT

SEQ ID NO: 45392 - DNA, 1950 bp, Magnaporthe grisea 70-15
  CDS (1)..(1950)
atggaaatgaactctcgcctagaagcaagcgtctcgatttactacatcaagctttactttgaagccggcctgtcgcatgcgaagaaattcaaaatctgcttgatgacttgcgggacttgtgattggtcgctgtttattgacgttgttccttcgaatttcaattccaacatcctagataattggcaaggattttggtgtaattactgccacttttgcatgcatgcggcttgcgataactggatggaggttgtcgagctgtatcacatcgtgcctatttccttcgctactcttgcatccatccatgtaacctttgagctgaagcaaatctggctcaacctgcaccaccccccactcttcgacgctcgcctctcgtccaaattgccaagcagcaacatggcaaaggaaaagagaaagaagccgccgaccgggtcggaaggcaagacgatcgtctttctgcacccggatctgggcatcggcggcgccgagcgcctggtcgtggacgctgccgttggcctgcagaagcgcggccaccgagtcgtcatcttcacgagccactgcgacccgagtcactgcttcgacgaagcccgcgacggcactctcgacgtccgcgtccgcggcaacaccatcgtgccgccgtcgatcctgtcgcgcttctccatcctctgcgccatcctccgccagatacacctcatcctgcagatcgccatcttctcgagcgagctcgccgacctccagcccgacggcttcttcgtcgaccagctcagcgccggcctgccgctgctggccggcctctcgccccagctcaactccccgccgccgcacatactcttctactgccactttccggacctgctgctcgcgcagggccggcaaaagtggtggaagcgcctgtaccgcgtgccgtttgatcggctggaggagtggagcatgggcttcgcggacgcaatcgccgtcaactcgggcttcaccaagggcgtcgtctcgcgcacctggcccgccctcgctgccaagaccgacctccaggtggtctatccttgcgtcgatgtgcgcgtgccgggagagccgcccaaggagggtcagagtgcagcagagggcaacaaggaagatgtgacctccgaactggactggaaggaatccaggatactgctcagcatcaaccgattcgagcgcaaaaagaatgtcgcattggcaatcaaagcctacgcgggtctacccaaggagaagcgggcgggcgtaaaactcgtcattgcgggcggctacgacaaccgcgtacccgaaaatgtctcctaccatacggagctcacaaacctggccgactcgcttgatctccgtcacggaaccaccaagacggtcgtcacagcactgggtctggcacgtgatccttcaatcgacgtactcttcctgcagtccgtcccgtcagcgctcaaaacagcactcctacgatcggcaaagctgctgctctacacgccagcagaggagcatttcggcattgtgcctctggaggcgatgctggcaggcctgcccgtccttgcctgcgacagcggtggtcccaccgagacagtactggagggcgtcacgggctggctgcgctcacccgagaagcccgaggagtggaccaaggtggtagatatggtcttgaacgaactctccgatgagcaaaaggatgatatgcgtgctgcgggtcccaagagggtcaaggagaatttcgccgaggagcaaatggcggagcggcttgacaggatctttgatgacatggagcagagcgcttccggatacaattgggcaggggacaagtgggatttctcgagcactttgagtgttttgataccctgcgtaaaatcccaagaaataccatatcatgacatctgcatcagtgacgacttaatatggtctcgatgcgtaatgacgcccatcagggtacccaaggtattagaaatgaatgcaggatag

SEQ ID NO: 45393 - protein, 649 aa, Magnaporthe grisea 70-15
MEMNSRLEASVSIYYIKLYFEAGLSHAKKFKICLMTCGTCDWSLFIDVVPSNFNSNILDNWQGFWCNYCHFCMHAACDNWMEVVELYHIVPISFATLASIHVTFELKQIWLNLHHPPLFDARLSSKLPSSNMAKEKRKKPPTGSEGKTIVFLHPDLGIGGAERLVVDAAVGLQKRGHRVVIFTSHCDPSHCFDEARDGTLDVRVRGNTIVPPSILSRFSILCAILRQIHLILQIAIFSSELADLQPDGFFVDQLSAGLPLLAGLSPQLNSPPPHILFYCHFPDLLLAQGRQKWWKRLYRVPFDRLEEWSMGFADAIAVNSGFTKGVVSRTWPALAAKTDLQVVYPCVDVRVPGEPPKEGQSAAEGNKEDVTSELDWKESRILLSINRFERKKNVALAIKAYAGLPKEKRAGVKLVIAGGYDNRVPENVSYHTELTNLADSLDLRHGTTKTVVTALGLARDPSIDVLFLQSVPSALKTALLRSAKLLLYTPAEEHFGIVPLEAMLAGLPVLACDSGGPTETVLEGVTGWLRSPEKPEEWTKVVDMVLNELSDEQKDDMRAAGPKRVKENFAEEQMAERLDRIFDDMEQSASGYNWAGDKWDFSSTLSVLIPCVKSQEIPYHDICISDDLIWSRCVMTPIRVPKVLEMNAG

SEQ ID NO: 45394 - DNA, 1422 bp, Gibberella zeae PH-1
  CDS (1)..(1422)
atggctccagacgccaaagataaaggctcaatcgtcttcttccaccccgatctcggtatcggtggtgcagagcgtcttgtagtagacgctgctgtcggtcttcaggagcgaggtcatcgcgtggtgatatttacgaatcactgcgatcctaagcattgctttgatgaatgtcgtgatggaactctcgatgtccgtgttcgtggtcactggctcatccccatgtccatcctctcccgcctcacaatcctctgcgccatcctccgtcatgtccacctcctcatccacatagctctcaccggcgagctacaagacctaaacccgcgcgcttttatcgtcgaccaactctccgccggccttcctctcatgcgctacatcgcccccgacagcccaatcctcttctactgccatttccccgaccttcttcttgcgcagggtcgcgaatctgccctgaagcgcctgtatcgtcgcccgttcgattggcttgaagaatggactatgggcttcgcgagcgctgtggcagtaaactcgggtttcacaaagggtgttgtgaaccagacgtggcccaatctcaagaagcgcaccgacaccaaagtggtgtatccttgtgtcgacactggggtcaaggaaaaggaagatgctggtaatgatggggacattcctttcaagggcgagaagatcatcttgagcatcaaccgttttgagaggaagaaggatattggacttgcgatcaaggctttcgctgctattcctgaagctgagcgcaagggctgccgtctcattttagcaggcggatatgatcctcgagtttctgaaaacgtccaataccatgccgaactggaagccctcgcctcctcccacggtctcgagcacctcaccaccaagactctcatcaccgctctgtccgcgcccacatccgtccccgtcctcttcctcctctcgatccccaactctctcaaagctacacttcttcgttccgcgcgtgttcttctctacacgcccaaaaacgagcatttcggcatcgttcctctcgaagctatgctcgcacggacacctgttctggccgccaactcaggcggtcctgtcgagacgatcgtggacggtgaaacaggatggttgcgatctccagacgatgtagatgagtgggccaaggtcgtgcgtcttgcgctggaacttggtgatgatcagatcaagtctatgggagatagaagcgaagcaagagtcaaggatatgtttggacgggcgcagatggccagccgattcaacgaaattttggatgacattgttgaaaagaaggcttcatcctccgtgcgcactgttgtcaatgtcgcagcggtctttggtttgggtcttttgggtttggtagcttcagcacttattgctcgtatgggaaagcaagctgagccatcggaattttcagtttaa

SEQ ID NO: 45395 - protein, 473 aa, Gibberella zeae PH-1
MAPDAKDKGSIVFFHPDLGIGGAERLVVDAAVGLQERGHRVVIFTNHCDPKHCFDECRDGTLDVRVRGHWLIPMSILSRLTILCAILRHVHLLIHIALTGELQDLNPRAFIVDQLSAGLPLMRYIAPDSPILFYCHFPDLLLAQGRESALKRLYRRPFDWLEEWTMGFASAVAVNSGFTKGVVNQTWPNLKKRTDTKVVYPCVDTGVKEKEDAGNDGDIPFKGEKIILSINRFERKKDIGLAIKAFAAIPEAERKGCRLILAGGYDPRVSENVQYHAELEALASSHGLEHLTTKTLITALSAPTSVPVLFLLSIPNSLKATLLRSARVLLYTPKNEHFGIVPLEAMLARTPVLAANSGGPVETIVDGETGWLRSPDDVDEWAKVVRLALELGDDQIKSMGDRSEARVKDMFGRAQMASRFNEILDDIVEKKASSSVRTVVNVAAVFGLGLLGLVASALIARMGKQAEPSEFSV

SEQ ID NO: 45396 - DNA, 1437 bp, Aspergillus nidulans FGSC A4
  CDS (1)..(1437)
atggcagaaaaactgctccccaaaccggcgagcataataatcattcatcccgatctcggcattggcggtgcagaacgcctgatcatcgacgtcgccctcgcgctccagaactctggccacaaagtcaccgtctacacgtcgcaccgggacaaatcgcattgcttcgaggaggcgcgggatgggacgcttgaagtacgggttcgcggggacagtttcttcccaccaagtataagaggccggtttgttgttcttttggcgatcttgaggcagctttgcttgacgttcgagttgttgcgggaggtcgcgcaaacggaaaacgagaatgccgaccaagtgtttattgttgaccaggtaccggcctgtgtgccgttactaaagatgcttggtccgcggtggtttgcttcaaagggaaaacaacgcatcctcttttactgtcattttcccgaccaattacttgcgcggcgagatggtgggtctgctttactgcaattgttgaaggggctgtaccggtatccttttgactggtttgagggatgggcgatgagtgcgagtgaccgggttgttgcgaactccactttcacgaagagcgtggtgagaggtgtctttggggcagagaaattgggtgatgtacgggttgtctatccgtgtgttgatacagcggcgaaagagaagagtgagaaggatgtggggactatctgggaagggaagaagatactcctgagtgtgaatcggttcgagaagaagaaggatcttgcgctggcgataagggcatatcatgggcttggggaaaagaggaagggggtaagattggttattgctggcggctatgaccctcgcataacagaaaatgtgcaataccacaaagaacttgatgccctcgcaacaagcctcggcttgcaaaccgccacatcgaagaccgtcccgtctgccctctccatcccctcctccatcgacgtcctctttcttccctcagtgtcctctgccttccgcgacagcctcctggctaaatcctcgcttctcctctacaccccggtgaacgaacactttgggatcgttcccattgaggcaatgcgcgcggggattcccgtccttgcatcgaacacgggcggtccgcttgagacgatcgttgaagggaagacagggtggctccgtgacgtggatgacgtcccagcttggacaggtgtcattgagaaggtgttgtatcagttgggggcggacgagcttcggcagatgagtgtggcggcgaaggagcgcgtcgaggctgagttctcgctgcacgctatgggtgatagacttgagggggagattgggaagatgctgagtactgaacggagacagtttaatggcgcgcaacaagcattgttgcttttgggaatgctgggggtggtatttgcagtgcttgtagggttggttctggcgtgggtcggttttgtataa

SEQ ID NO: 45397 - protein, 478 aa, Aspergillus nidulans FGSC A4
MAEKLLPKPASIIIIHPDLGIGGAERLIIDVALALQNSGHKVTVYTSHRDKSHCFEEARDGTLEVRVRGDSFFPPSIRGRFVVLLAILRQLCLTFELLREVAQTENENADQVFIVDQVPACVPLLKMLGPRWFASKGKQRILFYCHFPDQLLARRDGGSALLQLLKGLYRYPFDWFEGWAMSASDRVVANSTFTKSVVRGVFGAEKLGDVRVVYPCVDTAAKEKSEKDVGTIWEGKKILLSVNRFEKKKDLALAIRAYHGLGEKRKGVRLVIAGGYDPRITENVQYHKELDALATSLGLQTATSKTVPSALSIPSSIDVLFLPSVSSAFRDSLLAKSSLLLYTPVNEHFGIVPIEAMRAGIPVLASNTGGPLETIVEGKTGWLRDVDDVPAWTGVIEKVLYQLGADELRQMSVAAKERVEAEFSLHAMGDRLEGEIGKMLSTERRQFNGAQQALLLLGMLGVVFAVLVGLVLAWVGFV

SEQ ID NO: 45398 - DNA, 1557 bp, Gallus gallus
  CDS (1)..(1557)
atgagagagaggcaatgcctggttggtcccgcccccaagcaacgggcgcttccggcgggtggaggggcggcggcgcgcaagatggtggcgggtgggctgtgcctctgcgggctgctcagattgctgtgctcactgttaatccctgcgttgtttctaagtggagttctgtgcgcctgcttggccatcctgctgtggggaattcggctctggatacaaggaaggagaaagcagcagaccccagcaggaagggatgggaggcggccactgctggttgcattttttcatccctattgcaatgcaggtggtggaggagagagggtcttgtggtgtgccataagaacgctccagaaaaagtacaaaaatgtaacgtgtgttgtttacactggtgatagagatgccactgaagaagacataatagaaggtgctttcagaagattcaacattaaattaactcatcctgtgaagtttgtatttctggaaaaacgctatcttgtggaagcttctctttatcctcacttcactttgctgggacaaagtttaggctctgtgtttcttggttgggaagctcttctaaagtgcgttccagatatttacattgactcaatgggttatgctttcacgctccccctctttaaatatttaggaggttgtcgtgttggatgctatgtccattatcccaccatcagcaccgatatgctttctgtagttaggaatcaggataccaggtttaacaatgcagccttcattacaaacaatcctctcttcagcaaatttaaacttgtctactactacttgtttgccttcatgtacggattggtgggatcctgcagtgacgtggttatggtcaattcttcttggacactaaatcacatcctttctctctggagagctgggccttgcactagcgttgtgtatccaccatgtgatgttcagaccttcctggatatcccgctggaagaggaaaagaacagtgctgaatattctattgtttccatcagtcaattcaggcctgaaaaagatcaccctttgcaaatccgagcttttgctaagttgctgaaggagaagagactgaggcagcagctctcattgaagcttatcttaattggaggctgtcggaaccagcaagatgaagaccgtgtgaataaccttaagagtctttgtgaagagcttggagttagtaacaatgtgatgttcagaataaacattccctttgaggagctaaagaaacacctggccgaggccactatcggtctgcatacgatgtggaatgagcacttcggcatcggagtggttgaatgtatggcagctggcacagttatcctggctcacaattctggaggccccaaactggatattgtggtaccctacgaaggacgtattacaggcttcctagcagagaacgaggacagttatgctgagacaatggcttacatcttttccatgtctcctgaaaaaaggttagagatcagagaaagtgctcgccagtctgtgtgcaggttttctgaccagcattttgaagagacattcctcttatctgtggagcccttatttaaataa

SEQ ID NO: 45399 - protein, 518 aa, Gallus gallus
MRERQCLVGPAPKQRALPAGGGAAARKMVAGGLCLCGLLRLLCSLLIPALFLSGVLCACLAILLWGIRLWIQGRRKQQTPAGRDGRRPLLVAFFHPYCNAGGGGERVLWCAIRTLQKKYKNVTCVVYTGDRDATEEDIIEGAFRRFNIKLTHPVKFVFLEKRYLVEASLYPHFTLLGQSLGSVFLGWEALLKCVPDIYIDSMGYAFTLPLFKYLGGCRVGCYVHYPTISTDMLSVVRNQDTRFNNAAFITNNPLFSKFKLVYYYLFAFMYGLVGSCSDVVMVNSSWTLNHILSLWRAGPCTSVVYPPCDVQTFLDIPLEEEKNSAEYSIVSISQFRPEKDHPLQIRAFAKLLKEKRLRQQLSLKLILIGGCRNQQDEDRVNNLKSLCEELGVSNNVMFRINIPFEELKKHLAEATIGLHTMWNEHFGIGVVECMAAGTVILAHNSGGPKLDIVVPYEGRITGFLAENEDSYAETMAYIFSMSPEKRLEIRESARQSVCRFSDQHFEETFLLSVEPLFK

SEQ ID NO: 45400 - DNA, 972 bp, Gallus gallus
  CDS (1)..(972)
atggccttcgtggcgctctacgtcctcctgctcagcggggagcacgccgacgccttcatctgcgaccaggtgtctgcttgcattccgatacttaggctggccagaacacggaagaaggttttgttttactgtcactttcctgatcagctcctgaccaaaagagaatctttcctgaagcgcctctacagaatgccgctggactggctggaagagtacaccactggcatggcagactgtatcgttgtgaacagcaaattcaccgccagtgtattcaaggagacgtttaaatccttgtctcacataaatccagatgtcctttatccatcactcaacaccagtagcttcgagacagtggttcctgtggacatagctgacttgattcccaaaaagaccaagttcttgtttctatctattaataggtatgagagaaaaaagaaccttgcattggctcttgaagctttgcatgagcttcgaggaagacttgattctcatcagtggagtgaagttcacttggttatggcaggtggctatgacaaacgagttctggaaaacgtggagcattatgaagaactaaggggaattgcagctaagcttaatgttagcgatcatgtcactttcttgagatcattcacagatgaacagaaagtctctctccttaataactgtgtatgtgtgctttacacaccaagtaacgaacactttggcattgttcctctggaggcaatgtatatgagacgtccagttatagcagttaattcgggtggtcctttagaatcaatcttgaataacgttacaggatttttatgtgatcctctgccaacacaattctctgaggccatggaaaaaatcgtgagagatcctctcttgaaggactcaatgggagcagctgggagagtcagatttatggaaaaattttcctcagaagcattctcagaacagctgtatcaatacatatgcagactaacacaataa

SEQ ID NO: 45401 - protein, 323 aa, Gallus gallus
MAFVALYVLLLSGEHADAFICDQVSACIPILRLARTRKKVLFYCHFPDQLLTKRESFLKRLYRMPLDWLEEYTTGMADCIVVNSKFTASVFKETFKSLSHINPDVLYPSLNTSSFETVVPVDIADLIPKKTKFLFLSINRYERKKNLALALEALHELRGRLDSHQWSEVHLVMAGGYDKRVLENVEHYEELRGIAAKLNVSDHVTFLRSFTDEQKVSLLNNCVCVLYTPSNEHFGIVPLEAMYMRRPVIAVNSGGPLESILNNVTGFLCDPLPTQFSEAMEKIVRDPLLKDSMGAAGRVRFMEKFSSEAFSEQLYQYICRLTQ

SEQ ID NO: 45402 - DNA, 1257 bp, Oryza sativa (japonica cultivar-group)
  CDS (1)..(1257)
atggcagcggcggcgggaggagtcgccggcgagccgtcggggacgaggacgaagcagcttaaggtcgccgtgatccaccccgatctcgggataggtggtgctgagagattgatagtcgatgcggcttgtcagcttgcggtccatggtcatgatgttcatgttttcacatcacatcatgacaaaaaccgatgctttgaagagactgtttctggtccatttgaagttaaagtatatggagatttcttgcctcgccatattttttaccgcttccacgctatctgtgcatatcttcgctgcatttttgttgcaatgtgtgtgctactttggtggccctcatttgacatcatattagtagaccaggtttcggttgtgattccactgcttaaactgaaggcaaaatccaagatagtattttattgtcactttcctgatatgttgcttgctcaacatactaccatgcttcggaggttgtatcgcaagccaattgacatgattgaagaaacaactactggtatggcagatttgattctagtaaacagcaagttcactgcaacaacatttgccaggaccttttgcagccttcatgctagaggagtcgagcctgctgttctatatccagctgtctctgttgaacagtttcaggaacctcatgcttataagttgaatttcctctcaattaaccggtttgagagaaaaaagaatcttggtcttgccatttcagcattttctctgcttcgctctgttgcttctatgctacctggtgatgctcgacaggaagtaaccttaacagtagcaggtggatatgataagcgtctcagagaaaatgttgaataccttgaggagctcaaaagattggcagcgagtgaaggggtttctgaacatgtcaaatttgtgacatcttgttcaacttctgaaaggaacgaacttctctccaactgcctttgtgtgttatacactccaaaggatgaacatttcggtattgttcctctggaagccatggccgcatataaacctgtaattgcatgcaacagtggtggtccagtggaaacagtcataaatgacgagacagggtttctctgtgagccctctgcccctgaattttcaaaagccatgctgaagctcgtgaacgatcacgatctagcagttaagatgggtaaacaagcaaggggccatgttgtgcagaagttctcaaccaagacatttggtgaccttctgaacagctatgtccttaatgtgtaccatcagaggattgagtga

SEQ ID NO: 45403 - protein, 418 aa, Oryza sativa (japonica cultivar-group)
MAAAAGGVAGEPSGTRTKQLKVAVIHPDLGIGGAERLIVDAACQLAVHGHDVHVFTSHHDKNRCFEETVSGPFEVKVYGDFLPRHIFYRFHAICAYLRCIFVAMCVLLWWPSFDIILVDQVSVVIPLLKLKAKSKIVFYCHFPDMLLAQHTTMLRRLYRKPIDMIEETTTGMADLILVNSKFTATTFARTFCSLHARGVEPAVLYPAVSVEQFQEPHAYKLNFLSINRFERKKNLGLAISAFSLLRSVASMLPGDARQEVTLTVAGGYDKRLRENVEYLEELKRLAASEGVSEHVKFVTSCSTSERNELLSNCLCVLYTPKDEHFGIVPLEAMAAYKPVIACNSGGPVETVINDETGFLCEPSAPEFSKAMLKLVNDHDLAVKMGKQARGHVVQKFSTKTFGDLLNSYVLNVYHQRIE

SEQ ID NO: 45404 - DNA, 1311 bp, Pan troglodytes
  CDS (1)..(1311)
atggcggaggagcagggccgggaacgggactcggttcccaagccgtcggtgctgtttctgcacccagacctgggcgtgggcggcgctgagcggctggtgttggacgcggcgctggcgctgcagacgcgcgggtgtagcgtgaagatctggacagcgcactacgacccgggccactgtttcgccgagagccgcgagctaccggtgcgctgtgccggggactggctgccgcgaggcctgggctggggcggccgcggcgccgccgtctgcgcctacgtgcgcatggtcttcctggcgctctacgtgctgttcctcgccgacgaggagttcgacgtggtagtgtgcgaccaggtgaggcggccgcggggccggctgcgcgagtgcggacctcgccgtggagggcggccgcgggtgtctgcctgtatcccagtgttcaggctggctagacggcggaagaagatcctattttactgtcacttcccagatctgcttctcaccaagagagattcttttcttaaacgactatacagggccccaattgactggatagaggagtacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgatgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgtaaattcgggtggacccttggagtccattgaccacagtgtcacagggtttctatgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataa

SEQ ID NO: 45405 - protein, 436 aa, Pan troglodytes
MAEEQGRERDSVPKPSVLFLHPDLGVGGAERLVLDAALALQTRGCSVKIWTAHYDPGHCFAESRELPVRCAGDWLPRGLGWGGRGAAVCAYVRMVFLALYVLFLADEEFDVVVCDQVRRPRGRLRECGPRRGGRPRVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 45406 - DNA, 1251 bp, Canis familiaris
  CDS (1)..(1251)
atggcggagaagcggggccgcgacccggagcctgggcccagcccgtcggtgctgtttctgcacccggacctgggcgtgggcggcgccgagcggctggtgctggacgcggcgctggcgctgcaggcgcgcgggtgcagcgtgaagctctggacggcgcactacgaccccggccactgcttcgcggacagccgcgggctgcaggtgcgctgcgccggggactggctcccgcgcagcctgggctggggcggccgcggcgccgcggtgtgcgcctacgtgcgcatggtcttcctggcgctctacgtgctgttcctcggcgacgaggagttcgacgtggtcgtgtgcgaccaggtgtctgcctgcatcccagtgctcaagctggccagacggcgcaagaagatcctgttttattgtcacttcccagatctgcttctcaccaggagagattcttttctgaaacgcctatacagggccccgattgactggatagaggaatacaccacaggcatggccgactgcatcttggtcaacagccggtttaccgctgccatttttaaggaaacattcaagtcgctgtctcacatagaacccgatgtcctctacccatctctcaatgtcaccagctttgactccactgctcccgaaaagctcgatgacctcgtccccgaggggaagaagttcctgttcctctccatcaacagatacgaaaggaagaaaaatctgactttggcactggaagccctagtaaaactgcgtgggagattgacatcccaagattgggacaaggtccatctaatcatggcaggtggctatgatgaaagagtcttggagaatgtggaccactatcaggaattgaagaaaatggtccaacagtctgaccttgcacagtgtgtgaccttcctgcggtctttctcagacaaacagaaaatctcactcctccacggctgtacctgtgtgctttacacaccaagccatgaacactttggcatcgtccctttggaagccatgtacatgcagtgcccggtcatcgctgttaattcgggtgggcccttggagtccatcacccatggtgtcacagggtttctgtgcgagcctgacccagtgcacttctcagaagcaatggaaaagttcatccatgaaccttctttaaaagccacaatgggactggctgggagagccagggtgaaagcaaagttttcctcggaagcctttacagaacagctctaccagtatgtcaccaaactgctggtataa

SEQ ID NO: 45407 - protein, 416 aa, Canis familiaris
MAEKRGRDPEPGPSPSVLFLHPDLGVGGAERLVLDAALALQARGCSVKLWTAHYDPGHCFADSRGLQVRCAGDWLPRSLGWGGRGAAVCAYVRMVFLALYVLFLGDEEFDVVVCDQVSACIPVLKLARRRKKILFYCHFPDLLLTRRDSFLKRLYRAPIDWIEEYTTGMADCILVNSRFTAAIFKETFKSLSHIEPDVLYPSLNVTSFDSTAPEKLDDLVPEGKKFLFLSINRYERKKNLTLALEALVKLRGRLTSQDWDKVHLIMAGGYDERVLENVDHYQELKKMVQQSDLAQCVTFLRSFSDKQKISLLHGCTCVLYTPSHEHFGIVPLEAMYMQCPVIAVNSGGPLESITHGVTGFLCEPDPVHFSEAMEKFIHEPSLKATMGLAGRARVKAKFSSEAFTEQLYQYVTKLLV

SEQ ID NO: 45408 - DNA, 1506 bp, Cryptococcus neoformans var. neoformans JEC21
  CDS (1)..(1506)
atgagccgccccctccgaatagggttcatacatccagaccttggaataggcggggcagagcgtctcgtagtggacgcggctctatctctcaaaaacaaaggccaccatgtcacgatattcacttcgaggcatgatccttctcggtgctttccagagactatagatggcactcttccagtccatgtcctcggatcgtcccttcctcgatcactccaccccaaattcccattcaccatcctcttctccatcctccgatcccttcttcttgctgtccttctcctcacgtctcttcttttacccggtccgccatccattgccaaccctctttcgcctcttcaagggttcgatatcttctttgtcgatcagcaaagtgttgctgtgccgcttctgaggtttgttagcgggacaaggatcgtattttactgtcatttccccgacaaactgcttagcggaggatgggagatcgatgtgggcaaagataaggccgtggtggagagaaaaggggttggcatactgaagcgcatgtaccggtggcctatcgacaagctcgaggagtatacgactggtcaatcggacatcatcatctccaactctgaattctcttctcgcgtttttgccctcgctttcccttctctcgcccagaaacctcgccgagtggtctacccttgtatcgacctatcttcttacacatcaacttcttctgatgtcaaggatggaagcgtcaaccttattcaatccgatcgacctacaatcatttcttttaacaggtttgaggcgaagaagaatgtggacctagccataaggacttttgcaaaacttcgtgacgatgatctcatctcaaaggaagagtttagaaatcttcgatttgtcgttggtggggggtacgaccctgatcaacgggacaatgcccaaactcttctccacctccaaaacctctgtactaacctctccttatcacatcataccattccctcttcctctccaatctctcccaacacgcaaatcattttcctcctcaacttttcctctgcccagcgtgcccatctccttacttctccttctaccttagcgctcttgtacacacccaccaacgagcatttcggtatcgtccccatcgaagccggggcctgcggattacccgtattggcatgcgataccggcggtccggtagagaccgtcgttgatttttccatcccttccaatgctgagaacggcacgggtctcctacgaccaccccgagctgaagaatgggcaccagcgttgaccactctcctccatctctcttcttcccaacgctccattatctctcagagtgctcaaacccgtatcgccgaaaacttttccttggctacgatggggacgcagcttgagaaggcttgtcgggatgcgctagcgatgggtgatttgcatgttcaagttggggataagctaatttggggtggactgggattaatgggttttgcagcgggtgggttgggcgttatttggatggtatggggggtttga

SEQ ID NO: 45409 - protein, 501 aa, Cryptococcus neoformans var. neoformans JEC21
MSRPLRIGFIHPDLGIGGAERLVVDAALSLKNKGHHVTIFTSRHDPSRCFPETIDGTLPVHVLGSSLPRSLHPKFPFTILFSILRSLLLAVLLLTSLLLPGPPSIANPLSPLQGFDIFFVDQQSVAVPLLRFVSGTRIVFYCHFPDKLLSGGWEIDVGKDKAVVERKGVGILKRMYRWPIDKLEEYTTGQSDIIISNSEFSSRVFALAFPSLAQKPRRVVYPCIDLSSYTSTSSDVKDGSVNLIQSDRPTIISFNRFEAKKNVDLAIRTFAKLRDDDLISKEEFRNLRFVVGGGYDPDQRDNAQTLLHLQNLCTNLSLSHHTIPSSSPISPNTQIIFLLNFSSAQRAHLLTSPSTLALLYTPTNEHFGIVPIEAGACGLPVLACDTGGPVETVVDFSIPSNAENGTGLLRPPRAEEWAPALTTLLHLSSSQRSIISQSAQTRIAENFSLATMGTQLEKACRDALAMGDLHVQVGDKLIWGGLGLMGFAAGGLGVIWMVWGV

SEQ ID NO: 45410 - DNA, 1251 bp, Bos taurus
  CDS (1)..(1251)
atggcggagaagccgggccaagatgcggactcagatcctaagccaaccgtgctgttcctgcacccggacctgggcgtaggcggcgccgagcgactggtgctcgacgcagcgctggcgctgcaggcgcgcggatgtagcgtgaagatctggacggcgcactacgacccgggccactgcttcgcggagagccgtgagctgtcggtgcactgcgccggggactggctgcctcgcagcctgggctggggcggccgtggcgccgctgtctgcgcctacgtgcgcatgatcttcctggctctctacgtgctgttccttggcgatgaggagttcgacgtggtcgtgtgcgaccaggtgtctgcctgtatccccgtgttcaagctggccagacggcgtaagaaaatcctgttttactgtcacttcccagatctgcttctcaccaggagagattcttttattaaacgcctgtacagggccccgattgactgggtagaggaatataccacaggcatggcagactgcatcttggtcaacagccgcttcacagctgccattttcaaggaaacgttcaagtccctgtctcacatagaccctgctgtcctctacccatctctgaatatcgtcagctttgattctgctattcctgaaaagcttgatgacatagtcccccaggggaaaaaattcatattcctctccatcaacagatatgaaaggaagaaaaatctgactttggcagtagaagcccttgtaaagctgcgtggaagattgacatcccaagattgggacaaagttcatctgatcattgcaggtggttatgatgagagagtcctggagaacgtacagcactaccaggaactgaagcaagtggtccagcagtctgacctaggtcagtatgtgaccttccttcggtcttgctcagacaaacagaaaatctcactcctccgaggctgcacgtgtgtactttacacaccaagcaatgagcactttggcatcgttcccttggaggccatgtacatgcagtgcccagtcattgctgttaattcaggtgggcccttggagtccgtcgtccacagtgtcacaggatttctgtgtgaccctgacccagaacacttctcagaagcaatagaaaagtttatccatgaaccttccttaaaagccacaatgggactggctggaagaaaccgggtgaaagagaagttttcccctgaagcatttaccgaacagctttaccagtatgtcaccaaactgctggtataa

SEQ ID NO: 45411 - protein, 416 aa, Bos taurus
MAEKPGQDADSDPKPTVLFLHPDLGVGGAERLVLDAALALQARGCSVKIWTAHYDPGHCFAESRELSVHCAGDWLPRSLGWGGRGAAVCAYVRMIFLALYVLFLGDEEFDVVVCDQVSACIPVFKLARRRKKILFYCHFPDLLLTRRDSFIKRLYRAPIDWVEEYTTGMADCILVNSRFTAAIFKETFKSLSHIDPAVLYPSLNIVSFDSAIPEKLDDIVPQGKKFIFLSINRYERKKNLTLAVEALVKLRGRLTSQDWDKVHLIIAGGYDERVLENVQHYQELKQVVQQSDLGQYVTFLRSCSDKQKISLLRGCTCVLYTPSNEHFGIVPLEAMYMQCPVIAVNSGGPLESVVHSVTGFLCDPDPEHFSEAIEKFIHEPSLKATMGLAGRNRVKEKFSPEAFTEQLYQYVTKLLV

SEQ ID NO: 45412 - DNA, 1500 bp, Bos taurus
  CDS (1)..(1500)
atggcgactgctgaaaggggttggtgcttgtgtgagttattgaggtttttttattcattactcttccccgggctatttgtatgtggaactttgtgtgtgtgtttacttattatcctttggggaatccgactgctgctacagagaaagaaaaagtcagtgtcatctagcaaaactgggaaaaatcaaacggtgattgcatttttccatccatactgcaatgctggcggaggaggagaaagagtgttatggtgtgccttaagggctctacagaaaaagtatccagaagcactttatgttgtttacactggcgatgccgacgtcagtggccaacagatactggaaggcgcgttcagaagatttaacatcaggttaactcgcccagtgaagtttgttttcttaaggaagcgctaccttgtggaagattcactctatcctcatttcacactgctgggccaaagtctgggatccattttcctgggctgggaagctctgatgcagtgtgttcccgatgtttacattgattcaatgggctacgctttcacacttcctctgtttaagtatctaggtggttgccgagttggaagctatgttcattaccccaccatcagcactgacatgctctccgtcgtgaagaatcagaatgtgggatttaacaacgcagccttcattaccaggaatccttttctcagcaaagtaaagctcatctactactatttatttgcttttatgtatgggcttgttggttcttgcagtgacatcgtcatggtcaattcttcttggacactgaaccatattctgtcactgtggaaggttgggaactgcactaatattgtttatccaccttgtgatgtgcagacattcttggatcttcccttacatgaagagaaggcaacctcagaacacttactggtttcgattggccagttcaggcctgaaaagaaccatcctttgcagatcagagcctttgctaagttgttgaataagaaggagagtgaatctcttcctccacttaaacttgtgctcattggaggttgtcgtaaccaagatgatgaactcagggtaaaccaactgagaaggcttgctgaggaccttggagttcaagaagatgtggaatttaaaataaacattccgtttgatgagttaaagaattacttgtctgaagcaacagttggtctgcatactatgtggaacgagcattttgggattggaattgttgagtgtatggcagctggcatgattgtcctcgcacacaattcggggggcccgaagcttgacatcgttgttcctcaccacggcgagaggacagggttcctggctgaaagtgaagagggctatgctgagactatggcccatattctttccatgtctgcagaacagaggctccaaatcagaaacagtgcccgtgcatccgtaagcagattctccgatcaggagtttgaagtggcattcctatcgtctgtggaacgattattccaaaaatgccacacctgtacaaattaa

SEQ ID NO: 45413 - protein, 499 aa, Bos taurus
MATAERGWCLCELLRFFYSLLFPGLFVCGTLCVCLLIILWGIRLLLQRKKKSVSSSKTGKNQTVIAFFHPYCNAGGGGERVLWCALRALQKKYPEALYVVYTGDADVSGQQILEGAFRRFNIRLTRPVKFVFLRKRYLVEDSLYPHFTLLGQSLGSIFLGWEALMQCVPDVYIDSMGYAFTLPLFKYLGGCRVGSYVHYPTISTDMLSVVKNQNVGFNNAAFITRNPFLSKVKLIYYYLFAFMYGLVGSCSDIVMVNSSWTLNHILSLWKVGNCTNIVYPPCDVQTFLDLPLHEEKATSEHLLVSIGQFRPEKNHPLQIRAFAKLLNKKESESLPPLKLVLIGGCRNQDDELRVNQLRRLAEDLGVQEDVEFKINIPFDELKNYLSEATVGLHTMWNEHFGIGIVECMAAGMIVLAHNSGGPKLDIVVPHHGERTGFLAESEEGYAETMAHILSMSAEQRLQIRNSARASVSRFSDQEFEVAFLSSVERLFQKCHTCTN

SEQ ID NO: 45414 - DNA, 1224 bp, Apis mellifera
  CDS (1)..(1224)
atgacacgaattacatttcttcatccggatcttggtattggaggagcagaaagattagtaatagatgctgcgttagctttaaagaaaggaggatatgaggttaatttcgtgacaactcatcatgatcctgaacattgtttttctgaaacaaaagatggaacaattcctattacagttgtaggaaattggttacctagacatattttcggtagatttttcgcactttttgcttatattcgtatgatatatgcagctagttatatcattttttgtgaacatcgaccagatattgtattctgtgatttagtttctgtatgcattcctattcttcgattacgaattccatatataattttttattgtcattatccagatcagttgctttcacaatcaaagggaattagtaaacaattatatcgtgcacctcttaattatttagaagaattaacaactggaatggcacataaaatatttgtaaatagcatatatacactttctgtatttaaagatacttttaagaaattgtatattgaacctgaagttttatatccttctattaatactgacttttttgataaaactcgaataatatccttagaaagaatatttgataaaaaattgccatcaaatagtattatattattgtctattaatagatatgaacgtaaaaaaaatttagaactagcaatagaagcattggcagaacttcaaaaatatttgacagaagaagaatataaaaaagtatatttaattatggctggtggatatgataaaagagttgaagaaaatgtagaatattatttggaattaataggacttgttgatgaattacatgtaacagaaaaagtaatatttcttcgatctccttcagatattgataaaatatctattttacatcattgtaaaattatattgtacacacctccaaatgaacattttggtattgtaccacttgaagcaatgtatatgagtaaaccagtaattgcacataattctggtgggccaaaagaatctataatttctggagttactggatttttggttgatttatctggtgatgcatttgcttcaaaaatagcttatttaattaaaaatccagaatatattcaagaatttggaaatgcaggcaaagatagatttatgaaaacttttagttttgctgcatttaatgctcaattaaatgaagcaattgaagatttaataagtaataaaaaaataaagtaa

SEQ ID NO: 45415 - protein, 407 aa, Apis mellifera
MTRITFLHPDLGIGGAERLVIDAALALKKGGYEVNFVTTHHDPEHCFSETKDGTIPITVVGNWLPRHIFGRFFALFAYIRMIYAASYIIFCEHRPDIVFCDLVSVCIPILRLRIPYIIFYCHYPDQLLSQSKGISKQLYRAPLNYLEELTTGMAHKIFVNSIYTLSVFKDTFKKLYIEPEVLYPSINTDFFDKTRIISLERIFDKKLPSNSIILLSINRYERKKNLELAIEALAELQKYLTEEEYKKVYLIMAGGYDKRVEENVEYYLELIGLVDELHVTEKVIFLRSPSDIDKISILHHCKIILYTPPNEHFGIVPLEAMYMSKPVIAHNSGGPKESIISGVTGFLVDLSGDAFASKIAYLIKNPEYIQEFGNAGKDRFMKTFSFAAFNAQLNEAIEDLISNKKIK

SEQ ID NO: 45416 - DNA, 1428 bp, Cryptosporidium parvum
  CDS (1)..(1428)
atgagggtgtcaagttcatctttacttttcgatagaatgaagcctattaagagagttgcagttactcatcttgagtgtggtataggaggcgcagaacaactaatggtattagcatctctagcattacagagctacaaatcttcaaatgagaaaatcgagctgaccttgttcacttcttaccatgataagtctcactcattttctgccacaaatgatggcaggatcaaagtaaaagtttatggaaattggattccaagaacattttttggttacggtacaacattattttcctatattagaattatttatacttctcttataatgttttttttcgtaatgatgacatcattttcacttgagaaaacaagtagatactacgatgtgattttgaatgatcaagttagtgtaatcaatcctattttgaaattgatgactagaagactaatattttattgtcattttcctgatcagttgttggttagaaaaagagatggttctcttagaaaaatgtatagatatgtcatggactttttagaggaatttggcatgagatattgcgattatgtatttgtaaattcaatttttaccagaaaggtttatatagaaacattcaaaggattgatttctaatgcaaataaatatcctcttactttaagctatcctgaggtactttatccaccagtaaatctggaggatatcccctcagaagaagaatgtgaaaactgtttttcaaattcaaaaatacctcagcagctgaacagagcaccaaatgtaccatttttcttatcattaaatagatatgaaaggaaaaaaaatattgaacttgctattaagtcattcgcaatattacgtgaccaatacaagccaggagagaaattgtgtcttgttatttctggaggctatgacaaaagagtttcagagaatatcgagtattttgaagaacttctcaggcttgctaattcttatgcttttaatgtttatattggaaatgaatgtattgaatcaactgattcttgtttctccgttgtctttttaaggagtatttctgactcacttcgttggtctttactaagaaaatcaattggacttctttacactcctgaaaatgaacattttggtatggttccatgcgaagcaatgtctgtggggacttgtgtgattgcctgcaactctggcgggccaactgaaacaatagtgcatggaaaaactggttttctttgcgaaccaaatccagaaaattttgcgattagaatgaatgagctcattaaaattagtagagacagtatagagagctcagtttggagtagttcgtgtaaagaaagagtaactgcattatttagtcagagcattttccagaaaaggctctgtgaagtagcttattcaaatgagactaaatcaaaagtattcaagaagataaaacatttataa

SEQ ID NO: 45417 - protein, 475 aa, Cryptosporidium parvum
MRVSSSSLLFDRMKPIKRVAVTHLECGIGGAEQLMVLASLALQSYKSSNEKIELTLFTSYHDKSHSFSATNDGRIKVKVYGNWIPRTFFGYGTTLFSYIRIIYTSLIMFFFVMMTSFSLEKTSRYYDVILNDQVSVINPILKLMTRRLIFYCHFPDQLLVRKRDGSLRKMYRYVMDFLEEFGMRYCDYVFVNSIFTRKVYIETFKGLISNANKYPLTLSYPEVLYPPVNLEDIPSEEECENCFSNSKIPQQLNRAPNVPFFLSLNRYERKKNIELAIKSFAILRDQYKPGEKLCLVISGGYDKRVSENIEYFEELLRLANSYAFNVYIGNECIESTDSCFSVVFLRSISDSLRWSLLRKSIGLLYTPENEHFGMVPCEAMSVGTCVIACNSGGPTETIVHGKTGFLCEPNPENFAIRMNELIKISRDSIESSVWSSSCKERVTALFSQSIFQKRLCEVAYSNETKSKVFKKIKHL

SEQ ID NO: 45418 - DNA, 1518 bp, Dictyostelium discoideum
  CDS (1)..(1518)
atggacgaattaataatgatggtttttgtgttattcacaatagtattattattaacagtttcaatgacattggcagcattaatttcaaccattgtggtattagttgtaccattaattatttgtataatagcattattaattgcattaagaattaaatatggtagtaaaaaagatctaagtgaagtttcaataggatttttccatccatattgtactgcaggtggaggtggtgaaagagtattatggtgtgcaattaaatcaattcaagaagaatatccatatgttagatgtgttgtatatacaggtgataaagagagtgatgatgaaatatttaataaagtaaagaaaacatttgatatagaattgggtagagataatttagaatttattagattgaaaaaaagaaaatgggtagaagcatcaacatacccaagatttacattaattggacaaagtttaggatcaatgatattaggttgggaagcattaaccaaatttgttccaaccattttcttggattcaatgggttatgcattcacattcccaatattttcattaattggtggttcaactgttgcatgttatgttcattatccaacaattagtagtgatatgatctcttctgttaaatcatcatcatattcttttaataatgatgtttcaatttcttcaaataaatttaaaactatttcaaaattaatatattataatatattttcaaaaatttatcaaattgttggtagtttttcaaaattagtaatggtaaatggaacatggacaggcaatcatattagagatatttggaagaaacaatttggatatgatttatttatagtttatccaccagtcgatgttaaaggtagaaaacaattgaaattgggttggatggatggtactagaaagaatatgatattgtcgattgcacaatttagaccagaaaagaatcaccaattacaattgagaacattggctcatctattggagaaatatccatcacatagagaacaaccattgaataccaaattagtattggtaggtggtgttcgtgatcaagccgatcgtgatagagttgaacaattacgtaacctttcaaaagaattaaatattgaagatcatgttgaattccaaattggtattagctcagatcaacttaatcaactattaagtgaagcatcagttggtatacatacaatgtataatgaacattttggtattggtgtagtggaattaatggctgctggtgttataccagttgcaaacaatagtgcaggtccaaaagaagatattgtacgtcatgaagatactggtttcttagcttcaaccattcaagagtatgctgaatacattcatgaaattttagcatatcgtgaaaaatatgttgaaatgcaaaagaaagccagagattcaactgaccgtttctctgaatcaaatttttcaaatcaatttttaaaatatattaaaccattaattaatcaaagtttaagaaataataatagtagtagtaaaaaaagaaattaa

SEQ ID NO: 45419 - protein, 505 aa, Dictyostelium discoideum
MDELIMMVFVLFTIVLLLTVSMTLAALISTIVVLVVPLIICIIALLIALRIKYGSKKDLSEVSIGFFHPYCTAGGGGERVLWCAIKSIQEEYPYVRCVVYTGDKESDDEIFNKVKKTFDIELGRDNLEFIRLKKRKWVEASTYPRFTLIGQSLGSMILGWEALTKFVPTIFLDSMGYAFTFPIFSLIGGSTVACYVHYPTISSDMISSVKSSSYSFNNDVSISSNKFKTISKLIYYNIFSKIYQIVGSFSKLVMVNGTWTGNHIRDIWKKQFGYDLFIVYPPVDVKGRKQLKLGWMDGTRKNMILSIAQFRPEKNHQLQLRTLAHLLEKYPSHREQPLNTKLVLVGGVRDQADRDRVEQLRNLSKELNIEDHVEFQIGISSDQLNQLLSEASVGIHTMYNEHFGIGVVELMAAGVIPVANNSAGPKEDIVRHEDTGFLASTIQEYAEYIHEILAYREKYVEMQKKARDSTDRFSESNFSNQFLKYIKPLINQSLRNNNSSSKKRN

SEQ ID NO: 45420 - DNA, 1263 bp, Dictyostelium discoideum
  CDS (1)..(1263)
atggtaaaagatgaaaaagaattaaatattgcaattttacatccagatttaggtattggtggagcagagagattaatcgttgatttagcattaggattaaagagtgttggaaataatagaatcacaatgtacacatcaagacacgacccaaagagatgctttaaagagacatctaatggtgaattggacgtacacgtcacaggtggctatttcccaagacatattttcaatagatttatggtaatttgcgcaatcattagaaaccttttagcagcattatacatcatctttttctctggtcaaaagtatgacgtgattgtattggaccaaatctcagcctcaattccattatttaaactatttacaaattctaaagtactattctactgtcatttccctgacaaactattaacatcgagaacatcattaatcaaaagactctatcgtataccaatcgacctcttcgaagagtttaccactggttgtgccgatcaagtattggtcaatagtaacttcacttcatcaatttataaacaatcttttaaacatctcaaaaattcaccatcagtattatacccaatcatcaatacaaacgaatttgataaaacaaaacaatctcataatttttcaaatcaaccaattgaaaataatttaattaatccaattaaattagatgataaaaaattctttttgtcaattaatagatatgaaagaaaaaaagatttaaaattagcattggatgcatttagtgtatttattagtaatagtgaaagtggtggtagtggtaaaggtaaagatgaaatttatttagtatttgcaggtggatatgatacaggattaaaagagaatgttgaacatttacaagaattaaaagataaagccaaagaatatggattagagaatcgtgtaattttcttgataacaattaatgaagaacaaaaacaatggttattattaaactgttgttgtttaatttatacaccatcatttgaacattttggtattacaccattggaaggaatgtatgctggtaaacctgtgattgctgttaataatggtggtccattagaaacagttgtcgatggtaaaactggttacctttgtaatccaaccgttaaagattttgcaaatgctttcaataaaattatcaatgatcctatcaattccaaaaaaatgggtatcaatggtaaacaacgtgtaaatgataaattttcttttaaaccatttgctcaaaatttaaatacaattgttaaaaaactataa

SEQ ID NO: 45421 - protein, 420 aa, Dictyostelium discoideum
MVKDEKELNIAILHPDLGIGGAERLIVDLALGLKSVGNNRITMYTSRHDPKRCFKETSNGELDVHVTGGYFPRHIFNRFMVICAIIRNLLAALYIIFFSGQKYDVIVLDQISASIPLFKLFTNSKVLFYCHFPDKLLTSRTSLIKRLYRIPIDLFEEFTTGCADQVLVNSNFTSSIYKQSFKHLKNSPSVLYPIINTNEFDKTKQSHNFSNQPIENNLINPIKLDDKKFFLSINRYERKKDLKLALDAFSVFISNSESGGSGKGKDEIYLVFAGGYDTGLKENVEHLQELKDKAKEYGLENRVIFLITINEEQKQWLLLNCCCLIYTPSFEHFGITPLEGMYAGKPVIAVNNGGPLETVVDGKTGYLCNPTVKDFANAFNKIINDPINSKKMGINGKQRVNDKFSFKPFAQNLNTIVKKL

SEQ ID NO: 45422 - DNA, 1143 bp, Entamoeba histolytica HM-1:IMSS
  CDS (1)..(1143)
atggataataacactaaaactgctatcattattcatcctgatcttggtattggtggagctgaacgacttgttgtagatattgctcttgcattggaacatgaagattatgacgttaaattttatacatcacatcatgataaagaacattgttttccagagacaaaaggaaggttccaagtatttgttcatggagattttcttccaattacattatttggatatttttatattttctttgctacaataagagctctttatttatcaataattgttgcatggaaaactaatgcagacatttatattgttgatcaaatttcaattggagttccaatattaaaactctttaataaaaaggtattgttttattgtcatcatccagataaatgtctttgtaaagaaggaggatttatgaaaaagatatatagaatcccttttgattggttagaagaaaaatctatgggactaacatttccaagtcattctagaacaccacaagtactttatccaacatataatcctattttagaagaatcaatgaatagtgaaagtccatttgaagaagaacctaaagaagaattttggtttatttcaattaatagatatgaaggaaagaagaatcataaagtagcacttgaagcattaagtttattagaagatgatttaaaaaataatgttagaattattattgctggtggttatgatcttagagtaaaagaaaataaagatgtctataatgaattagaacaactttcacatcaattacatattgaagatcatgtatctttacttaaaaatttctcaaatgaagaacgtgaatatctttttaaaaaagctactgctgtattatatactcctccatttgaacatttcggtattgttccattagaagcaatgattaaaggagtaccagtaattgcttgtaataatggtggtccattagaaacagttcaaaatgaattaacaggactgctttgtgatggaagtaaagaaggatttgcagcatgtatatctcgactatgtcatgataacaacttaagacaaaaattaaagttaaatgctaagaaagcaactaaagaaaagtttgggtttgaaacatttacaaagaaagtatcagaggttgtacatcaagtcatatcaaactaa

SEQ ID NO: 45423 - protein, 380 aa, Entamoeba histolytica HM-1:IMSS
MDNNTKTAIIIHPDLGIGGAERLVVDIALALEHEDYDVKFYTSHHDKEHCFPETKGRFQVFVHGDFLPITLFGYFYIFFATIRALYLSIIVAWKTNADIYIVDQISIGVPILKLFNKKVLFYCHHPDKCLCKEGGFMKKIYRIPFDWLEEKSMGLTFPSHSRTPQVLYPTYNPILEESMNSESPFEEEPKEEFWFISINRYEGKKNHKVALEALSLLEDDLKNNVRIIIAGGYDLRVKENKDVYNELEQLSHQLHIEDHVSLLKNFSNEEREYLFKKATAVLYTPPFEHFGIVPLEAMIKGVPVIACNNGGPLETVQNELTGLLCDGSKEGFAACISRLCHDNNLRQKLKLNAKKATKEKFGFETFTKKVSEVVHQVISN

SEQ ID NO: 45424 - DNA, 1338 bp, Entamoeba histolytica HM-1:IMSS
  CDS (1)..(1338)
atggttgtgttacttactttctgtattcttttaccaattattatcttaattttattaattttaagatttaaataccaaaaaaagaggactatagctttcttccatcctaattgttctgctggaggaggaggagaaatggtactatgggttataattaaagttcttcttcaatcattccctaattattctattgttatctttactgctgatacatctccaaaagataagatattagaaaaagtaaagtcaacatttggttttgatttcttagactgtaacattaagttctatcaaatcaaacatagttattctttagttataaaaaaatatccctttttaactttattctttcaagcaattggttcaatgatttgttgttttgatgcattaattaaatgcaatgcagaatatttctttgacactacaggatgtgcatttacttatccatttgcatggttagcaggtgcaaagattatgacttatactcattatcctactatatcaactgatatgcttaatgtagttcaaaagagagaagttagtattaacaatacaaatacaattgcacgtagttcaatactttcaactatgaaagtcttttattataaaatatttgcttacctttattacttagttggaaatttagcttctttagtctttgttaatggaacttggactaaaaaccatatttctcaattatggaaaattcaacctcacttactctatcctccatgtgatattaatgtatctaatctaaatgaaaaaaattcatcttgtcatcttatcatttctataggacaatttagacctgaaaaaagacatttagtgcaaatagaagctatcaatattttagtacaagaacatcctgaaattaaaaataaaataaaattcgtagttattggtggagctcgtgatgcagaagaccttaaacgtaaagaagaagttattaaaacaattgaaaaagacaaattaactgacattattacagtgcctgaaagtacttcatatgaacaaaaaattgaatatctaaagaatgctgagattggtcttcacactatggttaatgaacattttggtatttgtgtggtagagtatatgggatttggagttattcctgttgctcataaaagtgctggaccagaattagatattgttgatgatcaatgtggttatcttgcaacaacacctaaagaatatgcagatgctattttcaagattataaatgatccagaaaagactgctcaaatgagacaagccgcaattcaaaaagctaaaaagttttcagtctcggcttttgaaaaacagtgtgaaaaagaattacttgaatttttgaaataa

SEQ ID NO: 45425 - protein, 445 aa, Entamoeba histolytica HM-1:IMSS
MVVLLTFCILLPIIILILLILRFKYQKKRTIAFFHPNCSAGGGGEMVLWVIIKVLLQSFPNYSIVIFTADTSPKDKILEKVKSTFGFDFLDCNIKFYQIKHSYSLVIKKYPFLTLFFQAIGSMICCFDALIKCNAEYFFDTTGCAFTYPFAWLAGAKIMTYTHYPTISTDMLNVVQKREVSINNTNTIARSSILSTMKVFYYKIFAYLYYLVGNLASLVFVNGTWTKNHISQLWKIQPHLLYPPCDINVSNLNEKNSSCHLIISIGQFRPEKRHLVQIEAINILVQEHPEIKNKIKFVVIGGARDAEDLKRKEEVIKTIEKDKLTDIITVPESTSYEQKIEYLKNAEIGLHTMVNEHFGICVVEYMGFGVIPVAHKSAGPELDIVDDQCGYLATTPKEYADAIFKIINDPEKTAQMRQAAIQKAKKFSVSAFEKQCEKELLEFLK

SEQ ID NO: 45426 - DNA, 1392 bp, Cryptosporidium hominis
  CDS (1)..(1392)
atggaacctattaagagagttgcagttactcatcttgagtgtggtataggaggcgcagaacaactaatggtattagcatctctagcattacagagctacaaatcttcaaatgagaaaatcgagctgaccttgttcacttcttaccatgataagtctcactcattttctgccacaaatgatggcaggatcaaagtaaaagtttatggaaattggattccaagaacattttttggctacggtacaacattattctcctatattagaattatttatacttctcttataatgttttttttcgtaattatgacatcattttcacttgagaaaacaagtagatactacgatgtgattttgaatgatcaagttagtgtaatcaatcctattttgaaattgatgactagaagactaatattttattgtcattttcctgatcagttattggttagaaaaagagatggttctcttagaaaaatgtatagatatgtcatggactttttagaggaatttggtatgagatattgcgattatgtatttgtaaattcaatttttaccagaaaggtttatatagaaacattcaaaggattgatttctaatgcaaataaatatcctcttactttaagttatcctgaggtactttatccaccagtaaatctggaggatatcccttcagaagaagaatgtgaaaactatttttcaaattcaaaaatacctcaacagctgaacagagcaccaaatgtaccatttttcttatcattaaatagatatgaaaggaaaaaaaatattgaacttgctattaagtcatttgcaatattacgtgaccaatacaagccaggagagaaattgtgtcttgttatttctggaggctatgacaaaagagtttcagagaatatcgagtattttgaagaacttctcaggcttgctaattcttatgcttttaatgtttatattggaaatgaatgtattgaatcaactgattcttgtttctccgtcgtctttttaaggagtatttctgattcacttcgttggtctttactaagaaaatcaattggacttctttacactcctgaaaatgaacattttggtatggttccatgcgaagcaatgtctgtggggacttgtgtgattgcctgcaactctggcgggccaactgaaacaatagtgcatggaaaaactggttttctttgcgaaccaaatccagaaaattttgcgattagaatgaatgagctcattaaaattagtaaagacagtatagagagctcagtttggagtagttcgtgtaaagaaagagtaactgcattatttagtcagagcattttccagaaaaggctttgtgaagtagcttattcaaatgagactaaatcaaaagtattcaagaagataaaacatttataa

SEQ ID NO: 45427 - protein, 463 aa, Cryptosporidium hominis
MEPIKRVAVTHLECGIGGAEQLMVLASLALQSYKSSNEKIELTLFTSYHDKSHSFSATNDGRIKVKVYGNWIPRTFFGYGTTLFSYIRIIYTSLIMFFFVIMTSFSLEKTSRYYDVILNDQVSVINPILKLMTRRLIFYCHFPDQLLVRKRDGSLRKMYRYVMDFLEEFGMRYCDYVFVNSIFTRKVYIETFKGLISNANKYPLTLSYPEVLYPPVNLEDIPSEEECENYFSNSKIPQQLNRAPNVPFFLSLNRYERKKNIELAIKSFAILRDQYKPGEKLCLVISGGYDKRVSENIEYFEELLRLANSYAFNVYIGNECIESTDSCFSVVFLRSISDSLRWSLLRKSIGLLYTPENEHFGMVPCEAMSVGTCVIACNSGGPTETIVHGKTGFLCEPNPENFAIRMNELIKISKDSIESSVWSSSCKERVTALFSQSIFQKRLCEVAYSNETKSKVFKKIKHL

SEQ ID NO: 45428 - DNA, 1344 bp, Cryptosporidium hominis
  CDS (1)..(1344)
atgatttttaattctttcaaaatttggaaggaagagagaaaaagtacaataggattttttcatcctcagtgtggtaactttggtgggggcgaaaaggtattatggtgtattatatatgaagttctaaataccaatataaaaaataaggttgtgatatattctacttgtaaacttgataggactgaaattgttaagaaagttgagagtttatttagaatccctttaaatcgtcccgagtttgttgacaggattaaaatcgtcgaattaaagttagggtttcttttacaacttgcattttttagactctggagtgtaaacttagcagctttaattgtttctctggagggtttattgtttagctggccatttccggaagtttttgtagaaacagcaggattcccgtttgcactaataccagcaagagttctcccaacaactaaacatatttcaacatatattcattatcctcaagttagcaaagaaaatattgaaagtgaaagggaaaggaatattctaagatatttttacttaaaactattcttgtttgtttataaacttagtattggtcttgcaaacaaggttgttgtaaattcaaattggacgtttaataagcttaatgagctttgggagaaaaattctattgaaatgagtgtttgctatccacctataaatatagatcattcactaaataagttagtagatccaaaactaagaaaaaatgtgattatttcactttcacaatttagagttgaaaaaaatcattttgtacaaatacgaattttctctggagtacttaaaaggatcaaggaaattattaataaagcgagcaaagaagagaaaattaggcttgaaaaaatctatgaagaaataaggtttaaaatgtgtggaacttcacaggattcaaatcctaaatacaaggattatctaaattcccttaaacaaatgatagtagatgagaagcttgaagagaagttagagctagttattaattcaagttcaacagagttgcagaatattatgagcacatcaaggtttgcaatccacacaatggaagatgaacattttggtatctgcgttgcagaattcgtctgctccggcttgttaacgtttgcacacaagtcaggagggcctgagaaagacatcctaacgagattcaatggacaagatgtcgggttcttggcatcgaacatccaggagtttgtggaaaaactcacacatgcaatcatttactatgaaagcccagctattcaaggcattttaaacaatgcacttaagtcagtatttgaaaggtatcaggataatatctcgtttggaaagacatgttggagagctctaaatatataa

SEQ ID NO: 45429 - protein, 447 aa, Cryptosporidium hominis
MIFNSFKIWKEERKSTIGFFHPQCGNFGGGEKVLWCIIYEVLNTNIKNKVVIYSTCKLDRTEIVKKVESLFRIPLNRPEFVDRIKIVELKLGFLLQLAFFRLWSVNLAALIVSLEGLLFSWPFPEVFVETAGFPFALIPARVLPTTKHISTYIHYPQVSKENIESERERNILRYFYLKLFLFVYKLSIGLANKVVVNSNWTFNKLNELWEKNSIEMSVCYPPINIDHSLNKLVDPKLRKNVIISLSQFRVEKNHFVQIRIFSGVLKRIKEIINKASKEEKIRLEKIYEEIRFKMCGTSQDSNPKYKDYLNSLKQMIVDEKLEEKLELVINSSSTELQNIMSTSRFAIHTMEDEHFGICVAEFVCSGLLTFAHKSGGPEKDILTRFNGQDVGFLASNIQEFVEKLTHAIIYYESPAIQGILNNALKSVFERYQDNISFGKTCWRALNI

SEQ ID NO: 45430 - DNA, 1572 bp, Danio rerio
  CDS (1)..(1572)
atgagtttgaacaaaagcgcttccgggatctgtcaggtgacgtgttgtgttgtcatatatttggagaagatgtcagcgcacgatcacttttccctttgtctgtgcgatttaataaggttactctggtctcttatgttaccatgcttctatctgagtttcctcctgacaactatccttttcctcttcatcatgggggtgagaagttggctgcagatgaagaggaagaccagaagagttcaggatggccggcctgccgtggcttttttccacccatactgcaatgcaggaggaggaggagaaagagtgctgtggtgtgctttacgggctcttcaaaacaggtaccaagatgtttctttcgtggtctacacgggtgatcagggggtgacggcagaagagattttggatggagcacggagacgctttaacatcagactcccccgacccgttaagtttgtgttcctgaagcatcgtctactggtggaggcaaaactttacccacatttcacccttctggggcagagtgtgggctccatcttcttggggtgggaggcattgaccgagtttgttccagatctctatattgactcaatgggcttcgccttcaccttacccgtgttccgctatctgggtggttgtcaagtgggaagctatgtgcactacccaaccatcagcacggacatgctgtctgtggttcgagaaagaaaccccaggttcaacaatgcagactacatctccagcaaccctgtactcagtgccattaaggtgatttattattgtgtcttcgcactgctgtatggcctggctggctcctgtagtgacgtcatcatggtcaattccacctggactttgggtcacattctggctctgtggcgcactccgaaccgcaccagtgtggtttacccaccatgcgatgttcaggcattcctggatgttccaattggggaagacaatgaagagaaagagcaaaagaagtgtcacagtctggtctctgtgggtcagttccggccagaaaaagaccatcagctgcagatcagggcatttaaaaagcttttaaacagaaaggaggcggagcttgcgggaagagaggctgtgaagctggtgctgattggtgggtgtcggaaccaggaggatgaagatcgggttctgatgctgagaggattgtgccaggagctgggcatagcagacagggtggagtttaagctcaatattccattccaggagctgaagaaagatttagcagatgccactatcgggttgcacacaatgtggaacgaacattttggcattggtatagtggagtgtatggctgcaggaacaataattctagctcacaaatctggcggtccaaagttggacattgtagttccatacgatggtggtcccaccggctttctggcagatgatgaagacaattacgcagacgccatggaacgaatcctttctatgagtcctgctactcggttagaaatgcgacgccgggcccgtctgtccgtctcccgcttctcagatcaggagtttgaaggttcatttctgtcagcaatggagcctctgatgtcaacattgagagcgtga

SEQ ID NO: 45431 - protein, 523 aa, Danio rerio
MSLNKSASGICQVTCCVVIYLEKMSAHDHFSLCLCDLIRLLWSLMLPCFYLSFLLTTILFLFIMGVRSWLQMKRKTRRVQDGRPAVAFFHPYCNAGGGGERVLWCALRALQNRYQDVSFVVYTGDQGVTAEEILDGARRRFNIRLPRPVKFVFLKHRLLVEAKLYPHFTLLGQSVGSIFLGWEALTEFVPDLYIDSMGFAFTLPVFRYLGGCQVGSYVHYPTISTDMLSVVRERNPRFNNADYISSNPVLSAIKVIYYCVFALLYGLAGSCSDVIMVNSTWTLGHILALWRTPNRTSVVYPPCDVQAFLDVPIGEDNEEKEQKKCHSLVSVGQFRPEKDHQLQIRAFKKLLNRKEAELAGREAVKLVLIGGCRNQEDEDRVLMLRGLCQELGIADRVEFKLNIPFQELKKDLADATIGLHTMWNEHFGIGIVECMAAGTIILAHKSGGPKLDIVVPYDGGPTGFLADDEDNYADAMERILSMSPATRLEMRRRARLSVSRFSDQEFEGSFLSAMEPLMSTLRA

SEQ ID NO: 45432 - DNA, 1413 bp, Aspergillus fumigatus Af293
  CDS (1)..(1413)
atggcccgcctcaaaccctccaaagttatcatcatccacccagacctgggaattggcggcgcagagcgcctaatcattgacgtggcgctggcgctgcagtcccgcggccacagagtcaccatctacacctcccaccgggacaaatcgcactgcttcgaggaagcacgcgacggcacgctcgacgtgcgcgtgcgcggcaactccctcttccccgcgcatgtcggcggccgactacacgtcctcatggccgttctacggcaattgcatctgaccgtctcggtgttgagggagattgcgacctctgaagaaaaagacaacatcttcatcgtcgaccaggtccccgcttgcgtgccgcttctgaaaacgctgggcccgcgcgcggcgcgcagcagtcgcagtcgccagcgcatcctcttctactgccatttccctgatcagttgcttgcacgtcggaatgagggcggggagctgttgcgacttgcgaagacgctctaccggtatccgtttgattggtttgaggggtgggcgatgagcgcgtcggataaggtcgttgccaactcgaggttcacgcgcggggtcgtgagcgaggtcttcgggaaggagaagctgggagatgttcggattgtctatccgtgtgtcgataccaaggctggcgcgccggttgggaccgaggaaggtcctttatggggtggaaagaagatcttcttgagtgtgaatcggttcgagaggaagaaggatttggcgctggccattcgtgcgtatcacggtcttgggcaggagaagcggagggggacgcggttggtggttgctggcggttacgacaatcgggtccaggagaatgtccaataccatcgagaactagaccagctcgccacaagtttgggattacagaccgcgacctctaaaacagtcatctccgccctatccatccccgactccatcgacgttctgttcttgctctccgtaccaactgccttccgggatacgctcctctcgcaggcaaaactgcttctctacactcccatcaacgaacactttggtattgtccccgtcgaagccatgcgcgccgggatccccgttctcgcatcaaatacaggcgggccattagaaactatcgtggaaggcgaaacgggctggctccgggacgcaacggttgtcgcggattggactgcggtcatggaccgggttctctacgagatggaccagaaggacttggaccgcatgtcagccgtgagcaaggcgagagtggagaaggagttctcgctgactgcaatgggtgacaggctcgaggaggagatcaccgatatgctcagcaaggaaagacggccgttcagcggttttcaccagctaatcctcgtctttgccctgttgggtattatgtcttctattcttgccgtgtgggctttgaaatga

SEQ ID NO: 45433 - protein, 470 aa, Aspergillus fumigatus Af293
MARLKPSKVIIIHPDLGIGGAERLIIDVALALQSRGHRVTIYTSHRDKSHCFEEARDGTLDVRVRGNSLFPAHVGGRLHVLMAVLRQLHLTVSVLREIATSEEKDNIFIVDQVPACVPLLKTLGPRAARSSRSRQRILFYCHFPDQLLARRNEGGELLRLAKTLYRYPFDWFEGWAMSASDKVVANSRFTRGVVSEVFGKEKLGDVRIVYPCVDTKAGAPVGTEEGPLWGGKKIFLSVNRFERKKDLALAIRAYHGLGQEKRRGTRLVVAGGYDNRVQENVQYHRELDQLATSLGLQTATSKTVISALSIPDSIDVLFLLSVPTAFRDTLLSQAKLLLYTPINEHFGIVPVEAMRAGIPVLASNTGGPLETIVEGETGWLRDATVVADWTAVMDRVLYEMDQKDLDRMSAVSKARVEKEFSLTAMGDRLEEEITDMLSKERRPFSGFHQLILVFALLGIMSSILAVWALK

SEQ ID NO: 45434 - DNA, 1818 bp, Ustilago maydis 521
  CDS (1)..(1818)
atggttctcgatcggcagtcagccgctgtggctaactcggtgcattcgccacgcaaaaagctgcgcatcggcttcgtccatcctgaccttggcatcggtggagctgaaaagctggtggtagacgctgcactctcactccaacaacttgggcacgaggtggtcattttcacttcgcatcacgatccgcgtcattgctttgaggctacacgcgatggaacgctcaaggtacaagtgatgcgtaccgcgataccgcgctctttgcttggcggcttccatcttccatgtgccatcttgcagcagatgagcctcgttttccagctcatcctcgcagttaccctgttcaactatcctggtactatgccacgctttgtttcgaaacgtatgacctcttcgccccccattcctggattcgatctgttcttcttcgaccagctacccgcgggtattccgtggctcaagatcatactggcgacgcgcgtcgtctattactgccactttccggacaaggacattagcaactcgattgcgatgcaaagggcacatgccagaggcgagtcgggtccatcggtcttgcgcaaactgtatcgcataccatttgacctgttcgaagaaggcaccaccgattattccgacaagatcttggtcaattccgagttcacctcggctcaattcgtcaagtccttcttccgtctcaggaggcagcccagggtgtgctatccaggcgtggaaatggatcagttcaagccggagagggtggagcaggcgctcaaaaaactcgagaccgaggcaaagcaaatgggcgacccgatacgaggttccattgccaagttctgcaaggacgagagcaagacgaccctgctctcgatcaaccgatttgaggcgaaaaagaatgtggcactggctttggaggctttcgccattgcgcagaaggagcttgctgccactgccaccaacggcgacagtgtgggatcgctaaggctggtgctggtgggtggatacgacaagcgcgtccgtgacaatgtcgcgacgctcaacgagttgcaaacccaggcgcaagagcttggtttgtcctccgtgacgctcagctaccatcgccaggcattcgaaacgcccactacagcgcctgcagccgacaagctcgcgaaagcctcggtgatcttcctgccctccttaccgatggcattgatccacacgcttctgctcaacccagccaccagggctctactatacactcccacagacgaacatttcggaatcgtgccgctcgaagccatggcatgcggtgttccggtgctcgcgaccaacactggtggaccggtcgaaactgtggtcgacctcgcactctcgtccacaggcgaacccacaaacctctcgaacggcacaggtcttcttcgtcatgcttccgctcccatctgggccgtttcaatcactgcgttgcttcgcctttcgtcctcgcatcgagagcagatctccgctgcggccaaggaacgtgtccgtaccaagtttagcaccgaagtgctctcgctagcgctcgaaaaggcgtgctacgatgcgttcgagctgggacgtgttcgcggtgacgaagggctgtaccagtggggctcgacgctggccgtattgatggtcatgtcgatcctcttttgggtcaacgtgtatttcagccatgacaagtggttggctatccaagcggcgaaattggcaaacgagaaggacaagtggttggcagagctcaaagcgactggcgtagccggttcagcaggtgggttgaatccgcatgctgatcacgttgcacaggcccctctgcccacgccactgtga

SEQ ID NO: 45435 - protein, 605 aa, Ustilago maydis 521
MVLDRQSAAVANSVHSPRKKLRIGFVHPDLGIGGAEKLVVDAALSLQQLGHEVVIFTSHHDPRHCFEATRDGTLKVQVMRTAIPRSLLGGFHLPCAILQQMSLVFQLILAVTLFNYPGTMPRFVSKRMTSSPPIPGFDLFFFDQLPAGIPWLKIILATRVVYYCHFPDKDISNSIAMQRAHARGESGPSVLRKLYRIPFDLFEEGTTDYSDKILVNSEFTSAQFVKSFFRLRRQPRVCYPGVEMDQFKPERVEQALKKLETEAKQMGDPIRGSIAKFCKDESKTTLLSINRFEAKKNVALALEAFAIAQKELAATATNGDSVGSLRLVLVGGYDKRVRDNVATLNELQTQAQELGLSSVTLSYHRQAFETPTTAPAADKLAKASVIFLPSLPMALIHTLLLNPATRALLYTPTDEHFGIVPLEAMACGVPVLATNTGGPVETVVDLALSSTGEPTNLSNGTGLLRHASAPIWAVSITALLRLSSSHREQISAAAKERVRTKFSTEVLSLALEKACYDAFELGRVRGDEGLYQWGSTLAVLMVMSILFWVNVYFSHDKWLAIQAAKLANEKDKWLAELKATGVAGSAGGLNPHADHVAQAPLPTPL

SEQ ID NO: 45436 - DNA, 1431 bp, Strongylocentrotus purpuratus
  CDS (1)..(1431)
atgatcctgttgctgattatagcatttccagttctactggctatggtgctgttcatggctcttcggcaaaaagttgagattgtgcgccattccaaactaactcatctttctaagccaggtccagatgggaagaaacccatcactgttggattctttcatccctactgtaatgctggtggaggtggtgagagggtcttatggtgtgcaatcagagctttacaaaccagatatcctcatattcagtgtgtagtgtactctggagacatagatgcaacaggggagcagattgtagagaaagctaagcagagattcaaccttacccttcccagacctgtagagtttgtgttcctaaccaaccgattccttgttgaagccaagacctacccattcctaactcttcttgggcagagcttgggttctatgcttctaggaatggaggccttgttcaaattcgtgcctgatgtgtacatagacaccatggggtatgccttcacactgcctttgtttcgctttcttgcaaagtgcagggtcggttgctatgtccactacccaaccatcagcacagacatgttgtcaagagttgctgcaggtactgtttcatacaacaacccaggatttgtggcacgcaacccagtgctccgcaagctcaagctcctatattacaaggcatttgctttcatctacggactaatgggtgcaagatcagacgtggtcatggtgaactcgtcgtggactcatggccatatcaatgaaatctggggagcttccactggacctagcattgtttatccaccatgtgataccaaagaattcacaagtctggcaatcattcctgatgaagagaaaaccaccaaagtcattgcgtcggtggcgcagtttcgtcctgaaaaagaccacgcgctgcaagtgaaatccttctccaatttaatgaataaactcacggtggatgaaaagagtgtggtgagacttgagctgatcgggggctgtcgcaatgctggagatgagagtagagtagctgatctgagggcgctggcttcatctctgggtgttgcagatcatgtagactttctgcttaatattccatttgaagatctcaagtcacatctagctggggccacaataggactacactccatgtggaatgaacattttggcatcggtgtggtagagtgtatggcagctggtaacatcattgttgcccacaactctgggggtcctaggatggacatcgtggtccctcaccaagaccagccaacagggtttttagctgacaccgaagagggttatgctgacaccatgctgaaaattctaagaatgacctctgaagaaaggatgaagattagactcgctgccaggagttctgtcgatagattctctgagaaggagtttgaaaaatctttccttgcagcttcagaaaaactttttgattag

SEQ ID NO: 45437 - protein, 476 aa, Strongylocentrotus purpuratus
MILLLIIAFPVLLAMVLFMALRQKVEIVRHSKLTHLSKPGPDGKKPITVGFFHPYCNAGGGGERVLWCAIRALQTRYPHIQCVVYSGDIDATGEQIVEKAKQRFNLTLPRPVEFVFLTNRFLVEAKTYPFLTLLGQSLGSMLLGMEALFKFVPDVYIDTMGYAFTLPLFRFLAKCRVGCYVHYPTISTDMLSRVAAGTVSYNNPGFVARNPVLRKLKLLYYKAFAFIYGLMGARSDVVMVNSSWTHGHINEIWGASTGPSIVYPPCDTKEFTSLAIIPDEEKTTKVIASVAQFRPEKDHALQVKSFSNLMNKLTVDEKSVVRLELIGGCRNAGDESRVADLRALASSLGVADHVDFLLNIPFEDLKSHLAGATIGLHSMWNEHFGIGVVECMAAGNIIVAHNSGGPRMDIVVPHQDQPTGFLADTEEGYADTMLKILRMTSEERMKIRLAARSSVDRFSEKEFEKSFLAASEKLFD

SEQ ID NO: 45438 - DNA, 1236 bp, Strongylocentrotus purpuratus
  CDS (1)..(1236)
atgcaaaaccggctttgtacaaaagagagaatggtgcgggtaattttcttgcatcctgatttgggcattggaggagccgagcgcctggtcgttgatgccgctctagccctgcagacccggcgacattctgtgaagatctacactgcccaccacgaccccactcattgtttcaaggaaacaagtgatggcactcttgaggtcgtgacagcaggagactggcttccaagaaatatttttggatcctgctacgcactctgcgcttacatccggatgatatatgtcgccctctatttactcctgttcagccgtgaaccgtatgatgtcatcatctgcgatcagatttctgcctgtattccgttcctgaagctgggtagatccaaagtgctgttctattgtcactttccggatctgttgctgacgaagcgacagagtttcctcaagaaattgtaccgaactcctatagactggctggaggagaagactaccggcatgtccgattgcatagtggtcaacagtaacttcactgcggatactttcaagcagaccttcaccaccctcaaggacgtccagcccgatgtcctctacccatccctcaacttcagcgccttcaacgcccgcgtagagcctgcaggtgacctcataccagtaggggtcaagacactcttcctgtcgatcaatcgctatgaaagaaagaagaaccttgtattggcgatagaagctatgggtgaattgaaatccaggctgtcggaggatgaatggcagaacgtccacctcgtcatggcaggaggctacgacggacgtgtcactgaaaacctggagcactacgaagagctcgtccaacgtgctgacgaacttaagctaactgatcatgtgacctttatccgttccttcagcgatgctcagaagctcactctccttgatagctgcacttgcctgctctacactccatcaaacgaacactttggtatcgtccctatagaagccatgtacatgtatcgtccggttatagcggtgaatagcgggggtccgctagaaaccatcgctcataaacagacagggtttctttgcgagccttctgcagctagttttgcgcctgcactggagcgtttcgtgcgggagccagacctgaagaatagactaggaaaagcagggagagatagagtcatcaacaatttctcatttagagcctttggcaataagttagagaaattggtgaaaagagttcataggttgtag

SEQ ID NO: 45439 - protein, 411 aa, Strongylocentrotus purpuratus
MQNRLCTKERMVRVIFLHPDLGIGGAERLVVDAALALQTRRHSVKIYTAHHDPTHCFKETSDGTLEVVTAGDWLPRNIFGSCYALCAYIRMIYVALYLLLFSREPYDVIICDQISACIPFLKLGRSKVLFYCHFPDLLLTKRQSFLKKLYRTPIDWLEEKTTGMSDCIVVNSNFTADTFKQTFTTLKDVQPDVLYPSLNFSAFNARVEPAGDLIPVGVKTLFLSINRYERKKNLVLAIEAMGELKSRLSEDEWQNVHLVMAGGYDGRVTENLEHYEELVQRADELKLTDHVTFIRSFSDAQKLTLLDSCTCLLYTPSNEHFGIVPIEAMYMYRPVIAVNSGGPLETIAHKQTGFLCEPSAASFAPALERFVREPDLKNRLGKAGRDRVINNFSFRAFGNKLEKLVKRVHRL

SEQ ID NO: 45440 - DNA, 1518 bp, Trypanosoma cruzi
  CDS (1)..(1518)
atgaacgaatttctctcatatctgtctatcaaccttggatgctcttttttattcgttggcatcttgctggtgcttcgcctgcggatccatgaggccgcactgcgtcggtttaggcccgaggcggcagagacgcgaaacccaacggacgtggcctcccagaaggaagctcagcgaccactgaaggtggtgattcttcacccagacctcggcattggtggggccgaacgacttattattgacgcggctttggccctacagaaacatcagcgtgttactcccgtcagtgtatgtattgtaacaaatcatcatgatccgaaacgtgcatttccggagactgtggacggtactgtaaaggtggtggtgagtggagcgtggctacccgatcatttcttgggacgtgcaaaggttttctgcgcgacgtgtcggatgctttgggctgccctcatgatctgctattgctaccccgacaccgactgtatctttgtggatcaagtagccgccgtgctaccgctgctccactttgttgcaacgcccatcccacgtctcttttattgtcactttcctgatcaatgctgtgacgccaaccgtgatgcgcaggggcgttttttgaaacccatctggagagtccataaactgtaccgacgcctttttgattatttggagtcttgggcgctgagctttgcggacagcattgtgtcaaactcaaagttcagccgaggggtgacggtgagggtttttccgcatcttgattcggtcattgacgccgagtcagatattttttatcctcccgtttcgtgggcaactaaggatctcccgaccgacacgacgcccgacctcgagaatgatgaattggcgccgttgcataacagtctagaaaaccgaactgtggtgcttagcatcaaccgttatgagaggaagaagaatcttccactggcaattgatgcatttgcacttgttgtggcggcggtttctaatgtcacctcgaggtccccacttcttgtcatggccgggggttatgacgtccgcttgaaagaaaatgtggagcacctgaaggagttgaaggagttggtggcgcaccacaacctcacagatgatcaggttctgtttctacagaacatatctgatgtgactaagggctatcttttgtcgcagtgtcgctgcttagtttacacaccagctatggaacactttggaattgtgccaacggagggcatggtgtgcgccaaaccaattgtcgccgtgaaccaaggcggtccatgcgagagtgtgggcgagggtgggacactttgtgatcccacaccggaggcatttgccgaagcactgacggcatacgtgaaggacgaggcgctggcaaaacgtgtgggtgcagccggacgagagcgtgcattaaagctttttggaatggatgtctttggagaaaaactggcaacaagactggtgaccttatgggcaaagaaaaacggagagctgaattctgcccaagacgaggagagtgttaagaagcaaaagagtaattag

SEQ ID NO: 45441 - protein, 505 aa, Trypanosoma cruzi
MNEFLSYLSINLGCSFLFVGILLVLRLRIHEAALRRFRPEAAETRNPTDVASQKEAQRPLKVVILHPDLGIGGAERLIIDAALALQKHQRVTPVSVCIVTNHHDPKRAFPETVDGTVKVVVSGAWLPDHFLGRAKVFCATCRMLWAALMICYCYPDTDCIFVDQVAAVLPLLHFVATPIPRLFYCHFPDQCCDANRDAQGRFLKPIWRVHKLYRRLFDYLESWALSFADSIVSNSKFSRGVTVRVFPHLDSVIDAESDIFYPPVSWATKDLPTDTTPDLENDELAPLHNSLENRTVVLSINRYERKKNLPLAIDAFALVVAAVSNVTSRSPLLVMAGGYDVRLKENVEHLKELKELVAHHNLTDDQVLFLQNISDVTKGYLLSQCRCLVYTPAMEHFGIVPTEGMVCAKPIVAVNQGGPCESVGEGGTLCDPTPEAFAEALTAYVKDEALAKRVGAAGRERALKLFGMDVFGEKLATRLVTLWAKKNGELNSAQDEESVKKQKSN

SEQ ID NO: 45442 - DNA, 1530 bp, Trypanosoma brucei
  CDS (1)..(1530)
atgatttacgaacttgcgctacttatatccaccttccttggactttccatctttgttattcccttttccctgctgcgaacatggacacgtaggcaggcgagtagtcgtttcgattcttcttctgctcgtcaacggcacccaacgaagttggatgagcaggtcaacgcgaaacgtccgttgaaggttgtgtttcttcaccccgatcttggcattggtggcgccgaacggcttgtcgttgacgctgctattgcacttcagaggtaccagaaagtgacgcctgtgcaagttattattgtgacaaaccatcatgatccccagcgtgcttttgctgagacggtggacgggacagtgaccgtgcaggtattcggttcgtggcttcccgcctccataaaggggcgagccaaagtgtttgctgcaacccttcgcatgtgctgggcggcgtgggttacgtgttggatgcaccctgatgcggactgtttcatggtggatcaagtagccgcagttcttccgctgctctcatttgtggcaccgcaaattcctcggctcttttattgtcattttcccgatcagtgctgtgacgggaaccgcgatgaaaaccagcaatacaagaagaaaccgtctatctttcgcctgctttatcggaagctatttgatgaggttgaagtctttgctatgaactatgccagcagtatcgtgtcgaattccaaattcagtagagcggctactctgaaggtttttcccaaactaagcaacaggattgacgccgaggctgacatattctaccctcctgtgtcattggctgttagggaaggagctaaacctaacggtgacacaaaagtatttgacaccgaggaactcgacaagctccgggacgctattcagggaagaagtgtggtgctcagtatcaaccgctacgagcgtaagaagaaccttgtattggctattgaagcatttgcacgtttgttaaactcggggaaaacgacatgcagtggtgctccgttgctcgttctggctggtgggtacgacacacggttggaagagaatgttgcacatttgaatgagctccaaaaggttgctgacacatacaagcttatggatagtcagattcttttcctgaagaatataaccgaactcgaaaagcgctaccttctttcccaatgttgctgtcttctctacacacccacatcggagcatttcggtattgttccgactgaggcaatgattagtgcgaagccagttgtagctgtcaaccgcggtggaccatgtgaaagtgtgggtgaaggtggcacactttgtgacccaacgcctgaggcttttgcggaggctatacttttatatctgaatgatgatgaattaaggaggcgggtgggagaggcgggaaggaaacgggcgagcgatgttttcactattgaaaggtttggggagaagctggccacacgttttgtgaagctatggactgaaacgaacgcggctatgggcagagcggcgttttgggggaaatggcttgagggaggaaaaaaggcggactga

SEQ ID NO: 45443 - protein, 509 aa, Trypanosoma brucei
MIYELALLISTFLGLSIFVIPFSLLRTWTRRQASSRFDSSSARQRHPTKLDEQVNAKRPLKVVFLHPDLGIGGAERLVVDAAIALQRYQKVTPVQVIIVTNHHDPQRAFAETVDGTVTVQVFGSWLPASIKGRAKVFAATLRMCWAAWVTCWMHPDADCFMVDQVAAVLPLLSFVAPQIPRLFYCHFPDQCCDGNRDENQQYKKKPSIFRLLYRKLFDEVEVFAMNYASSIVSNSKFSRAATLKVFPKLSNRIDAEADIFYPPVSLAVREGAKPNGDTKVFDTEELDKLRDAIQGRSVVLSINRYERKKNLVLAIEAFARLLNSGKTTCSGAPLLVLAGGYDTRLEENVAHLNELQKVADTYKLMDSQILFLKNITELEKRYLLSQCCCLLYTPTSEHFGIVPTEAMISAKPVVAVNRGGPCESVGEGGTLCDPTPEAFAEAILLYLNDDELRRRVGEAGRKRASDVFTIERFGEKLATRFVKLWTETNAAMGRAAFWGKWLEGGKKAD

SEQ ID NO: 45444 - DNA, 1086 bp, Synechococcus elongatus PCC 6301
  CDS (1)..(1086): transl_table=11
atgagagttgcgatcgttcactattggctggtgcaaatgcggggcggcgaacgggtcttggaagcactctgcgatctctttcccgaagctgacctgttcacccatgtctgcgatcgcgatcgtctcagcccgacgctgcaacgtcaccgcatccaaaccagcttcattcaacgcttaccagcggcgcaacggcgctatcccacctacctgccgctgatgccctttgctctcgagcaatttgacttgcggggctatgacctggtgatcagtagtgagtctggccctgccaaaggcgtgatcacggatccgaacagtctccatatttgctattgccacagcccgatgcgctacctctgggacttagcgcccagctatcgtcgccaagcaggttggttcaagcgccgggccatggatctgctgttgccgccgctgcgggtttgggatcaggctacagcccagcgcgtcgatcattttttggctaattctcgctttgttgctcagcggattcgcaagtattaccgccgtgaggcgactgtcttgcatccgcccgtccatgccgatcgctttgcgatcgccgaccgtgagccagaggacttttacctctacgtcggccagctcgtgccttacaagcgagctgatttagcggtcgcagcctgttccgcctttgggaagcgactcattgtgattggagatggggaagagcgatcgcgactggaaaaactggcaggacccaccgtgcagtttctcggtcgtcagtccgatgctgcgatcgccagctactaccagcgatgccgcgccttgctgttccctggggttgaagacttcggtatcgtgcccctcgaagcaatggccagcggtcgtccagtgattgcctacggcgatggtggagcgctagaaaccgtgaaagccggtgagacgggcctcttctttcagtccgctaccgttgaagcgctcacgaacgcgatcacccagtttgaagtgcaacagggacagtttgatccagtggccattcgagaacatgccatgggctttgattgcgataccttcaaaacgaacttccagcgcttcctcacgtcggtgctctag

SEQ ID NO: 45445 - protein, 361 aa, Synechococcus elongatus PCC 6301
MRVAIVHYWLVQMRGGERVLEALCDLFPEADLFTHVCDRDRLSPTLQRHRIQTSFIQRLPAAQRRYPTYLPLMPFALEQFDLRGYDLVISSESGPAKGVITDPNSLHICYCHSPMRYLWDLAPSYRRQAGWFKRRAMDLLLPPLRVWDQATAQRVDHFLANSRFVAQRIRKYYRREATVLHPPVHADRFAIADREPEDFYLYVGQLVPYKRADLAVAACSAFGKRLIVIGDGEERSRLEKLAGPTVQFLGRQSDAAIASYYQRCRALLFPGVEDFGIVPLEAMASGRPVIAYGDGGALETVKAGETGLFFQSATVEALTNAITQFEVQQGQFDPVAIREHAMGFDCDTFKTNFQRFLTSVL

SEQ ID NO: 45446 - DNA, 1056 bp, Methanosarcina barkeri str. fusaro
  CDS (1)..(1056): transl_table=11
atggaaattgattatatcaacggtcttaaaacagatgaaaaattcggaatgtcaaagtatcaaagtgagattcacagcaggttaagtgatatcaaattaaatcggatagaatatcccaatgtatcaagaatacccggaattaacaaggttgttgaatggtttgcgtatccgttcattgttaaaaagaaagtagataagaacaatgttaagaatataactcgccaggatctagcgtttcttttagaattaacgggtttagaaaaaaccattgttacttgtcacgatatcatacctatagcatattataatacccaaaatcctctctggaaacttaatgcaaagggattgagaaaagcagagagaataattacggtgtctgaattctctaagcaggatataagtaaatacataaaatatccggaagaaaatatagagattatacctcctgcagtggatcataatctctactatccagatagaagtaaagaatgtttattaaaatataatattggtgacggtgaaaaagtaattttatatgttggagctgaagaacctagaaaaaatatccaatttcttataaattcattcagcaaattaaaaaataaaatatcaaatataaaattattgaaagtagggaccccgaattacctgtttgtaagaaaaagactacttaaacagatagaggttctaaacttacagaatgacgtcatctttacagggtatgtctcagagtccgaactggcagagatatacaatgctgtggatctgtttgtatttccttctttatatgaagggttcgggatgcctcctctagaagcaatggcttgtggaacacctgttataacttcaaatacttcgtctttacctgaagttgtaggagatgcagctatagttgtagatccatatgatgtaaacaagtttgctgaagaaatgtatgagttattaatgaatgatgatctcaaagaagagatgattagaaaaggactgaaaaggtcaaaaatgtttagctgggatacttcggcaaaaaaaacattaaaagtatataaggaattgtga

SEQ ID NO: 45447 - protein, 351 aa, Methanosarcina barkeri str. fusaro
MEIDYINGLKTDEKFGMSKYQSEIHSRLSDIKLNRIEYPNVSRIPGINKVVEWFAYPFIVKKKVDKNNVKNITRQDLAFLLELTGLEKTIVTCHDIIPIAYYNTQNPLWKLNAKGLRKAERIITVSEFSKQDISKYIKYPEENIEIIPPAVDHNLYYPDRSKECLLKYNIGDGEKVILYVGAEEPRKNIQFLINSFSKLKNKISNIKLLKVGTPNYLFVRKRLLKQIEVLNLQNDVIFTGYVSESELAEIYNAVDLFVFPSLYEGFGMPPLEAMACGTPVITSNTSSLPEVVGDAAIVVDPYDVNKFAEEMYELLMNDDLKEEMIRKGLKRSKMFSWDTSAKKTLKVYKEL

SEQ ID NO: 45448 - DNA, 1524 bp, Nostoc punctiforme PCC 73102
  CDS (1)..(1524)
atgcacattggatttctcaaccctcaaggcaattttgattcaaacaatagtcacataaccaaacacccagattttgggggtcaactgatttacgttaagcaagtcgccatagctatagccgaaaagggacacaaagttgatattctcacccgtcaaattattgacccggaatggccagaatttgcccaggcgtttgacacttatccaggaatcgataacgtccgcattatccgcttgccagctgggccaaaagaatttcttcccaaagagtcgttatggactcatctgattagtgattgggtacccaacatcttgaaattctatcaacaacaaggtggcttacccgatgctatgactgctcactatgccgatggagggctgtgtggcgttctaattgaacaggatacaggcataccttttacctttactgctcattctcttggtgcccaaaagatggacaagctggaagtcacttccgagaacttgttagaaatagatgagcaattccattttaaatatcgcatcctagccgaacgcttgagcatgaatcgctcggtcgttaatatcaccagtacacgacaagaacgctttcaacagtattctcatcgagtctatcggagtgcagtagatgtagacaacgacaaccgctttgcggtgattccaccaggagcagatttctcgattttcggtgcaaaggcacgttccgaaaatgagaaagcaactgaagagttcattcaggagcgattggcacgggacattgaagaggcacgtcgagatttgcctgtcatcgtagcatccagtcgattagagcttaaaaaaaacatattagggctagtgcaagccttcgcaattagtccaacacttcaggaacgagctaacttgatgttacttacagggggactggacaatcccttacgagaagaggctagtgatagcatagctgaagaggtattagcccccattcgagaggtggtcaaggaaaacgacttgtggggcaagattagtgcatttggcttgttagatcagtctcaagagtcactggcagcagcctatcggtttatggttaaacgccgctcggtatttgcgctgacagcactttacgaaccctttggacttgctcccttagaagcagcagttgcaggtttaccagtggtagcaaccaagaacggtggtcctagcgaaagcttgcgacagggaaataaggaatatggcatactcgtagacccagaagatcctgctgatattgcacgaggcttggagcgggtgctatgtgatgctcaagagtgggactattttgcccaagctggtcagcaacgggttctgaaaacgtacagttgggaatctactgctgaaaactacctgactttgcttgagcaaattctgtctttaccggaaacccgccctcgcgccgaacttctacccatccatccctactttcgtaatccagaatcgcagaccgatatttctttggaagaattaagcgacctctactttggatctaaccaaaaggtactcagtacatga

SEQ ID NO: 45449 - protein, 507 aa, Nostoc punctiforme PCC 73102
MHIGFLNPQGNFDSNNSHITKHPDFGGQLIYVKQVAIAIAEKGHKVDILTRQIIDPEWPEFAQAFDTYPGIDNVRIIRLPAGPKEFLPKESLWTHLISDWVPNILKFYQQQGGLPDAMTAHYADGGLCGVLIEQDTGIPFTFTAHSLGAQKMDKLEVTSENLLEIDEQFHFKYRILAERLSMNRSVVNITSTRQERFQQYSHRVYRSAVDVDNDNRFAVIPPGADFSIFGAKARSENEKATEEFIQERLARDIEEARRDLPVIVASSRLELKKNILGLVQAFAISPTLQERANLMLLTGGLDNPLREEASDSIAEEVLAPIREVVKENDLWGKISAFGLLDQSQESLAAAYRFMVKRRSVFALTALYEPFGLAPLEAAVAGLPVVATKNGGPSESLRQGNKEYGILVDPEDPADIARGLERVLCDAQEWDYFAQAGQQRVLKTYSWESTAENYLTLLEQILSLPETRPRAELLPIHPYFRNPESQTDISLEELSDLYFGSNQKVLST

SEQ ID NO: 45450 - DNA, 1125 bp, Cytophaga hutchinsonii
  CDS (1)..(1125)
ttgaatattgctgtaaatacacgtttgttattggaggatcgcctggaaggaatcggctggtttacgtatgaaacattgaaacgtataacggaacagaatccacagcatacgttccactttttctttgacagaccctataacgataaatttgttttcgggaaaaatgttgttccgcacgtattgtttccgcaggcaagacatccctttctttggtatattttctttgaatggagtattccgtttatgcttcggaaagtaaaagcggatgcgtttatttcaacagatgggtatatgccgaagtcttcgaaagtaaaagtattaaacgtaattcacgatataaattttgaacaccggcctcaggatttacccaaacgcgtagcaaactattacaaaaagaacatgcccctgttcgctcagaaggcaacaaggcttgcaaccgtttctgagttttccaaacaagatctggtaaaaacatacaacattccggcagataaaattgatgtggtatacaatggctgcaatgcagcattcaagccaattccggaagcagaacaagtaaaggttcgttataaacattcagctggcagaccgtttttcctgtatataggatccatgcatccgcgcaaaaacatcttaaacttaatgaaagcgtttgaggtgtttaagaaaatgacaaactgcgacatgaaattgcttctggttggtaaagccatgtggagcaataaagatattcaatcgttgtatcatacgcttatttacagacacgacatacattttttaggtcacataaaaacagctgaactggccaggattatggcttcggcgcacgcgcttacattcgttccgtattttgaaggatttggtatacctatactggaagcgttgaactgcggcgtccctgttatcacatccaatacaacttcgttaccggaagttgccgggaaagcagccttattagttaatcctgaatcttcagaagctatagcaaatgctatgattcagatctataaagcaccgcatataagagaaaaattacttgcacaaggagttattcagcgtcaaaaattttcatgggacaaaacagccgcattgctttgggcaagttttgaaaaaatgatgcgctaa

SEQ ID NO: 45451 - protein, 374 aa, Cytophaga hutchinsonii
MNIAVNTRLLLEDRLEGIGWFTYETLKRITEQNPQHTFHFFFDRPYNDKFVFGKNVVPHVLFPQARHPFLWYIFFEWSIPFMLRKVKADAFISTDGYMPKSSKVKVLNVIHDINFEHRPQDLPKRVANYYKKNMPLFAQKATRLATVSEFSKQDLVKTYNIPADKIDVVYNGCNAAFKPIPEAEQVKVRYKHSAGRPFFLYIGSMHPRKNILNLMKAFEVFKKMTNCDMKLLLVGKAMWSNKDIQSLYHTLIYRHDIHFLGHIKTAELARIMASAHALTFVPYFEGFGIPILEALNCGVPVITSNTTSLPEVAGKAALLVNPESSEAIANAMIQIYKAPHIREKLLAQGVIQRQKFSWDKTAALLWASFEKMMR

SEQ ID NO: 45452 - DNA, 1995 bp, Mus musculus
  CDS (7)..(1485)
gataagatggcggcggacactgggagctggtgcgtgtacgccgtgctgcggtttttctattcactcttctttcctggactgatgatatgcggagttttgtgtgtatatttggtcattggcctttgggttatcaggtggcatctacagagaaagaagaagtctgtgtcgaccagcaaaaatggaaaagaacaaacggtggttgcatttttccatccatactgtaatgcaggtggcggaggagagagagttctgtggtgtgctttgagagccctgcagaaaaagtatcctgaagcagtttatgttgtatatactggtgacattaatgtcagtggtcaacagatactagatggtgctttcagaaggtttaacatcaagttggctcacccagtgcagtttgttttcttaaggaaacgctaccttgtggaagattcccggtatcctcacttcacattgctaggccaaagtcttggatccattcttctcggctgggaagctctgatgcagcgcgttcctgatgtttacatcgactcaatgggatacgccttcacactccctctctttaagtatgtgggaggttgccgagtcggaagctatgttcactatcccacgatcagcactgacatgctgtctgtggtgaagaatcagaatcctggatttaataatgctgctttcattagcagaaatgctcttctcagcaaagcaaagctcatctattactatttatttgcttttgtttatggccttgttggatcttgcagtgacatagtcatggttaattcttcttggacattaaaccatatcctctcactgtggaaggttgggcattgcactaacattgtctatccaccttgtgatgtgcagacatttctggacatccctttacatgagaagaaggtgaccccagggcatttgctggtttccattggccagttcagacctgaaaagaatcatgctttgcagatcaaagcctttgctaaattgttaaatgagaaagcagctgagttaggccattctcttaaacttgtccttattggagggtgtcgcaacaaagatgatgagtttagagtaaaccaactgagaagtctatctgagaatttgggagttcaagaaaatgtggaatttaaaataaacatttcattcgatgaattgaagaattacttgtctgaagcgaccatcggtctgcatactatgtggaatgagcattttgggattggagttgtcgagtgtatggcagctggcacagttatccttgcacacaactcaggaggcccgaagctggacattgtcattcctcatgaaggacagataactggctttctggctgagagtgaagaaggctatgctgactctatggctcacattctttctctgtctgcagaagagagactccaaatcaggaagaatgctagagcgtctataagcagattctccgaccaggagtttgaagtagcattcctgtgttccatggagaagttacttacttagtgtccagtctgcacagtctgggtattttatacagcatggagctggagctataggtcatgggagaacccgtgcttcgtgtgtgggagtcccgagctccatctccagcaccaaaagtaaaaggaaacaccttcacctgtaaatatttcctaaatttattctttatcataatcaaagcagcctgagcaacattctcagcaatatgtatataggcaaggcagtagttaacaaaaaggcagaattaatctatatggaaaaagtaatctcacgtagcttttttttttttttcttttttttttttttttttctttttgagacagggtttctctgtgtagccctggctgttctagaactcactctgtagaccaggctggccttgaactcatagagatccgcccgcctctgtctcccaagtgctgggactaaaggcgtgccaccacacccagcttcatgtagctcaatgtacagattttactaactgtttgctctcaaaatctgagcagtacagatccc

SEQ ID NO: 45453 - protein, 492 aa, Mus musculus
MAADTGSWCVYAVLRFFYSLFFPGLMICGVLCVYLVIGLWVIRWHLQRKKKSVSTSKNGKEQTVVAFFHPYCNAGGGGERVLWCALRALQKKYPEAVYVVYTGDINVSGQQILDGAFRRFNIKLAHPVQFVFLRKRYLVEDSRYPHFTLLGQSLGSILLGWEALMQRVPDVYIDSMGYAFTLPLFKYVGGCRVGSYVHYPTISTDMLSVVKNQNPGFNNAAFISRNALLSKAKLIYYYLFAFVYGLVGSCSDIVMVNSSWTLNHILSLWKVGHCTNIVYPPCDVQTFLDIPLHEKKVTPGHLLVSIGQFRPEKNHALQIKAFAKLLNEKAAELGHSLKLVLIGGCRNKDDEFRVNQLRSLSENLGVQENVEFKINISFDELKNYLSEATIGLHTMWNEHFGIGVVECMAAGTVILAHNSGGPKLDIVIPHEGQITGFLAESEEGYADSMAHILSLSAEERLQIRKNARASISRFSDQEFEVAFLCSMEKLLT

SEQ ID NO: 45454 - DNA, 1446 bp, Xenopus laevis
  CDS (1)..(1446)
atgttatgtgggatgatgaggctgttgactgccttgttcatcccagtgctgattgccagcgttggtttgtgcctcatctttgtcttgctttttatttgcactcgattgtgggttcagcgaaagaaaaaggtggaaataggaaaagatgggaaaaagaagaaagtggtggcgttttttcacccatactgcaatgctggaggcggaggagagagagtactgtggtgtgcattgagatccctccagaagaggtacaaagatgcgatctacgtcatttatactggtgataaggatgcctctgaggaacagatccttaacggggctgctgcaagatttaacatcaagctgtcccaccccgtaaggttcattttcctggaaaagcgtggacttgtggaagcaagctgttacccccgttttactttgctgggccagagtcttggctccgttgttttaggctgggaagctcttacgaagtgcgtgccggatatatacattgattctatgggctacgcatttacattgcctctcttcaagtatcttggaggatgccatgttggctgctatgtgcactatccgactatcagcatggatatgctttctgttgtgcgcagtcagcatgcaagattcaacaatgctgcttttatctctaacaatcctgttctaagcagactgaaactgatttattattatctgtttgcactattctatggatgggttggttcatgtagtgatgtcatcatggtgaactcaacatggactttctcccacatccttgacctgtggaaatgtagtgaccgtactagtatagtttatcccccatgtgatgttcagacatttttagagatagatataaaccaacacaaagaaaacgaggagcattcagttgtttctatagggcagttcaggcctgagaaggaccaccctctgcaaatacgcgcatttgcagccttgctggagaagaaaaccgctgaacaaagagcgaagctgaaactgatcctaattggagggtgtcgcaacgatgaagatgagctccgtgtgtcagagctgaaaaaactcagctccgaactcggaattcctgtggagttcaaagtaaacgttccatttgaggagctaaagaagcatttaagtgaagctaccattggcttgcacaccatgtggaacgagcactttggaattggcatcgttgagtgcatggctgccggtaccataattctggctcataattctggaggcccaaagctggatattgtggtgcctcatgaagaacaacagacgggcttcttggcagatagtgttgacagttatgcagcagcaatggatcatattctgtctctgacaccagagcagagattatctataaggcaaaatgcacgtctttctgttggcagattttcggatcaggaatttgaagctaatttcctggcttcgtcagagccgctatttaaatga

SEQ ID NO: 45455 - protein, 481 aa, Xenopus laevis
MLCGMMRLLTALFIPVLIASVGLCLIFVLLFICTRLWVQRKKKVEIGKDGKKKKVVAFFHPYCNAGGGGERVLWCALRSLQKRYKDAIYVIYTGDKDASEEQILNGAAARFNIKLSHPVRFIFLEKRGLVEASCYPRFTLLGQSLGSVVLGWEALTKCVPDIYIDSMGYAFTLPLFKYLGGCHVGCYVHYPTISMDMLSVVRSQHARFNNAAFISNNPVLSRLKLIYYYLFALFYGWVGSCSDVIMVNSTWTFSHILDLWKCSDRTSIVYPPCDVQTFLEIDINQHKENEEHSVVSIGQFRPEKDHPLQIRAFAALLEKKTAEQRAKLKLILIGGCRNDEDELRVSELKKLSSELGIPVEFKVNVPFEELKKHLSEATIGLHTMWNEHFGIGIVECMAAGTIILAHNSGGPKLDIVVPHEEQQTGFLADSVDSYAAAMDHILSLTPEQRLSIRQNARLSVGRFSDQEFEANFLASSEPLFK

SEQ ID NO: 45456 - DNA, 2310 bp, Tetraodon nigroviridis
  CDS (1)..(2310)
atggtgcaggtggtgttcatccatccagacctcggcattgggggggccgagcgactggtggtggacgcagccgttgctctgaaatctaaaggatgcagcgtgcagatatggacggcccattacgacccttcacactgcttctctgagactctggacccagaccttcccgtggtgtgtgtgggtgactggctacccaccagtgtgtttggctacttgcatgcgctctgtgcctacctgaggatgacctacgtggcgttgtatctgctcttcctcagcggggtggaatatgacgtcatcttctgcgatcaagtgtcggcgtgtatccctgtgctgcgactgtcccgccgcaggaagaaagtcctgttctattgtcacttcccggaccagctgctgacccagaggcagtcggtcctgaagaggctttaccgggcccccctggactggctggaggaacgcaccaccggcatggctgacatgattctggtgaacagccagtttactgcgggcgtcttcagagagacctttggtggtctggcaggggtccagacagacatcctctatccctccctgaacacgcgccactttgaccagccgcccgccgagacacaggacctgggggggctgctccccgagggcacctcctgcttcttcctctctctgaaccgctacgagaggaagaagaacctgggcctggctctggagtcccttgccgttctgaagagccgccttcctcccggccggggttcaggcgttcacctggtggtggccgggggctacgacgagcgggtgaccgagaacgttcagcatttcaccgagctgagagagctggccgagcagctgcgcctgggcggctgcgtcaccttcctgcgctcgccttccgattcgctgaaggtggccttgctgcggggcagcgcagcggtgctgtacacccccagcagggagcatttcgggatcgtccccgtggaggccatgtactgctgctgccccgtggtggcggtgaactctggggggccgctggagagcgtggcggacggggagacgggctttctgtgcgagcccaccgccgaggccttctcgcaggccatggagaggctggtgagggagccgcagctccgcagggacatgggacaagccgggaggaggagggtgcaggacaggttctccctgcaggccttctcagagcagctgtacgggtcaggggaggaaaactccgtgtgtgtggttcacctcctggcctccactctgccagtggcctgtggtgaggtggctgctcagatcaccgtgcgtctgagtggcagcgataaccggcacccaggaatggtaattgggaaggagggaggggggatgggtggagggtggtggggggctggggcaggtcgcgtccagccccaccgaggagggggcgcttcgaggcggccacggggaacacggggagccggggcaccaggagccgcacaaggactcctacagcacctttgcctccgagttcctggagtccagataccttctgacgacggttatcccttccccaccgctcctccagtggatcctttcgctaggatcaaagtcagcgactgcggcgtgacaaagggctgcataagatacgggaagcccgggtgcgacgccgacacctgcgactacttcctgagttaccgtcgtatcgggacggacgtggagtatgagatgagcgcagacacggacggatgggtggccgtcggtttttcctccgacaaaaaaatggcgagcagcttgacgctctccggaggagatgacgtcatgggctgcgtccatgacgataacggacgtgttcggatacatcatttctacaacgtcggtcagtgggccaaggaaatcaagaggaaccccgccagggacgaagagggcattttcgagaacaaccgggtgacctgccgcttcaagcgtccgctctacgtcccccgggaggagacgctggtggacctacacctgtcctggtactacctgttcgcatggggaccggccatacaaggtgattcacccacccctccgtcaccagttgaattcctcgcggaaggttttaggctcatcctgacctctcctaacaggatccatcaccagacacgacatcgacagcccccccgtcagcgaccacatgataagcatctacaagtacgaggacatcttcatgccgtccacagcctaccagaccttcaactctccgctctgcctgctgctcattgtcgctctcaccttctacttgctgatgggaacgccatgacgaagacgagcagagcagagaggaacggagggaacgtgaccaagcagcaataa

SEQ ID NO: 45457 - protein, 769 aa, Tetraodon nigroviridis
MVQVVFIHPDLGIGGAERLVVDAAVALKSKGCSVQIWTAHYDPSHCFSETLDPDLPVVCVGDWLPTSVFGYLHALCAYLRMTYVALYLLFLSGVEYDVIFCDQVSACIPVLRLSRRRKKVLFYCHFPDQLLTQRQSVLKRLYRAPLDWLEERTTGMADMILVNSQFTAGVFRETFGGLAGVQTDILYPSLNTRHFDQPPAETQDLGGLLPEGTSCFFLSLNRYERKKNLGLALESLAVLKSRLPPGRGSGVHLVVAGGYDERVTENVQHFTELRELAEQLRLGGCVTFLRSPSDSLKVALLRGSAAVLYTPSREHFGIVPVEAMYCCCPVVAVNSGGPLESVADGETGFLCEPTAEAFSQAMERLVREPQLRRDMGQAGRRRVQDRFSLQAFSEQLYGSGEENSVCVVHLLASTLPVACGEVAAQITVRLSGSDNRHPGMVIGKEGGGMGGGWWGAGAGRVQPHRGGGASRRPRGTRGAGAPGAAQGLLQHLCLRVPGVQIPSDDGYPFPTAPPVDPFARIKVSDCGVTKGCIRYGKPGCDADTCDYFLSYRRIGTDVEYEMSADTDGWVAVGFSSDKKMASSLTLSGGDDVMGCVHDDNGRVRIHHFYNVGQWAKEIKRNPARDEEGIFENNRVTCRFKRPLYVPREETLVDLHLSWYYLFAWGPAIQGDSPTPPSPVEFLAEGFRLILTSPNRIHHQTRHRQPPRQRPHDKHLQVRGHLHAVHSLPDLQLSALPAAHCRSHLLLADGNAMTKTSRAERNGGNVTKQQ

SEQ ID NO: 45458 - DNA, 1350 bp, Schistosoma japonicum
  CDS (61)..(1248)
cttgatagccggtttttgaattcgatttattacaagacacttgcttcctaacgcaatacaatgccaaagcatatcatttttctacatccagatcttggtataggtggcgctgaaagactcattgtagattcggcagtcgctttgcagtcatgtggttataatatcagtattatcacaaatcatcacgaccctaatcattgtttcgaagaaacattggagtcaaatttaaatgtaactgtagtagctgattggtttccacgttctctatttggttacatgacagcgttatgtgcatatattcgccttatgcttgcaacactgtatttattgttattttatggaaagaaaccagatgtaacgtttgtcgatcaaatatcagcacccataattctacttcgagctttcggatacaaaacaatattttattgtcactttccagatttacttttaacaagggataaaaatttctttttaaaaaagctgtacagattacctattgattatgttgagcaattatcaactggaatggctaatgttgtccttgttaacagcaagtttacatctaatatattcagagaaacatttacctcacttaatcacgtacaactacgtattttatatccgatcgcaaccacgaggagtttatgcttaccaacatcagaaaagtctgaaagtgatcagtcgaaatatgaataccgtaagcttttgccatcaggaattattcctgtaaaagccaagattgtattcgtatcaattaatcgatatgaacggaaaaaaaatcttacattggctttaaacagtcttgactacttgatcacgcattgggatcaacttattgattcgtcattggaaatacagcctgagaatgttcatttagtcatagctggaggttatgatcgccgtgtagttgaaaatgtcgaatattatgtcgaattagttaacctatcaaaaacattgaagctttcaggaaatgttactttcctacgttcctgttcatctgaaatcaagcctttattaattgcctctagcgatgctgtaatttacactccagataaggaacactttggaattgttcccattgagtcaatgctgttgtctcgagctgttattgcattagattctggtggtccgaaagaaactgtcttacataatatcactggatttttgtgtacagtggagccaacaactcaacttccggaaaacatggctaactatcttagcaagtatgtttcacacaatttcttctagcatattaccaactgtgatcagtcagttttgttgtttatgtgtcaactataaatgatactgagtaaaacaagaatccagtattaattaaaaaaaaaaaaaaaa

SEQ ID NO: 45459 - protein, 395 aa, Schistosoma japonicum
MPKHIIFLHPDLGIGGAERLIVDSAVALQSCGYNISIITNHHDPNHCFEETLESNLNVTVVADWFPRSLFGYMTALCAYIRLMLATLYLLLFYGKKPDVTFVDQISAPIILLRAFGYKTIFYCHFPDLLLTRDKNFFLKKLYRLPIDYVEQLSTGMANVVLVNSKFTSNIFRETFTSLNHVQLRILYPIATTRSLCLPTSEKSESDQSKYEYRKLLPSGIIPVKAKIVFVSINRYERKKNLTLALNSLDYLITHWDQLIDSSLEIQPENVHLVIAGGYDRRVVENVEYYVELVNLSKTLKLSGNVTFLRSCSSEIKPLLIASSDAVIYTPDKEHFGIVPIESMLLSRAVIALDSGGPKETVLHNITGFLCTVEPTTQLPENMANYLSKYVSHNFF

SEQ ID NO: 45460 - DNA, 1479 bp, Homo sapiens
  CDS (1)..(1479)
atggcggccggcgaaaggagctggtgcctgtgcaagttgttgaggtttttttattcattattcttccctgggctcattgtatgtggaactttatgtgtgtgtttggtcattgtcctttggggaatcagactgctgctacagagaaagaaaaaattagtgtcaactagcaaaaatgggaaaaatcaaatggtgattgcattttttcatccatactgcaatgctggtggaggaggagaaagagttttatggtgtgctttaagagccctgcagaaaaagtatcctgaagcagtttatgttgtttataccggcgatgttaatgtcaacggtcaacagatactagaaggtgctttcagaagatttaacatcagattaattcacccagtgcagtttgtttttttaaggaaacgctatcttgtggaagattcactgtatcctcacttcacactgctgggccaaagtctaggatccatttttcttggctgggaagctctaatgcagtgtgttcctgatgtttacattgattcaatgggatacgcttttacgcttcctctgtttaagtatatagggggttgccaagttggaagctatgttcattatcctactatcagcaccgacatgctctctgtagtgaagaatcaaaatattggatttaataatgcagccttcattaccaggaatccttttctcagcaaagtaaagctcatctactactatttatttgcttttatttatggacttgttggttcttgcagtgatgtagtcatggtcaattcttcttggacactaaaccatattctctcactatggaaagttgggaattgcactaacattgtttatccaccttgtgatgtgcagacatttctggacattcccttacatgagaaaaagatgaccccaggacatttgctggtttctgttggccagtttaggccggaaaagaatcatccattgcagatcagagcctttgctaaattgctgaataagaagatggttgagtcacctccttcgcttaaacttgtcctcattggaggttgtcgtaacaaagatgatgaacttagggtaaaccaactgagaaggctgtctgaggatttaggagttcaagaatatgtggaatttaaaataaacattccatttgatgaattaaagaattatttgtctgaagcaacaattggtctgcataccatgtggaacgagcattttgggattggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaa

SEQ ID NO: 45461 - protein, 492 aa, Homo sapiens
MAAGERSWCLCKLLRFFYSLFFPGLIVCGTLCVCLVIVLWGIRLLLQRKKKLVSTSKNGKNQMVIAFFHPYCNAGGGGERVLWCALRALQKKYPEAVYVVYTGDVNVNGQQILEGAFRRFNIRLIHPVQFVFLRKRYLVEDSLYPHFTLLGQSLGSIFLGWEALMQCVPDVYIDSMGYAFTLPLFKYIGGCQVGSYVHYPTISTDMLSVVKNQNIGFNNAAFITRNPFLSKVKLIYYYLFAFIYGLVGSCSDVVMVNSSWTLNHILSLWKVGNCTNIVYPPCDVQTFLDIPLHEKKMTPGHLLVSVGQFRPEKNHPLQIRAFAKLLNKKMVESPPSLKLVLIGGCRNKDDELRVNQLRRLSEDLGVQEYVEFKINIPFDELKNYLSEATIGLHTMWNEHFGIGVVECMAAGTIILAHNSGGPKLDIVVPHEGDITGFLAESEEDYAETIAHILSMSAEKRLQIRKSARASVSRFSDQEFEVTFLSSVEKLFK

SEQ ID NO: 45462 - DNA, 1728 bp, Caenorhabditis briggsae
  CDS (1)..(1728)
atggtacgagtcaccattctgcatcctgatcttgggattggaggagccgagcggctgattgtagacgcagcgacaggcctaaaagagcgaggacattcggttcgaatcgttaccaatcagtacgataaaaaccactgttttcaagaaactctcaatctagacatctgcactgttgttaaatggatccctcgctcatttttcggaaaaggccatgccctactcgcctacatcaaaatgatcgtagcagcattctacatagcacttttctaccgagatacagacgtcgttctatcagattcagtttctgccggccaatttgttctcagatatttatcaaatgcgaaactagtcttttattgtcactatccagatcgacttctgacgaaaagaaacggccagttgaaggctgcttaccggatagtgatagattggatagaagaatgttcaacgggactggcggatgtcatctgtgttaacagcaattttacaaaaggagttgttcaggaaacgttcaaatcattgcaatccagagagttgactgttttgtatccatcattaaatacagcgttttttgattcaatccagccttcagaccattttggaaacgattttaacattgatgccaaatacattttcacatctttcaatcggttcgaaaggaagaagaacattgttttggcattggattcttttgcccagctaaagtccaatttttcaacttccgactttgcgaagtttcatttgataattgctggcggatatgataagaataacctggaaaacattgagcactacgacgaattgaaaaaacacgcagaagatctcggtttgacagataaccaggtcacatttctccgatcgccttctgatgaggtgaagataaacattatcagaaagagtcgagcagttttgtacactcctgatcgtgagcattttggaatcgttccagtagaagctatgtatttggggacaccagtaatagcagtcaacactggaggtccacgtgaaactgtgcgaaacaacgaaacaggatatcttgttaatcaaaacgccgaagagtttgcagagaagatgaaggagattctgcaagatgagaagaaatatcaaaaattgagcgaagaaggaccgaaatgggtgcaacggacaaaagcattcattggcaagccagccccacaattcaaaactcaggccgtcatcgacggagagttcgttgatgtctcgctctccgattacaagggaaagtacgtggtgctcttcttctacccacttgacttcaccttcgtgtgcccaactgagattatcgctttctcggaccgtgctgctgagttcagcgccatcaacaccgtcgttctcgctgcttccactgactctgtcttctctcacttggcatggatcaaccagccacgcaagcacggagggctcggagaaatgaacatcccagtgctcgctgacaccaaccatcaaatctctcgtgattatggagttctcaaggaggaagatggaatcgctttccgcggtctcttcatcattgacccacaacagaaccttcgccaaatcaccatcaacgatcttccagtcggacgctctgtcgatgagactcttcgtctcgtccaagccttccaattcgtggagaagcacggagaggtttgcccagctggatggactccaggatctgacaccatcaagccagacgtcaagaagagccaagaatacttcggaaagcactaa

SEQ ID NO: 45463 - protein, 575 aa, Caenorhabditis briggsae
MVRVTILHPDLGIGGAERLIVDAATGLKERGHSVRIVTNQYDKNHCFQETLNLDICTVVKWIPRSFFGKGHALLAYIKMIVAAFYIALFYRDTDVVLSDSVSAGQFVLRYLSNAKLVFYCHYPDRLLTKRNGQLKAAYRIVIDWIEECSTGLADVICVNSNFTKGVVQETFKSLQSRELTVLYPSLNTAFFDSIQPSDHFGNDFNIDAKYIFTSFNRFERKKNIVLALDSFAQLKSNFSTSDFAKFHLIIAGGYDKNNLENIEHYDELKKHAEDLGLTDNQVTFLRSPSDEVKINIIRKSRAVLYTPDREHFGIVPVEAMYLGTPVIAVNTGGPRETVRNNETGYLVNQNAEEFAEKMKEILQDEKKYQKLSEEGPKWVQRTKAFIGKPAPQFKTQAVIDGEFVDVSLSDYKGKYVVLFFYPLDFTFVCPTEIIAFSDRAAEFSAINTVVLAASTDSVFSHLAWINQPRKHGGLGEMNIPVLADTNHQISRDYGVLKEEDGIAFRGLFIIDPQQNLRQITINDLPVGRSVDETLRLVQAFQFVEKHGEVCPAGWTPGSDTIKPDVKKSQEYFGKH

SEQ ID NO: 45464 - DNA, 1215 bp, Xenopus laevis
  CDS (1)..(1215)
atgagaccttcggttctgtttgttcacccagacctcggcattggaggcgctgagagactggtggtggacgctgctttagcattaaagtctcgaggttgccatgttcaggtgtggacgagtcactacgaccctaatcactgcttttcagagactcggaattccggtattcctatacgatgttgtggagactggcttccccggagcttgctcggtagatgccatgcactctgcgcctacatacgcatgatcttcctggcactgtatattgtatttcttagtggggaacaattcgatgtagttttttgtgatcaggtgtcagcttgcattcctttttttaaactggccagaaattcaaagaaagtacttttttattgccattttccagatcagcttctaactcagaggctgtcgtggattaaaaggatgtacagagccccaattgattggttagaagaaaaaactactgggatggctgactgcattctcgtcaacagctattttactgctgctgttttcaaaaaaacatttacttcattagcttacatagagccaactgttctttatccatctctaaacgtgagcaactttgtatcaacagtgtttgaagatgtaagtgacctttttcctgttaaaagacaacatatatttctttcaatcaatcgatttgaaagaaagaaaaatcttaatcttgctctggaatcgatgtttgagcttcgtaagagacttagcttgttggaatgggaacgtgtccatcttgtattagctggaggctatgacgagagagtattggaaaatgtagaacattatcaagaactcaaagacaatgctgccaaatacgacatttgtaaccatgttacatttttaagatccttttctgatgaacaaaaacgtaatctactccatagagccatatgtgttctttatacaccaagcaatgaacatttcggaatagttcctatagaggctatgtacatgcactgtccagtcgtagctgttaattcgggtggtcccttggaatctgttgaaaataatgtaacaggatttttgtgcagtccaaacccaaaggagtttgctgatgcaatggaaaagtttgtgaaaaatcctgatcttaaaaacagaatgggggaatctggacatttacgagttaagaacaaattctccactgaagcattttcggatgagatatatgcccatatttgcaaattaaccaattaa

SEQ ID NO: 45465 - protein, 404 aa, Xenopus laevis
MRPSVLFVHPDLGIGGAERLVVDAALALKSRGCHVQVWTSHYDPNHCFSETRNSGIPIRCCGDWLPRSLLGRCHALCAYIRMIFLALYIVFLSGEQFDVVFCDQVSACIPFFKLARNSKKVLFYCHFPDQLLTQRLSWIKRMYRAPIDWLEEKTTGMADCILVNSYFTAAVFKKTFTSLAYIEPTVLYPSLNVSNFVSTVFEDVSDLFPVKRQHIFLSINRFERKKNLNLALESMFELRKRLSLLEWERVHLVLAGGYDERVLENVEHYQELKDNAAKYDICNHVTFLRSFSDEQKRNLLHRAICVLYTPSNEHFGIVPIEAMYMHCPVVAVNSGGPLESVENNVTGFLCSPNPKEFADAMEKFVKNPDLKNRMGESGHLRVKNKFSTEAFSDEIYAHICKLTN

SEQ ID NO: 45466 - DNA, 987 bp, Homo sapiens
  CDS (1)..(987)
atgcagtgtgttcctgatgtttacattgattcaatgggatacgcttttacgcttcctctgtttaagtatatagggggttgccaagttggaagctatgttcattatcctactatcagcaccgacatgctctctgtagtgaagaatcaaaatattggatttaataatgcagccttcattaccaggaatccttttctcagcaaagtaaagctcatctactactatttatttgcttttatttatggacttgttggttcttgcagtgatgtagtcatggtcaattcttcttggacactaaaccatattctctcactatggaaagctgggaattgcactaacattgtttatccaccttgtgatgtgcagacatttctggacattcccttacatgagaaaaagatgaccccaggacatttgctggtttctgttggccagtttaggccggaaaagaatcatccattgcagatcagagcctttgctaaattgctgaataagaagatggttgagtcacctccttcgcttaaacttgtcctcattggaggttgtcgtaacaaagatgatgaacttagggtaaaccaactgagaaggctgtctgaggatttaggagttcaagaatatgtggaatttaaaataaacattccatttgatgaattaaagaattatttgtctgaagcaacaattggtctgcataccatgtggaacgagcattttgggattggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaa

SEQ ID NO: 45467 - protein, 328 aa, Homo sapiens
MQCVPDVYIDSMGYAFTLPLFKYIGGCQVGSYVHYPTISTDMLSVVKNQNIGFNNAAFITRNPFLSKVKLIYYYLFAFIYGLVGSCSDVVMVNSSWTLNHILSLWKAGNCTNIVYPPCDVQTFLDIPLHEKKMTPGHLLVSVGQFRPEKNHPLQIRAFAKLLNKKMVESPPSLKLVLIGGCRNKDDELRVNQLRRLSEDLGVQEYVEFKINIPFDELKNYLSEATIGLHTMWNEHFGIGVVECMAAGTIILAHNSGGPKLDIVVPHEGDITGFLAESEEDYAETIAHILSMSAEKRLQIRKSARASVSRFSDQEFEVTFLSSVEKLFK

SEQ ID NO: 45468 - DNA, 1272 bp, Brachydanio rerio
  CDS (1)..(1272)
atgtcattcaaacagacagacgagtttgtgtcagtaaacgtgaaaggttcctgtcaggacagtatggttcgggtggtgttcctgcaccctgatctgggtataggtggtgcagagcgtctggtggtggacgcggctgtagctctgcgctctcgtggatgtagtgttcagatctggacagcgcattatgacccgcagcactgcttctccgagactctctctcctgacctgccggtggtgtgtgtgggcgattggctgcccaccagtgtgtttggttatttccacgctctctgtgcttacctgcgcatgatctacttaaccatttatctcgtgctctttagtggagaggagtttgatgttgtcttctgcgatcaggtttcagcgtgcattccttttttgcgtttggcacgtcaaaggaagaaagtcttattctactgtcatttccctgaccagctactgacacagcgtcgttctgctctgaagcgcctgtatcgagggccaattgactggttcgaagaactgaccacaggcatggccgatcgcattctagtcaacagccagttcaccgccaaagtcttcaaacagacgtttcccaaactgtccgagatccacactgacgtcctttatccctctctgaactcatcagctttcgatgatgaagtagagggtctcggtggactcctccctgaaggacggagcttcatttatttgtcgatcaaccgctacgaacgcaaaaagaacctgccattggcattacaagcattagcaaacctgaaggaccgactgtcagttggagaatgggagtgtgtgcaccttgtaatggcgggaggttacgacgagcgtgtggttgaaaatgtagagcactatgaagaactgcgctcactcgtgacctctcttggcctggaggaccacgtcaccttcttgcgttcgttttcagacaaacagaaactgtctttgctgcataacagcacttgtgtactctacactcccagcaatgaacattttgggattgtccctattgaatccatgtatttgcgctgccccgttattgctgttaactccggtggaccacttgaatctgtggcgcatgaagaaacgggatttctatgcgaacccacacctgaacgcttttcggaagccatgcagaatttcgtttcagatcctaaactaaagcagagaatgggacaggctggcagagagcgggtacagcagcgcttctcaatgcaggccttcgccgagcagctctatagtcatatcgccagccttaaccaataa

SEQ ID NO: 45469 - protein, 423 aa, Brachydanio rerio
MSFKQTDEFVSVNVKGSCQDSMVRVVFLHPDLGIGGAERLVVDAAVALRSRGCSVQIWTAHYDPQHCFSETLSPDLPVVCVGDWLPTSVFGYFHALCAYLRMIYLTIYLVLFSGEEFDVVFCDQVSACIPFLRLARQRKKVLFYCHFPDQLLTQRRSALKRLYRGPIDWFEELTTGMADRILVNSQFTAKVFKQTFPKLSEIHTDVLYPSLNSSAFDDEVEGLGGLLPEGRSFIYLSINRYERKKNLPLALQALANLKDRLSVGEWECVHLVMAGGYDERVVENVEHYEELRSLVTSLGLEDHVTFLRSFSDKQKLSLLHNSTCVLYTPSNEHFGIVPIESMYLRCPVIAVNSGGPLESVAHEETGFLCEPTPERFSEAMQNFVSDPKLKQRMGQAGRERVQQRFSMQAFAEQLYSHIASLNQ

SEQ ID NO: 45470 - DNA, 1527 bp, Brachydanio rerio
  CDS (1)..(1527)
atggttgtcatatatttggagaagatgtcagcgcacgatcacttttccctttgtctgtgcgatttaataaggttactctggtctcttatgttaccatgcttctatctgagtttcctcctgacaactatccttttcctcttcatcatgggggtgagaagttggctgcagatgaagaggaagaccagaagagttcaggatggccggcctgccgtggcttttttccacccatattgcaatgcaggaggaggaggagaaagagtgctgtggtgtgctttacgggctcttcaaaacaggtaccaagatgtttctttcgtagtctacacgggtgatcagggggtgacggcagaagagattttggatggagcacggagacgatttaacatcagactcccccgacccgttaagtttgtgttcctgaagcatcgtctactggtggaggcaaaactttacccacatttcacccttctggggcagagtgtgggctccatcttcttggggtgggaggcattgactgagtttgttccagatctctatattgactcaatgggcttcgccttcaccttacccgtgttccgctatctgggtggttgtcaagtgggaagctatgtgcactatccaaccatcagcacggacatgctgtctgtggttcgagaaagaaaccccaggttcaacaatgcagactacatctccagcaaccctgtactcagtgccatcaaagtgatttattattgtgtcttcgcactgctgtatggcctggctggctcctgtagtgacgtcatcatggtcaattccacctggactttgggtcacattctggctctgtggcgcactccgaaccgcaccagtgtggtttacccaccatgcgatgttcaggcattcctggatgttccaattggggaagacaatgaagagaaagagcaaaagaagtgtcacagtctggtctctgtgggtcagttccggccagaaaaagaccatcagctgcagatcagggcatttaaaaagcttttggacagaaaggaggcggagcctgcgggaagagaggctgtgaagctggtgctgattggtgggtgtcggaaccaggaggatgaagatcgggttctgatgctgagaggattgtgccaggagctgggcatagcagacagggtggagtttaagctcaatattccattccaggagctgaagaaagatttaacagatgccactatcgggttgcacacaatgtggaatgaacattttggcattggtatagtggagtgtatggctgcaggaacaataattctagctcacaaatctggcggtccaaagttggacattgtagttccatacgatggtggtcccaccggctttctggcagatgatgaagacaattacgcagacgccatggaacgaatcctttctatgagtcctgctactcggttagaaatgcgacgccgggcccgtctgtccgtctcccgcttctcagatcaggagtttgaaggttcatttctgtcagcaatggagcctctgatgtcaacattgagagcgtga

SEQ ID NO: 45471 - protein, 508 aa, Brachydanio rerio
MVVIYLEKMSAHDHFSLCLCDLIRLLWSLMLPCFYLSFLLTTILFLFIMGVRSWLQMKRKTRRVQDGRPAVAFFHPYCNAGGGGERVLWCALRALQNRYQDVSFVVYTGDQGVTAEEILDGARRRFNIRLPRPVKFVFLKHRLLVEAKLYPHFTLLGQSVGSIFLGWEALTEFVPDLYIDSMGFAFTLPVFRYLGGCQVGSYVHYPTISTDMLSVVRERNPRFNNADYISSNPVLSAIKVIYYCVFALLYGLAGSCSDVIMVNSTWTLGHILALWRTPNRTSVVYPPCDVQAFLDVPIGEDNEEKEQKKCHSLVSVGQFRPEKDHQLQIRAFKKLLDRKEAEPAGREAVKLVLIGGCRNQEDEDRVLMLRGLCQELGIADRVEFKLNIPFQELKKDLTDATIGLHTMWNEHFGIGIVECMAAGTIILAHKSGGPKLDIVVPYDGGPTGFLADDEDNYADAMERILSMSPATRLEMRRRARLSVSRFSDQEFEGSFLSAMEPLMSTLRA

SEQ ID NO: 45472 - DNA, 1275 bp, Drosophila melanogaster
  CDS (1)..(1275)
atggttcgagttctgttcctccacccggatttgggcatcggaggagctgagcgactggtggtggatgccgctctggcactcaaggagcggggtcaccaggtcagcttcctaacgaatcaccacgacagcacgcactgcttcaaggagacggcggacggcacttttccggtccacgtagtgggcgactggttgccacgcgggctcttcggaagattctatgccatctgtgcctatctgcgcatgctctatgcggcgatctacgccagtttttttatgccccagcgggagcaagtggacgtggtggtgtgcgacctaatctctgtgtgcattccagttctccgcttcgcccctcatcgtccgaaggttctattctactgccactttccggatcagcttctcagcagccgtgaaggactgctgaagcggctgtaccgcctgcccatcaactggctggaggagcacacgatcggtctagcagacaaggtgctggtcaactccaaatttacgctacgtgtcttccaggacacctttcgccgactgagcacggtgccggatgtgctgtatccttcactgcacacccagtactttgaccagatgcagaaaaagctagaacagcggtctgctttactggacgagccagtgcatccgcgagtaccactcaacgcctttatctatctggacatcaatcgctacgagcgcaagaagaaccacgcccttgccttacattccctgcgccttctgggcgacatgctgcccgccacggaattcaagcgctgtcgcctgatcatcgccgggggttacgacaccagatgcatggaaaatgtggagcacttcgcggagctggagcaccttacggaggagttgaagcttcaggatcacgttgtgctgctacgctcgcctaccgacgaggagaaatgtcgcctgctctttgccgctcactgtctgctgtatacgccagagaacgagcacttcggcattgtgccgctggagggcatgtactgctcgaagccagtcgtggcattgaacagcggcggacccactgaaacggtggtgaacacttcgactggctttctgtgcgaaaagaccgagaagagctttggtggagcaatgctccagcttttccgggacgagcagctgcgtgtgaagatgggagaccagggtcacaaacgggtgcagcaaaagttctctttccaagcattcgcagatcggctcaacggcattattagagatcttgttcctatctccagggagtcgagtgccaagaaaaataaataa

SEQ ID NO: 45473 - protein, 424 aa, Drosophila melanogaster
MVRVLFLHPDLGIGGAERLVVDAALALKERGHQVSFLTNHHDSTHCFKETADGTFPVHVVGDWLPRGLFGRFYAICAYLRMLYAAIYASFFMPQREQVDVVVCDLISVCIPVLRFAPHRPKVLFYCHFPDQLLSSREGLLKRLYRLPINWLEEHTIGLADKVLVNSKFTLRVFQDTFRRLSTVPDVLYPSLHTQYFDQMQKKLEQRSALLDEPVHPRVPLNAFIYLDINRYERKKNHALALHSLRLLGDMLPATEFKRCRLIIAGGYDTRCMENVEHFAELEHLTEELKLQDHVVLLRSPTDEEKCRLLFAAHCLLYTPENEHFGIVPLEGMYCSKPVVALNSGGPTETVVNTSTGFLCEKTEKSFGGAMLQLFRDEQLRVKMGDQGHKRVQQKFSFQAFADRLNGIIRDLVPISRESSAKKNK

SEQ ID NO: 45474 - DNA, 1095 bp, Homo sapiens
  CDS (1)..(1095)
atgtttgtttttttaaggaaacgctatcttgtggaagattcactgtatcctcacttcacactgctgggccaaagtctaggatccatttttcttggctgggaagctctaatgcagtgtgttcctgatgtttacattgattcaatgggatacgcttttacgcttcctctgtttaagtatatagggggttgccaagttggaagctatgttcattatcctactatcagcaccgacatgctctctgtagtgaagaatcaaaatattggatttaataatgcagccttcattaccaggaatccttttctcagcaaagtaaagctcatctactactatttatttgcttttatttatggacttgttggttcttgcagtgatgtagtcatggtcaattcttcttggacactaaaccatattctctcactatggaaagttgggaattgcactaacattgtttatccaccttgtgatgtgcagacatttctggacattcccttacatgagaaaaagatgaccccaggacatttgctggtttctgttggccagtttaggccggaaaagaatcatccattgcagatcagagcctttgctaaattgctgaataagaagatggttgagtcacctccttcgcttaaacttgtcctcattggaggttgtcgtaacaaagatgatgaacttagggtaaaccaactgagaaggctgtctgaggatttaggagttcaagaatatgtggaatttaaaataaacattccatttgatgaattaaagaattatttgtctgaagcaacaattggtctgcataccatgtggaacgagcattttgggattggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaa

SEQ ID NO: 45475 - protein, 364 aa, Homo sapiens
MFVFLRKRYLVEDSLYPHFTLLGQSLGSIFLGWEALMQCVPDVYIDSMGYAFTLPLFKYIGGCQVGSYVHYPTISTDMLSVVKNQNIGFNNAAFITRNPFLSKVKLIYYYLFAFIYGLVGSCSDVVMVNSSWTLNHILSLWKVGNCTNIVYPPCDVQTFLDIPLHEKKMTPGHLLVSVGQFRPEKNHPLQIRAFAKLLNKKMVESPPSLKLVLIGGCRNKDDELRVNQLRRLSEDLGVQEYVEFKINIPFDELKNYLSEATIGLHTMWNEHFGIGVVECMAAGTIILAHNSGGPKLDIVVPHEGDITGFLAESEEDYAETIAHILSMSAEKRLQIRKSARASVSRFSDQEFEVTFLSSVEKLFK

SEQ ID NO: 45476 - DNA, 1092 bp, Actinobacillus actinomycetemcomitans
  CDS (1)..(1092): transl_table=11
atgaaagttgctattattcactattggttagtgaatttaagaggtggagagaaagtacttgaagccctatgtgagctttatccgcaagcggatatttttacccatgtttatattcaggaaaagtttcaaaattccgtgatttccaagcataagattactacaacatttatctctaaacttccctgggccgccaaacattatcaattatatttgccattcatgccattagcgttagaagagatggatttatctggttatgatttagtgatttccagtgagtcgggtccggctaagggtgttattgtaccgcccggtgtgccgcatatttgttattgtcattcaccaatgcgctatgcttgggatatgtatggagaatatcgggcgaagatgggaaaaataaagcgatttttggccgcacttttcttgcattacattcgtcgttgggatcaattaactagtcagcaagttactaaatttattgctaacagccaatttgttgccaagcggataaaaagctactatgcacaggaaagcatggttatttatccgccggttcaggtggatgcattcgaattagctcaagacagtgaagattattatttgattttaggacaactggttccttataaaaaaacggatttggccgttcgggcatttaatcaatcgggcaaaaagttagttgttattggagatggtgtacaattagagctgttaaaaaagattgcacaacgtaatgtgaagatattgggctatcaaccctttcaagtagtgaaagaatacttaatgaaatgcaaagcattaattttccccggtgtggaggattttggtattgttcccttggaagcgatggcgtgtggtaagccggtaattgcttttgctcagggaggtgcgttggagacaataaaagaggggattactggttcctttttctataaccagactgaaaatagtttaaactgggctgtttctcattttgaacaaaatttttacgttgaaccgtacataatacgacaacatgctatgctcttttctaaagaaaattttaaagaaaaaattcattcctatataaatcagatcattaccggtaaatag

SEQ ID NO: 45477 - protein, 363 aa, Actinobacillus actinomycetemcomitans
MKVAIIHYWLVNLRGGEKVLEALCELYPQADIFTHVYIQEKFQNSVISKHKITTTFISKLPWAAKHYQLYLPFMPLALEEMDLSGYDLVISSESGPAKGVIVPPGVPHICYCHSPMRYAWDMYGEYRAKMGKIKRFLAALFLHYIRRWDQLTSQQVTKFIANSQFVAKRIKSYYAQESMVIYPPVQVDAFELAQDSEDYYLILGQLVPYKKTDLAVRAFNQSGKKLVVIGDGVQLELLKKIAQRNVKILGYQPFQVVKEYLMKCKALIFPGVEDFGIVPLEAMACGKPVIAFAQGGALETIKEGITGSFFYNQTENSLNWAVSHFEQNFYVEPYIIRQHAMLFSKENFKEKIHSYINQIITGK

SEQ ID NO: 45478 - DNA, 1218 bp, Arabidopsis thaliana
  CDS (1)..(1218)
atggcgaaaaaagaaggttcaaagatgaacatcgccattatacatccagatcttggaataggcggagcagagagattgattgttgatgcggccgttgagcttgcctcgcacggtcataaagttcatatcttcacctctcaccacgacaaatccagatgcttcgaggaaactctttccggtatctttcaagttacggtgtatggatctttcctgccacggcatattttctaccgactacacgcagtgtgtgcatatttgcggtgcttgtttgttgctctctgtgttcttttgggttggtcttcattcgatgttgtactagcagaccaagtttcagtcgtagtcccattgctgaaactcaaaaggtcatctaaggttgttttctactgccatttcccggatctcttgctagctaagcatacaacaacacttagacggatgtatcggaaacccattgatttcattgaagaacaaacaacagggatggctgatatgatccttgttaacagtaacttcacggcatcaacatttgccaatacatttaaaaggctaaatgcacaagggagtcgcccagctgtactttaccccgcagtcaatattgatcagttcattgaaccccacacttataagttgaatttcctctccataaaccgctttgagaggaaaaagaacatcgatctagctgtttcagcttttgctatcctatgcaaacataagcaaaatctgagtgatgttacccttaccgttgcaggcaagtgtggatatgacgagcgattgaaggagaatgttgagtacttggaggagctcagaagtttagccgagaaagaaggagtttctgatcgagttaactttatcacatcttgttcaaccgctgaaagaaatgaacttctctcaagctgcttgtgcgttctctacacccccacggatgaacattttggtattgttccattagaagcaatggctgcatacaaacccgtgatagcctgcaacagtggtggccccgtggagacggtaaagaatggagtaacaggctatctttgtgaaccaactccagaagatttcagttcggcgatggctagattcatcgagaatcctgagttggcgaatagaatgggagctgaagccaggaaccatgtcgttgaatcattctctgtgaagacgtttggacagaagttgaatcagtatctcgttgatgtcgtatcaagtcctaaagaagattga

SEQ ID NO: 45479 - protein, 405 aa, Arabidopsis thaliana
MAKKEGSKMNIAIIHPDLGIGGAERLIVDAAVELASHGHKVHIFTSHHDKSRCFEETLSGIFQVTVYGSFLPRHIFYRLHAVCAYLRCLFVALCVLLGWSSFDVVLADQVSVVVPLLKLKRSSKVVFYCHFPDLLLAKHTTTLRRMYRKPIDFIEEQTTGMADMILVNSNFTASTFANTFKRLNAQGSRPAVLYPAVNIDQFIEPHTYKLNFLSINRFERKKNIDLAVSAFAILCKHKQNLSDVTLTVAGKCGYDERLKENVEYLEELRSLAEKEGVSDRVNFITSCSTAERNELLSSCLCVLYTPTDEHFGIVPLEAMAAYKPVIACNSGGPVETVKNGVTGYLCEPTPEDFSSAMARFIENPELANRMGAEARNHVVESFSVKTFGQKLNQYLVDVVSSPKED

SEQ ID NO: 45480 - DNA, 1416 bp, Schizosaccharomyces pombe
  CDS (1)..(1416)
atgattacaacacttgccattgctcttttcattgctgtggtcgccatccattcacatatacgaagaaaaatatgcaaggaaattggaattcgacttatcaaaaagatagcccctgtgaaagctagtttatacaaacaagtgggcgtggagccgaaactagcaagaaccgtcgggttttttcatccttactgcaatgctggaggcggaggtgaacgagtattatggacagctgtcaaatctgtccaaacggagtttccaaatgttatttctgttgtgtatactggcgacaatgttagtaaagccgaaattctgcgcagagtcaagaatacatttgaaatcgacctggattcttccaaaatagtttttgtttatctaaaacttcgtttccttgtgtccgccactacttggcatcggtttacattgcttggacaatcgctaggaagtatgattttaggtttcgaagctatttatcgatttgcacctgacattttcattgacaccatgggatatgctttcactttttgtgtcgttaaaagcttccaaaatattcctgtcggcgcgtacgttcattatcccacgatttctaccgacatgctaaagtccttaaaacaagtatctctacttgctaaggttaaaatggcttactggagatggttcgctcagttgtattcagatgccggatctcatgcggactatgtgatgactaactcttcatggacgagaaaccacattgcatctctttgggggaaagatattcaactctccgttgttttccccccctgtaacacttcagagcttgaaaagatcgacattaacagaaagcgcgaacccactcttctttatcttgcacaatacagacctgaaaagaatcatgaaaatgtacttcgtagttttgctctctattttgaacagcatcctgattctccagcgaagctattactggtcggtagcgttcgaggtgaagaagacatgtgttttgtgaatcatttgaagacccttgcgactgaactcaacttacaatcaaaagtcaaatttgttgtagatgctccttggcccaaggtagttgagtatctaggtacttgctctataggtgtcaattacatgtggaatgagcattttgggattggtgtcgttgaatacatggctgctggtttaatacctgttgtcaacaattcgggtggcccaaagttcgatatcgtgattccatggattggaaagcctacaggttttcatgctagcaccattagcgaatatgctgaagcctaccataaagctcttacattgagtcctcaagagcaattagagatgagaatcaatgctcgttcagcttgcgctcgttttggcgaacacgtttttatgcgcgattttggaaatgtgtttgccaaactccttcgtgaagattacagtcgtacctaa

SEQ ID NO: 45481 - protein, 471 aa, Schizosaccharomyces pombe
MITTLAIALFIAVVAIHSHIRRKICKEIGIRLIKKIAPVKASLYKQVGVEPKLARTVGFFHPYCNAGGGGERVLWTAVKSVQTEFPNVISVVYTGDNVSKAEILRRVKNTFEIDLDSSKIVFVYLKLRFLVSATTWHRFTLLGQSLGSMILGFEAIYRFAPDIFIDTMGYAFTFCVVKSFQNIPVGAYVHYPTISTDMLKSLKQVSLLAKVKMAYWRWFAQLYSDAGSHADYVMTNSSWTRNHIASLWGKDIQLSVVFPPCNTSELEKIDINRKREPTLLYLAQYRPEKNHENVLRSFALYFEQHPDSPAKLLLVGSVRGEEDMCFVNHLKTLATELNLQSKVKFVVDAPWPKVVEYLGTCSIGVNYMWNEHFGIGVVEYMAAGLIPVVNNSGGPKFDIVIPWIGKPTGFHASTISEYAEAYHKALTLSPQEQLEMRINARSACARFGEHVFMRDFGNVFAKLLREDYSRT

SEQ ID NO: 45482 - DNA, 1647 bp, Saccharomyces cerevisiae
  CDS (1)..(1647)
atgggcagtgcttggacaaactacaattttgaagaggttaagtctcattttgggttcaaaaaatatgttgtatcatctttagtactagtgtatggactaattaaggttctcacgtggatcttccgtcaatgggtgtattccagcttgaatccgttctccaaaaaatcttcattactgaacagagcagttgcctcctgtggtgagaagaatgtgaaagtttttggtttttttcatccgtattgtaatgctggtggtggtggggaaaaagtgctctggaaagctgtagatatcactttgagaaaagatgctaagaacgttattgtcatttattcaggggattttgtgaatggagagaatgttactccggagaatattctaaataatgtgaaagcgaagttcgattacgacttggattcggatagaatatttttcatttcattgaagctaagatacttggtggattcttcaacatggaagcatttcacgttgattggacaagcaattggatcaatgattctcgcatttgaatccattattcagtgtccacctgatatatggattgatacaatggggtaccctttcagctatcctattattgctaggtttttgaggagaattcctatcgtcacatatacgcattatccgataatgtcaaaagacatgttaaataagctgttcaaaatgcccaagaagggtatcaaagtttacggtaaaatattatactggaaagtttttatgttaatttatcaatccattggttctaaaattgatattgtaatcacaaactcaacatggacaaataaccacataaagcaaatttggcaatccaatacgtgtaaaattatatatcctccatgctctactgagaaattagtagattggaagcaaaagtttggtactgcaaagggtgagagattaaatcaagcaattgtgttggcacaatttcgtcctgagaaacgtcataagttaatcattgagtcctttgcaactttcttgaaaaatttaccggattctgtatcgccaattaaattgataatggcggggtccactagatccaagcaagatgaaaattatgttaaaagtttacaagactggtcagaaaatgtattaaaaattcctaaacatttgatatcattcgaaaaaaatctgcccttcgataagattgaaatattactaaacaaatctactttcggtgttaatgccatgtggaatgagcactttggaattgcagttgtagagtatatggcttccggtttgatccccatagttcatgcctcggcgggcccattgttagatatagttactccatgggatgccaacgggaatatcggaaaagctccaccacaatgggagttacaaaagaaatattttgcaaaactcgaagatgatggtgaaactactggatttttctttaaagagccgagtgatcctgattataacacaaccaaagatcctctgagataccctaatttgtccgaccttttcttacaaattacgaaactggactatgactgcctaagggtgatgggcgcaagaaaccagcagtattcattgtataaattctctgatttgaagtttgataaagattgggaaaactttgtactgaatcctatttgtaaattattagaagaggaggaaaggggctga

SEQ ID NO: 45483 - protein, 548 aa, Saccharomyces cerevisiae
MGSAWTNYNFEEVKSHFGFKKYVVSSLVLVYGLIKVLTWIFRQWVYSSLNPFSKKSSLLNRAVASCGEKNVKVFGFFHPYCNAGGGGEKVLWKAVDITLRKDAKNVIVIYSGDFVNGENVTPENILNNVKAKFDYDLDSDRIFFISLKLRYLVDSSTWKHFTLIGQAIGSMILAFESIIQCPPDIWIDTMGYPFSYPIIARFLRRIPIVTYTHYPIMSKDMLNKLFKMPKKGIKVYGKILYWKVFMLIYQSIGSKIDIVITNSTWTNNHIKQIWQSNTCKIIYPPCSTEKLVDWKQKFGTAKGERLNQAIVLAQFRPEKRHKLIIESFATFLKNLPDSVSPIKLIMAGSTRSKQDENYVKSLQDWSENVLKIPKHLISFEKNLPFDKIEILLNKSTFGVNAMWNEHFGIAVVEYMASGLIPIVHASAGPLLDIVTPWDANGNIGKAPPQWELQKKYFAKLEDDGETTGFFFKEPSDPDYNTTKDPLRYPNLSDLFLQITKLDYDCLRVMGARNQQYSLYKFSDLKFDKDWENFVLNPICKLLEEEERG

SEQ ID NO: 45484 - DNA, 1545 bp, Ashbya gossypii
  CDS (1)..(1545)
atgatgacccccttgaatattgccttgattcaccctgatctgggcatcggcggagcagaacgtctagtggtagatgcggccattggccttcaggatcaagggcatcgtgttactatctatactagccactgcgacaagaaccactgttttgaggagatcaaacgcggggatttaaaggtcgttgttgtgggtgacttcctaccgacaaatattcttgggaagttctttatcctgtgcgccaacttgagacagctcgctctggtgttcaagctggtgatcaacggcagcattgataagcacgatttgttcattgtggaccagctttcgacatgcgttccgctactgcacctattcagcgcttccggtcgtgtgttattctactgccattttcccgatcagctgctggcacaacgcaagagtctggtatcgaagctgtaccgggtaccgtttgatctgctagagcagctcacaatgggatgtagcgactcagttgtggtaaattcgtatttcactcgttctgtcttctttgacaccttcaagatactgagattaaacccccgtgtggtatacccatgtgtggccatggacgaacttccaatagaaaagatagatattggattctatgaccagattattgggccaaacaataggtactacctaagcataaatcggtttgagagaaagaaggacattgcgctagcccttaatgccttcaaggcttctaaagagggccatagtagtgatacaaaactaataatatgtggaggatacgacagccgagtggcggaaaatgtggaatatctgagcgaactacagcttatttgcgagaaagcaaatatagcacatgtaactatattctacagcgagtttagcagaactcctgagcattatacttttcctaccggcgtgagggagaagaaggttatatttctggcatctatatcgtcgtcactaaaggaattgctccttaagaaagcccaattattgctgtacacgccctcccgtgagcatttcgggatcgtgccactggaagctatgaagcatggtactcccgtgttggctgtggataacggtggaccgctggaaacagttgttactctcaagagtgataatcaagataccgctaccggatggctgagacgtgcggacgctggaatatgggcagaagctatcgacgagcaggcagagtatgtcaagaaaaatccaggcatcttcgctactaacgggccgaaatgggtcaaagacaagttttcccgtgatgctatgacaagctcatttttgcacaacatagataatattttcatgactgatagagtaattcagccgtgggctgtcatggtgatcctcgctgcgagctacatcctgtggcgttcatctcacgtttttggtgatgcatgtagatacatatatctcctcacaggtggtatccttgttctacgttcgagatatctgcttgccatcttctgggtccttctgttcgtaatgcagccgcagctgtccgttggtgttgacacaataactgccacattgaagccaaaactatag

SEQ ID NO: 45485 - protein, 514 aa, Ashbya gossypii
MMTPLNIALIHPDLGIGGAERLVVDAAIGLQDQGHRVTIYTSHCDKNHCFEEIKRGDLKVVVVGDFLPTNILGKFFILCANLRQLALVFKLVINGSIDKHDLFIVDQLSTCVPLLHLFSASGRVLFYCHFPDQLLAQRKSLVSKLYRVPFDLLEQLTMGCSDSVVVNSYFTRSVFFDTFKILRLNPRVVYPCVAMDELPIEKIDIGFYDQIIGPNNRYYLSINRFERKKDIALALNAFKASKEGHSSDTKLIICGGYDSRVAENVEYLSELQLICEKANIAHVTIFYSEFSRTPEHYTFPTGVREKKVIFLASISSSLKELLLKKAQLLLYTPSREHFGIVPLEAMKHGTPVLAVDNGGPLETVVTLKSDNQDTATGWLRRADAGIWAEAIDEQAEYVKKNPGIFATNGPKWVKDKFSRDAMTSSFLHNIDNIFMTDRVIQPWAVMVILAASYILWRSSHVFGDACRYIYLLTGGILVLRSRYLLAIFWVLLFVMQPQLSVGVDTITATLKPKL

SEQ ID NO: 45486 - DNA, 1377 bp, Candida glabrata
  CDS (1)..(1377)
atggtgcctgcgaagaagttaaagatagcatttgtgcatcccgatttaggaattggtggagcagaaagactagtggttgatgcagcacttggtttacaagaagcaggtcatgaagttatcatatatacaagtcattgtgacaagacacattgtttcgaagaggtcaaaaatggtactttgaaagttgaagtgtttggtgattttctaccgactgatttgggtaaacgattcttcattgtctttgctaatttgagacagttgtatctgacagctaaagtggtgttgtcaggaagatcaaaagacaaagatgtgtttatcattgatcagttatcaacttgtgtcccattttttaagttagcaaataataaagttttgttttattgccattttccagatcaattgttagctataagaacgaactggattaaaagcttatatcgtataccattcgatctactagagcaattcacgatgtactgttcggatgaggttgttgttaactctaactttacaaaatccatgtataaaaaaaccttcaaatacctacagaaaaacccaaacgtcatttatccatgtgttgataccgatactgagactctgattaacgatagggatatgcaaataggaaaccttttggttggaaaatgtccaaatttctacttgagtatcaataggtatgagaggaaaaagaatatagaactagcaatacaagcgtttgccaaagcatcagttgaaaacacaaatttggttgtatgtggtggttatgatccaaggatacacgaaaatgtacagtatttgcaagaattgacatgcctttgcaaagaattggatctttcttatactgttaatcactattctgactttattgaggatagttattctgtgaatgaaattgaaaagttgtttggtgcaaaggttatatttttgacatcaatttcttcttctttgaaggaatttctaattcaaaacatgcaactattattgtatacaccttcatatgaacattttggaatagtaccattggaagctatgaaatacggcaaaccagtgttagctgtcaacaatggtggaccagttgaaactgttgtaagctatcaaaaagaagataatgagaaatcaaccactggttggttgaggtcagctgacgctgatgagtgggcatcggctttgattgaaagtaaagaagttttgaatcaaaatccggaacttttcaaaaataatggccctaaaagggttattgaactattctcaagaaaagctatgacgcaagaatttgaaactaacatcaagttagcgctaaggcatacttccaatataagtatcatatatgttgtatccataatatttgcagtactgctcaaagtatttgttttctaa

SEQ ID NO: 45487 - protein, 458 aa, Candida glabrata
MVPAKKLKIAFVHPDLGIGGAERLVVDAALGLQEAGHEVIIYTSHCDKTHCFEEVKNGTLKVEVFGDFLPTDLGKRFFIVFANLRQLYLTAKVVLSGRSKDKDVFIIDQLSTCVPFFKLANNKVLFYCHFPDQLLAIRTNWIKSLYRIPFDLLEQFTMYCSDEVVVNSNFTKSMYKKTFKYLQKNPNVIYPCVDTDTETLINDRDMQIGNLLVGKCPNFYLSINRYERKKNIELAIQAFAKASVENTNLVVCGGYDPRIHENVQYLQELTCLCKELDLSYTVNHYSDFIEDSYSVNEIEKLFGAKVIFLTSISSSLKEFLIQNMQLLLYTPSYEHFGIVPLEAMKYGKPVLAVNNGGPVETVVSYQKEDNEKSTTGWLRSADADEWASALIESKEVLNQNPELFKNNGPKRVIELFSRKAMTQEFETNIKLALRHTSNISIIYVVSIIFAVLLKVFVF

SEQ ID NO: 45488 - DNA, 1431 bp, Debaryomyces hansenii
  CDS (1)..(1431)
atgtcaaagaaattaggcaataattcgaagaagatcgcgtttgtccatccagatcttggaattgggggagctgaaagattagtcgttgatgcagcagtaggtttacaagaacttgaaaatgaagtcacaatttacacgtctcattgcgataagaagcattgcttcgaagaagttagttccaacttattagacgtagaggtctatggagacttctttccaactaatgttttgaagaggttccacattctatttgctattatcagacaattttatttggtgctagcattaatatttactggtaaaataaaacaatacgactatttcatagttgatcaactatccttttgtattccattattatgctgtttcagtagacctgaatgcaaaattttattctactgtcatttcccagatcagctattagcattaaaaggcggatttcttaagaggttctacaggatgccttttgatctcattgaggaatggactacgggaataagcgatcaaatagtggttaattccaaatttaccaaaggtattttccacaaaacatttaaggggttaaaaaatattgagccgggagttatttatccatgtgttgaccttaattcagcgactgatactgaagaggacaagttgatggatgaagaggtgaatgaattctttaagggcggtaagtttttcctttcagttaatcgatttgaacgaaagaagaatattggtttagctattcaatcatttgctaagtttaaggcacaattacccaaaaatgtttcggaagataatagaataaaaccacgattggtggtcgcaggcggatttgatccaagggtacttgaaaatgtggaatacttgcaagagttgaatggattatctgaactgttgaacttgaaatgtttcactattcgtggcaaattgcttataataccacctgctactgacatattattcttaccatcaattaagtcatcattgaagaaatctttaattaaaaatgctgaattattattatatacgccttcttttgaacattttggaattgttcctgttgaaagtatgctattcaaaactcccgtgttatcggctaataatggtggtccattagagtcgattgttcattttacttctgataatatagcaacagcaactggctactctcaagaacctaatgatgaattgtggtcaaaaacaatgcacacattttacactgaattggacgaagcaacaaagttgaaattgggggaaaatgggttgaccagagttcatgaattatttctgagacaccagatgagtgaagcgtttatgcaaaatttgattcaaagtaattcaaaggatgaagagaagggaattttatatggtatcttaaaaatgtggagaattgaattgttatttgttcttattagttattatttggtgagattatataaatag

SEQ ID NO: 45489 - protein, 476 aa, Debaryomyces hansenii
MSKKLGNNSKKIAFVHPDLGIGGAERLVVDAAVGLQELENEVTIYTSHCDKKHCFEEVSSNLLDVEVYGDFFPTNVLKRFHILFAIIRQFYLVLALIFTGKIKQYDYFIVDQLSFCIPLLCCFSRPECKILFYCHFPDQLLALKGGFLKRFYRMPFDLIEEWTTGISDQIVVNSKFTKGIFHKTFKGLKNIEPGVIYPCVDLNSATDTEEDKLMDEEVNEFFKGGKFFLSVNRFERKKNIGLAIQSFAKFKAQLPKNVSEDNRIKPRLVVAGGFDPRVLENVEYLQELNGLSELLNLKCFTIRGKLLIIPPATDILFLPSIKSSLKKSLIKNAELLLYTPSFEHFGIVPVESMLFKTPVLSANNGGPLESIVHFTSDNIATATGYSQEPNDELWSKTMHTFYTELDEATKLKLGENGLTRVHELFLRHQMSEAFMQNLIQSNSKDEEKGILYGILKMWRIELLFVLISYYLVRLYK

SEQ ID NO: 45490 - DNA, 1251 bp, Homo sapiens
  CDS (1)..(1251)
atggcggaggagcagggccgggaacgggactcggttcccaagccgtcggtgctgttcctccacccagacctgggcgtgggcggcgctgagcggctggtgttggacgcggcgctggcgctgcaggcgcgcgggtgtagcgtgaagatctggacagcgcactacgacccgggccactgtttcgccgagagccgcgagctaccggtgcgctgtgccggggactggctgccgcgaggcctgggctggggcggccgcggcgccgccgtctgcgcctacgtgcgcatggttttcctggcgctctacgtgctgttcctcgccgacgaggagttcgacgtggtagtgtgcgaccaggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataa

SEQ ID NO: 45491 - protein, 416 aa, Homo sapiens
MAEEQGRERDSVPKPSVLFLHPDLGVGGAERLVLDAALALQARGCSVKIWTAHYDPGHCFAESRELPVRCAGDWLPRGLGWGGRGAAVCAYVRMVFLALYVLFLADEEFDVVVCDQVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 45492 - DNA, 1512 bp, Kluyveromyces lactis
  CDS (1)..(1512)
atgtctgaagctccagttcaccagcgtaaagtcgcgttcatacacccagatttaggaattggcggcgcagaaagattagtcgtcgatgctgccgctggcctacaaaacgctgggtatgacgtgacgatttatacaagtcattgcgacaagtctcattgttttgaagaggttaagaatggtacacttaaagtagaagttcgtggagacgcattgccaactcatatctttggtaagttctcgatcttatgcgccaacttaagacagttatatttgacatggaatctaatatctacaggaaaaatcgaagaatatgatgtttatatcgtggatcaactatcttcgtgcgttcctttattacatttaaatgctccagactcaaaagtgttgttttattgccatttcccggatcaattgctcgccaggcgggatggcttattgaagaaactgtatagaataccgtttgacatattggaacaatttaccatgggtgtagcagatactattctagttaattctaattttacaaagcaggtatttgccaaaacgttccagtcactagccgttgaccctaaagtggtttacccttgtgtaaacgtagagcaagaagaaatacttcctttagataaagatcttatgaagaagatcttgaagaacaatgaaaagtattatctatctatcaacagatacgaaaggaaaaaaaacattgaattggctatcactgcttttgcacaatcaaaacaacgtacctcccataaactatttatatctggaggttacgatttgaataattccgagaatatcgactatctaaaagaattggaaactttggccactgaattgaaattgaagcacgttcatctttcatatccagaatactccaagagtcctgacaagtgtccatcaagtaacttcgctgatgctcaaatattgtttttgacttctgtgtcatcgtctctcaaggaattactattgcaaagtactgaaatgttgctatacactccttctaacgaacactttggaattgtaccactcgaggctatgaagtatggtgtacctgttttggcagtagatacgggtggtccactagaaacagtggtagattacaatgagacaccttctcatattgatgcaactggttggttacgaccatccgatgctgatgaatggtcaaaagtgttggatcaatccgtagacatatttgaaaagaatcactccttattcgaagttaacggtcctaaacgtattaagtactatttctccagagaagcgatgtccaaaaactttgataataccatcgaccatattatttggaagtcaagaggaacgcgtttatggagcacattagctccagggctactgatgttcactgtccaatatgctacactgttgataacaggcgatgcttcttggccatatttattgctagctgcgatttcttattttgtattaagaagtgtaaaggccactgtgtactggatcatcgttttctgttacctaaactattcaacttaa

SEQ ID NO: 45493 - protein, 503 aa, Kluyveromyces lactis
MSEAPVHQRKVAFIHPDLGIGGAERLVVDAAAGLQNAGYDVTIYTSHCDKSHCFEEVKNGTLKVEVRGDALPTHIFGKFSILCANLRQLYLTWNLISTGKIEEYDVYIVDQLSSCVPLLHLNAPDSKVLFYCHFPDQLLARRDGLLKKLYRIPFDILEQFTMGVADTILVNSNFTKQVFAKTFQSLAVDPKVVYPCVNVEQEEILPLDKDLMKKILKNNEKYYLSINRYERKKNIELAITAFAQSKQRTSHKLFISGGYDLNNSENIDYLKELETLATELKLKHVHLSYPEYSKSPDKCPSSNFADAQILFLTSVSSSLKELLLQSTEMLLYTPSNEHFGIVPLEAMKYGVPVLAVDTGGPLETVVDYNETPSHIDATGWLRPSDADEWSKVLDQSVDIFEKNHSLFEVNGPKRIKYYFSREAMSKNFDNTIDHIIWKSRGTRLWSTLAPGLLMFTVQYATLLITGDASWPYLLLAAISYFVLRSVKATVYWIIVFCYLNYST

SEQ ID NO: 45494 - DNA, 1248 bp, Mus musculus
  CDS (1)..(1248)
atggccgaaaacctgtaccgagcccgttcccgggtttacagcccatctgtgctgtttctgcacccagacatgggtataggcggagccgagcgcctagtgctggacgcggcgctggcgctgcaggagtacggctgtgatgtgaagatatggaccgcgcactacgacccgaaccactgcttcatcgagacccgcgagctctcggtgcaatgcgcaggggactggctgcctcgcagcctgggctggggcggccgcggcgccgccatctgctcctacgtgcgcatggtctttctggcgctctacgtgctgtttctctccggcgaggagttcgacgtggtggtgtgcgaccaggtgtctgcctgtatcccggtgttcaaactggccagacggcgtaagagggtcctattttactgtcacttcccagatctgctgcttactcagagaaattcagctctgaagaagttctacagggcccccatcgactggatcgaggaatacaccacaggcatggcagaccgcatcttggtcaacagccagtacactgcttccgtctttaaagaaaccttcaagaccctgtctcacagaaatcctgatgtgctctacccatctctgaatatcggcagctttgacttggctattcctgaaaagatagatgacctcgtccccaaggggaagcaattcctgttcctctctatcaaccgatacgaaaggaagaaaaatctgcccttggcactgagatccttggtgcagcttcggaatcggttaccatctcaagagtgggataaggttcatctcttcatggccggtggttatgacgataggatcccggagaacgtggagcactataaggagttgaagaaaatggtccaagagtcagaccttgagcgtcatgtgaccttcctgcggtccttctcggacagacagaagatctcactcctccacggctgcttgtgtgtgctctacactccgagcaacgagcactttggcatcgtccctctggaggccatgtacatgcagtgcccagtcatcgctgttaataacggtgggcccctggagtccattgtccacaaggtcacggggttcctgtgtgagccagacccagtgcacttctcagaagccatggagaagttcatccacaaaccatccttaaaagccacgatgggcctcgctggaaaagccagggtggcggagaagttttcagctgatgcatttgcagaccagctgtaccagtatgtcacgaagctggtgtag

SEQ ID NO: 45495 - protein, 415 aa, Mus musculus
MAENLYRARSRVYSPSVLFLHPDMGIGGAERLVLDAALALQEYGCDVKIWTAHYDPNHCFIETRELSVQCAGDWLPRSLGWGGRGAAICSYVRMVFLALYVLFLSGEEFDVVVCDQVSACIPVFKLARRRKRVLFYCHFPDLLLTQRNSALKKFYRAPIDWIEEYTTGMADRILVNSQYTASVFKETFKTLSHRNPDVLYPSLNIGSFDLAIPEKIDDLVPKGKQFLFLSINRYERKKNLPLALRSLVQLRNRLPSQEWDKVHLFMAGGYDDRIPENVEHYKELKKMVQESDLERHVTFLRSFSDRQKISLLHGCLCVLYTPSNEHFGIVPLEAMYMQCPVIAVNNGGPLESIVHKVTGFLCEPDPVHFSEAMEKFIHKPSLKATMGLAGKARVAEKFSADAFADQLYQYVTKLV

SEQ ID NO: 45496 - DNA, 1416 bp, Neurospora crassa
  CDS (1)..(1416)
atggcggcgggcgtcgacgagaaagataaaaagacaatagtcttcctccatcccgacctgggaattggcggcgcagaaagattggttgtcgacgccgccgtaggccttcagaaccgtggccataaggtggtcatcttcaccagccattgcgatcccagacactgttttgatgaagctcgcgatggaaccctcgacgttcgcgtccgcggcaactccatcatccccccttcccttctcggccgcttctccatcctctgcgccatcctccgccaactccacctaatcctccaaattaccctcctaacctccgaactacgcaccctctccccctccgccttcttcgtcgaccaactcagcgccggcctacccctcctcaaacttctcgttccgacctctcccatcttcttctactgccacttccccgacctgctcctcgtccaagggcgccaaacatggtacaagcgcctctaccgccttcccttcgacacctgggaagaatggtccatgggcttcgccgattccatcgccgtcaactcctccttcactaagggtatcgtctcgcacacatggcccagtctcgccagcaagcgcagcctggaagtcgtccacccatgcatcgacgtgcgctctacctccgactccagccaaaaccccaatgacgacgacaaggatgtactcccctggaccaaaacgggcatcatcctatccatcaaccgctttgagcgcaaaaaggacattgccctggccatcaaggccttcgcctctctttctcccgaacaaagggggaaagcaaagttgattatcgcgggggggtatgacaaccgcgtgcacgagaacgtttcgtaccatatggacttggtggacttggccgagggcgctccttaccatctcaagacggcgacagccaagacggtcgtgtcggcactgaatacctcccctgatgtggaagtcctttttctgttgtcggtacctaatacccttaaggaaatcctgttgcggtcagcgaaattgttggtctacacgccaagtaacgaacactttggtatcgtgccgcttgaagccatgttaaggggcgtgccggtgttggcggcgaataatggtggaccgacggagacggtggtggaaggggagacggggtggttgagagacccgaatgacgtaggggagtgggctaaggttatggataaggttttgaatgggatgggggaggaagagttgaagaggatgggaaagaagggggtggagagggtcaagggtaggtttgcggatacgcagatggcggagaggttggaggagattattgaaaggatgcccaaaggggacgcggcgcagagtgggatgattcttttggtggtgggagctgcggtggcggctgttgctggggttatcagtgctgtgtattggaaactttggtga

SEQ ID NO: 45497 - protein, 471 aa, Neurospora crassa
MAAGVDEKDKKTIVFLHPDLGIGGAERLVVDAAVGLQNRGHKVVIFTSHCDPRHCFDEARDGTLDVRVRGNSIIPPSLLGRFSILCAILRQLHLILQITLLTSELRTLSPSAFFVDQLSAGLPLLKLLVPTSPIFFYCHFPDLLLVQGRQTWYKRLYRLPFDTWEEWSMGFADSIAVNSSFTKGIVSHTWPSLASKRSLEVVHPCIDVRSTSDSSQNPNDDDKDVLPWTKTGIILSINRFERKKDIALAIKAFASLSPEQRGKAKLIIAGGYDNRVHENVSYHMDLVDLAEGAPYHLKTATAKTVVSALNTSPDVEVLFLLSVPNTLKEILLRSAKLLVYTPSNEHFGIVPLEAMLRGVPVLAANNGGPTETVVEGETGWLRDPNDVGEWAKVMDKVLNGMGEEELKRMGKKGVERVKGRFADTQMAERLEEIIERMPKGDAAQSGMILLVVGAAVAAVAGVISAVYWKLW

SEQ ID NO: 45498 - DNA, 1368 bp, Rhizomucor pusillus
  CDS (1)..(1368)
atgacgtctaaatcgttaaacgttgcattcatacaccctgatctcggcataggtggagccgaacgtttggtcgttgacgctgcagtgggcattcagaaaaaaggccatcaggtcatcttttatacaagtcatcacgacccaaaccattgctttgaggaaacacgagatggaacattaaaagtgcaagtacgcggcgattggttgccacggacgatttttggacgtttttatattctatgcgccatcttgcgacaattcgttcttgttgcttcgctgatactttgggaacgacactcgtacgatatcttctttgtcgaccaactgagcgcctgcgtgcctttgctgaaatggtttacaacagctaaaatccttttttactgccattttccggacaaactattaacgcaacgcaattctaccatcaaaaagctgtacagagcacctgtggataaaatggaagagttgactactggcatgtcagatctaattgcagtcaacagcgggttcactgctggcatgtttaagaaatcatttccatcagtccatcaaacacctcaaatactatatccacctatcaatttcgacgcatatgatcgacctgtagatcgaaacgatcctaccgttaaaatactagaaacagacaagcgggtgctgttatcaattaaccgtttcgagcgcaaaaagaatgtagaactggcgttgcgagctttcgctgcattgaaaatcaagaacatggtacctaaagatgtatttgcaaattacagacttgtgcttgcaggcggttacgacaaacgtgttagagaaaatgtcgaatatttagaagaattagatcaactggcgactgaagagtttggactacagacatttacgatccacccttcaagcgcggcggcggacgtccctgcagatgcccaagttgttttcctttgctccttcaacgatgctcaacgaacatttttactcgatcaagccaagcttttgctgtacaccccatcaaacgaacatttcggtattacgccggtcgagggcatgtatgcgtctgtacctgtcattgcagtcaacacaggtggtcctgtagaaactgtcaagaacaaagaaacgggactcttgctaccgtctgacccggacgtatgggcagagggcatccgcgactttatcatagagaaatacaatggcaaacagatgggtcagcacgggcgccagcacgtccaatccaagttttctttgcctgcctttgcagatcggctggaagcgatgatgatcgagcttgagacgagcacgcccgaccaatcaagcagcggtgctgtgtacttgcttggagccatcggtgtattatttgcatgcataatttattgcataaaacaataa

SEQ ID NO: 45499 - protein, 455 aa, Rhizomucor pusillus
MTSKSLNVAFIHPDLGIGGAERLVVDAAVGIQKKGHQVIFYTSHHDPNHCFEETRDGTLKVQVRGDWLPRTIFGRFYILCAILRQFVLVASLILWERHSYDIFFVDQLSACVPLLKWFTTAKILFYCHFPDKLLTQRNSTIKKLYRAPVDKMEELTTGMSDLIAVNSGFTAGMFKKSFPSVHQTPQILYPPINFDAYDRPVDRNDPTVKILETDKRVLLSINRFERKKNVELALRAFAALKIKNMVPKDVFANYRLVLAGGYDKRVRENVEYLEELDQLATEEFGLQTFTIHPSSAAADVPADAQVVFLCSFNDAQRTFLLDQAKLLLYTPSNEHFGITPVEGMYASVPVIAVNTGGPVETVKNKETGLLLPSDPDVWAEGIRDFIIEKYNGKQMGQHGRQHVQSKFSLPAFADRLEAMMIELETSTPDQSSSGAVYLLGAIGVLFACIIYCIKQ

SEQ ID NO: 45500 - DNA, 1536 bp, Schizosaccharomyces pombe
  CDS (1)..(1536)
atgtcacaagaaaattcggtgcatcgtagttctactaaaaagactccaattaaaattgctttcatccatccggatttaggaattggtggtgctgagaggcttgttgtagacgctgctgttggattacaatcactagggaaagaagttgtagtatttacgtctcattgtgataaaaaacattgtttcgaagaaatacgcgatggtactataaaggtaaaggtatatggtgattggcttccttcttctatatttggcaggctcagcattttctgcagctctctcagacaagtctacttgacgatgatccttctgacgaattacatgcactttgacgctattattgtagatcagctttcaacatgtgttccatttcttcttttggctagccagatgatccttttttattgtcattttcctgacaaatatcttgctaaacgcggtggaatccttaaaaagttgtatcgtattccttttgatacggttgaagcagagtctgttcgacttgcagatcgaattgttgttaatagcaagtttacagcttccgtcttcaaaaaagcatttccaaaaattcgtaagccccttcgaatcgttcatccttgcgttgatatagaggcagctagcaagcctttggagtttcaactccctgaaaaaattctgtatttacgttatagtcaacgaaagcttttaatttccgtcaaccgatttgaaaggaagaaggatattcgacttgcaatcgatgcttttagtgcattgcgcgatctttctgctaaccgatttcctgaatacttgcttttagtagccggtggctacgatattcgtgtttcagaaaatcgtcgatatttaaaagaattgcaggaattttgtgaacaaaaggatctttcttatacgactgtaaaagataattgggataacataactgttgctccttctaccaatgtattgtttttattatcagttccttcaaaggttcgggatgctttaatttcttcttctagaatattgctctacactcctgaaaatgaacattttggtattgtccctttggaagccatgcttcgtaaagttccagtattagcccaaacgaatggtgggcccttggaaacggttatagatggaaagaatggttggcttcgtcctagagacgcgaaaatttggggaaatgttatatatgaagcgactactagtactacatatgatactgctgccatgggtgaagcagggagtgaatgggtgaagaatgaattttctacagatgcaatggctcgaaaattcgaatcggaaataatgtctggaatacgatcaatcacgcccgaaaaaagattaatgagacgcgtgaatggactgttggctgtctttgttctatttatgctattttgggggacatgcattatcgctgcaactgttcccttcgccataatcaaattgtatttcgctcaaacgtattcaagcgtaaaactcggatttatgctaggaacttgtatagtttcagtgtcatttctaactttcactgtctatgcaaagctaacgaatctttaa

SEQ ID NO: 45501 - protein, 511 aa, Schizosaccharomyces pombe
MSQENSVHRSSTKKTPIKIAFIHPDLGIGGAERLVVDAAVGLQSLGKEVVVFTSHCDKKHCFEEIRDGTIKVKVYGDWLPSSIFGRLSIFCSSLRQVYLTMILLTNYMHFDAIIVDQLSTCVPFLLLASQMILFYCHFPDKYLAKRGGILKKLYRIPFDTVEAESVRLADRIVVNSKFTASVFKKAFPKIRKPLRIVHPCVDIEAASKPLEFQLPEKILYLRYSQRKLLISVNRFERKKDIRLAIDAFSALRDLSANRFPEYLLLVAGGYDIRVSENRRYLKELQEFCEQKDLSYTTVKDNWDNITVAPSTNVLFLLSVPSKVRDALISSSRILLYTPENEHFGIVPLEAMLRKVPVLAQTNGGPLETVIDGKNGWLRPRDAKIWGNVIYEATTSTTYDTAAMGEAGSEWVKNEFSTDAMARKFESEIMSGIRSITPEKRLMRRVNGLLAVFVLFMLFWGTCIIAATVPFAIIKLYFAQTYSSVKLGFMLGTCIVSVSFLTFTVYAKLTNL

SEQ ID NO: 45502 - DNA, 1383 bp, Yarrowia lipolytica
  CDS (1)..(1383)
atgagagtagcatttattcaccctgatctgggaattggcggagctgaacgatgggttgttgacgcagcagtgggtctgcagaacctgggccatgaagtcgacatctacacgtcgtactgcaacaagagccactgctttgatgaggtccgtgacggcctgctcaaggtgaccgtgctgggcgacaccatctgcccccacaccatcaagggcaagtttgcaatcttttgcgccacttttcggcaactgcacctggcctacgagctgaagaagggcccgggaagcaaggtggacgtgtttgtcgtggaccagctgagtgcatgtgttcccttgctcaagctgtggttccccaaggctcgagtccttttctacggccatttccctgatcagctgctggtgcagaacagaaaccaaatgtcgctggtcaagaaggcctaccgatacccctttgacaagttcgaggaaatcaccaccgcctcggccgaccgactggtcgtcaactctcatttcacaaaggacatgttcgaaaagactttccctgccaccaagaaccctctggtgatctacccttgcgtcgacacagacatcaaggagcagcagcagggtctcgacagagacatgatcacagctgcctcccagtacaccttcttgctgtccatcaaccggtttgagcgcaagaagaacatattgctggctattgaggcatttggggaagcccagaagaaatcgtccaacctcaaactggctgtggctggaggctatgatttcagagttaatgagaacgttgagtatctccaggaactcatcctggcctgtgagaagctcaagctgtcacacatctctatcaccgctgataagtacgccaagctgttggaaaaggacacccctgctgccgtctggacgtccatcttcaagaacgacgtcatcttcttcccttcggcgtctaactcgttcaaaaacactcttcttcacatctccaagcttctgctatacacacctcaaaatgagcactttggcatcgtgcctctggagggtatgctgtggaagacgcctgtgttggccaccaactcgggaggacctcttgagaccgtcaaggacaatgtgggatggacagttgagggcaagagcgaactatgggctcctgtgattgataaggtggttcatatgaatgcatctgactatgctgtgcttcagacagagtgtgtcaattgggtgaaccgattttcgcaggacaccatggccagtgagctggaggaggctatggaggaggttcgaaagaaggctcccaccgagaacgtgggatgggactacattcgtcttggcatgtggtacagcgtacttatgaccttgactttgtctattgtcctgctggccatttggccctga

SEQ ID NO: 45503 - protein, 460 aa, Yarrowia lipolytica
MRVAFIHPDLGIGGAERWVVDAAVGLQNLGHEVDIYTSYCNKSHCFDEVRDGLLKVTVLGDTICPHTIKGKFAIFCATFRQLHLAYELKKGPGSKVDVFVVDQLSACVPLLKLWFPKARVLFYGHFPDQLLVQNRNQMSLVKKAYRYPFDKFEEITTASADRLVVNSHFTKDMFEKTFPATKNPLVIYPCVDTDIKEQQQGLDRDMITAASQYTFLLSINRFERKKNILLAIEAFGEAQKKSSNLKLAVAGGYDFRVNENVEYLQELILACEKLKLSHISITADKYAKLLEKDTPAAVWTSIFKNDVIFFPSASNSFKNTLLHISKLLLYTPQNEHFGIVPLEGMLWKTPVLATNSGGPLETVKDNVGWTVEGKSELWAPVIDKVVHMNASDYAVLQTECVNWVNRFSQDTMASELEEAMEEVRKKAPTENVGWDYIRLGMWYSVLMTLTLSIVLLAIWP

SEQ ID NO: 45504 - DNA, 27 bp, Artificial sequence
  (1)..(27): primer
atgattgaaaaggataaaagaacgatt

SEQ ID NO: 45505 - DNA, 26 bp, Artificial sequence
  (1)..(26): primer
ttatatttcttcataagggtaggaga

SEQ ID NO: 45506 - protein, 581 aa, Artificial sequence
  Variant (2)..(7): xaa in position 2 to 7 is any amino acid
  Variant (8)..(8): xaa in position 8 is any or no amino acid
  Variant (10)..(15): xaa in position 10 to 15 is any amino acid
  Variant (17)..(22): xaa in position 17 to 22 is any amino acid
  Variant (23)..(28): xaa in position 23 to 28 is any or no amino acid
  Variant (30)..(46): xaa in position 30 to 46 is any amino acid
  Variant (47)..(49): xaa in position 47 to 49 is any or no amino acid
  Variant (51)..(51): xaa in position 51 is any amino acid
  Variant (53)..(55): xaa in position 53 to 55 is any amino acid
  Variant (57)..(63): xaa in position 57 to 63 is any amino acid
  Variant (64)..(72): xaa in position 64 to 72 is any or no amino acid
  Variant (74)..(76): xaa in position 74 to 76 is any or no amino acid
  Variant (78)..(79): xaa in position 78 to 79 is any amino acid
  Variant (80)..(81): xaa in position 80 to 81 is any or no amino acid
  Variant (83)..(85): xaa in position 83 to 85 is any amino acid
  Variant (87)..(93): xaa in position 87 to 93 is any amino acid
  Variant (94)..(186): xaa in position 94 to 186 is any or no amino acid
  Variant (188)..(189): xaa in position 188 to 189 is any amino acid
  Variant (190)..(210): xaa in position 190 to 210 is any or no amino acid
  Variant (212)..(213): xaa in position 212 to 213 is any or no amino acid
  Variant (215)..(220): xaa in position 215 to 220 is any amino acid
  Variant (222)..(227): xaa in position 222 to 227 is any amino acid
  Variant (228)..(228): xaa in position 228 is any or no amino acid
  Variant (231)..(231): xaa in position 231 is any or no amino acid
  Variant (233)..(234): xaa in position 233 to 234 is any or no amino acid
  Variant (237)..(237): xaa in position 237 is any or no amino acid
  Variant (240)..(241): xaa in position 240 to 241 is any amino acid
  Variant (242)..(246): xaa in position 242 to 246 is any or no amino acid
  Variant (248)..(252): xaa in position 248 to 252 is any amino acid
  Variant (253)..(265): xaa in position 253 to 265 is any or no amino acid
  Variant (270)..(285): xaa in position 270 to 285 is any amino acid
  Variant (286)..(315): xaa in position 286 to 315 is any or no amino acid
  Variant (319)..(320): xaa in position 319 to 320 is any amino acid
  Variant (322)..(324): xaa in position 322 to 324 is any amino acid
  Variant (326)..(328): xaa in position 326 to 328 is any amino acid
  Variant (330)..(330): xaa in position 330 is any amino acid
  Variant (332)..(332): xaa in position 332 is any amino acid
  Variant (334)..(336): xaa in position 334 to 336 is any amino acid
  Variant (338)..(339): xaa in position 338 to 339 is any amino acid
  Variant (340)..(364): xaa in position 340 to 364 is any or no amino acid
  Variant (368)..(368): xaa in position 368 is any or no amino acid
  Variant (371)..(374): xaa in position 371 to 374 is any amino acid
  Variant (375)..(376): xaa in position 375 to 376 is any or no amino acid
  Variant (378)..(378): xaa in position 378 is any amino acid
  Variant (379)..(384): xaa in position 379 to 384 is any or no amino acid
  Variant (386)..(393): xaa in position 386 to 393 is any or no amino acid
  Variant (395)..(424): xaa in position 395 to 424 is any or no amino acid
  Variant (426)..(426): xaa in position 426 is any amino acid
  Variant (428)..(439): xaa in position 428 to 439 is any amino acid
  Variant (441)..(445): xaa in position 441 to 445 is any amino acid
  Variant (446)..(450): xaa in position 446 to 450 is any or no amino acid
  Variant (454)..(456): xaa in position 454 to 456 is any amino acid
  Variant (462)..(463): xaa in position 462 to 463 is any amino acid
  Variant (466)..(466): xaa in position 466 is any amino acid
  Variant (468)..(472): xaa in position 468 to 472 is any amino acid
  Variant (476)..(478): xaa in position 476 to 478 is any amino acid
  Variant (482)..(484): xaa in position 482 to 484 is any amino acid
  Variant (486)..(487): xaa in position 486 to 487 is any amino acid
  Variant (488)..(518): xaa in position 488 to 518 is any or no amino acid
  Variant (521)..(521): xaa in position 521 is any amino acid
  Variant (523)..(528): xaa in position 523 to 528 is any amino acid
  Variant (529)..(530): xaa in position 529 to 530 is any or no amino acid
  Variant (533)..(534): xaa in position 533 to 534 is any amino acid
  Variant (536)..(554): xaa in position 536 to 554 is any amino acid
  Variant (555)..(579): xaa in position 555 to 579 is any or no amino acid
IXXXXXXXVXXXXXXLXXXXXXXXXXXXVXXXXXXXXXXXXXXXXXXXXLXVXXXGXXXXXXXXXXXXXXXXVXXXLXXXXLXXXMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXKXXYXXXXXXLXXXXXXXADXIXXNSXFTXXXXXXXFXXXXXXXXXXXXXXXXXXVLYPXXXXXXXXXXXXXXXXXXXXXXXXXXXXXXXXXXXXXXXXXXXXXXLSIXXFXXXKXXXLXIXAXXXLXXXXXXXXXXXXXXXXXXXXXXXXXXXLVLXGGXXXXXXEXXXXXXXLXXXXXXXXLXXXXXXXXXXXXXXXXXXXXXXXXXXXXXXVXFXXXXXXXXXXXXLXXXXXXXXXXLYTXXXEHFGIXXLEXMXXXXXVIAXXXGGPXXXIXXXXXXXXXXXXXXXXXXXXXXXXXXXXXXXXXTGXLXXXXXXXXFAXXMXXXXXXXXXXXXXXXXXXXXXXXXXXXXXXXXXXXXXXXXXXXXFS

SEQ ID NO: 45507 - protein, 26 aa, Artificial sequence
  Variant (2)..(3): xaa in position 2 to 3 is any amino acid
  Variant (4)..(4): xaa in position 4 is Leu, Pro or Val
  Variant (5)..(5): xaa in position 5 is Phe, Ile, Leu, Met or Val
  Variant (6)..(18): xaa in position 6 to 18 is any amino acid
  Variant (19)..(19): xaa in position 19 is Ile, Leu or Val
  Variant (20)..(20): xaa in position 20 is any amino acid
  Variant (21)..(21): xaa in position 21 is Ala, Ser, Thr or Val
  Variant (24)..(24): xaa in position 24 is any amino acid
  Variant (25)..(25): xaa in position 25 is Phe, Trp or Tyr
  Variant (26)..(26): xaa in position 26 is Ser or Thr
YXXXXXXXXXXXXXXXXXXXXNSXXX

SEQ ID NO: 45508 - protein, 15 aa, Artificial sequence
  Variant (2)..(3): xaa in position 2 to 3 is any amino acid
  Variant (4)..(5): xaa in position 4 to 5 is any or no amino acid
  Variant (7)..(7): xaa in position 7 is any amino acid
  Variant (9)..(10): xaa in position 9 to 10 is any or no amino acid
  Variant (12)..(12): xaa in position 12 is Asp or Asn
  Variant (13)..(14): xaa in position 13 to 14 is any amino acid
  Variant (15)..(15): xaa in position 15 is Leu or Val
SXXXXRXEXXKXXXX

SEQ ID NO: 45509 - protein, 31 aa, Artificial sequence
  Variant (2)..(2): xaa in position 2 is any amino acid
  Variant (3)..(4): xaa in position 3 to 4 is any or no amino acid
  Variant (6)..(7): xaa in position 6 to 7 is any or no amino acid
  Variant (12)..(12): xaa in position 12 is Cys, Gly, Thr or Val
  Variant (13)..(13): xaa in position 13 is Ile, Pro or Val
  Variant (14)..(14): xaa in position 14 is any amino acid
  Variant (16)..(21): xaa in position 16 to 21 is any amino acid
  Variant (22)..(22): xaa in position 22 is Ala, Ile, Leu, Pro or Val
  Variant (23)..(23): xaa in position 23 is any amino acid
  Variant (24)..(24): xaa in position 24 is Phe, Ile, Leu or Val
  Variant (25)..(25): xaa in position 25 is Ala, Ser or Val
  Variant (26)..(28): xaa in position 26 to 28 is any amino acid
TXXXEXXHFGIXXXEXXXXXXXXXXXXXGGP

SEQ ID NO: 45510 - DNA, 1143 bp, Saccharomyces cerevisiae
  CDS (1)..(1143)
atgtctagcaaatggtttaatgctatacacctactggtgtgcccgttgacggtactggtaggatatctcatgaacgcgtatggctacggtgcggcgctgcaagcaaccctgaataaggatggtctggtaaatgctatgttggtaaagaaagggtggttttggacttccttggtcggatggtggtgtattatacgctaccgtgcggtgccgggggcaaccggcagagaccgaagacacattgtccagtcattcaaaaggtatgccatactgacagtgtggtggtacgtattcacgcaaggtatatggtttggcgtaggccccatcatggacttggtattcgtatatacgggtggccattgtcactatgacgtcttcgatgatgcaggtcacgtgaacgaagacttccagggttctgtcacccggactaatcgcgcgttggcgctcattcacaatgtcctcactttgcacggacaccaccaagaacaccgtcagcaacaactctgggaccgctccatagggtcgatccagggcgccctgcaggcgacgcaaccgaaaaccccaaaaaacgtaacggccagcgctgccgctgccatcaatacttttattcatgaccagatgcacaggtggcaaggtccgttaaccacctcggcacagtgcagacgttttggaggccattgggctggaggacacgatccatccgggcacgtgttcttggccaccttgatgtgcatgtttcttctaggtgagctacgtgtgtttgggcgtcgtgcactggctcacttgtacgcgcagaaatggcagcttgtacgattggtgacccgccttttcgacactggaccgctatggacgtggcggcggtgtggcggcggctcaatgacctgtggcgcccgtttgtggcgtgcgatagtcgagccgcctgtcacgtgcgcggccgccctgctccgtttgacgcgatgcatagcatgcgaccacccagtaatcatactgctgacgctattggtcacgtggttatggcagctgctgttgactgcggtggcgtcccgtttccacaccgtacgtgagcacatgtctggattgctagctgcgtacatagtgacaggccttgtctacgctcgcgacgcagccgcgctacgtccagtatga

SEQ ID NO: 45511 - protein, 380 aa, Saccharomyces cerevisiae
MSSKWFNAIHLLVCPLTVLVGYLMNAYGYGAALQATLNKDGLVNAMLVKKGWFWTSLVGWWCIIRYRAVPGATGRDRRHIVQSFKRYAILTVWWYVFTQGIWFGVGPIMDLVFVYTGGHCHYDVFDDAGHVNEDFQGSVTRTNRALALIHNVLTLHGHHQEHRQQQLWDRSIGSIQGALQATQPKTPKNVTASAAAAINTFIHDQMHRWQGPLTTSAQCRRFGGHWAGGHDPSGHVFLATLMCMFLLGELRVFGRRALAHLYAQKWQLVRLVTRLFDTGPLWTWRRCGGGSMTCGARLWRAIVEPPVTCAAALLRLTRCIACDHPVIILLTLLVTWLWQLLLTAVASRFHTVREHMSGLLAAYIVTGLVYARDAAALRPV

SEQ ID NO: 45512 - DNA, 1089 bp, Eremothecium gossypii
  CDS (1)..(1089)
atgtctacagtaaggcgtgaacggtcgaggtttctgtgggtgcagctgtccctgtgtccagtgattatcgtggtggggacagtaatgcggatattcagcgaaccgaacagttggaacgccgacaaagacagcacggtaaacatatggttcatcaagcagggctgggcgtggacctctgcggtttgctggtggtgcgttgtgcggtacaaaggccttggggggcgaagcttgcggcaaaccgcgctccggtacgttgcgctgacggcgtggtggtatgcgtttacacaagccatatggtttggaatagcgccaataatggatcaggtattcacttcaacgggcggccactgcagctttgacgtgtttgacaccggcatgggcctaaactcgggcttccatgactctgaagggcgccgcacgcggtcactacaaaagctactgcagtggttcactgcgcatggggcccagggcgacgagctgcgcgagcgcacaatgtactggatccggtgtatgcttactgggggccagtgcgagaacaccggccttgatcctacagaactcaactcttatatccaggactcagtcacggcgtctgcaatccgcagcagccacgcgtgctccaggctgggtggccattggatgggtgggcacgacccgagtgggcatgtattcctgataacgttaatgtgtatgtttatgctgggcgagctgcaggtatttggccgccgcgcaatcgggaagctttctgctgattgtcaacagctgcagggcgctcctggtaaaattgtggcacgcattttgcaagcaagtccgattagagagctaattaactctgaagccccccaacatattttaagacgccttttcgttcaactgccactagagagtcttgcgattctggtgagcgcggttgtttttggctttcggttcattgtgctggaaaacccgattctattgcttgtcggtcttattctgacatggacctggtcactcctggtaactatactctctttccattcgtttgcggagcatttgaccggtttgctcttcgcataccttctagttttggcgttatactggtacatataa

SEQ ID NO: 45513 - protein, 362 aa, Eremothecium gossypii
MSTVRRERSRFLWVQLSLCPVIIVVGTVMRIFSEPNSWNADKDSTVNIWFIKQGWAWTSAVCWWCVVRYKGLGGRSLRQTALRYVALTAWWYAFTQAIWFGIAPIMDQVFTSTGGHCSFDVFDTGMGLNSGFHDSEGRRTRSLQKLLQWFTAHGAQGDELRERTMYWIRCMLTGGQCENTGLDPTELNSYIQDSVTASAIRSSHACSRLGGHWMGGHDPSGHVFLITLMCMFMLGELQVFGRRAIGKLSADCQQLQGAPGKIVARILQASPIRELINSEAPQHILRRLFVQLPLESLAILVSAVVFGFRFIVLENPILLLVGLILTWTWSLLVTILSFHSFAEHLTGLLFAYLLVLALYWYI

SEQ ID NO: 45514 - DNA, 1116 bp, Candida glabrata CBS138
  CDS (1)..(1116)
atgcaaacggaatctgtatacagatgggtgttgttaggaatatgtcccacaatccttatactgggtaatattatatacatggcttaccttgatggacccattgcagttaacaaagatggatttgtaaacagaatactggtaaaacgaggttggttttggactactgttattgggtggctgtgtatattgaggtatgatgcaaagaggcaatggaagtctagtttaaaaagatatttaatattgacgctttggtggtatgtgttcactcagggtattttatggtttgatattccgcccatcatggatttgatttttaaatacagtggcggatcttgtaattttgacatctatgatagtgatggtaatgtaaatttaaagtttcaggattcttggaggagaaggattaaatcatggaggatgatatatgacaaggtcaaagattatcaaaagaatggaaagaatccgctggcggttgattcaaaattgatggattttgtaacagggagtattgagaaggcaattgaacactattcgtaccacatcaagagcaatatcatgataaaggaaattagtcgacttttgtctgaccttaacatcacctacagtacagagcagataaatgactttattaagaactttatttcaaatactacagttggtaacagttctggagcaaattcaacattggacaattcttttgcctgtcgacttaatggtggatattggcagggtggacatgacccatctgggcatattttcttattgacgttaatgatcctatttttggtaggagaatcaaaacaatttatcgttggtgcagtcatgcgggttgtcgataccagaaaatatgttatggataaaataaaaaaaatttgtaatgaacctatggctaatgcttctgtttatgagagaagagtacgcaaattgatgcgatgtctcagttttagtgcgagctacatattatgggaaaatcctgttatattattgcttctgctactggctatttgggtatggaactttgtcattaccgttattgtctttcatactttgactgagcagctcagtggtttattctttgcatatgttgttggagcacttctatactacgattattaa

SEQ ID NO: 45515 - protein, 371 aa, Candida glabrata CBS138
MQTESVYRWVLLGICPTILILGNIIYMAYLDGPIAVNKDGFVNRILVKRGWFWTTVIGWLCILRYDAKRQWKSSLKRYLILTLWWYVFTQGILWFDIPPIMDLIFKYSGGSCNFDIYDSDGNVNLKFQDSWRRRIKSWRMIYDKVKDYQKNGKNPLAVDSKLMDFVTGSIEKAIEHYSYHIKSNIMIKEISRLLSDLNITYSTEQINDFIKNFISNTTVGNSSGANSTLDNSFACRLNGGYWQGGHDPSGHIFLLTLMILFLVGESKQFIVGAVMRVVDTRKYVMDKIKKICNEPMANASVYERRVRKLMRCLSFSASYILWENPVILLLLLLAIWVWNFVITVIVFHTLTEQLSGLFFAYVVGALLYYDY

SEQ ID NO: 45516 - DNA, 1014 bp, Kluyveromyces lactis NRRL Y-1140
  CDS (1)..(1014)
atgaaacgggtattttggttgttatgtccagttttatttttagctccctatgttttgccgatttcacttggaacagctgataaagatggaatactgaacgtatattttgttaagtttggttggttttggacatcggtaatatcatgcttatgtgtgataaggtactctaatatagtcaaccattggaaaaggtacctgctattaacgttatggtggatgatatttacccaagaagtatttggattgacgccgctaatggatctagtgttccttaacagcggaggaatttgttcatttgacatatttagtacagatggcaatgaacagacactgaatttgcaattccatgacaatgagtttagaaggcttaggggaatacgaaggatgctaaattggcttggtaatgtgcatggtagtgaaacacttttatctgcgttgaactctattatctcggaagatagttcagagtatactccagaacttgctgctgaattatctgaattatccaaattggtgaagtcaagtgctggttgctcatatgctggaggacactgggttggcggacatgatccaagtggacatatatttttgataacacttatgcttatgttgatgtttggggagttatcattatatcaaagtcgtgcatttagacacttgcaaaatacttataaaagatttttgaaccgggcaggtagtcagttattacaacttctagataatagtgcattggctaatttatggattcatgatgatcatgatgatgattcacaatggtggttcaagtttctctttcaacctccattgtcatgttaccagaccttaatgaccttaatatatctgattctgaggtttataatttgggaaaatccgatactattactattcactttaacagcgttgtggtcatactcatttgtagtgacagtaatgctctttcacacattttgggagcagttatccgggtttgttgctgcatatttggtttgcattcttgtgtatcaattcttttaa

SEQ ID NO: 45517 - protein, 337 aa, Kluyveromyces lactis NRRL Y-1140
MKRVFWLLCPVLFLAPYVLPISLGTADKDGILNVYFVKFGWFWTSVISCLCVIRYSNIVNHWKRYLLLTLWWMIFTQEVFGLTPLMDLVFLNSGGICSFDIFSTDGNEQTLNLQFHDNEFRRLRGIRRMLNWLGNVHGSETLLSALNSIISEDSSEYTPELAAELSELSKLVKSSAGCSYAGGHWVGGHDPSGHIFLITLMLMLMFGELSLYQSRAFRHLQNTYKRFLNRAGSQLLQLLDNSALANLWIHDDHDDDSQWWFKFLFQPPLSCYQTLMTLIYLILRFIIWENPILLLFTLTALWSYSFVVTVMLFHTFWEQLSGFVAAYLVCILVYQFF

SEQ ID NO: 45518 - DNA, 1002 bp, Candida albicans SC5314
  CDS (1)..(1002): transl_table=12
atgtcaacaaatactatatatgatgatcattatataaaaatgaataaacttttcaaatcgatatatactcaaactaaacttaatatttatgaatttttatttgctatttcatttctagtaaattttatacttggtcgattcattcatttttcagcacctgatgaagaagtttataattattataataataaacggaatatattgaatcaatggtttgttaaaaaaggttggggttggacaactttggtgattattttattttattccaatatcatttataaacaatacaacagcaaagcaacaactaatactactactactaataataataacaacaacaaacaaggggtgatagttcagacaattcgtaatgcggttattaattatattgttgttactatatggtggatatttttcactcaatggtgttttggattacctataatggataaaatttttgtattaactggagggaaatgtagtattgacaccaatagtatggcacatttcaatcctaatcatcatcatgttcatgccaattttgtacaaaaattggaaaatatttgggaatctaccgggataacttcctataattgtcgtagaattaaaggaagtcaatggataggtggtcatgatcctctgggtcatgtatttttaatgattcattcatcattatatttatttaatgaaatgattaattattggcctggttggacttatattaaacataatctttctcaaatattgacaagtggtaatgataatggtaatgataatggtaatggtaatggcaatggcactagatctttaagtattggtgataaattgttattattatggaatactccacaattgataattggagggttgattggattatggtggtttatgttattaatgacaaatatttatttccatctgagtttagaaaaattggtaggtttgggatttggttatattggtgttgcaggattatattggataccgagatggttattataa

SEQ ID NO: 45519 - protein, 333 aa, Candida albicans SC5314
MSTNTIYDDHYIKMNKLFKSIYTQTKLNIYEFLFAISFLVNFILGRFIHFSAPDEEVYNYYNNKRNILNQWFVKKGWGWTTLVIILFYSNIIYKQYNSKATTNTTTTNNNNNNKQGVIVQTIRNAVINYIVVTIWWIFFTQWCFGLPIMDKIFVLTGGKCSIDTNSMAHFNPNHHHVHANFVQKLENIWESTGITSYNCRRIKGSQWIGGHDPSGHVFLMIHSSLYLFNEMINYWPGWTYIKHNLSQILTSGNDNGNDNGNGNGNGTRSLSIGDKLLLLWNTPQLIIGGLIGLWWFMLLMTNIYFHSSLEKLVGLGFGYIGVAGLYWIPRWLL

SEQ ID NO: 45520 - DNA, 26 bp, Artificial sequence
  (1)..(26): primer
atgtctagcaaatggtttaatgctat

SEQ ID NO: 45521 - DNA, 22 bp, Artificial sequence
  (1)..(22): primer
tcatactggacgtagcgcggct

SEQ ID NO: 45522 - protein, 418 aa, Artificial sequence
  Variant (2)..(3): xaa in position 2 to 3 is any amino acid
  Variant (5)..(7): xaa in position 5 to 7 is any amino acid
  Variant (12)..(13): xaa in position 12 to 13 is any amino acid
  Variant (17)..(17): xaa in position 17 is any amino acid
  Variant (20)..(27): xaa in position 20 to 27 is any amino acid
  Variant (28)..(34): xaa in position 28 to 34 is any or no amino acid
  Variant (37)..(38): xaa in position 37 to 38 is any amino acid
  Variant (41)..(43): xaa in position 41 to 43 is any amino acid
  Variant (46)..(46): xaa in position 46 is any amino acid
  Variant (49)..(49): xaa in position 49 is any amino acid
  Variant (55)..(57): xaa in position 55 to 57 is any amino acid
  Variant (63)..(70): xaa in position 63 to 70 is any amino acid
  Variant (71)..(98): xaa in position 71 to 98 is any or no amino acid
  Variant (108)..(109): xaa in position 108 to 109 is any amino acid
  Variant (113)..(113): xaa in position 113 is any amino acid
  Variant (115)..(116): xaa in position 115 to 116 is any or no amino acid
  Variant (118)..(118): xaa in position 118 is any or no amino acid
  Variant (120)..(120): xaa in position 120 is any amino acid
  Variant (125)..(125): xaa in position 125 is any amino acid
  Variant (128)..(129): xaa in position 128 to 129 is any amino acid
  Variant (133)..(133): xaa in position 133 is any amino acid
  Variant (135)..(135): xaa in position 135 is any amino acid
  Variant (140)..(144): xaa in position 140 to 144 is any amino acid
  Variant (145)..(147): xaa in position 145 to 147 is any or no amino acid
  Variant (150)..(151): xaa in position 150 to 151 is any amino acid
  Variant (153)..(157): xaa in position 153 to 157 is any amino acid
  Variant (159)..(160): xaa in position 159 to 160 is any amino acid
  Variant (162)..(162): xaa in position 162 is any amino acid
  Variant (164)..(165): xaa in position 164 to 165 is any amino acid
  Variant (167)..(170): xaa in position 167 to 170 is any amino acid
  Variant (171)..(188): xaa in position 171 to 188 is any or no amino acid
  Variant (190)..(194): xaa in position 190 to 194 is any or no amino acid
  Variant (196)..(198): xaa in position 196 to 198 is any or no amino acid
  Variant (200)..(201): xaa in position 200 to 201 is any amino acid
  Variant (202)..(223): xaa in position 202 to 223 is any or no amino acid
  Variant (225)..(230): xaa in position 225 to 230 is any amino acid
  Variant (232)..(232): xaa in position 232 is any amino acid
  Variant (233)..(256): xaa in position 233 to 256 is any or no amino acid
  Variant (258)..(259): xaa in position 258 to 259 is any or no amino acid
  Variant (261)..(263): xaa in position 261 to 263 is any or no amino acid
  Variant (268)..(268): xaa in position 268 is any amino acid
  Variant (284)..(284): xaa in position 284 is any amino acid
  Variant (288)..(288): xaa in position 288 is any amino acid
  Variant (292)..(293): xaa in position 292 to 293 is any amino acid
  Variant (295)..(297): xaa in position 295 to 297 is any amino acid
  Variant (299)..(301): xaa in position 299 to 301 is any amino acid
  Variant (303)..(308): xaa in position 303 to 308 is any amino acid
  Variant (310)..(330): xaa in position 310 to 330 is any amino acid
  Variant (331)..(360): xaa in position 331 to 360 is any or no amino acid
  Variant (362)..(367): xaa in position 362 to 367 is any amino acid
  Variant (370)..(370): xaa in position 370 is any amino acid
  Variant (372)..(372): xaa in position 372 is any amino acid
  Variant (378)..(379): xaa in position 378 to 379 is any amino acid
  Variant (382)..(383): xaa in position 382 to 383 is any amino acid
  Variant (385)..(385): xaa in position 385 is any amino acid
  Variant (387)..(388): xaa in position 387 to 388 is any amino acid
  Variant (392)..(392): xaa in position 392 is any amino acid
  Variant (394)..(394): xaa in position 394 is any amino acid
  Variant (395)..(396): xaa in position 395 to 396 is any or no amino acid
  Variant (400)..(401): xaa in position 400 to 401 is any amino acid
  Variant (403)..(403): xaa in position 403 is any amino acid
  Variant (408)..(409): xaa in position 408 to 409 is any amino acid
  Variant (414)..(416): xaa in position 414 to 416 is any amino acid
FXXVXXXLCPVXXILGXVIXXXXXXXXXXXXXXXKDXXVNXXXVKXGWXWTSLVXXXCIIRYXXXXXXXXXXXXXXXXXXXXXXXXXXXXXXXXXXXXRYLILTLWWXXFTQXIXXFXIXPIMDXVFXXTGGXCXFDIFXXXXXXXXLNXXFXXXXXRXXRXLXXIXXXXXXXXXXXXXXXXXXXXXXDXXXXXIXXXIXXXXXXXXXXXXXXXXXXXXXXXXTXXXXXXIXXXXXXXXXXXXXXXXXXXXXXXXXSXXCXXXGGHWXGGHDPSGHVFLITLMXMFLXGELXXFXXXAXXXLXXXXXXLXXXXXXXXXXXXXXXXXXXXXXXXXXXXXXXXXXXXXXXXXXXXXXXXXXXLXXXXXXILXEXPILLLXXLIXXWXWXXLVTXIXXXFHTXXEXLSGLXXAYIVXXXLY

SEQ ID NO: 45523 - protein, 17 aa, Artificial sequence
  Variant (2)..(2): xaa in position 2 is Asp or Arg
  Variant (3)..(3): xaa in position 3 is Gly or Asn
  Variant (4)..(4): xaa in position 4 is Phe, Ile or Leu
  Variant (5)..(5): xaa in position 5 is Leu or Val
  Variant (7)..(8): xaa in position 7 to 8 is any amino acid
  Variant (9)..(9): xaa in position 9 is Phe or Leu
  Variant (12)..(12): xaa in position 12 is any amino acid
  Variant (15)..(15): xaa in position 15 is any amino acid
KXXXXNXXXVKXGWXWT

SEQ ID NO: 45524 - protein, 45 aa, Artificial sequence
  Variant (2)..(2): xaa in position 2 is Ala, Leu or Val
  Variant (3)..(3): xaa in position 3 is Ala, Ile or Leu
  Variant (6)..(6): xaa in position 6 is Ala, Leu or Val
  Variant (9)..(9): xaa in position 9 is any amino acid
  Variant (10)..(10): xaa in position 10 is Ala, Ile or Val
  Variant (14)..(15): xaa in position 14 to 15 is any amino acid
  Variant (16)..(17): xaa in position 16 to 17 is any or no amino acid
  Variant (19)..(19): xaa in position 19 is Asp or Gly
  Variant (20)..(20): xaa in position 20 is Ile, Leu or Val
  Variant (21)..(21): xaa in position 21 is Ala, Gly, Pro or Thr
  Variant (23)..(23): xaa in position 23 is Ile or Leu
  Variant (26)..(26): xaa in position 26 is any amino acid
  Variant (27)..(27): xaa in position 27 is Ile or Val
  Variant (29)..(30): xaa in position 29 to 30 is any amino acid
  Variant (31)..(31): xaa in position 31 is Ser or Thr
  Variant (34)..(34): xaa in position 34 is any amino acid
  Variant (36)..(36): xaa in position 36 is any amino acid
  Variant (37)..(37): xaa in position 37 is Phe or Tyr
  Variant (39)..(40): xaa in position 39 to 40 is any amino acid
  Variant (41)..(42): xaa in position 41 to 42 is any or no amino acid
  Variant (44)..(44): xaa in position 44 is Ala, Asp, Gly, Ser or Thr
  Variant (45)..(45): xaa in position 45 is Gly or Asn
YXXLTXWWXXFTQXXXXFXXXPXMDXXFXXXGGXCXXDXXXXDXX

SEQ ID NO: 45525 - protein, 28 aa, Artificial sequence
  Variant (2)..(2): xaa in position 2 is His or Tyr
  Variant (4)..(4): xaa in position 4 is any amino acid
  Variant (13)..(13): xaa in position 13 is Ile or Val
  Variant (16)..(16): xaa in position 16 is Ala, Ile or Leu
  Variant (20)..(21): xaa in position 20 to 21 is any amino acid
  Variant (22)..(23): xaa in position 22 to 23 is any or no amino acid
  Variant (25)..(26): xaa in position 25 to 26 is any or no amino acid
GXWXGGHDPSGHXFLXTLMXXXXFXXGE

SEQ ID NO: 45526 - protein, 46 aa, Artificial sequence
  Variant (2)..(2): xaa in position 2 is any amino acid
  Variant (3)..(5): xaa in position 3 to 5 is Ile or Leu
  Variant (6)..(7): xaa in position 6 to 7 is any amino acid
  Variant (9)..(10): xaa in position 9 to 10 is any or no amino acid
  Variant (12)..(13): xaa in position 12 to 13 is any or no amino acid
  Variant (15)..(15): xaa in position 15 is any amino acid
  Variant (16)..(16): xaa in position 16 is Phe, Trp or Tyr
  Variant (17)..(17): xaa in position 17 is any amino acid
  Variant (18)..(18): xaa in position 18 is Phe or Leu
  Variant (19)..(19): xaa in position 19 is Leu or Val
  Variant (20)..(20): xaa in position 20 is Ile, Met or Val
  Variant (22)..(22): xaa in position 22 is any amino acid
  Variant (23)..(23): xaa in position 23 is Ile, Leu or Met
  Variant (24)..(24): xaa in position 24 is any amino acid
  Variant (27)..(27): xaa in position 27 is Ser or Thr
  Variant (28)..(29): xaa in position 28 to 29 is any amino acid
  Variant (31)..(31): xaa in position 31 is any amino acid
  Variant (33)..(33): xaa in position 33 is Ser, Thr or Val
  Variant (35)..(35): xaa in position 35 is Phe or Leu
  Variant (36)..(37): xaa in position 36 to 37 is any amino acid
  Variant (38)..(38): xaa in position 38 is Ala or Gly
  Variant (40)..(40): xaa in position 40 is Ile, Leu or Val
  Variant (41)..(41): xaa in position 41 is Gly, Leu or Val
  Variant (42)..(42): xaa in position 42 is Cys, Gly or Val
  Variant (43)..(43): xaa in position 43 is Ala, Ile or Leu
  Variant (44)..(44): xaa in position 44 is Ala, Gly or Leu
  Variant (45)..(45): xaa in position 45 is Leu or Val
PXXXXXXLXXLXXWXXXXXXTXXXFHXXXEXLXGXXXXYXXXXXXY

SEQ ID NO: 45527 - DNA, 1877 bp, Saccharomyces cerevisiae
  CDS (505)..(1791)
tctctaaggagaagaaatccataactatattacctttatcttatcttgaccccctatatgatattattttgcccatatttgtttttattattgattatccttttattgtctttttgttagggatatttcataataaatatttgaatatataatatgtacaataattaaataattttctgattattccttcaatattttgtgttgaaaatttgctttaaatgtattctttaattaaattctttattcgctatacctgccacataaccactttccccttcattttcttcttttctttgtgtgtgaagagtaactagctgttttactggtcgctttggaaattttctatacatttttttaataaaggaaagttaaagacaaagtactacgcctctttatttttcatctgcagaaataatctgtcactgcttattcatatcatctccaaatctaatgcttggaagtcgctatcaaaattaaagaagtttatcatcagaaattgttaaaatggcaaaaggaggctcgctatacatcgttggcatattcttaccaatatggacctttatgatctatatttttggcaaagagttattcctcatacgaaaataccaaaagattgacagtacgtatactgctctttcccaaagagtaaaagaacaatatgatacaagtcgaagaagaaactattttcctaaagtaaaactttcccgcaatagctacgacgactacactttaaattataccagacagaatgattctgattcttttcacctacgagaaaatgcaacaattttaatgctggtgagaaattcagaattagaaggggcattggattcaatgagatcattagaggacagatttaacaacaagtatcattatgattggacttttctaaatgacgttcctttcgatcaagacttcattgaagctacaacatcaatggcgagtgggaagacccaatatgctttaataccaccagaagattggaatcggccgcaatggattaacgatacactttttgaagaaagacttcgagtcatggaggatgagggtgttttatatgggggatccaagtcatatagaaatatgtgtcggtttaattctggtttttttttccggcagtcaatactggacaactatgattactactttagggtggaacccaatgtcaagtattattgcgatttcccatatgacccgttcagagttatgagattgaagggcaaaaaatacggatttgtcatatcattatatgaatatgaagaaaccataccaaccttatgggacgcggtagaggagtatttagtggccagcgaagagaccattttacgtaaagaggacagtgcctatgcatttttgaccgattcagggctagttggtaagcattatcccgttgttgaagcaaactctgactacaatttgtgccatttttggtcgaattttgagattggcgacttgaatttcttcagaagtgacgaatataagcatttttttgaaactttagatgccaagggcggattttactacgaaaggtggggtgacgcacctgtacattcaattggtgtctccctactgctgagacctgacgaaatcattcattttgacgaacttggctattttcactcaccgtttggcacctgtccagcatcttacgctgttaggctcgatcagaggtgtagatgcaaaagcgatgatgaaagtgtcatagatataaccccacatagttgtttgatgagatggtggaaaaacggtagcggcaaatatttcttaaaagaagagcaagacgagatttaaaatcctgtcctttttcctgttaaataggcctaacttccacagggtgaaaattcattactagttacacacacgtatacatacagtta

SEQ ID NO: 45528 - protein, 428 aa, Saccharomyces cerevisiae
MAKGGSLYIVGIFLPIWTFMIYIFGKELFLIRKYQKIDSTYTALSQRVKEQYDTSRRRNYFPKVKLSRNSYDDYTLNYTRQNDSDSFHLRENATILMLVRNSELEGALDSMRSLEDRFNNKYHYDWTFLNDVPFDQDFIEATTSMASGKTQYALIPPEDWNRPQWINDTLFEERLRVMEDEGVLYGGSKSYRNMCRFNSGFFFRQSILDNYDYYFRVEPNVKYYCDFPYDPFRVMRLKGKKYGFVISLYEYEETIPTLWDAVEEYLVASEETILRKEDSAYAFLTDSGLVGKHYPVVEANSDYNLCHFWSNFEIGDLNFFRSDEYKHFFETLDAKGGFYYERWGDAPVHSIGVSLLLRPDEIIHFDELGYFHSPFGTCPASYAVRLDQRCRCKSDDESVIDITPHSCLMRWWKNGSGKYFLKEEQDEI

SEQ ID NO: 45529 - DNA, 969 bp, Encephalitozoon cuniculi
  CDS (1)..(969): transl_table=11
atgcttttgccgctgctgattgttggaatggcaatttgcagagagaatgctgtgatcctgattctttgcaggaacagcgacaagaacgggataacagagacgataaagaatttcgaggaggtgttcaataagaactttggatatccatacgtgttcctgaacgacgaggagtttactgaggacttcaagaagtccataagagacgttacgtctagcaccgttgagtttgggaagctcgagcccgaggagtgggaggttccaaagtggatagacatgaagaaggcaaaggaggagatgatgaagatggaagacaaaaagattatttatggagggtcattatcgtacaggaagatgtgcagattcttctccgggtttttttatagaaacaagctggtcgagaaatacgactactattggaggatagagcccgacgtgaagtttctgtgtcaaatagagtacgacccatttacatacctaagggagaacaacaagcaatatggatttgtgatatcgctggttgaattcatggatacgattcccggtctctttagagaggtgttaaagttcataacacagaacctgaactcgattagaaaggtggatggaaacaggttcatcctgaacaaggatggatcctacaacggatgccacttctggtcaaacttcgagatagcaagctttggatttttcagaagcgagacgtaccaaaagtactttgactggctggacaaagctggagggttcttctacgagagatggggagatgccccagttcatagcattgctgcatctctcttcctggataaggatcagactcacttcttcagtgatatagggtatgagcaccctccattccaacactgccctcgagaggcgtcgatgaggtccaaatgcaagtgcagtatctccaactcattggattactcttcaaactcgtgtctgggattgtacataaagtctcttctgtga

SEQ ID NO: 45530 - protein, 322 aa, Encephalitozoon cuniculi
MLLPLLIVGMAICRENAVILILCRNSDKNGITETIKNFEEVFNKNFGYPYVFLNDEEFTEDFKKSIRDVTSSTVEFGKLEPEEWEVPKWIDMKKAKEEMMKMEDKKIIYGGSLSYRKMCRFFSGFFYRNKLVEKYDYYWRIEPDVKFLCQIEYDPFTYLRENNKQYGFVISLVEFMDTIPGLFREVLKFITQNLNSIRKVDGNRFILNKDGSYNGCHFWSNFEIASFGFFRSETYQKYFDWLDKAGGFFYERWGDAPVHSIAASLFLDKDQTHFFSDIGYEHPPFQHCPREASMRSKCKCSISNSLDYSSNSCLGLYIKSLL

SEQ ID NO: 45531 - DNA, 1137 bp, Schizosaccharomyces pombe
  CDS (1)..(1137)
atgggcatacccaaatcatcaatttatttttgtatactattattctgcattatttcattctatttacagtcttctaaagatgggcctaaggaactaaaagtcaagtatgtatttctaaaaaaagccacagcaaagcaaagaggagagtcatccttgacagattcagattattttcctaagcagcccaatatgaacgctactttgtttatgctttgccgtaatagagacattaaggacgctcttgtttccatacaaagcgtcgaggatcggttcaatcatcgctatcattacccatggacatttatgaatgatgccccttttactaaagaatttataacagctacttcaaaaatggtgagtggggatgctacctatgtccaactcaacaacgaagagtggggaattcctataaacatcgatttaaatcgtatgttgaaatcaattcgggatatgaccgatgacaaagtaatatatggattttcactgagttatcggatcatgtgtcgcttcaattcaggatttttttatcgaaacaaagccctttcacattatgattattactggcgcgttgaacccggcgttgaatattcttgcgatataccttatgatccttttcgaaagttgagtgacgagaataaggcgtatgggtttgtcatatcaatgacggattattatgaaaccctcccttctttatggaacgttactcgagattttattcaccaaaacccacaatatcttgcacaaaataactccttggattttatcgttaatgaccaccaggggttaagtggtgactacaatctctgccatttttggagtaattttgaaattgccaatttaaatttctttcgaagtcctgcatacacagactactttgcgcacttagataaaaattatggatttttttacgagcgctggggggatgctcccgtacattcactggcagcatcgctatttctgaacaaatcgcaaatacattactttgaggactttggttattaccatttaccctggtaccattgccctacggatgtacagtcgcatgcgacagctagatgtctatgcgatccgactggtacgattgattatttacccttctcttgtgctattaaatggttagaaaacatcaatagttaa

SEQ ID NO: 45532 - protein, 378 aa, Schizosaccharomyces pombe
MGIPKSSIYFCILLFCIISFYLQSSKDGPKELKVKYVFLKKATAKQRGESSLTDSDYFPKQPNMNATLFMLCRNRDIKDALVSIQSVEDRFNHRYHYPWTFMNDAPFTKEFITATSKMVSGDATYVQLNNEEWGIPINIDLNRMLKSIRDMTDDKVIYGFSLSYRIMCRFNSGFFYRNKALSHYDYYWRVEPGVEYSCDIPYDPFRKLSDENKAYGFVISMTDYYETLPSLWNVTRDFIHQNPQYLAQNNSLDFIVNDHQGLSGDYNLCHFWSNFEIANLNFFRSPAYTDYFAHLDKNYGFFYERWGDAPVHSLAASLFLNKSQIHYFEDFGYYHLPWYHCPTDVQSHATARCLCDPTGTIDYLPFSCAIKWLENINS

SEQ ID NO: 45533 - DNA, 897 bp, Schizosaccharomyces pombe
  CDS (1)..(897)
atgtactttctaattctgttttctagtaatgctgaacttggggaagtgttgcgcacgatgcgtagcgtagaggatagatttaataagaggtttcattatccttggacgttttacggcatggatgagtttacggaatactttatgagtacgacaagcacgattgcgtctggtcattgtgaatacggtacgaagggaataacttataccaatcatttacaatttattctaactatctcttacttagtgcattgggatctttctcaagtaaaacccctagttgaaaacaatcgactttatcaacaacgagcagatgcacttgctcaagagaatctatcttacgtatactctcctttgtttcacagttttcaagattgggtagttcgatctttattatatcatcctcaattggaatacgattatgtttggagaatagaacccgggctcaaattggtttgtgaagaaaaaaaagatatattttctactttcaaagacagcgacattgtatttacaaaccacgtctgtgaacgtaaacactctggtatatatgctatggaagaggcaattgaagaatacaaaattttaaacactcaaggagatttcagcaatatctgggtttatagtaacaactacacctattgtaaatactggccttttaatgaaattttatctctaaagcaaattcggcataatcagacctacaccaacctaattaattacttgcttggttcaggaggaacatattatcatcgctggaccgagtctgatatcctttcagcagcatttggtgttttaagagcgcgtgctaatcatatggaatcagtgggatttttcttaaacgatgatgttcattattgcccagaaactattccatacacaggaagatgtgcatgtttgtga

SEQ ID NO: 45534 - protein, 298 aa, Schizosaccharomyces pombe
MYFLILFSSNAELGEVLRTMRSVEDRFNKRFHYPWTFYGMDEFTEYFMSTTSTIASGHCEYGTKGITYTNHLQFILTISYLVHWDLSQVKPLVENNRLYQQRADALAQENLSYVYSPLFHSFQDWVVRSLLYHPQLEYDYVWRIEPGLKLVCEEKKDIFSTFKDSDIVFTNHVCERKHSGIYAMEEAIEEYKILNTQGDFSNIWVYSNNYTYCKYWPFNEILSLKQIRHNQTYTNLINYLLGSGGTYYHRWTESDILSAAFGVLRARANHMESVGFFLNDDVHYCPETIPYTGRCACL

SEQ ID NO: 45535 - DNA, 1176 bp, Schizosaccharomyces pombe
  CDS (1)..(1176)
atgggatacaaacaactaatttataaacttaatcatcctcctcttagacggattgatgaaaggaatgatcctttgttttcaaatggctgtaagaacgttcatttggaagcacagttgcatccgagaatgaatgcaacttttgttatgcttgctcgtaattcagacttgccaggtgttgtttcttctatcaattcattggagaaacactttaatcgacattttaattacccttatacatttttaaacgatgagccctttgatgaaaaatttaaggaaaccattcttaaacttacatctgcgaacgttgaatttggaacgcttgaaaaagatacttttggatttcctggtaatgttgatgtagatgcagcgcgtgaagctattgcaagtcaaggagatcgaggtatcatgtatggtgatacagaaagttaccatcatatgtgtcgctttttttcggggttcttttataagcatccgttgctactcaaatatcaatggtactggcgagttgaacccgacgtagctttcacatgcgatatatcttatgaccctttctactacatggaagaaaatgggaaaatatatggttatgttgtagcattaaaggaattagaagacactgttccaaacttgtttcgatatacctcggcttatcgtcgaaataataatttaacctctaacatgtggaaattctttttggatgctcctaaaaaggaaaactacgatatttcaagaaaagaccctacagtaggtctctccttttcctctcatttaaatgctatgattgactcatcatattcagcagaaacatcttcaatggaaggggagtcctataatatgtgtcatttttggagcaattttgagattgcaaatttcaagttcttcagaaatgaacagtatgagaacttcttccgtacaatggatgcgacaggaggcttttggactgaaagatggggagacgctccatttcactctctagctgctggactgttcttgtcgaaagaacaggttcattattttcgtgatttaggatatcggcattctgacattcatcattgtggacaaagtctgggttgcaattgcgaatgcattcctgagttatcagaaatagaatctacttctggaggttgtgtcacccaatgggtgaatttaataggtgatggattcttagatgaatga

SEQ ID NO: 45536 - protein, 391 aa, Schizosaccharomyces pombe
MGYKQLIYKLNHPPLRRIDERNDPLFSNGCKNVHLEAQLHPRMNATFVMLARNSDLPGVVSSINSLEKHFNRHFNYPYTFLNDEPFDEKFKETILKLTSANVEFGTLEKDTFGFPGNVDVDAAREAIASQGDRGIMYGDTESYHHMCRFFSGFFYKHPLLLKYQWYWRVEPDVAFTCDISYDPFYYMEENGKIYGYVVALKELEDTVPNLFRYTSAYRRNNNLTSNMWKFFLDAPKKENYDISRKDPTVGLSFSSHLNAMIDSSYSAETSSMEGESYNMCHFWSNFEIANFKFFRNEQYENFFRTMDATGGFWTERWGDAPFHSLAAGLFLSKEQVHYFRDLGYRHSDIHHCGQSLGCNCECIPELSEIESTSGGCVTQWVNLIGDGFLDE

SEQ ID NO: 45537 - DNA, 1317 bp, Schizosaccharomyces pombe
  CDS (1)..(1317)
atgactgttatcttacagtacgctgatcatttcgttgaatatcaaaacgatatgaaaagatatgatacattacatgtttggaaactaataaaattattaatatgcaaattccttttatttcatgattttggcactgcgttgttcacaagccttgtgaaagcctcaatgcttggattccataattggagacgtacatattggttgtacttgaagaaattgagacctattaatgatacatacgacgcgccgtttgcgataggatgtaagaatgtggcctatgaagcaagtcaatatcctagaatgaatgctacttttatggttttagcaagaaactctgaccttgacggtgttctatctagtatgaactcaatcgaacgtcgatttaatcgacacttcaagtatccttatgtcttcttaaacgatgaaccttttactacggaatttaaaaaagcggttaaggatgctacggattcttctattcaattcggtgttctcgatgatgaactatggaacttccctaaagatgtcgacaaggatatgatagatgagagtattgctgaacaagttggagtcgtatatgcgaactttcctagttatcataaaatgtgcagattcttttcgcgaaacttttacaaacatcccttaatgcaacagtacgagtggtattggagacttgaaccggaagtcactttttcttgtgacatctcttatgacccattttactacatggacaagcacaataaagtctacggatacgttattgctatcaaagaacttgcaaaaactgttccaaatctgtttcggtacactgttgctcatcaaaaaatatccaatttaccaactaccgatctttggagcttcttccttgataaacgctatgaaacgagaattaaaaagctgaaagaagaacaaaaagatcaaggatattacgttttaccggagccccctttaaaccgaattgatggccagatttataatctatgccatttttggagtaacttcgaaattgcacgcttagacttttacaatagtaaagagtataatgaatatgtcgacgcattggaaaatgctggaggattttggactgaaaggtggggcgatgctccggtgcattcgctagcagtgggtcttctccttaatcgatctcaagtccattactttagagaccttgggtatcaacattccacaattcaacactgtggtcaagaatatggttgtaattgtgattgccccttcaacatacccgattatgaaactaagccaggttcttgtattaacgagtgggcatcggtgatggggggatttttagatgaataa

SEQ ID NO: 45538 - protein, 438 aa, Schizosaccharomyces pombe
MTVILQYADHFVEYQNDMKRYDTLHVWKLIKLLICKFLLFHDFGTALFTSLVKASMLGFHNWRRTYWLYLKKLRPINDTYDAPFAIGCKNVAYEASQYPRMNATFMVLARNSDLDGVLSSMNSIERRFNRHFKYPYVFLNDEPFTTEFKKAVKDATDSSIQFGVLDDELWNFPKDVDKDMIDESIAEQVGVVYANFPSYHKMCRFFSRNFYKHPLMQQYEWYWRLEPEVTFSCDISYDPFYYMDKHNKVYGYVIAIKELAKTVPNLFRYTVAHQKISNLPTTDLWSFFLDKRYETRIKKLKEEQKDQGYYVLPEPPLNRIDGQIYNLCHFWSNFEIARLDFYNSKEYNEYVDALENAGGFWTERWGDAPVHSLAVGLLLNRSQVHYFRDLGYQHSTIQHCGQEYGCNCDCPFNIPDYETKPGSCINEWASVMGGFLDE

SEQ ID NO: 45539 - DNA, 1119 bp, Schizosaccharomyces pombe
  CDS (1)..(1119)
atgcggatatcaagattgctgattagagtacttttgggattcgtgatacttttcattacatacatcctctttccttcaataccaaaagcattggtgaatactttaaatgtgtataaactagaggagcgtttaaactattacaatgatcgtttattagatggaaatttgaaatcgaaggaattggagaatgctacgttcgtaactttagcacggaatgcggacctttacgatttaattgaaacaataaatatatatgaaaatcggtttaattcgaagcacaactatccttgggtttttctaaatgatgaaccatttactcgaacttttgaagtggtcatgtctcgtctaactagtggtccaacatattttggtgtcgtgaacagtagtgaatgggatattccaaaatggatagatatggatattgcacattccaattggaatcgcctatcaagggaaggcgtactttatggaggcatgaaatcatatcgtcaaatgtgtcgatatttctctggatttttttggagacatcctttacttgatccttataaatattattggagagttgaaccttcaactaagcttttatgtgaagtgaacaaagatcctttccgacaactgagattactgaataaaacctatggatttgtcataacgttatttgagatcggacaaacagtaccatcattatggaatagtaccttggaatttattgagaaatatcctgaaacactggcgaaaaacaatttatgggaatggatttcagatgataatggaaaaaaatttagccactgccatttttggtcaaactttgaaatagcggatctcgattttttcagaagtgattcttacagaaaatattttgattttttagataaaaagggtggctttttttatgagagatggggtgatgctccagtacattctatagcattaagtttatttctcgatagaaacaaactgcattactttgacgaaataggatattctcatgctcctcttcttcattgccctagaaagggacgttgcttctgtaaaccggaagagattgatttatcgtccaactcttcttgcatagctaggttcattaacctaactaacgaagactacgatgaattataa

SEQ ID NO: 45540 - protein, 372 aa, Schizosaccharomyces pombe
MRISRLLIRVLLGFVILFITYILFPSIPKALVNTLNVYKLEERLNYYNDRLLDGNLKSKELENATFVTLARNADLYDLIETINIYENRFNSKHNYPWVFLNDEPFTRTFEVVMSRLTSGPTYFGVVNSSEWDIPKWIDMDIAHSNWNRLSREGVLYGGMKSYRQMCRYFSGFFWRHPLLDPYKYYWRVEPSTKLLCEVNKDPFRQLRLLNKTYGFVITLFEIGQTVPSLWNSTLEFIEKYPETLAKNNLWEWISDDNGKKFSHCHFWSNFEIADLDFFRSDSYRKYFDFLDKKGGFFYERWGDAPVHSIALSLFLDRNKLHYFDEIGYSHAPLLHCPRKGRCFCKPEEIDLSSNSSCIARFINLTNEDYDEL

SEQ ID NO: 45541 - DNA, 1173 bp, Schizosaccharomyces pombe
  CDS (1)..(1173)
atggttcgcttgccaagaaagttcaaacgtgttttacttttagtggtattacttacattggttgtatttgtacgtttcaaaaagcaatacatcccaactatcagtgtatttgagggcagtctgattgacaatcgagatactctttcgtatttcaatatttctaatctagagccctcagaacgctccgaatggcttccaaataaacgggttaatgctgcctttgttacgttggcaagaaatgaagatttgaatgatttacttaaatcaatccgaaaacttgagaagactttcaatcataaatatcattatggatgggttttccttaacaatgaggagttctctgacgaatttaaggagcatgttattgaagcggtctctggcaaatgtgaatttggtttggtacctcaggaacaatggagcattccggaatatattgaccaagacaaaatgcatgaaaattggaaaaaacttcaagaattaggaattctttatgctgacaaagaatcttatcgtcacatgtgtcgctttgagtctggtttcttttatcgtcatcctcttgttcagaagtacgaatattattggagagttgaacctagtgtggatttcttttgcgacctcgatttcgatccatttgcttatatgaaggaaaataacaaggcgtatgcattcactatcactgtaactgaatattcagaaacaattccttctctttggccctctaccaaagaattcatcaaaatgcaccctaatgctcttcatcctaataatgctctaaacttcatatctaatgatgatggggaaacttataacggatgtcatttttggactaattttgaaattgcgaaagttgatttttgggaaagtgaagtttatagtaaatattttgactaccttgataaaagtggtaatttcttctatgagcgttggggtgatgctccagttcatagcattgctgtttcgttgttcgctgatcgtgacaatatccattttttcaatgagattggctattggcatcctggtagcggtcattgtcctttggatgatgctacacgcgctaaatgcgactgtgatccttatgaatccattgattataatggatggagctgtctagataaattctataccgcatttgaaatgcctttccccgaaaactggtctttttatagccattaa

SEQ ID NO: 45542 - protein, 390 aa, Schizosaccharomyces pombe
MVRLPRKFKRVLLLVVLLTLVVFVRFKKQYIPTISVFEGSLIDNRDTLSYFNISNLEPSERSEWLPNKRVNAAFVTLARNEDLNDLLKSIRKLEKTFNHKYHYGWVFLNNEEFSDEFKEHVIEAVSGKCEFGLVPQEQWSIPEYIDQDKMHENWKKLQELGILYADKESYRHMCRFESGFFYRHPLVQKYEYYWRVEPSVDFFCDLDFDPFAYMKENNKAYAFTITVTEYSETIPSLWPSTKEFIKMHPNALHPNNALNFISNDDGETYNGCHFWTNFEIAKVDFWESEVYSKYFDYLDKSGNFFYERWGDAPVHSIAVSLFADRDNIHFFNEIGYWHPGSGHCPLDDATRAKCDCDPYESIDYNGWSCLDKFYTAFEMPFPENWSFYSH

SEQ ID NO: 45543 - DNA, 1239 bp, Eremothecium gossypii
  CDS (1)..(1239)
atgagaaatagatggtcacatctgctcttggttctgttcgccggtgcaaccatcctcgcacttttgggcagactgaaaaatgtgggcgagcgttcgctggaccaatggtacgcagcgaggtcgtacgagatattgcacaagttcgacaacgtgaggcgatatgaccagttgttccgtccgccgaagatgtcgaccaattcctacgtagacctgctggagttccgacctctagtcgccgacggcccacgcgaaaatgcgaccttgctcatgctctgtcgcaattgggagcttcccggggtgctgagctccatgcgctccctcgaggatcggtttaacagccgcttccactacgattgggtgttcctgaacgacgtgccgtttgacgtggacttcgtggaggccaccagcgcgatggccagcggccggaccttctacgggctggtgcccgacgaggactggaacacgccccgctggatcgacccgctgcgctacgaggagtgcctgcaggatatgctcgcgaaggacgtcccgtacggtggctcacggtcgtaccgcaacatgtgcagattcaactccgggttcttcttccggcaagagttgctggacaactacgactactacttccgcgtggagccaaacgtcgaatacttctgtgacttcccgtatgaccccttccgcgtcatgcgcgagcaccgcaagaagtacggcttcgtcatcacgctgacggagtacgagcagaccgtgcctacgctgtggcaggccgtgcgcgcgttcgcagccgagcacccggagctcgtggacctcgccaccaacctgcacgagttcgtcaccagcgggcccgcggccccctccgccctcgcagacctcgaatacaacctgtgtcacttctggtccaacttcgaaatcggcgacctcaacttcttccgcagcccggcgtacctgaccttcttcgagcacctcgaccgcgccggcggcttctactacgagcgctggggcgacgcgcccgtccactccctcgccgccgcgctgctcctgcgcgccgacgaggtgcaccacttcgaggagatcggctacttccacgtgccctacggcacgtgcccgtccgcgcacgtcgcgcgtctcgcgcagcgctgcgtctgcaacttcggccgcgaggccgtcgacatcgagcacacatcgcactcctgtctcgaccactggtggcgccgcggcggcggcaagttcttcctgtctatgtag

SEQ ID NO: 45544 - protein, 412 aa, Eremothecium gossypii
MRNRWSHLLLVLFAGATILALLGRLKNVGERSLDQWYAARSYEILHKFDNVRRYDQLFRPPKMSTNSYVDLLEFRPLVADGPRENATLLMLCRNWELPGVLSSMRSLEDRFNSRFHYDWVFLNDVPFDVDFVEATSAMASGRTFYGLVPDEDWNTPRWIDPLRYEECLQDMLAKDVPYGGSRSYRNMCRFNSGFFFRQELLDNYDYYFRVEPNVEYFCDFPYDPFRVMREHRKKYGFVITLTEYEQTVPTLWQAVRAFAAEHPELVDLATNLHEFVTSGPAAPSALADLEYNLCHFWSNFEIGDLNFFRSPAYLTFFEHLDRAGGFYYERWGDAPVHSLAAALLLRADEVHHFEEIGYFHVPYGTCPSAHVARLAQRCVCNFGREAVDIEHTSHSCLDHWWRRGGGKFFLSM

SEQ ID NO: 45545 - DNA, 1263 bp, Eremothecium gossypii
  CDS (1)..(1263)
atgcaacccggattcggggaacccgcactccgccaccattgccggagatctgcgcttgcggtgacgatgtacaagaacacgaggaagaggctgatgcccaagtcagcggtgcttgtgcggcggtatgagcgacagatcaagacggtgtttgtggcgtttctggcggcgctcatgatcatgtttctggcgcgggagccctaccttggcataggctcgggcacgcgcagcgacgccaagctgcagccagccgcggccgagcggctgcagggcgtcagggtgctggaggacgctggcgagcccgtgcgcgcggcattcgtggtgctcgcgcgcgaggaggacctgtggtcgctggtgacctcgatccggcacgtggaggaccgcttcaacgcgcgctaccactacgactgggtcttcgtcggggcgacgcccctgtcggagaagttccagacggtgacgcgcagcctcgtgagcgggcgcgcacgcttctgcgtggcgcaggcggcggcgcgcgagtacccccccgcggtggagaaggagcgcgcgggcaaggcgaccacagcgctggccgagagcggcgtttcgatcgaacaagtcctgctctggcgcttccacgcgggctacctcgcgctgctgcccgagatgcaggagtacgaatactactggtatgtcgagcccgacatcgagctgtactgcgacatcaactacgacatattccgcttcatgaaggcccaccgcaagcagtttggcttcatcctggccaccgaggacccgtccgactactcggccctgtggacggaggccaccgcgttcgcaaagcagcgcgcggacctcctggcgcacgacaacctgcgcaacttcgtgtctaacgacggcgacaccttcaacggctgcgtcttccgcgcgggcttccaggtctcctcacttgacttctggcgctccgacgccttccgggccttcttcgaagccctcgacgcgagcggcggcttcttctacaacctctggactgacgtcgcggtccagacgctcgccgtcgcgctgctcatggacagaagagacgttcactttttcgatagcatcggcctctaccaccgtgagatgcgctcctgccccttcgagcagacgatcaggcgccagaacaagtgcatctgcaacccggagcaggacctgacctgggaaaccgggtatgtctgcacccgcaggttcatgcaggcccgtggactccagctgccgaaaggaatacgccgcgctgcacgcgctgtatag

SEQ ID NO: 45546 - protein, 420 aa, Eremothecium gossypii
MQPGFGEPALRHHCRRSALAVTMYKNTRKRLMPKSAVLVRRYERQIKTVFVAFLAALMIMFLAREPYLGIGSGTRSDAKLQPAAAERLQGVRVLEDAGEPVRAAFVVLAREEDLWSLVTSIRHVEDRFNARYHYDWVFVGATPLSEKFQTVTRSLVSGRARFCVAQAAAREYPPAVEKERAGKATTALAESGVSIEQVLLWRFHAGYLALLPEMQEYEYYWYVEPDIELYCDINYDIFRFMKAHRKQFGFILATEDPSDYSALWTEATAFAKQRADLLAHDNLRNFVSNDGDTFNGCVFRAGFQVSSLDFWRSDAFRAFFEALDASGGFFYNLWTDVAVQTLAVALLMDRRDVHFFDSIGLYHREMRSCPFEQTIRRQNKCICNPEQDLTWETGYVCTRRFMQARGLQLPKGIRRAARAV

SEQ ID NO: 45547 - DNA, 1362 bp, Eremothecium gossypii
  CDS (1)..(1362)
atgctatgcttgagaaagtgccttagacggcctatccttctcctggctattgcgctgactggtattgtgtgtttcctcatatatcgtatcaaccatatcctagaagttcgggcctacttcgcaaacacagttgaatctgtcggcgccaccctatctgatatagctagcaaaactacacatgctgatagagccagcgagtttgatgcactaatagaaaagctcactactccgctacattctggagcggagttgtcgggcgctacaagagaagaagggctacgggcgtatgcacgcttcatggaccagcccatcgatgagccgaaaggaactcccctggtgcggcctggcacagatgcagcagggaaggcgccggcgaccattttatgcctagtgaggaacaaagatcttgaaggaataaggagctcgattaccgagctcgaaaaagcgtttaatggcaagttcaagtacccgtatacttttttgaacgatgaaccgtttactccagagttcaaggaggctattcagaagcttattcctgagcatgaatcggaatttgcaactattgacaaggagttctggtctataccggaggccatcaatcgtgagaaatatgatgttcaaaagctaaagcttttaaccctcaaagtgggccatgcagaggaggattcctatcacctcatgtgtaggttttactctcgatacttctacaaagtgccagaacttgcaaagtaccgctatgtatggcggcttgaaccgaacgtcaacttccacagcgaactaaactacgatgtgttccagtttatgaaggctgcaaataaaatttatgggtttacaataagcctatatgacaacccatggtccgtggagtcgttatgggaccatactatggattttgtccgcgctcatccccactatctcaaccaggccggcgccaccgactggctacgggaaaacatccagaagtccgaaaacttcaaaatcacccgcggatacagcacttgccacttttggagcaatttcgagatcattgacttggagttcttacgcagtgaagcttacgaacaatttgttgaataccttgatcagacaggcgggttcttctacgagcgttggggcgatgcacctgtaagaagcctcgcgctggccctctttgcaaacgcttctgatattcattggtttcgtgacattgcatacaatcacttgccatactttaactgtcccacctttctcccggattctcgaaggtctttcggtacctgtaaatcggggaagttttccaattgggacgagctaaacgtggagaattgtgcgggcaactggatactccacgccatgacggatgcagatcgcgctgcctactga

SEQ ID NO: 45548 - protein, 453 aa, Eremothecium gossypii
MLCLRKCLRRPILLLAIALTGIVCFLIYRINHILEVRAYFANTVESVGATLSDIASKTTHADRASEFDALIEKLTTPLHSGAELSGATREEGLRAYARFMDQPIDEPKGTPLVRPGTDAAGKAPATILCLVRNKDLEGIRSSITELEKAFNGKFKYPYTFLNDEPFTPEFKEAIQKLIPEHESEFATIDKEFWSIPEAINREKYDVQKLKLLTLKVGHAEEDSYHLMCRFYSRYFYKVPELAKYRYVWRLEPNVNFHSELNYDVFQFMKAANKIYGFTISLYDNPWSVESLWDHTMDFVRAHPHYLNQAGATDWLRENIQKSENFKITRGYSTCHFWSNFEIIDLEFLRSEAYEQFVEYLDQTGGFFYERWGDAPVRSLALALFANASDIHWFRDIAYNHLPYFNCPTFLPDSRRSFGTCKSGKFSNWDELNVENCAGNWILHAMTDADRAAY

SEQ ID NO: 45549 - DNA, 1284 bp, Eremothecium gossypii
  CDS (1)..(1284)
atggccgttctactgtcgaagaaggtgattcgagtggcactgctatcctctgtggtgctcctgttcttggggctcctctcggggcaccaggatgtgcaggaatacatgcccgatagcgtgagggacatgcactcgagcgttaagggctcgttgacgggggtctggggcggcaggaccgaggccgttgttgaggagacgaagagcgatgcgggcgtggcgcatgcagacagtggcgcggagcgctcgaaggcgccagcgaaggccaaggagcctgcagaggagtggatgcggaagccggcgccggtgcaggcggacggtaaggtgcgcgcgtcgtttgtctcgcttgtgcgaaactcgcagctggagggcatcattccggcgatcaagctggtcgagcagcgcttcaaccacaagtaccactacccctggctcttcctcaacgacgagcccttcaacgaggagttcaagaccgagattaggaaggttgtgagctctgaggcacgcttcgagaccatccccaaggagcactggagcttccccgagtggatcgaccaggataaggcggccgagacccgcgagaagatgaagggcatcatctatggtgactccgtgtcctacaggcacatgtgccgcttcgagtccggcttcttctggcgccatcccgcgttggaggactacgactggtattggcgtgtcgagcccgacaccaagctcttctgtgacatcgactacgacgtcttccgctggatgcaggacaacgacaaggtctacggcttcaccatctccatccacgagttccaggccaccatcccgaccctctgggagaccaccaccaacttcatcaagaagcaccccgagtatgtcgccaaggacaacatgcagggctttatttcggacgacaacggcaagacctacaacctgtgccacttctggtccaacttcgagatagcctcattgaacttctggcgctccaagccttaccgtgagtactttgactacctcgaccaggccggtggctttttctacgaaagatggggtgatgcccctgtgcacagtatcgctgcgtccttgttcttgccgaaagataagatccactttttcaacgacattgcatactaccatgggcccttcacccactgcccgattgaaaaggacgtgttccagaaagggaactgcgactgtaacccggatgatgactttacgttccagggctacgcatgcggacataagtattatgaggtcaacagcatgaagaagcctcctggatatgagcgcttccagtga

SEQ ID NO: 45550 - protein, 427 aa, Eremothecium gossypii
MAVLLSKKVIRVALLSSVVLLFLGLLSGHQDVQEYMPDSVRDMHSSVKGSLTGVWGGRTEAVVEETKSDAGVAHADSGAERSKAPAKAKEPAEEWMRKPAPVQADGKVRASFVSLVRNSQLEGIIPAIKLVEQRFNHKYHYPWLFLNDEPFNEEFKTEIRKVVSSEARFETIPKEHWSFPEWIDQDKAAETREKMKGIIYGDSVSYRHMCRFESGFFWRHPALEDYDWYWRVEPDTKLFCDIDYDVFRWMQDNDKVYGFTISIHEFQATIPTLWETTTNFIKKHPEYVAKDNMQGFISDDNGKTYNLCHFWSNFEIASLNFWRSKPYREYFDYLDQAGGFFYERWGDAPVHSIAASLFLPKDKIHFFNDIAYYHGPFTHCPIEKDVFQKGNCDCNPDDDFTFQGYACGHKYYEVNSMKKPPGYERFQ

SEQ ID NO: 45551 - DNA, 1305 bp, Neurospora crassa
  CDS (1)..(1305)
atggcccgcctccgcccctccctacggctattccccttgggtctaccgcgccttgcactcagccgccacacgcgattcgcgctcctcctcatcctgacagctgccctcatcgaagtcttccttcacacacaacgatgggccgtccgacaacccgagcacgagctcgacgagcccttttacacgtcatgtcaagaacccgccattgaccaaccgcgcgagaaggcagcgatggtgatgctggtccgcaaccaggagctgatgaaggcgctcaagacggtgcagagcattgagaaacacttcaatcagtggtttcactaccccatcgtcttcctgaacgatgagccgttcagcaaggagttcatcagcgccatgaacgcgactgtgagtggggaagcgaggttcgagctcgtgccgaagaaggaatggctgtttcccgagtggatggatgtggcggatgcgaaggcatctatcaaagcacagggggaggcggggatcctgtatgctgggttggaaacttatcaccacatgtgtcggttttactctggcaaattctacaccctcgaagcactcaaagactacgcctggtactggcggatcgagccagacgtcgagttctactgttccattacctacgacccttttgtcgaaatggccaagcacgacaaagtgtacggtttcaccatcgctctgccagaggagccgcggacgtgcccaagcctcttccgcaagatggccgactacaaggagttgaacaacattccgaccacggagctgtggaaggccacgatagctgcttcatgggtgccttggccactccgccccttcatgggttggtttcggcaccgcgaccgctctggcgatgggtggagtttgtgtcattactggtccaactttgaaattgccaacctggacttttttcggggaaaggactatcagcggttgtttgagtatcttgataagactgggggattttactacgagcggtggggtgacgcagccgtccattctcttgctttgcacatgcttcttccttcccacaaagttcaccactttgaagactttggttaccgccacgactggtattaccaatgtccagccaatgcaccaaatggtcaactgttcgagtcgaagctacttcctgatggtccatatagcccagaacgtgaaggcggtattggatgccggtgcgagtgtgacgggcggaggactcggaactttccagcgtattgcacgaataagctcaaagaacctaatacggccaggcgtctgagtatggtagaatcggttcgcagctggttcccatga

SEQ ID NO: 45552 - protein, 434 aa, Neurospora crassa
MARLRPSLRLFPLGLPRLALSRHTRFALLLILTAALIEVFLHTQRWAVRQPEHELDEPFYTSCQEPAIDQPREKAAMVMLVRNQELMKALKTVQSIEKHFNQWFHYPIVFLNDEPFSKEFISAMNATVSGEARFELVPKKEWLFPEWMDVADAKASIKAQGEAGILYAGLETYHHMCRFYSGKFYTLEALKDYAWYWRIEPDVEFYCSITYDPFVEMAKHDKVYGFTIALPEEPRTCPSLFRKMADYKELNNIPTTELWKATIAASWVPWPLRPFMGWFRHRDRSGDGWSLCHYWSNFEIANLDFFRGKDYQRLFEYLDKTGGFYYERWGDAAVHSLALHMLLPSHKVHHFEDFGYRHDWYYQCPANAPNGQLFESKLLPDGPYSPEREGGIGCRCECDGRRTRNFPAYCTNKLKEPNTARRLSMVESVRSWFP

SEQ ID NO: 45553 - DNA, 1512 bp, Neurospora crassa
  CDS (1)..(1512)
atggacctcctccgtcagctcggggggctcctccccggcggcagaccgccccagcttcccctcggccagggcgaaaaggacaagccacggaggacactggcacagcgccttcagtatcttaggagacccctcaggttacgaggcaactcgagcatatccgtgcctctgggcgtggtcattctcttcccctgcatagtcgtcatcctcatcctcgtcctcttcgtcaggcacccaagctcccccggccgcatcttgatgcccgccggtgccccgcccggcatcaggaaaatcagcgaaaagtacgacaaggtcttcgtcaccggctgccttgagcccgacaccagcaagccccgcgccaatggcgccttcgtcgtcctcgcgagaaacaaggagctggacggtgtcatccagtccatcaagtccatcgagcgccacttcaaccgctggtaccactacccctacgtcttcctgaacgatggcgactttgacgacaccttcaaggacaccgtcaagaactacacctctgctcccgtcgagttcggcaaggttggcccggacatgtggggattccccgactgggtcgaccccaaggtcgccaaggagggtatcgccaagcagggtgatgccgctgtcatgtacggtggcatggaaagttaccactccatgtgcagattctactctggcttcttctacaagcacgagctcctccagaagtacgagtggtactggcgcttggagcccgagatcaagtacttctgcgacatcacctatgaccccttcctcaagatgatcgagaacaacaagacctacggcttcaccattgcggtcaaggaactccgcgagaccgtccccaacattttccgctatgcctccgcctacaagcgtctcaacaacattacctcgcagggtctgtgggaaatgtttgtcgagccccagcccgagaagaagcccgaagcccccgagcccggccttcctgaggagatcctgcgctccgaccccggcgctaacaagctccccgatatcgaccccgaggcgatggagggcgagaagtacaacatgtgccatttctggtccaactttgagattgcccgcttggatttcttccggtccaaggcgtacgaggatttcttccagatgatggatcacagcggtggcttttggatggagcgttggggtgatgccccgattcactccctcgctgccggtgccctcttgggcccccgcgacatccattacttccgcgacttcggttaccgccacaccaccattcagcactgccccgccaacgcgcccgcccgccagctgccccgcgagccctacctcgagaagaccacgctggacgaaaagaagcgcatcgaggaggacaagtactgggatgaatacgacacccccaaggagaacggcgttggatgccgctgcaggtgcgacacggacattgtcgacgtcgagggcaaggaaggttcttgcttggccgagtgggtggatgttgcgggtggctgggccagtccttag

SEQ ID NO: 45554 - protein, 503 aa, Neurospora crassa
MDLLRQLGGLLPGGRPPQLPLGQGEKDKPRRTLAQRLQYLRRPLRLRGNSSISVPLGVVILFPCIVVILILVLFVRHPSSPGRILMPAGAPPGIRKISEKYDKVFVTGCLEPDTSKPRANGAFVVLARNKELDGVIQSIKSIERHFNRWYHYPYVFLNDGDFDDTFKDTVKNYTSAPVEFGKVGPDMWGFPDWVDPKVAKEGIAKQGDAAVMYGGMESYHSMCRFYSGFFYKHELLQKYEWYWRLEPEIKYFCDITYDPFLKMIENNKTYGFTIAVKELRETVPNIFRYASAYKRLNNITSQGLWEMFVEPQPEKKPEAPEPGLPEEILRSDPGANKLPDIDPEAMEGEKYNMCHFWSNFEIARLDFFRSKAYEDFFQMMDHSGGFWMERWGDAPIHSLAAGALLGPRDIHYFRDFGYRHTTIQHCPANAPARQLPREPYLEKTTLDEKKRIEEDKYWDEYDTPKENGVGCRCRCDTDIVDVEGKEGSCLAEWVDVAGGWASP

SEQ ID NO: 45555 - DNA, 1446 bp, Neurospora crassa
  CDS (1)..(1446)
atgggttaccaccaccgcacatcttcccggctgggcacgctgcctctcgcgtttgacctgccggcgcgagtaggacagatcttcatgttgcaatttcgacgacttcggcgctcagggcgcaatggacgccgaatcaagctccttctcaagttcgcattaccgctcctggtcctataccttatcgatctgcccattcatctctaccgcacgcgcgttgcgcgccctcatcaggatctcgaccagccgttcgcgacaggatgtctggacccgtcggttaccgccgcgcagccgcgcgagaacgccacttttgtcatgctggcgcggaatagcgaaattgaaggtgcaaaagcaacagtggcgaatatcgaacggcagttcaaccggtggtttcactacccgattatgttcctgaacgacgctccgtggtcagaggaattcaaggatgtactaagcagggctgtgagcaatgggactgaggtcaggttcgaggtcatcgagaagggaaagtgggggtttcctgaggaaatgaatgagaaggaaaagacaaaggccagattgcagatgaagaagcagggtgagcgaggtgtgggctatggtgacatggagagttatcatcacatgtgtcggttttactctggcgagttctacaatctcgaagccctgaggccctacaagtggtactggcgcctcgagccaagtgtacgctacagctgtgccctcacatacgacccttttgcggaaatggctcgtcacgacaaggtctacggctggacgatagcgctctgggaggttggcgacacctgcccgtccctattcaagaccaccgacgactaccgaatcgaaaagggtattccccggacgcccacctggaacgccttgttacaagtgatgtggttccccgcgcccgtccgttggtttctcggcttgtttcgggtacgggagcacgacaactccggcaacaagtggaacatgtgccactactggagcaactttgagattgccaatctggacttcttccgcggccgcgagtaccaggattacttccgctacctggacagcaaaggcggcttctactcggagcgctggggcgatgcgccggtgcacacgctcgccgtgcacatgcttctcccgcccgagaagattcatcacttttcggatattggctacgagcatgacacgctgtggcagtgtccgggaaatgcaccgatggaccagcaactcctcggtaacaaggcgctgcgtgacatgggcaggatgacactgccgtcggagggagggacaggatgcaggtgcaaatgccaggagaataagaggaggaggaatatcaatagtcagtgcacgagcgagctgacgaggccagtggcgtttcataggccaagctggtgggagaggcacaatggagtgtatcactatgctgtaaataacccaaataatccgaggaagtga

SEQ ID NO: 45556 - protein, 481 aa, Neurospora crassa
MGYHHRTSSRLGTLPLAFDLPARVGQIFMLQFRRLRRSGRNGRRIKLLLKFALPLLVLYLIDLPIHLYRTRVARPHQDLDQPFATGCLDPSVTAAQPRENATFVMLARNSEIEGAKATVANIERQFNRWFHYPIMFLNDAPWSEEFKDVLSRAVSNGTEVRFEVIEKGKWGFPEEMNEKEKTKARLQMKKQGERGVGYGDMESYHHMCRFYSGEFYNLEALRPYKWYWRLEPSVRYSCALTYDPFAEMARHDKVYGWTIALWEVGDTCPSLFKTTDDYRIEKGIPRTPTWNALLQVMWFPAPVRWFLGLFRVREHDNSGNKWNMCHYWSNFEIANLDFFRGREYQDYFRYLDSKGGFYSERWGDAPVHTLAVHMLLPPEKIHHFSDIGYEHDTLWQCPGNAPMDQQLLGNKALRDMGRMTLPSEGGTGCRCKCQENKRRRNINSQCTSELTRPVAFHRPSWWERHNGVYHYAVNNPNNPRK

SEQ ID NO: 45557 - DNA, 1311 bp, Neurospora crassa
  CDS (1)..(1311)
atggcggcgggcagcgcacgctacgtgcgctacatcctccttgccttttttgttatcgccgttctttacttcatctctacgccgtcatccgtcgtgacccccctaaaagataactttggcaaattccaacaatccaccggaaactcgaagccatcgactggaagtactaccggaagcactgccggaagtaccaccggaggcaccaccgaagtcgcccacgatgaaaagacacccgctaagagcaatggcgccgactacgatcctgcccagtacccgttggccatgactccgaatgacccgggctggaacgacttgtctggggttaagggcggccctcgcatgaacgcgacctttgtcaccttggctcgcaacggcgatgtgtgggaaattgcaaagtcgatccgctcggtcgaggaccgcttcaaccgccgctacaactacgactgggtcttcctcaacgacaagccatttgacgaaaccttcaagaaggttacctcctcgcttgtgtccggcaagacgtactatggcgagattccgaccgagcactggtcgttcccgcctcacattgaccaggagaaggccaaaaaggttcgcgaggacatgagacagcgcaagatcatttacggtgacagtatcagctaccgccacatgtgccgctttgagtccggcttcttcttccgccagcccctcatgatgaactacgactactactggcgcgttgagccgagcgtcgagttccactgcgacatccactacgatcctttccgcttcatgcacgagaataacaagaagtacagcttcgtgctcagcctttacgagtacttcgagactatcccgaccctctgggacagcgttaccaagttcatcaagaaccaccccgagcacattgctgagggcaactccatggctttcctcagtgacgatggtggcaagacctacaacaagtgccacttttggtccaactttgagattggtagcctcaactggcttcgctccaaggcctacaccgactacttcgagtctctggatcaggatggtggtttcttctatgagcgctggggcgatgccccggtccactctattgccgccggcttgatgttgaagaaggaggaaatccacttcttcaacgacattgcctactaccacgttcccttcactcactgccccaccggagagcagttccgtctcgaccgcaagtgccactgcaaccccaaggagaactttgactggaaggggtattcttgcacttcgaggtactacgagcttaatggtcttccgaagccagaaggctggcaagatcagtcggattag

SEQ ID NO: 45558 - protein, 436 aa, Neurospora crassa
MAAGSARYVRYILLAFFVIAVLYFISTPSSVVTPLKDNFGKFQQSTGNSKPSTGSTTGSTAGSTTGGTTEVAHDEKTPAKSNGADYDPAQYPLAMTPNDPGWNDLSGVKGGPRMNATFVTLARNGDVWEIAKSIRSVEDRFNRRYNYDWVFLNDKPFDETFKKVTSSLVSGKTYYGEIPTEHWSFPPHIDQEKAKKVREDMRQRKIIYGDSISYRHMCRFESGFFFRQPLMMNYDYYWRVEPSVEFHCDIHYDPFRFMHENNKKYSFVLSLYEYFETIPTLWDSVTKFIKNHPEHIAEGNSMAFLSDDGGKTYNKCHFWSNFEIGSLNWLRSKAYTDYFESLDQDGGFFYERWGDAPVHSIAAGLMLKKEEIHFFNDIAYYHVPFTHCPTGEQFRLDRKCHCNPKENFDWKGYSCTSRYYELNGLPKPEGWQDQSD

SEQ ID NO: 45559 - DNA, 1182 bp, Neurospora crassa
  CDS (1)..(1182)
atggcgattgctcgcccagtacgagccctggccctggcggctgcgctcgtctggtgtttcttcatatggcagcttctgtcgccatcgggaaccgccatgaccaaagacaaatacttgtcctttgagcgggatcccaacctggaccctacgggagaacccgaagggaagctcatacgcgcttccgaagactatgcgccgggcgcaaagaactcggccagaatcaatgccactctgctggcgctggtgcgaaacgaggagctggaaggcatgctgcaggcgatgcgcgacctcgagcggacatggaaccacaagttcaactacccctggacctttttcaacgacgtgcccttttccgatgagttcaagaagagaacgcgcgcggtaacgaaggccgaggtcagatacgaacttatccccaaggagcactgggaaatgccatcatggattaaccaggacctgtaccacgagtcggtcaagatcctcgaagaaaagaagattcagtatgccgacaaaatttcgtaccaccagatgtgccggtggaacagcggcatgttctacaagcacccggccctggccaacacgcagtactactggcgcgtcgagcccaacgttcacttcttttgcgatgtcgactatgacgttttccgctacatgcacgataacaacaagacgtacggcttcaccatcaacctgtacgacgccccggcgtccatcactactctgtggcccgaaaccgaaaagttcttggccgagcaccccgaatatgtgcacgagaacagcgccatgaattggctgacggacaagacccgccgtcccgaccacacaaaggatgccaacggttattcgacatgccacttttggagcaactttgagattggcgatatgaacttctggcgcagcaaggcgtacgaggattatttcaaccacttggaccgtgccggtggctttttctacgagcgttggggtgacgcacctgttcacagtattgccctgggtctcttcgaagactctagcaagattcattggttccgcgatattggctatcagcacattcccttcttcaactgtcccaactcccccaagtgcaagggctgcgttaccggccgtttcaccgatggcgaggcctggctcaacagggaagactgcagacccaactggttcaagtacgtcggcatgggctaa

SEQ ID NO: 45560 - protein, 393 aa, Neurospora crassa
MAIARPVRALALAAALVWCFFIWQLLSPSGTAMTKDKYLSFERDPNLDPTGEPEGKLIRASEDYAPGAKNSARINATLLALVRNEELEGMLQAMRDLERTWNHKFNYPWTFFNDVPFSDEFKKRTRAVTKAEVRYELIPKEHWEMPSWINQDLYHESVKILEEKKIQYADKISYHQMCRWNSGMFYKHPALANTQYYWRVEPNVHFFCDVDYDVFRYMHDNNKTYGFTINLYDAPASITTLWPETEKFLAEHPEYVHENSAMNWLTDKTRRPDHTKDANGYSTCHFWSNFEIGDMNFWRSKAYEDYFNHLDRAGGFFYERWGDAPVHSIALGLFEDSSKIHWFRDIGYQHIPFFNCPNSPKCKGCVTGRFTDGEAWLNREDCRPNWFKYVGMG

SEQ ID NO: 45561 - DNA, 1185 bp, Magnaporthe grisea 70-15
  CDS (1)..(1185)
atgttccgaaggctcagacgcatgccacggcggctgcacccgcttttcgtcgcggcaatgtggctcgccatcccgctcgcgctcgagagcatatatcaccagcgcagctacaacgtgccgatcccggagcgcgagatggactctgcctttttcggcagcgagggctgcctggacccggaggagatggccaaggggccgcgcgagaaggcggcgctcgtcatgctggcgcgcaactcagagctggagcaggccaagcacacggtcgagtcggtcgagcgccgcttcaaccgctggttccactaccccgtggtgtttttcaacgacgaggagtgggacccagagtttgtgcgccagctgaatgctacggtcagcggagaggcaaggtttgagatcataccgagggacgtgtggtatttcccgagctggatggatgcggacaaggcaaaggctagcatcaaggatcagggtgataggggggtctcgcatgagcccgacgtcgactttacgtgctcgataacctacgacccctttgtcgaaatggccaagcgcaacaagaaatatggctttacgatatcgctctgggaggagcgcgacacgtgcccaaccttgtttcgccacatggccgactggaaggaggccaacgacgtcccgaccaacaacctctggaaggcagccgtctcggcctcgtgggtgccctggccgttccgcaacctcgtcgcctggctgtcgcacagggacaggttcggcgacatgtggagcggctgccactactggagcaactttgaaattgccgacatggactttttccgtgggaaaaggtaccaggacatgtttgagtacctggacaagaagggcgggttctactttgagcggtggggcgatgctgcagttcactccatcgcggtcgccatgctcctggacccatcccaggtccaccactttgacgacataggctaccggcacgatcagctgtaccagtgtcccgtcaactcccccggcagccagctccccgacaaccccagcctggggacggacaagaactgggctccctcggccgaggggggagtcgggtgccgctgcgagtgcgacggcaggacgacgccgcgcaaccacccagggtactgtctaaacaagctcaaggcgcccaacaccaggagccggccctggttcacgtggttattgtga

SEQ ID NO: 45562 - protein, 394 aa, Magnaporthe grisea 70-15
MFRRLRRMPRRLHPLFVAAMWLAIPLALESIYHQRSYNVPIPEREMDSAFFGSEGCLDPEEMAKGPREKAALVMLARNSELEQAKHTVESVERRFNRWFHYPVVFFNDEEWDPEFVRQLNATVSGEARFEIIPRDVWYFPSWMDADKAKASIKDQGDRGVSHEPDVDFTCSITYDPFVEMAKRNKKYGFTISLWEERDTCPTLFRHMADWKEANDVPTNNLWKAAVSASWVPWPFRNLVAWLSHRDRFGDMWSGCHYWSNFEIADMDFFRGKRYQDMFEYLDKKGGFYFERWGDAAVHSIAVAMLLDPSQVHHFDDIGYRHDQLYQCPVNSPGSQLPDNPSLGTDKNWAPSAEGGVGCRCECDGRTTPRNHPGYCLNKLKAPNTRSRPWFTWLL

SEQ ID NO: 45563 - DNA, 1176 bp, Magnaporthe grisea 70-15
  CDS (1)..(1176)
atggctaggcccgtaagggtgttggcgactgtcgccatcttcatgtggtgtgtctttctgtacatgatctttagaccatcatcgccgttattagtcgccgatgaattttccaactttcagagggatccgatgcacgatccaactggcgagcccgaaggcatcttaaggcgcgtatcgcccgagtatgcaccagacgccaaccctaccgagcggattaacgcgaccctgctggcgctggtgaggaacgaggagctagacggcatgctgcaagccatgggcgacttggagcgcacatggaacagcaagttcaactacccctggacattcttcaacgacgttcctttctcgaaagagttcaagcagaagacccaagccatgacaaaggccaagtgcaactacgaaattatcccaaaggaacattgggacatgccttcatggattaacaaggacatctacgatgagtcggtcaagatcctcaaggagaacaagatccaatacgccgacaaaatctcataccatcagatgtgccgatggaacagcggtctcttctacaaacaccccgccctgaaggacgtgcaatattattggcgagtggagcccaaggtgcacttcttctgcgacatcgactacgacgtcttccgctttatgcaggacaacaacaagacttacggcttcaccatcaacctctacgatgcgccggagtcgatcccgaccctgtggcccgagactgaaaagttcttggctgagcacccccagtacaagcatcccaacaacgcgctcgactggctcacagacaaggagaagcgccctgagcataaccgcaaggcgaacggctactcgacatgccacttctggagcaactttgaggtcgcagacatgaacttctggcgcagtaagacctacgaagactacttcaaccaccttgaccgcgccggtggctttttctacgagcgctggggtgacgcccccgtacacagcattgctcttggtctctttgaggatgccagcaagattcattggttccgtgacatcggatatcagcacatcccattcttcaactgccccaactcgcccaagtgcaagggttgcgtcgctggacgcttcaccgacggtgagaagtggcttcaccgtgaggactgcaggccgaactggttcaagatgcacggcatgggctga

SEQ ID NO: 45564 - protein, 391 aa, Magnaporthe grisea 70-15
MARPVRVLATVAIFMWCVFLYMIFRPSSPLLVADEFSNFQRDPMHDPTGEPEGILRRVSPEYAPDANPTERINATLLALVRNEELDGMLQAMGDLERTWNSKFNYPWTFFNDVPFSKEFKQKTQAMTKAKCNYEIIPKEHWDMPSWINKDIYDESVKILKENKIQYADKISYHQMCRWNSGLFYKHPALKDVQYYWRVEPKVHFFCDIDYDVFRFMQDNNKTYGFTINLYDAPESIPTLWPETEKFLAEHPQYKHPNNALDWLTDKEKRPEHNRKANGYSTCHFWSNFEVADMNFWRSKTYEDYFNHLDRAGGFFYERWGDAPVHSIALGLFEDASKIHWFRDIGYQHIPFFNCPNSPKCKGCVAGRFTDGEKWLHREDCRPNWFKMHGMG

SEQ ID NO: 45565 - DNA, 1317 bp, Magnaporthe grisea 70-15
  CDS (1)..(1317)
atggcggccggtagcgctcgctacgtgcgatatctcttgatcgcctttttcgttctcgctgtattctatttcgtttcacactcttcttacgatgtaaggccagatcagtatcccggcgggagcggcgacatccaacagaaccagcccgctgcgcaacaacctgccaaggttgacaccccaaaggtggacacacccaagctcgatgatgcccccaagaaagatcagacctcccacaagcctgccgttgggaaggttgactcgggcaaggcggctgagcacccgatggctatgaagcccggccagcccgaatgggaggatctcgtgagcgtagcaccaggcccgcgcatgaatgcaacatttgtcacgcttgcccgtaactcggatatttgggagatcgccgactcgatccgccaggtcgaggatcgcttcaacaagcgctacaactacgattgggtcttcttgaacgacgcaccttttgatgacgaattcaaaacaatcaccacttcgctagtctctggcaagacgcactacggcgagattcccaaggagcactggtcattccctgagtggatcgatgaagaaaaggccgccaaggtgcgcgaggacatgaaggagaagaagatcatctacggagactctgtcagctatcgccacatgtgccgcttcgaatcgggtttcttctttcgccagccactcatgatgaactacgactactattggcgcgttgagcccagcgtcaagctcttctgtgacatccactacgaccctttccgttacatgaaggagaacaagaagaagtacagcttcgtcctgagcttgtacgagtacgtcgagacgatcccgacgctctgggacagcaccaagaagtttatgaagaaccaccctgagcacattgtggagggcaacaccatgcagttcctgagtgacgatggcggcgagacctacaacaagtgccacttttggtccaacttcgagattggcgacctgaactggctacgttccaaggcctacattgacttcttcgagtctctcgacaaagacggtggtttcttttacgagcgctggggagatgcccctgttcactccattgctgccggacttatgctcaagaaggaagaggttcacttcttcaacgacattgcctactggcacgttcccttcacacactgccctactggcgacaaactccgcgaaaagctcaagtgcacatgcaaccccaaggataactttgactggaagggctattcttgtacttcgcgcttcttcgaggccaatggaatggagaagcctgagggttgggagaagcagacagactag

SEQ ID NO: 45566 - protein, 438 aa, Magnaporthe grisea 70-15
MAAGSARYVRYLLIAFFVLAVFYFVSHSSYDVRPDQYPGGSGDIQQNQPAAQQPAKVDTPKVDTPKLDDAPKKDQTSHKPAVGKVDSGKAAEHPMAMKPGQPEWEDLVSVAPGPRMNATFVTLARNSDIWEIADSIRQVEDRFNKRYNYDWVFLNDAPFDDEFKTITTSLVSGKTHYGEIPKEHWSFPEWIDEEKAAKVREDMKEKKIIYGDSVSYRHMCRFESGFFFRQPLMMNYDYYWRVEPSVKLFCDIHYDPFRYMKENKKKYSFVLSLYEYVETIPTLWDSTKKFMKNHPEHIVEGNTMQFLSDDGGETYNKCHFWSNFEIGDLNWLRSKAYIDFFESLDKDGGFFYERWGDAPVHSIAAGLMLKKEEVHFFNDIAYWHVPFTHCPTGDKLREKLKCTCNPKDNFDWKGYSCTSRFFEANGMEKPEGWEKQTD

SEQ ID NO: 45567 - DNA, 1551 bp, Magnaporthe grisea 70-15
  CDS (1)..(1551)
atggatctcttccggcgagcccgacggctcgtcccccaacaaacacctgcgcagctgccttcggccagcgagaagagcaaacctcagggccccaaccgcttgacgtcgcggttggccttcttcaggaggccgctccggttacgcggtaactcgagcgtgtctgtgcctctgggagttgtcatactattcccatgcatagttgtcatcctcattttggtgctctttgttcgccatcccagctcgccaggcaggatattgatgccggctggggcaccgccagcaatcagaaaaattagcgaaaagcatgacaaggtttttgtcaacggttgcctcgaccccaagactgaggcagataaggctcctcgcgccaacgccgcctttgtcgtccttgcacgcaacaaggagctggatggtgtcatccagtccatcaagtcgattgagcgtcacttcaaccgctggttccactacccttacgtcttcctcaacaacggcgacttcaatgagaccttcaaggagactgtgcgaaaccacacttcggcccccgtcgagtttggctttgtcggtcccgacatgtggggataccccgactggatcgatgagaaggttgccaaggagggaattgccaagcagggcgacgctgccgtcatgtacggtggtctcgagagctaccactccatgtgtcgcttttattctgggttcttttacaagcaccctcttctggcgaaatatgagtggtactggcgtttggagcctgaaatcaagtacttctgtgacatcacctacgatcctttcctgaagatgattgaatcaaacaagacatacggattcaccattgccgtcaaggagcttcgcgagactgttcccaacatcttccgctacgcctcggcttacaagcgcctcaagaacatcaccactcaaggtctgtgggagatgttcgtcgagcccactcaggagaaggagcctgagaaggagcagttgcctgaggatgaccccaactacaagccacctttgcctgaagaggtgacccgcaacgacccgaaccgcaatacccccatcgagatcgatcccgaggcgatggagggtgagaagtacaacatgtgtcacttctggtcgaatttcgagattgcccgtctgagctggttccgtagcaaggagtacgaagacttcttccagatgatggacaggagtggtggcttctggatggagcggtggggtgacgcacctatccactcgctcgccgccggtgttcttctcgcaccgcgcgacatccactacttccgtgactttggctaccgccacaccacgatccagcactgtccggccaacgcgccttcacggcagctggctcgcgagcccttcctggagaagacgacgcttgacgagcgcaagaggcacgaggaggatcaatactgggagcagttcgacgcccccaaggagaatggcgttggttgccgctgccgctgtgacaccgatatcgttgatgtcgagggcaaggacggtagctgcctggccgaatgggtagacgttgccggtggttgggctagcccttga

SEQ ID NO: 45568 - protein, 516 aa, Magnaporthe grisea 70-15
MDLFRRARRLVPQQTPAQLPSASEKSKPQGPNRLTSRLAFFRRPLRLRGNSSVSVPLGVVILFPCIVVILILVLFVRHPSSPGRILMPAGAPPAIRKISEKHDKVFVNGCLDPKTEADKAPRANAAFVVLARNKELDGVIQSIKSIERHFNRWFHYPYVFLNNGDFNETFKETVRNHTSAPVEFGFVGPDMWGYPDWIDEKVAKEGIAKQGDAAVMYGGLESYHSMCRFYSGFFYKHPLLAKYEWYWRLEPEIKYFCDITYDPFLKMIESNKTYGFTIAVKELRETVPNIFRYASAYKRLKNITTQGLWEMFVEPTQEKEPEKEQLPEDDPNYKPPLPEEVTRNDPNRNTPIEIDPEAMEGEKYNMCHFWSNFEIARLSWFRSKEYEDFFQMMDRSGGFWMERWGDAPIHSLAAGVLLAPRDIHYFRDFGYRHTTIQHCPANAPSRQLAREPFLEKTTLDERKRHEEDQYWEQFDAPKENGVGCRCRCDTDIVDVEGKDGSCLAEWVDVAGGWASP

SEQ ID NO: 45569 - DNA, 1527 bp, Gibberella zeae PH-1
  CDS (1)..(1527)
atggacctgatcagaagggccaccagggtggctcccagcaaacctcccctacaactgcccctcgatgagaagcgagactccaaacacaacaaggccgtcgacaatcgcatggccttcttccgtaggccgctacgattaaaggggaattcgacgatttctgtacctctgggcgtggtcatcttttttcctatgcttgttttaatccttatttttattcttttcgttagccatcccagttctcccggcaggggtttccttataccaggaggcgctgcccctaaaatgcggaaaatcagcgaaaagtacgacaaggtgttcgtcgagggctgtgcccagcccgacaccagcaaacctcgagccaatgctgcttttgtgatattggcgagaaacaaggagcttgatggtgtgttgcaatccatcaagtcggtcgagagacacttcaacaggtggtacaactacccctatgtgttcctcaatgatggcgatttcgacgaaaacttcaaagaggccattcgaaaccacacttcgggtgaagtcgagtttggaaaggttggaccagacatgtggggtttccctgattggatcgatcccaaggttgtcaaagagggcattgcaaagcagggtgatgctgctgtcatgtacggaggtttggagagttaccacaagatgtgtagattctactctggcttcttcttcaaccatcctctactactcaagtatgagtggtattggcgagtcgagccagagatcagctatttctgcgacatcacatacgaccccttccaaaagatgatcgaacacaacaaaacatatggcttcacaattgccgtcaaagagcttcgcgagactgtccccaacatcttccgatacgcctccgcgtacaagcgactcaataacatcacatccaagggcctatgggaaatgtttgtcgagccaccagaggacgaggaggaggactctcccaaggaaagcgatacctctccaaacgataacagtttctgggatacccttacagggaagaagaagaacactattgaccccgagtcaatggagggagaggcctacaacatgtgccatttttggtctaatttcgagattgccaaactcagctggttccgcagcaaggagtatcaggatttctttgaaatgatggaccgcagtggtggcttttggatggaacgatggggcgatgctcccatccactcccttgccgctggcgctctgcttggaccccaggacatccattacttccgagactttgggtaccgacacacgacaatccagcattgtcctgctaacgcacccggcaagcaactcgctcgtgagccttacctcgagaagacgacatttccagaatataagcgcttcgaggaagacgactactgggagcagtgggacgacgtgcaagaaggtggcattggctgccgttgcaggtgtgacacagatgttgtcgatgttgagggcaaggaaggatcttgtctggctgaatgggtcgacgttgctggcggctgggctcatccatattaa

SEQ ID NO: 45570 - protein, 508 aa, Gibberella zeae PH-1
MDLIRRATRVAPSKPPLQLPLDEKRDSKHNKAVDNRMAFFRRPLRLKGNSTISVPLGVVIFFPMLVLILIFILFVSHPSSPGRGFLIPGGAAPKMRKISEKYDKVFVEGCAQPDTSKPRANAAFVILARNKELDGVLQSIKSVERHFNRWYNYPYVFLNDGDFDENFKEAIRNHTSGEVEFGKVGPDMWGFPDWIDPKVVKEGIAKQGDAAVMYGGLESYHKMCRFYSGFFFNHPLLLKYEWYWRVEPEISYFCDITYDPFQKMIEHNKTYGFTIAVKELRETVPNIFRYASAYKRLNNITSKGLWEMFVEPPEDEEEDSPKESDTSPNDNSFWDTLTGKKKNTIDPESMEGEAYNMCHFWSNFEIAKLSWFRSKEYQDFFEMMDRSGGFWMERWGDAPIHSLAAGALLGPQDIHYFRDFGYRHTTIQHCPANAPGKQLAREPYLEKTTFPEYKRFEEDDYWEQWDDVQEGGIGCRCRCDTDVVDVEGKEGSCLAEWVDVAGGWAHPY

SEQ ID NO: 45571 - DNA, 1434 bp, Gibberella zeae PH-1
  CDS (1)..(1434)
atgacaaaggccccttgctccactctctggtgggtagggacacttgctctcttttacttcactctgatcgtgtttggatctacgttgtctttgtctgctgattctccgatcaaggcagctttggtggctttggttaaggataacgacatcaacgctacgcttttcagcatcaagcagttcgatgacaagttcaacaaggactacctccatgattgggtcttcttcagtatccaggatctcccagaggctttcaagaactcggtttccaacgctaccaacgcaacttgcatcttcgaggtcattcccgaagagaactggaacgacccacgatgggttgattcgttccagcattccatgtctcaggatgccagcctggataaaagctctgcaactctcaagactatcgccaacatccaccagatgaaccgatggatctcggctccttttgccaaagagcaacgtctccaggactatgaatggtttctgaaagttgatccaggcgctcaactagcccaaaacatccctttcgatgtatttcgcttcatgcgagacaatggcatcgcttatgggtctagtcgagctttttttggtcaggccaaactgtctcggctctctccccgagtcaagtccttctttgagaaaaacccggagctgctccacaaggaagccgatgtcgcatggcttattgagaacgtcactggcctcctcatgaaatctggtccactggatgacggttttgaagacttggttgacgagggcaatgacaagctgaggtcgcggaaccaggcgtctcaggttcccggagcccaagatgaaggcgagagatcatggcttagcgagtgctttgcatcttggctagctgacattcatggaagcagtctctccccatcattcgagattggatcactcgcttttttccgcagccttaaccaggttgcattctttgatcatcttgacaatgcgggcgactttcagtttcggcgagtgggcgatgcaccactgcacagtctaagtgccagcatgctcctgcctcgagagagcgtttggaacttccgcaccaaggaaaccaagctcggctctcaacacgacggcgaacacactcaagctgagcgccagtacagtgagatgtgcatgaataactttgacacctctaacttgaacggcagtgcgaagtcgaagggggatgcctacgaggcgatgacggcgctattcaaggcttgggacttgatggcccaggacgtgggtgcgcagagcaagagccccaagttgatttcgggtaacacttggatgggcaaaatgaacggggatgctggatgctcatttttttggttttggcgaaagacactatctgcagatctaggatttggatgggaggaggtcgatttgagttgcttgcatgacgggatgaagggtcaggtaatgatcaaggtctaa

SEQ ID NO: 45572 - protein, 477 aa, Gibberella zeae PH-1
MTKAPCSTLWWVGTLALFYFTLIVFGSTLSLSADSPIKAALVALVKDNDINATLFSIKQFDDKFNKDYLHDWVFFSIQDLPEAFKNSVSNATNATCIFEVIPEENWNDPRWVDSFQHSMSQDASLDKSSATLKTIANIHQMNRWISAPFAKEQRLQDYEWFLKVDPGAQLAQNIPFDVFRFMRDNGIAYGSSRAFFGQAKLSRLSPRVKSFFEKNPELLHKEADVAWLIENVTGLLMKSGPLDDGFEDLVDEGNDKLRSRNQASQVPGAQDEGERSWLSECFASWLADIHGSSLSPSFEIGSLAFFRSLNQVAFFDHLDNAGDFQFRRVGDAPLHSLSASMLLPRESVWNFRTKETKLGSQHDGEHTQAERQYSEMCMNNFDTSNLNGSAKSKGDAYEAMTALFKAWDLMAQDVGAQSKSPKLISGNTWMGKMNGDAGCSFFWFWRKTLSADLGFGWEEVDLSCLHDGMKGQVMIKV

SEQ ID NO: 45573 - DNA, 1185 bp, Gibberella zeae PH-1
  CDS (1)..(1185)
atgacagttgcgcggcctgtccgggcgttgatcgccggaggatgcatcatctggtgtttctttatgtggcagatatttgctccttcttggggtctaagtggtcccggcgatcggtactccaattttgaacgagatcctatgctagatcctaccgacgagccagaaggaaaactacaccgcacgagtccacgatacgcccacgatgcgcaaaagaccgaacgtatagatgctacgctgttggcccttgtaaggaacgaggaggtggacgctatggttatgtctatgcgtgacctcgaaaggacatggaactcaaagttcaactatccctggacatttttcaacgacaagccttttacggaagagtttaagaggaaaacgagggcggcgacaaaagcaaagatcaactacgaaatcatccccgacgaacattggaagatgccatcctggattgacgaacaaatatttgaagagtcagccaagattttggagaagaacggtgttcaatacgcaagcaagatctcataccaccaaatgtgtcgatggaatagcggtctcttctacaagcatccagccctcaaggatatccgctactactggcgtgtggagccaaatgtgcacttcttctgcgatgtcgactacgacgtcttccgctacatgcacgacaacaacaagacatacgggtttacgatcaacctttacgacgacccaaagacccttccttcgctgtggcctgaaacggtcaagttcctggccgagcacccaggatacattcatcaaaacagtgctgttggctgggtcactgatgatattcgtcgaccacaatcgaatagaaaggctcaggggtattcgacgtgccatttctggagcaattttgagattggagacatggagttttggcgaagcaagacctacgaagactactttaatcaccttgaccgtgcgggtggtttcttttatgaacgatggggcgatgcccccgttcatagtattgctctcggtctgtttgaagatcagagcaagatccactggttccgtgatatcggatatcagcatattcccttcttcaactgtcccaactctccaaagtgcaaaggctgcgtcactggccgtctcacagacggtgaagcctggctgcaccgagaagactgtcggcccaactggttcaagtatgtcggtatgggttga

SEQ ID NO: 45574 - protein, 394 aa, Gibberella zeae PH-1
MTVARPVRALIAGGCIIWCFFMWQIFAPSWGLSGPGDRYSNFERDPMLDPTDEPEGKLHRTSPRYAHDAQKTERIDATLLALVRNEEVDAMVMSMRDLERTWNSKFNYPWTFFNDKPFTEEFKRKTRAATKAKINYEIIPDEHWKMPSWIDEQIFEESAKILEKNGVQYASKISYHQMCRWNSGLFYKHPALKDIRYYWRVEPNVHFFCDVDYDVFRYMHDNNKTYGFTINLYDDPKTLPSLWPETVKFLAEHPGYIHQNSAVGWVTDDIRRPQSNRKAQGYSTCHFWSNFEIGDMEFWRSKTYEDYFNHLDRAGGFFYERWGDAPVHSIALGLFEDQSKIHWFRDIGYQHIPFFNCPNSPKCKGCVTGRLTDGEAWLHREDCRPNWFKYVGMG

SEQ ID NO: 45575 - DNA, 1311 bp, Ustilago maydis 521
  CDS (1)..(1311)
atggcttctggattcctcgacgcccttttgcgtcgcccgcagaggctgattctgctcgtcaccctcttccttttcgtcctcgtcttttcgacctacgtctccttctctgcaaatggcgttcaaaatttccgcgatcgcttgaactcgcttcctgccttcgccagcccatggcaggcttccagcaaaggcacaccgtctttcccggcaccgagttcggtcgctgatatgtacactcacaaccctggtacgccttcctcgattgacgagttgtcgaaatgggcgcagaagggagacgacggcaacctgtatcctcctacatttatcccacagatggctaaccaaggtccacgcgccaaagctggctttatcgtcctcgttcgaaacgccgaactcttaggcatgcgcgaatctatgcgagacgttgaagaaaagttcaatcgcaagtatggctacccttggatctttctcaacaacgagcccttcaccgaagaattcaagcgaggtgttcgccagatgacccgcagcgaatgtcgattcggcttgatcctcaaggagcactggggctatcccgactggatcagccaggagaaggccgcagagactcgcgtcaagatgaaagatgtcatctacggctcatcggaaagctaccgccacatgtgccgataccagtctggattcttcttccgccacaacctcacgctcgatctggactactattggcgtgtcgagccaggtatcaagctctattgcgatctcgactacgatcctttcgtctttatgcagatgaacaacaagacttatggcttcaccatggcgctctacgagtacaaagagactgtgccgacattgtggtccgagacgcagaagttcttcgcccagcatcccgagcacctcgccaaggatccaagttatcacttcttgggcgaccacccggagcaaggcattcaagatacatgggtcggcgcccactattggtccaactttgaaatcggcgaccttcgtttctggcgatccaagacgtacctcgactattttgaatggctcgacaaagcaggaggattcttctacgagcgatggggagacgcgcccgttcattccattgctgtttctctcctcctcgatcgaagccgacttcactttttcgatgatattggctacttccacaatccgtggaatcactgtcccgccaatcgcaaaaagtaccatgacacgggtcgatgcaattgtgatcccaagcagtcgtttgataatgagggatactcttgtctgcccaggtggtggaaaggctctccggagggctatccaaagtga

SEQ ID NO: 45576 - protein, 436 aa, Ustilago maydis 521
MASGFLDALLRRPQRLILLVTLFLFVLVFSTYVSFSANGVQNFRDRLNSLPAFASPWQASSKGTPSFPAPSSVADMYTHNPGTPSSIDELSKWAQKGDDGNLYPPTFIPQMANQGPRAKAGFIVLVRNAELLGMRESMRDVEEKFNRKYGYPWIFLNNEPFTEEFKRGVRQMTRSECRFGLILKEHWGYPDWISQEKAAETRVKMKDVIYGSSESYRHMCRYQSGFFFRHNLTLDLDYYWRVEPGIKLYCDLDYDPFVFMQMNNKTYGFTMALYEYKETVPTLWSETQKFFAQHPEHLAKDPSYHFLGDHPEQGIQDTWVGAHYWSNFEIGDLRFWRSKTYLDYFEWLDKAGGFFYERWGDAPVHSIAVSLLLDRSRLHFFDDIGYFHNPWNHCPANRKKYHDTGRCNCDPKQSFDNEGYSCLPRWWKGSPEGYPK

SEQ ID NO: 45577 - DNA, 1188 bp, Ustilago maydis 521
  CDS (1)..(1188)
atgaacctcaccttgcgctacgtcgcgctggtgctggtcacacttctctcgctgcactacctggccagctacacatccaccgcatatcacaaccaggtggacacgctgcgctcttcatggtcctcttcttcgtcgaaagctgtcgacctaatcgcatatgcaaacacgcccaaagccaacgcaaccttcgttattctttgtcgtgaaggagagctcaatggaatcctcgctagtcttcaactgctcgagagcaccttcaacgatcgaccacatcatcgatatccctatgtttttttgaacgaccaacctttctcggaaaagttcaagctgcacgtcacccgagccgtctcgtcgagcgtcgaattcggccaagtgcccgcagagcattgggacatcccttcgagcattgacctgggcaaagcacagaaatcatgggaccgagcaaagaagaccggtatgccctacggaggctccaagtcgtataggcaaatgtgcaggtttcagtctggtttctttttcagacatccactcttgctcaggtacaagtactattggagggtcgagcccgacgttaaatacttttgcgatttgaccgactacgacccgtttcgttttatgcaacagaacaagaaaaagtacggctttgtgctggcgatgcacgatatcccaggcacggttcgaacgctctgggtacatgtgcgccagtggtatgaaaagaatcctggcctactcgttcccaacaacatgtttggttttgtcactgacaacaacggacgcggatacaacatgtgccactactggtccaacctagagatcgctgatatggacttttaccgctccgaagcctatctttcctactttgatcacctcgatcaagccggaggtttcttctacgagcgatggggcgatgcgcctgttcattctatcgctgcctcgctcctgctcgacaaatccgaggtgcactattttgacaacatcggctacctccaccatcccatcctgcattgtccaaaggtgtccaagcagaacgcaatctcgccgcacaccggaaagtcacgatgctactgtgcgcacgaaacgtcgtttgcttttgatgacggtcgccattcctgtctatacaactttctcgaggtcaacggtaggaattcgactgcggccagagatgagttcagaaaagccgacgattga

SEQ ID NO: 45578 - protein, 395 aa, Ustilago maydis 521
MNLTLRYVALVLVTLLSLHYLASYTSTAYHNQVDTLRSSWSSSSSKAVDLIAYANTPKANATFVILCREGELNGILASLQLLESTFNDRPHHRYPYVFLNDQPFSEKFKLHVTRAVSSSVEFGQVPAEHWDIPSSIDLGKAQKSWDRAKKTGMPYGGSKSYRQMCRFQSGFFFRHPLLLRYKYYWRVEPDVKYFCDLTDYDPFRFMQQNKKKYGFVLAMHDIPGTVRTLWVHVRQWYEKNPGLLVPNNMFGFVTDNNGRGYNMCHYWSNLEIADMDFYRSEAYLSYFDHLDQAGGFFYERWGDAPVHSIAASLLLDKSEVHYFDNIGYLHHPILHCPKVSKQNAISPHTGKSRCYCAHETSFAFDDGRHSCLYNFLEVNGRNSTAARDEFRKADD

SEQ ID NO: 45579 - DNA, 1497 bp, Aspergillus nidulans FGSC A4
  CDS (1)..(1497)
atgggcgtcgttcaacgagttcgaaaatggttgccctcaacaccgagtcttccccttgatgactcgccgtacgaaaaaggccacaaatcctcgagatttgcatttttcaggcgcaggatacggttgaagggcaactcctctgtctcgatacccttggggtttgttttattatttccatgcattgtaatagttctcattttactacttttcgtccgacatccgtcatccccaggaggtatattaatacccgcgggcacaccgccgtctataaggaaaataagtgagaaatacgacaaagttttcgcgacgggctgtcagcccatcaacaccgatacaccccgagcgaacgcggctttcgtcgtgctcgcaagaaataaggaaatcgatggcgttatccagtcaatgaagtcgatcgagcgacacttcaaccgctggtaccgctacccttatgtttttctaaacgacgccgagttcgacgataacttcataaatactgtgaagaactatacaagtgcgcccgttgagtttgggaagatcgatgagacaatgtggggttaccctagttgggtcgaccacgaggttgctaaagaaggcatccggaaacaaggagatgccgcaatcatgtatggaggtatggagagctaccatcacatgtgccgcttctactctgggttcttctacaagcacccgctcctcctgaagtacgagtggtattggcgtttggagcccgagatcaagtacttctgcgacatcacctatgatcctttcctcaagatggccgaggccaataaaacgtacggattcaccattgctgtgaaggaacttcgcgagaccgtgccgaatatctttcgctacgcttcagcttacaaacgaaagaacaatataaaatcccaaggactgtgggagatgtttttggaaccccgcgaggaaccaaatccggaggaacagcaacccgagactctccctgaggaaattcttattacggagcccggtgagaagaacgaaattgatcccgaaactatggagggagagagttataacatgtgccatttctggagtaactttgaaattgcgcgcttggacttcttccggagcaaagagtacgaggatttcttcgagatgatggataggagtggtggtttctggatggagagatggggtgatgctcccattcattccctcgctgctggtgtgcttctgtcaccgagtgacatccactatttccgtgacttcggttaccgacacaccacgattcaacactgccctgcgaacgcacctgcccgacaactaccgcgcattccgtaccttgaaatgacgaccgaggacgagaaggagcgtattgaagaggatgagtattgggcaaaccccgatcctgtaaaggaaaatggagttggctgcagatgccggtgtgataccgatattgtggatgtcgaaggcaagcaaggcagttgccttgcggaatgggtggaagttgctggagggtgggcatctccatag

SEQ ID NO: 45580 - protein, 498 aa, Aspergillus nidulans FGSC A4
MGVVQRVRKWLPSTPSLPLDDSPYEKGHKSSRFAFFRRRIRLKGNSSVSIPLGFVLLFPCIVIVLILLLFVRHPSSPGGILIPAGTPPSIRKISEKYDKVFATGCQPINTDTPRANAAFVVLARNKEIDGVIQSMKSIERHFNRWYRYPYVFLNDAEFDDNFINTVKNYTSAPVEFGKIDETMWGYPSWVDHEVAKEGIRKQGDAAIMYGGMESYHHMCRFYSGFFYKHPLLLKYEWYWRLEPEIKYFCDITYDPFLKMAEANKTYGFTIAVKELRETVPNIFRYASAYKRKNNIKSQGLWEMFLEPREEPNPEEQQPETLPEEILITEPGEKNEIDPETMEGESYNMCHFWSNFEIARLDFFRSKEYEDFFEMMDRSGGFWMERWGDAPIHSLAAGVLLSPSDIHYFRDFGYRHTTIQHCPANAPARQLPRIPYLEMTTEDEKERIEEDEYWANPDPVKENGVGCRCRCDTDIVDVEGKQGSCLAEWVEVAGGWASP

SEQ ID NO: 45581 - DNA, 1350 bp, Aspergillus nidulans FGSC A4
  CDS (1)..(1350)
atgggtgggctagcactcttcctcctctccaggcgctcgatccccgttccagacagttcaagctcaatttcaacgcctccgcccccgccctctgaccgacccgtgaacgcattcggatactcacttaatccacaatcaagtagcgaggtagtgaggttcgctgcaagtcatcctggcggtcgtgctaatgcgacctttgtgactctggcgcgaaattcagatgtttgggagattgcgcaggccattcgccaggtggaggatcgtttcaaccgcaacttccactatgactggatcttcctaaacgaccaaccattcgatgacaactttaaacgtatcacgacatcactggtgtccggcactacgcgttatggcgagattccgaaggagcattggtcctatccagactggatcgaccaggacagggcaagggaggttcgggaagagatgaaggagaagaagattatttatggtcactcggaaagttaccgacatatgtgccgttatgaatcgggattctttttccgtcatcctctgctgcaggagtacgagttctattggcggattgaacccggcgtcgagctgttttgcgacattccctacgacccttttctcttcatgaaggagaacgataagaagtatagcttcgtgatgagtatgtatgaatacgaaggtactatcccgacgctttgggactcggtcaagcagttcatggatgatcaccctgagcacatcgccgaagggaactcgttgcgtttcctgagcgatgacaatggcaaaacctacaacaaatgccacttctggtcgaattttgagatcggcagcctggattggttgagatccaaggagtacctggactactttgactttctcgaccgggcaggcggcttctactatgaaagatggggtgacgcgcctatccattcgattgccgctggcttgctcctcaagaaagaacaactgcacttctgggacgagatttcctactaccacataccctttacccattgtcctcgtgatgaacaactcaggatggacctccgatgtagctgcgacccatcaggaaactttgactggaggggtttctcatgcctttcccggtattacaagaccaacaatatcccattgcccccaggtgttgacgagtacagctggctagctattttcggaataattgttggtctgttggccgttgctgggatcgtagcaaccgccgtcaaccatcaagcccgaagccacgcgcttcaagaagtacagtacttatactggcaaagccagactctctgggagcggtatcagaaagagaaacgcgagtgggagcgagagaggatggggcgagcatggtcgccataa

SEQ ID NO: 45582 - protein, 449 aa, Aspergillus nidulans FGSC A4
MGGLALFLLSRRSIPVPDSSSSISTPPPPPSDRPVNAFGYSLNPQSSSEVVRFAASHPGGRANATFVTLARNSDVWEIAQAIRQVEDRFNRNFHYDWIFLNDQPFDDNFKRITTSLVSGTTRYGEIPKEHWSYPDWIDQDRAREVREEMKEKKIIYGHSESYRHMCRYESGFFFRHPLLQEYEFYWRIEPGVELFCDIPYDPFLFMKENDKKYSFVMSMYEYEGTIPTLWDSVKQFMDDHPEHIAEGNSLRFLSDDNGKTYNKCHFWSNFEIGSLDWLRSKEYLDYFDFLDRAGGFYYERWGDAPIHSIAAGLLLKKEQLHFWDEISYYHIPFTHCPRDEQLRMDLRCSCDPSGNFDWRGFSCLSRYYKTNNIPLPPGVDEYSWLAIFGIIVGLLAVAGIVATAVNHQARSHALQEVQYLYWQSQTLWERYQKEKREWERERMGRAWSP

SEQ ID NO: 45583 - DNA, 1188 bp, Aspergillus nidulans FGSC A4
  CDS (1)..(1188)
atggctgtcgctagacctattcgcatgctctctgcggcatgcgtggtactcgtgatttttctggtgttccagatgaagaggagcccttcatatgtcggcatggggccaggcgaatacaacggcatgactgcggaccctctgaatgatccaaccggtgagcctgatggctatctgtggcgcgccgacgaacacgactacgctcctgacagcaccaactccgcccgaaccaatgcagccatcatctccctcgtgcggaacgaagagctgaacgagctgcttccaagcatgcgcgacttggaaaggacatggaaccacaaatttaactacccatggattttcttcaacgacgtgccgttcaccgaggagtttaagaaacgaacacaggctgagactaaggccaaatgtcaatacgaattggttcccaaagagcactgggaagtccctagcttcattgacatgaaccttttcaaagagtccgcggcgctcctgaaagagaagggattacagtacgccgataagatatcctaccatcagatgtgccggtggaacagtggcatgttctacaagcacccagcgcttaaagattatcgctactactggcgcgtggagcccaaagtccagttcttttgtgatgtcgattatgatgtcttccgcttcatggaggaccgcaacaagacttacggtttcacgattaatttgttcgatgctcccgagagtatcccatccctgtggccgacgacacaggagttcctcgccgcgaatccatcttacctctccgataacaacatgatggactggttgactgacgaccagctccgaccggaccacacccgcgatgcgaacggatactcgacctgccatttctggtccaactttgagattggtgatatggagttcttccgcggtgacaaatactctgcgtactttgatttccttgatcacgctggtggtttcttctacgagagatggggtgatgctcctgttcattcgatcggtttgggattgttcgaggacaagaacaaggttcattggttccgcgacatcggataccgccatattccttacttcaactgccccaactcgcccaaatgttccgcttgcacccctggcaagttctacgaaggcgcatcgttccttgctaaggaggactgccggcccagctacttcaagcacgttgggacccattaa

SEQ ID NO: 45584 - protein, 395 aa, Aspergillus nidulans FGSC A4
MAVARPIRMLSAACVVLVIFLVFQMKRSPSYVGMGPGEYNGMTADPLNDPTGEPDGYLWRADEHDYAPDSTNSARTNAAIISLVRNEELNELLPSMRDLERTWNHKFNYPWIFFNDVPFTEEFKKRTQAETKAKCQYELVPKEHWEVPSFIDMNLFKESAALLKEKGLQYADKISYHQMCRWNSGMFYKHPALKDYRYYWRVEPKVQFFCDVDYDVFRFMEDRNKTYGFTINLFDAPESIPSLWPTTQEFLAANPSYLSDNNMMDWLTDDQLRPDHTRDANGYSTCHFWSNFEIGDMEFFRGDKYSAYFDFLDHAGGFFYERWGDAPVHSIGLGLFEDKNKVHWFRDIGYRHIPYFNCPNSPKCSACTPGKFYEGASFLAKEDCRPSYFKHVGTH

SEQ ID NO: 45585 - DNA, 1206 bp, Candida glabrata CBS138
  CDS (1)..(1206)
atgtcgaaacttagaatacctcctggtaaggaacctctggtgaagagaattggtatcgctttggtacttttcctgtccaccttcttcctctactctactgtttctggcggtgagttcttccactctggcaagcctgtgaagggtgcttctactgctatcacgggtaacactggttacaagtacacttatgccgacgaggacggccattacccagaaagcaagaaggttagagctactttcgtgactttggtccgtaacaaggacttgtgggaactgctgccaacgatcaagaacgtcgaagacagattcaaccgccatttccactacgattgggtgttccttaacgatgagcccttcactcaggaatttatcaccaccaccactgctatgacctctggtaagaccaaatacggtctaatccctcgtgagcactggtcctaccctgaatggatcgaccaggaaaaggccagactcaccagagaagaaatgaagaagcaaaagattatctacggtttctctgagccttatagacatatgtgtcgtttcgagtccggtttcttctacagacaaaaagtccttgatgagtacgaatactactggcgtgtggaacctggtaccaagttgcactgtgatgtcaattacgatgtctttaagttcatgaaggacaacggtaagaagtacggtttcaccgtctctttgttggaatacgaagcaaccatcaagaccttatggcaaaccactgttgaatttatcaagaagttcccacaacacttggcaaagaacagcatgttggatttcatctctgacgaccaaggtgagtcttacaacttgtgccatttctggtccaactttgaaatcgcctccttggacttatggagaggtgaagcctacagtgcttactttgattacttagaccatgctggtggtttcttctacgagagatggggtgatgctccagttcactcaattggtgctgcgttgttcttggacagagatgaaattcaccacttcggtgacttgggatactaccatcctcctttccatgcttgtccaattgacgaaaacatcagattatctaacagatgtgattgtcatccaaacaaggactttacttgggtgccatactcttgtgctctaaagtactacaacgttaacaagttgacaaagccacttggatggcaagagcacgttggcatgaaggtctga

SEQ ID NO: 45586 - protein, 401 aa, Candida glabrata CBS138
MSKLRIPPGKEPLVKRIGIALVLFLSTFFLYSTVSGGEFFHSGKPVKGASTAITGNTGYKYTYADEDGHYPESKKVRATFVTLVRNKDLWELLPTIKNVEDRFNRHFHYDWVFLNDEPFTQEFITTTTAMTSGKTKYGLIPREHWSYPEWIDQEKARLTREEMKKQKIIYGFSEPYRHMCRFESGFFYRQKVLDEYEYYWRVEPGTKLHCDVNYDVFKFMKDNGKKYGFTVSLLEYEATIKTLWQTTVEFIKKFPQHLAKNSMLDFISDDQGESYNLCHFWSNFEIASLDLWRGEAYSAYFDYLDHAGGFFYERWGDAPVHSIGAALFLDRDEIHHFGDLGYYHPPFHACPIDENIRLSNRCDCHPNKDFTWVPYSCALKYYNVNKLTKPLGWQEHVGMKV

SEQ ID NO: 45587 - DNA, 1392 bp, Candida glabrata CBS138
  CDS (1)..(1392)
atggctattttcttgtcaaagaggctgatcaggctatgtgccatggtcaccgtgttgttgctactattggcaactttgaacacacaccagtccagttctcaatatgtgagcggttatctgccatcgcaattgaggttaccagacagttctaactttggcttccctagtggtggtgcctccgatgtcacggtaggccaaaccaccgaacttgaggaccctaccaaagagctagaggctgccagagccaaggctgacaaggataccgatgctggtaatatttccaatccggacgagaaggcaccaggcgattcaggcaaagctctagagcaagctgccaatgctgaggccgctgttaaggatatgaccaagaaggatattgaggagtacctggccccatcttttgccaacaagggtaagagaccaaaggccgcctttgtcactctgattagaaacagagagctaaacgacatcttggaaccaatgaacatggttgaaaagagattcaacaagaactaccattacccatgggtcttcttgaacaacgagccatttaccgaagaattcaaggaaactgtcaaaaagcatgcctctggtgaagttatcttcgacttgattcctaaggagcactggggctatccagattatgttgaccaagataaggccgctatcgagagaaagaagatggccgacaagaatattatctacggtgatagtgaatcttatagacacatgtgccgtttccaatctggtttcttctggagagaaaaggctttagaagactttgactggtactggagagtcgaaccaagcacaaagatttactgtgatattccttacgatccattccaatacatgcaagacaacaagaaggcctatggtttcacaatcactatccatgaatacagatctactatcgaatctctttggaagaccgtcaaaaacttcatcaaggacttccctcagtacttggccaaggataacttggagaagtttgtctctgaagacaacttagaagaatacaacttgtgccacttctggtctaacttcgagatcgctaacttgaacgtttggagatcaccagcttacagagatttctttgattacctagataagactggtaactttttctatgagagatggggtgatgctcctgtccattctatttttgtctctttgttcttaccaaagagctacttacactatttcaacgattttggctactaccatcctccttataaccactgtccaattgacaatgaaattttcagagacagaaactgtgactgtactcaaaaggatgacttcaccttcaagggttattcttgtggtattcaataccataatgctcaaggtatcaagaaaccaagcaattgggaagattacagcgattaa

SEQ ID NO: 45588 - protein, 463 aa, Candida glabrata CBS138
MAIFLSKRLIRLCAMVTVLLLLLATLNTHQSSSQYVSGYLPSQLRLPDSSNFGFPSGGASDVTVGQTTELEDPTKELEAARAKADKDTDAGNISNPDEKAPGDSGKALEQAANAEAAVKDMTKKDIEEYLAPSFANKGKRPKAAFVTLIRNRELNDILEPMNMVEKRFNKNYHYPWVFLNNEPFTEEFKETVKKHASGEVIFDLIPKEHWGYPDYVDQDKAAIERKKMADKNIIYGDSESYRHMCRFQSGFFWREKALEDFDWYWRVEPSTKIYCDIPYDPFQYMQDNKKAYGFTITIHEYRSTIESLWKTVKNFIKDFPQYLAKDNLEKFVSEDNLEEYNLCHFWSNFEIANLNVWRSPAYRDFFDYLDKTGNFFYERWGDAPVHSIFVSLFLPKSYLHYFNDFGYYHPPYNHCPIDNEIFRDRNCDCTQKDDFTFKGYSCGIQYHNAQGIKKPSNWEDYSD

SEQ ID NO: 45589 - DNA, 1275 bp, Candida glabrata CBS138
  CDS (1)..(1275)
atgcatgcgcatcaagtcaatattaaggccgtcatactgctcactacattaaccgtgctggtgtggttaccatcctttcgagaatggaatcgtatcttaagtttaagaagcaaagatcagcactatttagacaagtcagcactgatacgatctaaatatctacagaaaaccagagatactatttataaacctctcaaaatgtcttcacatactgctgctgataataataatctcataactacatctatggatattaataactttgagaaacaaaatgcaacatttgtgatgctggctcggaatagcgatgtgaatgatgcagttgaggctatcaaatctctagagtcacgcttcaatcacaaataccattacgattgggcttttttcaatgatgtaccctttgatgaagatttcatcaggcgtacaacagaagttgccagcggcaagactcaatatggactgataccgaaagataactgggatataccgtcatggatcaataaaacaacgatgaacaataatatgaatatctttaatgaagaaaatatgctgtatggctcatctatatcatacagaaatatgtgtcggtacaattctggatttttctttaggcagaaattacttgatggctatgattattatatgagagtggaccctgatgtacattttctttgcgatcttccttacgacccttttgaaatgatggtggttaaccataagaaatacggatttgtaataaccatgcatgaaataggcagcacaatccctacactttgggatactgttaaaaaatttataagtcaacacagtgacctaatcaacaaaaataatctacttggctttttaacagataagaatgatcttggaaagaacaaatttaaagcacacttccaagacgattacaatctttgccatttctggactaatttagaagttggtgatctgaattttttcaggagtgacaaatatttgaagttttttgatttcctagacgccaacggtgggttctactatgaaagatggggtgacgcacctattcattccattgcagcagctttgttcttagataaggatgaaattattcattttgaagagattgggtatcaccatatgccatattaccattgccctatgccgaatgcattttgggattctcacaaatgcgcctgttctagatctggtcaattcaacgttataaataatgaaataaactgcttgcctagatattggaaacataatggtaaaacgtttgtcaaagaaccagggcatttttga

SEQ ID NO: 45590 - protein, 424 aa, Candida glabrata CBS138
MHAHQVNIKAVILLTTLTVLVWLPSFREWNRILSLRSKDQHYLDKSALIRSKYLQKTRDTIYKPLKMSSHTAADNNNLITTSMDINNFEKQNATFVMLARNSDVNDAVEAIKSLESRFNHKYHYDWAFFNDVPFDEDFIRRTTEVASGKTQYGLIPKDNWDIPSWINKTTMNNNMNIFNEENMLYGSSISYRNMCRYNSGFFFRQKLLDGYDYYMRVDPDVHFLCDLPYDPFEMMVVNHKKYGFVITMHEIGSTIPTLWDTVKKFISQHSDLINKNNLLGFLTDKNDLGKNKFKAHFQDDYNLCHFWTNLEVGDLNFFRSDKYLKFFDFLDANGGFYYERWGDAPIHSIAAALFLDKDEIIHFEEIGYHHMPYYHCPMPNAFWDSHKCACSRSGQFNVINNEINCLPRYWKHNGKTFVKEPGHF

SEQ ID NO: 45591 - DNA, 1281 bp, Candida glabrata CBS138
  CDS (1)..(1281)
atgggagctgttaagaagaagcttatgccgaagtcggcgatgtttgtaaggaagtatgaaaagaccattcgtgttgggtttgcatctttccttatggcgctgactgttctatttctgatgcacaagcccgatgcgggcactactgcgatggcaccccagcagacaatggctggtttcactagcgttgttaagaatggccagcctgggtatgtgattcctgcctctgatctactgcaggacgtcaaggaacatcctctggatgatggtgtcaaggaaaaggctgcatttatcactctggctagaaatggtgacttgtggtctttggtaaatacaataagacatgtcgaggacagattgaaccatcgttatcactatgattgggtattcctgaatgacaaaggtttcaccgatgagtttatccgcttgacatctgcattggtctctggtaaagctaagtacggtaaagttcctaaagaacattgggaagttccatctcacattgacaaggagaaatatgaaatctctaggcgtaaaatggtcctagacaaagttccatacggtgattcgacaccatacagacacatgtgccgttaccaatcaggtcttttctatagacatgaacttgtgcaagagtacgactattactggagagttgacacagacatcactgttttttgtaatttccaatacgacatcttcaagttcttgagacagaacaagaagaagtacgggttcgtaatttcattgacagaatacgaggagaccattccaacgttgtgggctactgtgaaggaattcatgaagaaatacccacaacacattcataagaataacttcttgaactttatcagtgacgatggcggtgagacatacaatggctgccatttctggacaaatttcgaagtcggtgacttgaacttctggaggtcacaagcttacacggatttcttcaatttcttggatcagaagggtggtttctattacgaaagatggggtgatgcgcctgttcattccattgctgcagcactgctgttagacaaggatgagattcatttctttgacggtttcggttaccaccacccagatttccaatcttgtccacatgaagaagaagtcagactacagaacaaatgtacctgtaattttagcaaggataagatttggatgacgtactacttctgcaatctgcgttactttgaagctaaagaaatcggtctaccaccaaaaattgaagccaacttagacgaagaatacaagaagaaattgaaggtttctagctaa

SEQ ID NO: 45592 - protein, 426 aa, Candida glabrata CBS138
MGAVKKKLMPKSAMFVRKYEKTIRVGFASFLMALTVLFLMHKPDAGTTAMAPQQTMAGFTSVVKNGQPGYVIPASDLLQDVKEHPLDDGVKEKAAFITLARNGDLWSLVNTIRHVEDRLNHRYHYDWVFLNDKGFTDEFIRLTSALVSGKAKYGKVPKEHWEVPSHIDKEKYEISRRKMVLDKVPYGDSTPYRHMCRYQSGLFYRHELVQEYDYYWRVDTDITVFCNFQYDIFKFLRQNKKKYGFVISLTEYEETIPTLWATVKEFMKKYPQHIHKNNFLNFISDDGGETYNGCHFWTNFEVGDLNFWRSQAYTDFFNFLDQKGGFYYERWGDAPVHSIAAALLLDKDEIHFFDGFGYHHPDFQSCPHEEEVRLQNKCTCNFSKDKIWMTYYFCNLRYFEAKEIGLPPKIEANLDEEYKKKLKVSS

SEQ ID NO: 45593 - DNA, 1236 bp, Candida glabrata CBS138
  CDS (1)..(1236)
atgaaggagtggcttatttgggtagtagaggtgtttatatggtggggacagctatggttctgcggtgatattgatcgcaactattttgagagaagtgtggcagtgaagacaaagtacgatggggttaggcgacgtgagtattttgtgccattgaagctggccacgaatagttatgacgacatggctgttttcaccgaactagagtattctcccaaaagggagaacgcaacgttgttgatgcttgttagaaattgggaattgagtggagccctggcgtccatgcggtcgttggaggatagattcaacaggaagtataattatgattgggtcttcttgaatgatgtgccgtttgatgaggatttcatgctggcaacatctgctatggctagtggtatgacttactatggtatggtgccgccccatgaatggtctactccaacttggattaatgaggaccagtacgcacagtgcctgagagacatggaaggcagcggtgtcatatatggtggttcaagatcatacagaaatatgtgcaggttctactctgggtttttctacaagcaggatcttttgaaaaactatgattactacatgagagtagaacccaacgttgagtatttctgtgacttcccatatgacccatttaaagtcatgcgtgcaaataaatacaaatatggcttcttaatgtcattatatgagtacgaaaacactattccacacttgtggcatgcagttgaggattacattaacgaatatggtcacaaactcaattttgaaaacaattcctacagttttttagtggataaagaccatttcagcccaaataccatgggtatcatagagtcacacaccgattacaacctatgccatttctggtccaattttgaagttggagatttaagtttcttcagaagtaaagagtacgaagagttcttcgatttcatggatcaaaagggaggattttattatgaaagatggggtgatgcaccaatacatacaattgctgcatctctactattgaacactagtgaagtgatacatttcgatgaattgggctacagacatgaaccatatctctcctgcccgagatctctgggtatacaattacaacaaagatgcctgtgtgatgtaaactccgatgtcaatttggacatttcattggcaagttgtctacctagatggtggaggaacgggtctggcaaaacgtttgttaaacccaaacaatttacagattaa

SEQ ID NO: 45594 - protein, 411 aa, Candida glabrata CBS138
MKEWLIWVVEVFIWWGQLWFCGDIDRNYFERSVAVKTKYDGVRRREYFVPLKLATNSYDDMAVFTELEYSPKRENATLLMLVRNWELSGALASMRSLEDRFNRKYNYDWVFLNDVPFDEDFMLATSAMASGMTYYGMVPPHEWSTPTWINEDQYAQCLRDMEGSGVIYGGSRSYRNMCRFYSGFFYKQDLLKNYDYYMRVEPNVEYFCDFPYDPFKVMRANKYKYGFLMSLYEYENTIPHLWHAVEDYINEYGHKLNFENNSYSFLVDKDHFSPNTMGIIESHTDYNLCHFWSNFEVGDLSFFRSKEYEEFFDFMDQKGGFYYERWGDAPIHTIAASLLLNTSEVIHFDELGYRHEPYLSCPRSLGIQLQQRCLCDVNSDVNLDISLASCLPRWWRNGSGKTFVKPKQFTD

SEQ ID NO: 45595 - DNA, 1599 bp, Candida glabrata CBS138
  CDS (1)..(1599)
atgagggtaaaggtcaaaaggtgggtaaatgatgcagtagaggaagtattagattggctattgtcaaccattgcgatatatatgtatattacagccattatttgtgggacattcttatattttacttacccttctcgaactgatatacgattttactccgagcaggatttgggtaccgaaagagatgcaccattctactatggttgtgtgaacacagagggatatttacaagcaccagaatataagaagatgaatgcagcctttgtcatgcttacgcggaataacgaattgaaggatgtattgtcttcaatgaatagcattgaagcgcatttcaatcaatggtttaaatacccatacgtgttcctgaatgacgaaccgttcagcgaagaatttaagaaatcaatacgtgaagctacagatgctgatatcgaatttggtacactagatgaaagtcaatgggagtttccagaagaagtaagaaacacattcgaatatcagaatgccataaccgatcagggagacagaggtatcttgtatggtaatatggaatcataccataagatgtgtcggttctattcgggcatattttacaaacatccattgatgcagaaatatgaatggtattggaggttagaacctgatgtggagtttttctgtgatttgacatatgatccattttttgaaatgcatagaagaaataaaaagtatgcattcaccatgattatacctgaaatttactggactgtgccgaacttgtttaggtacacaaaggcatttattagagagtatggcgtaaaagtggggacactttggaagcttttcgcaacaaattatgatattctgaagaccgataaaggaagagatgaatttactgactatgaaaatatggttagagatgatcttcatcagtgggtaaaatttggtggtgatgtggaacccaagttatcagagaaggtagctatcgaccatttacttgaatcggaaactgcagacgatgacgtagggttgatgttcttggtgaacagggctaggtcaaaggtaccactaatcgaagatgaatttgagggagaagaatataatttatgtcatttctggtcaaacttcgagatagcaagattggatgtttttgataacgaagtctacaacagttatttccaatatttagaagctagtggtggtttttggaaagaacgttggggggatgcaccagtacattctattggattagcattgactctagacgtagacgatatacattattttagagatattgggtatatgcattccattttgaaacattgtccaaagaactcacctgatttaaacgaattccaatacaagcccgctaataagaaatacaagaggagctcctggactagatatgatactccaattgaagggggtagcggttgtcgttgtagatgtcctagtaaaccggctgaggtagaagatactatcacattttgttttgaaaaatggatggatgtgacacatttgaagaagggagaggtagagctataccaactattcaacattgaagagaaagaggaaatggtgagaaatgattttgaaaggcaccatcaacagcagaatcagtaa

SEQ ID NO: 45596 - protein, 532 aa, Candida glabrata CBS138
MRVKVKRWVNDAVEEVLDWLLSTIAIYMYITAIICGTFLYFTYPSRTDIRFYSEQDLGTERDAPFYYGCVNTEGYLQAPEYKKMNAAFVMLTRNNELKDVLSSMNSIEAHFNQWFKYPYVFLNDEPFSEEFKKSIREATDADIEFGTLDESQWEFPEEVRNTFEYQNAITDQGDRGILYGNMESYHKMCRFYSGIFYKHPLMQKYEWYWRLEPDVEFFCDLTYDPFFEMHRRNKKYAFTMIIPEIYWTVPNLFRYTKAFIREYGVKVGTLWKLFATNYDILKTDKGRDEFTDYENMVRDDLHQWVKFGGDVEPKLSEKVAIDHLLESETADDDVGLMFLVNRARSKVPLIEDEFEGEEYNLCHFWSNFEIARLDVFDNEVYNSYFQYLEASGGFWKERWGDAPVHSIGLALTLDVDDIHYFRDIGYMHSILKHCPKNSPDLNEFQYKPANKKYKRSSWTRYDTPIEGGSGCRCRCPSKPAEVEDTITFCFEKWMDVTHLKKGEVELYQLFNIEEKEEMVRNDFERHHQQQNQ

SEQ ID NO: 45597 - DNA, 1434 bp, Candida glabrata CBS138
  CDS (1)..(1434)
atggagaccagggggttgatacactggttgcggtactactacaaagtctttcaccggaacaggactctgaaagcggtcgctgtgcttctgagctttgtgctgttcatatactacgtgcgtaactcagacatcactgataaactggttacgtttgctggcgaggagaacgtcaagagcttacacgctgtgaaggcgaacatcagggcgaactggaaccaggaggacgatggggacaagttcaagaaggacctaagtgcttctttgcaagtgaagctcgacaacatactggggactcaaaacatgtcccttgccgagatgggcgagctgccaatcgatgcagagacgatcgaggagcagaagagtattcgttacgccaagctgttgaaggatcacaaggccacggagaacagcacaatggggttcctcttcaagtctttggctaacgaagggctgaaaccctcagcatgcatatattcttttgtcacgggcaactcagaattgaggaagctactaagaactatagagtctgtacagaagaagttcaatcacaagttcggttacccctgggtgatcatcagtcccgagcccttgtcagagaagttccatgccgacgttgaaaagaaactagaagagttcacatctgctatagacgatgtcaagactgaggtggagtttggaaccgtgccgcctgaacattgggggttccctgattttatcgactcaaccgtggcttcaaacgccagaattgatctgttcgatattcccaacggtgactcgcaattattcagattaatcaatagatacaacgctggcctggcagctcatcacacattgctgaaaaagtatgattggtacatgcgtgtgagccccggcatacggttgaattgtgagatggaatacgacataatgaggtggatgcaggataaccgtaaaatatttggattcactttatcaatcaaagaaattgaacgttctgcaaagaaaatatggggccataacttgaatttcactgcacacaaccgagaattctacaaccccattgaaaagtcaagtttaagatcttacatccaagttggaagagatacatacaattattgttccttctctaccgatttgcaaattgtgaatctgaacttcttgagatcaccagtatacacaaaatattttgagtacatggacaaagcaggaggcatattctatgagagatggtccgatagcattatccagtcaatggcatattcaactatggtaccagctaaaatgattcaacatatcagcccaatgggataccagaataaagagacagtagtgtgccctgcagatgatataatgtggagggaatataaatgtgaatgtgatcaaggtagtgatatttcctttaaccgtgacttaacttgcacgcagagatacaaagacactcaaggaatgttttga

SEQ ID NO: 45598 - protein, 477 aa, Candida glabrata CBS138
METRGLIHWLRYYYKVFHRNRTLKAVAVLLSFVLFIYYVRNSDITDKLVTFAGEENVKSLHAVKANIRANWNQEDDGDKFKKDLSASLQVKLDNILGTQNMSLAEMGELPIDAETIEEQKSIRYAKLLKDHKATENSTMGFLFKSLANEGLKPSACIYSFVTGNSELRKLLRTIESVQKKFNHKFGYPWVIISPEPLSEKFHADVEKKLEEFTSAIDDVKTEVEFGTVPPEHWGFPDFIDSTVASNARIDLFDIPNGDSQLFRLINRYNAGLAAHHTLLKKYDWYMRVSPGIRLNCEMEYDIMRWMQDNRKIFGFTLSIKEIERSAKKIWGHNLNFTAHNREFYNPIEKSSLRSYIQVGRDTYNYCSFSTDLQIVNLNFLRSPVYTKYFEYMDKAGGIFYERWSDSIIQSMAYSTMVPAKMIQHISPMGYQNKETVVCPADDIMWREYKCECDQGSDISFNRDLTCTQRYKDTQGMF

SEQ ID NO: 45599 - DNA, 1335 bp, Kluyveromyces lactis NRRL Y-1140
  CDS (1)..(1335)
atgcaaacttcatgcatatataagatgatctatagcgatggcagttccctagctgggtattcgatgttcgcccttcggagagtgtaccttggtgcctacgctgctattgtatcactgtcattgactttataccttatccgtgtgggttttgctgtcattaaggaagtatatctgcatcaaagaatagaacaaggctttttccctagatccgaagatgtcctacacaaatatgacaacataaggcggttcaataagagttttggtgaattgaaaccggcaagcaattcatatttagatgatttgatcattccagttgagagagattctatcattcaagaaagagagaatgccacaatattgatgttatgccggaattgggagataccaggtgttttgcaatctatgcgctcattggaagataggttcaatagacggtataaatatgactggacgtttctcaatgatgtcccattcgatgattacttcattgaagccaccagtgctatggctagcggtaaaacaaagtacggattgatacctagtgaagattgggaccgcccagcttggatagatgaagaattattcgaggaaaggctgcagatgctaaaggaaaagaaggtaatatacggagactcgaaatcgtatcgtaatatgtgtcgtttcaatagtgggttctttttcagacaaaagcttttggaccaatatgattactattttagagtcgaacctgatgtggaatacttctgcgatttcccatatgatccattcaaagtcatgcgggagaagaagaagaaatacggatttgtgatatctatctttgaatatgaggatacggtaacgacattatgggatgctgttgaggaattcatggatacttatccagaaattctacatcctaacaacagtctaagctttttgacggataccacgatggtgggacgttttttccctgttgttgattcgaatacagactataatctatgtcatttctggtccaatttcgaaattggagatctaaatttctttagaagtgacgagtatcttcagtatttcaattacttggactccaagggtgggttttattatgaacgttggggtgatgcacccgtgcacagtataggtgcctcattacttctagacaagaatgaaatccaccactttgatgaaattggatacagccatgttccatttgaaacatgtcccacgtccatatcagcacgattagtgctccgttgtatgtgtgatcctaacggcgaatctaatattcccatccacccaaacagttgcttgatgagatggtggaaaaacggtgccggcaaactatttattagatga

SEQ ID NO: 45600 - protein, 444 aa, Kluyveromyces lactis NRRL Y-1140
MQTSCIYKMIYSDGSSLAGYSMFALRRVYLGAYAAIVSLSLTLYLIRVGFAVIKEVYLHQRIEQGFFPRSEDVLHKYDNIRRFNKSFGELKPASNSYLDDLIIPVERDSIIQERENATILMLCRNWEIPGVLQSMRSLEDRFNRRYKYDWTFLNDVPFDDYFIEATSAMASGKTKYGLIPSEDWDRPAWIDEELFEERLQMLKEKKVIYGDSKSYRNMCRFNSGFFFRQKLLDQYDYYFRVEPDVEYFCDFPYDPFKVMREKKKKYGFVISIFEYEDTVTTLWDAVEEFMDTYPEILHPNNSLSFLTDTTMVGRFFPVVDSNTDYNLCHFWSNFEIGDLNFFRSDEYLQYFNYLDSKGGFYYERWGDAPVHSIGASLLLDKNEIHHFDEIGYSHVPFETCPTSISARLVLRCMCDPNGESNIPIHPNSCLMRWWKNGAGKLFIR

SEQ ID NO: 45601 - DNA, 1284 bp, Kluyveromyces lactis NRRL Y-1140
  CDS (1)..(1284)
atgagtggcatattgcataatgtacagaagagaacatcagctatcaagactttgttgctagtgctgttcttgtttcttgtgatatacactatgagaattgagaatgttgggaaagtgaaaaccggatcgagggttgatgatagcatggaatcaaaggataatagattggaatatatgaaatcaagtgattcccagcttccaccagttagtcttaatagagtcctagatcaaaagtgggaaaaacgctaccctttcgacgctgctggatctggggctgtgtatgactccgtggttcatgggaccaaggataaacccaaggcatgtttcgtatcattggtccggaatgaagaactatgggatttggctaaatcgatttcatctgtcgaagatcgtttcaacaataagtttaattatccatggatcttcctaaacgatgaaccatttaccgaagagttcaaagaacgtatctctgccattgttccaaactctcaattcggtgttataccgaaggaacactggtcatacccagattatgtttctaaagaacgtgcagctcaaactagaattgacatgcaggatataatctacggtgcttccgagagttatcgtcacatgtgtcgctttcaatcggggttctttttccaacatccattattagccgagttcgattggtactggcgtgtcgaaccaagtaccgaattgctatgctccatcgattatgatatcttccaacagatgcaggataaagacttaggtctcggattcgtcatttctatccatgaatttgtcatcacaatcccaactttatggaacactactcgtgggttcgcagaaaaacattcagaatacatccataacgacaatttgttgaagttcatatccgatgatggtggtgatagttataacttgtgtcatttctggtcgaatttcgaagtcgccaacctaaatttctacagatcaaaagcatacacggactatttcgattatcttgatcgctcaggtggattcttctacgaacgctggggtgatgctcccgtacattcaattgctgcatcgcttttcttgcctcgcaacaaattgcactttttccaagatattggatatcatcaccctccatacaacaattgtccgttcgacagcggaattagagccaagggtaaatgttactgtgacccaaaaaccgatttcacattcagggattacgcttgtggtattcaatattacgaggcccaaggcattgaaaaaccctttaattggaaagattatagtggccgaggctattga

SEQ ID NO: 45602 - protein, 427 aa, Kluyveromyces lactis NRRL Y-1140
MSGILHNVQKRTSAIKTLLLVLFLFLVIYTMRIENVGKVKTGSRVDDSMESKDNRLEYMKSSDSQLPPVSLNRVLDQKWEKRYPFDAAGSGAVYDSVVHGTKDKPKACFVSLVRNEELWDLAKSISSVEDRFNNKFNYPWIFLNDEPFTEEFKERISAIVPNSQFGVIPKEHWSYPDYVSKERAAQTRIDMQDIIYGASESYRHMCRFQSGFFFQHPLLAEFDWYWRVEPSTELLCSIDYDIFQQMQDKDLGLGFVISIHEFVITIPTLWNTTRGFAEKHSEYIHNDNLLKFISDDGGDSYNLCHFWSNFEVANLNFYRSKAYTDYFDYLDRSGGFFYERWGDAPVHSIAASLFLPRNKLHFFQDIGYHHPPYNNCPFDSGIRAKGKCYCDPKTDFTFRDYACGIQYYEAQGIEKPFNWKDYSGRGY

SEQ ID NO: 45603 - DNA, 1221 bp, Kluyveromyces lactis NRRL Y-1140
  CDS (1)..(1221)
atgagcgagaccagaatcaataaggagcgttctgcgcgtctccttgggataattatcgttgctgcaattaccatctatttgttgttccaaggtgcttcatacaatggtggatacagcactggtgtgtcatcttcgcagaatgcaaatcagtacgagaccgttcgcatgaagggtgattcccgtgttgttgtagacccaaacacagggttgaagtacaccaccgtcgattccggtaagtacactggctccaaggttaaggcaacttttgtgactttggcacgtaacggtgatttgacagaattattgtcatctattaggtctgttgaagatagattcaacaagaagttccaatacgattgggtgtttttgaacgatgaagagttcacagatgacttcaagaatacagttgcttctatgattagtggtaacgtcaagtttggcctaatccctgtcgaacactggtcctatccaagctggatcgaccaggaaaaggctgctcaagtcagagctgatatgaaagccaagaagattatctatggtcattcggaatcatacagacatatgtgtcgttatgaatcaggattcttctatagacacaaattgatggatgaatacgagttctactggcgtgttgaaccaggtgttaagatctactgtgatatcgattacgacattttcaaattcatgaaggataacgataagaagtacggtttcaccatctctttgagagaatacgaagctaccatagaaacgttgtggaagaccgttttcgaatttaaccaggcaaacccacaatatttgcacaagaacaacatgatgaagttcatctcagatgataacggtgcttcttataacttgtgtcatttctggtcgaacttcgaagtcgcatccctagaactatggagaagtgaagcctacacaaagttcttcgatcatttggatcatgctggtgggttcttctacgaaagatggggtgacgcccctgtccattctattgctgctgcattgtttttggacaagaaccaaatccatcatttcaatgacgtcggttactaccacgttccattccattcctgtccagtttctgatgcattcagaagggatcacagatgtgtctgctccccaagtgatgatttcacttggaaatcttactcctgtactccacagttctacaacgttagaaacttgaagaaacctgagggctggcaaaacttcacatga

SEQ ID NO: 45604 - protein, 406 aa, Kluyveromyces lactis NRRL Y-1140
MSETRINKERSARLLGIIIVAAITIYLLFQGASYNGGYSTGVSSSQNANQYETVRMKGDSRVVVDPNTGLKYTTVDSGKYTGSKVKATFVTLARNGDLTELLSSIRSVEDRFNKKFQYDWVFLNDEEFTDDFKNTVASMISGNVKFGLIPVEHWSYPSWIDQEKAAQVRADMKAKKIIYGHSESYRHMCRYESGFFYRHKLMDEYEFYWRVEPGVKIYCDIDYDIFKFMKDNDKKYGFTISLREYEATIETLWKTVFEFNQANPQYLHKNNMMKFISDDNGASYNLCHFWSNFEVASLELWRSEAYTKFFDHLDHAGGFFYERWGDAPVHSIAAALFLDKNQIHHFNDVGYYHVPFHSCPVSDAFRRDHRCVCSPSDDFTWKSYSCTPQFYNVRNLKKPEGWQNFT

SEQ ID NO: 45605 - DNA, 1569 bp, Kluyveromyces lactis NRRL Y-1140
  CDS (1)..(1569)
atgaggaatagaaccagaaagctactgatagtgataacaattgcacttctaatttgtgttggtgtacaccatattgtgcgaacggaagaagctgcaatatgggaagatgctgtagtctactcctcagcggatcgcgcctctaagaaggaacatcccttctttgaagggtgtgtggatactgcagaatatctaaatcacaaaaaatatgaacgacagaatgccacatttgtgatgttaacaagaaacgaggagctggatggggtaattcacactatgagatctgtggaaagaagattcaatcaatggttccaatatccgtacgtttttatgaacaacgaaccattcactgatgaatttcaagaaagagtccgatcattaacaactgccaacataacgtttgcccttgtagatgagtcctcatggaatttccctaaggagaacactccactatttcagcattacgttgaatcccagggtgatcgtggaattatgtatgggaatatggtttcataccataagatgtgcagattttattccggactcttctataaacaccctgcagttaggcaatacgagtggtactggcgtattgaaccagatgtggaattcttctgtgatctaacttatgatccattctttgaaatgaagaaggcaggaaagaaatacggtttcacaatttttatcaaagaaatatattggactgtgccgaacttatttagagcaaccagaagtttcatcaagcaaaacgatatcaaactcggatcactgtggaaagcctttattaagaatagaaacgttttactcggagatgattatttaaattcctttgtcaatgaactagaagaattgaacgaagaaatgacccacgaatttctgattgactatttgaagaagaattgggcaagagaaaaagtcatagatgacgagctaatacaagaaattgctcatagggtcaggaggaaagttcctgtcgttgaagacaaatttgaccaagaagagtacaatttatgtcatttttggtccaatttcgaaattgctagagttgatgtatttgataatgaagtatacaacaagtatttcgaataccttgagtcgtggggtggattctggcaagaaagatggggggatgcgcctgtgcattcgttaggtttggccttaacattgaatgcagaagacatccattatttcagagatatcggatatcaacatactacaatcgtacactgccccaacaacaaagagggaaagcaattaccatatgtggaatcgtcaaaatacacagaaatattcgaaagagagtcatctaggatgagtgtaaaagagaaagcgttacaatatttcaagactggcaaaatagacgatggttgggatacaggaagtggatgcagatgccaatgccccgatattatagatgtggaggatacatcgcaccaatgcctcatgcaatggttcgacctagtgagcgattctccatcgcgagaagaatccctactaccgtttaatgcagcagaattaaaagtagcactcgctaatgactacaaaagacattttgcgaagaataataattaa

SEQ ID NO: 45606 - protein, 522 aa, Kluyveromyces lactis NRRL Y-1140
MRNRTRKLLIVITIALLICVGVHHIVRTEEAAIWEDAVVYSSADRASKKEHPFFEGCVDTAEYLNHKKYERQNATFVMLTRNEELDGVIHTMRSVERRFNQWFQYPYVFMNNEPFTDEFQERVRSLTTANITFALVDESSWNFPKENTPLFQHYVESQGDRGIMYGNMVSYHKMCRFYSGLFYKHPAVRQYEWYWRIEPDVEFFCDLTYDPFFEMKKAGKKYGFTIFIKEIYWTVPNLFRATRSFIKQNDIKLGSLWKAFIKNRNVLLGDDYLNSFVNELEELNEEMTHEFLIDYLKKNWAREKVIDDELIQEIAHRVRRKVPVVEDKFDQEEYNLCHFWSNFEIARVDVFDNEVYNKYFEYLESWGGFWQERWGDAPVHSLGLALTLNAEDIHYFRDIGYQHTTIVHCPNNKEGKQLPYVESSKYTEIFERESSRMSVKEKALQYFKTGKIDDGWDTGSGCRCQCPDIIDVEDTSHQCLMQWFDLVSDSPSREESLLPFNAAELKVALANDYKRHFAKNNN

SEQ ID NO: 45607 - DNA, 1251 bp, Kluyveromyces lactis NRRL Y-1140
  CDS (1)..(1251)
atgatcggtaaattacatctatcgaaaagaacggtacgaaatggtatcatattgatcacgataatcggattaatttatggattctggtcgacttatgggatcgaagatagaattgccgagttaaaaccagaaccagaatcagaaccaaaatcatcggtacaggacgagaaaccagttgaaaagttttatactgatgataggggtaatgatattatactttctttggtgcgaaacgaggaattggatggtatgttgcaatcaattagacaattcgagagacgattcaacaagaaataccattacgattggtggtttgtaaacgataaaaagttcactgaagagttcatcaatggtacttctaatgaagttagcggtaacgtaaagtatatcacgcttccgaaagaatttttcgactatccagataatatcgatcgtggaaaagctgccaaagttagagaggaaatgggcaaaaagaaaattgcttatggcgctagcgaatcgtatcgtttcatgtgtagattcaattctggattgttttacaagttaccagaactagcaaatgttgaatactattggcgtgtggaaccttacgtgaaattcggatgtgatataaactatgatgtattccagcatatgagacaaaacgacaaattatacgggtttgccatggccatgggtgaagaccaaaagacgatcccgacgttatgggaacatacgtataagtattttttcgaaatgcaccctgaacttgtcagcaaacgaaacaacttcaaattcatctcggacgatgacggagccacgtataacggatgtcatttttggactaactttgagattgcccatttaaagatattcaaagacccgagttatgggtacgaatcttatttccaatatttggactcacttggtgggtttttctacgaacgttggggcgatgctccggttcatacgcttgcatttagtttgttactagacgttgaccaaatccattttgtacccgatacagggtacgcacacaatccaaatcaagattgtccaagagataacccgttgaaagaaatattgagatgcaattgccaagcctcaaaagatttcacgtggcatcgttggagttgcgtcagtaagttctttgatgtgaatggactgcagaggccagataccttatcacaagtgaagaaacactactcatatttattaccagaaaataagaatatggacaggacacagcctatgacaacagaactcaaataa

SEQ ID NO: 45608 - protein, 416 aa, Kluyveromyces lactis NRRL Y-1140
MIGKLHLSKRTVRNGIILITIIGLIYGFWSTYGIEDRIAELKPEPESEPKSSVQDEKPVEKFYTDDRGNDIILSLVRNEELDGMLQSIRQFERRFNKKYHYDWWFVNDKKFTEEFINGTSNEVSGNVKYITLPKEFFDYPDNIDRGKAAKVREEMGKKKIAYGASESYRFMCRFNSGLFYKLPELANVEYYWRVEPYVKFGCDINYDVFQHMRQNDKLYGFAMAMGEDQKTIPTLWEHTYKYFFEMHPELVSKRNNFKFISDDDGATYNGCHFWTNFEIAHLKIFKDPSYGYESYFQYLDSLGGFFYERWGDAPVHTLAFSLLLDVDQIHFVPDTGYAHNPNQDCPRDNPLKEILRCNCQASKDFTWHRWSCVSKFFDVNGLQRPDTLSQVKKHYSYLLPENKNMDRTQPMTTELK

SEQ ID NO: 45609 - DNA, 1233 bp, Kluyveromyces lactis NRRL Y-1140
  CDS (1)..(1233)
atgcagccgaagaaaaagctcatgccaaaatcggcatttcttgtgaagaaatatgagcgtcatattagattgctgttcattgcattcatcacggttttatgtttcgtgttcattacacgttctggtaatggtagcagcgaaacgccagtgcttccaccaaagactgtcgaaccagcagtgtcgagtcctggtggtgcaaaagataagttcctgaagcctcatactgataaggttcagaacgttttttacccagaagatgatggtgttagagaaaaggcctgtatggtcaccttagcaagaaacaaagatttatggcatttggttacatctgtgagggatgttgaagatagattcaacaagaactatcattacgattgggtctttttgaacgatgaaccgttcaacgaggaattcaaaagtgttatgacagcaatggtcagtggtaccgctaaatttggtgtgattccaaaggaacactggtccttcccagactggattgaccaggataaggcggcagaagtcagaaaacagatgaaagaagacggtatcatttacggtgactccgtctcttacagacatatgtgtagatacgaatccggattcttctggagacacgagttacttgacgagtatgaatggtattggcgtgtggaaccagatatcaagttgttctgtgatattcactacgatgtttttaagttaatgaagcaaaacaacaagaagtacgggttcatcttatccgttagcgaatacgaaaaaacgattcctactttatgggaaaccaccaaaaatttcatgaaggaatacccacaacacgtcaaggaaaataatttgatgaagtttatctccaacgatggtggtaagacttataacatgtgtcacttctggtctaacttcgaaatcgcatcgctagaattatggagatcccctgcctaccgtgagtacttcgactacttggaccgttccggtgggttcttctacgagagatggggtgatgctccgattcattccattgccgctgcacttttcttagaaccagaagaattccatttcttcgacggcataggatactaccatccaggattcacttcatgtcctgtggaagaagctatcagattacaaaacagatgtacatgtgacccaggcgatgaccaaacttggggtgacagttatttctgcacaagaaaatacttcggtgcccgtggtttgaaactaccaaaggaggtcaggtaa

SEQ ID NO: 45610 - protein, 410 aa, Kluyveromyces lactis NRRL Y-1140
MQPKKKLMPKSAFLVKKYERHIRLLFIAFITVLCFVFITRSGNGSSETPVLPPKTVEPAVSSPGGAKDKFLKPHTDKVQNVFYPEDDGVREKACMVTLARNKDLWHLVTSVRDVEDRFNKNYHYDWVFLNDEPFNEEFKSVMTAMVSGTAKFGVIPKEHWSFPDWIDQDKAAEVRKQMKEDGIIYGDSVSYRHMCRYESGFFWRHELLDEYEWYWRVEPDIKLFCDIHYDVFKLMKQNNKKYGFILSVSEYEKTIPTLWETTKNFMKEYPQHVKENNLMKFISNDGGKTYNMCHFWSNFEIASLELWRSPAYREYFDYLDRSGGFFYERWGDAPIHSIAAALFLEPEEFHFFDGIGYYHPGFTSCPVEEAIRLQNRCTCDPGDDQTWGDSYFCTRKYFGARGLKLPKEVR

SEQ ID NO: 45611 - DNA, 1773 bp, Debaryomyces hansenii CBS767
  CDS (1)..(1773)
atgcctgcggtaaagactaacgatcaagggtcgattaaggactctttggaaccacacgatacatctgactcagactatgactattccgacgacgatgatgaatatgaagtctcattcaccgaggcaagacttaggaatatcaagtctatcgtacatacatcaaggcgaatacgcttacccaaacgatcacatagactatggataatgttgttgataattgtcttgtttatatactcatttactaatatggggtttcagggagcaaagaataatattcaagaagatataggaacattttccgacccattagatgaagccgaaggtcatttcatgagtgaaacaaggatatcgtctgacatagactcaccttttcaaattggatgtcgggtaccagacataactcagccaagggcgaatgcggccctcgtggtattaaccaggaattcagaggtcaaaaaagtcatcaaatctatgaagtcgatggagagacattttaaccagtggtttaattatccatgggttttcttgaatgatgagccattcactgacgaattcaagaattctgtcttgaagtatacgtcttccaaagtagagtttggcacaatcccggagaaagagtggaatttcaatgaagatattgataaagatgaattacacgagcatattgccaaccaaggagatagaagaatcatgtacggaaattctgagtcttatcataagatgtgccggtttttttcgggctatttctacaaacatgaattggtgaagaaaagggattggtattggagagtggagcccgatgttgaattcttttgcgatttgacatacgatccctttattgaaatggaaaagcgcaataagaagtatggcttcaatgttcttattggtgaattgtactacactattccggggttatttaaagagacaagggcatttataaggaaaaacaacgttccattgggtaatgcatggagcttgtttatcacggactataagtacgcagtaggtaaaaatgctgccaagtacgatggtttcaaatctaagtcggatatattgcgagagatagaaatgaacttaacggtcaagaagttcttatcaatgaaggacaaaacggatgaacaaatccccgagtatgatctgtggttactagatgaagtaatttctaagtctaaaaagccagcgttatatgaagatagaattgacctcgaagagtacaacatgtgccatttctggtcgaattttgaaattgcaagaaccgacttgtttaattccccaagatacgaagcgtattttgaccatttagagaagagcggaggattttataaagagcgatggggagatgcccctgtacattcacttgctataggaatgttacttgacctcaaggatatacattacttcagagacgttggctacaggcactcagggttgagccattgccctgggaactcgagaagataccaactaaaatatgaaccaagcgaaaggtactaccagaaggatttgagtaaggactcggcatggctttcgccagacagcccccgttctaatggaatcgggtgtagatgtaggtgtcccaagacaaaggaaattgaagattcgctgtcgtcgtgtgtccgttcgtgggccgatatcaccagtaacagatacatacctcccgaacctgtcgacgttgatttttgggaagaagaaatcaaaaaccgtttaaacaaattccttgcaaccggcggaatcctaggccaaaacaacattgccgaaaagttgctcagctag

SEQ ID NO: 45612 - protein, 590 aa, Debaryomyces hansenii CBS767
MPAVKTNDQGSIKDSLEPHDTSDSDYDYSDDDDEYEVSFTEARLRNIKSIVHTSRRIRLPKRSHRLWIMLLIIVLFIYSFTNMGFQGAKNNIQEDIGTFSDPLDEAEGHFMSETRISSDIDSPFQIGCRVPDITQPRANAALVVLTRNSEVKKVIKSMKSMERHFNQWFNYPWVFLNDEPFTDEFKNSVLKYTSSKVEFGTIPEKEWNFNEDIDKDELHEHIANQGDRRIMYGNSESYHKMCRFFSGYFYKHELVKKRDWYWRVEPDVEFFCDLTYDPFIEMEKRNKKYGFNVLIGELYYTIPGLFKETRAFIRKNNVPLGNAWSLFITDYKYAVGKNAAKYDGFKSKSDILREIEMNLTVKKFLSMKDKTDEQIPEYDLWLLDEVISKSKKPALYEDRIDLEEYNMCHFWSNFEIARTDLFNSPRYEAYFDHLEKSGGFYKERWGDAPVHSLAIGMLLDLKDIHYFRDVGYRHSGLSHCPGNSRRYQLKYEPSERYYQKDLSKDSAWLSPDSPRSNGIGCRCRCPKTKEIEDSLSSCVRSWADITSNRYIPPEPVDVDFWEEEIKNRLNKFLATGGILGQNNIAEKLLS

SEQ ID NO: 45613 - DNA, 1515 bp, Debaryomyces hansenii CBS767
  CDS (1)..(1515)
atgtctcatgattcaaacacagtgaaagatgtcatatataaacctaacaaacggttgttgaggatatttattgtgctttgcattattctgcttctttttatcggtcagcacttagttttcggaaatcgtgaagatctagtatctgaagtacaaaataataaagtttttagatttatcaacgaagcggaagataaggatactttgaataacgtgaatttctatggaacatccgtacaaacacattcggcacaaaaacaagaagaagaacaggatgtgaagggtagtcaatcagcaaacagaattaatgaagcttccaactcggcgggtgatgaggaaactgaggaaatggaaaatatgatggatgaacaggaaaacgagagagagagagcggcgatggtaattatagtgcagaataaagcagacattctgctggtgatgccaacaataagaagctaccaacagaagtttaacgaaaaatacaattatgactgggttataatatcacacagggcgatgttgtctctgcttcagcaagatataacggctttaacgaagccgggatccaatgttaagtttatggatatgaaatatctgtcggaacttataatataccctcctggaattgacaaacaaaaggtaagagaaataagacgggatacaaattttccaaagttgttgagatccaagaatatattacaagcgagacattttgcaaggtttttgacgggccatttttataatttggataacatttggaaagattatgattattactggaaagtgccgctagggtcgcaattgaattgtgaggtcaactatgatgtattcaaatacatgaagcaaaacaagattaagtatggatggctgttgatgcaacaagactatcctcacctccatcctagtttgttcaatgccgtaaaaaggtacattctcgatccaggcaacgattttatggatgaatcgggacccactcggaacaactttcatttccttcttggcaacggtatggatcctgaagcattgcaagatccaaatgccgattggaaaataaattcgtgctctattgattcagaattcgaattagtggatttgtcgttcttcaaatccattcaataccagcatttcttcaattacatagacggattcaatggcttctactacgaaagctggagtgaaccggtaatcaagaccatagccacttcacttttcctcaacacaaatcaagttcacttcttcgacgatttggcagtactggttcggacccaagctttaggactctgccctttaaacaaagatttttatatcaagaacaaatgtacttgcaatccacaagaacacggtaagaagattggtgtgggtaaatttcctggagaagaattacaattaatgcataagagtacatgtttggctaaatggttgcaatcttcaggccaaggcacacctcaagcttttgaagctgaagacgacccacttttcgaatcttttctcgaaaatgacgaacctccctcagactag

SEQ ID NO: 45614 - protein, 504 aa, Debaryomyces hansenii CBS767
MSHDSNTVKDVIYKPNKRLLRIFIVLCIILLLFIGQHLVFGNREDLVSEVQNNKVFRFINEAEDKDTLNNVNFYGTSVQTHSAQKQEEEQDVKGSQSANRINEASNSAGDEETEEMENMMDEQENERERAAMVIIVQNKADILLVMPTIRSYQQKFNEKYNYDWVIISHRAMLSLLQQDITALTKPGSNVKFMDMKYLSELIIYPPGIDKQKVREIRRDTNFPKLLRSKNILQARHFARFLTGHFYNLDNIWKDYDYYWKVPLGSQLNCEVNYDVFKYMKQNKIKYGWLLMQQDYPHLHPSLFNAVKRYILDPGNDFMDESGPTRNNFHFLLGNGMDPEALQDPNADWKINSCSIDSEFELVDLSFFKSIQYQHFFNYIDGFNGFYYESWSEPVIKTIATSLFLNTNQVHFFDDLAVLVRTQALGLCPLNKDFYIKNKCTCNPQEHGKKIGVGKFPGEELQLMHKSTCLAKWLQSSGQGTPQAFEAEDDPLFESFLENDEPPSD

SEQ ID NO: 45615 - DNA, 1257 bp, Debaryomyces hansenii CBS767
  CDS (1)..(1257)
atggggtcttctaggtcaaatgcccgtattataagatttgcagtgtttgctcttattttgattggatgtgggtttatcctttcaagaggctcatactacaatgctgacgctaacccaggtacaaacttgcaagccaagccagctagtgatggaagtattagtcgtgaaggtgatgtgagtggtggtaatggaggcggaaatgtgcaagcggaattgcagatgccaaatcaaaatgtgccagcagcagccaagccaaaggcagagggaggagctaacaaaaaggacaaggttaaggctacgtttgtgtcgcttgctagaaattctgacttgaattcgttgcttggatcgatcagacagatcgaagatcgtttcaatcacaagtttaactacgactgggttttcttgaacgatcagccattttctgacgaattcaaggaggtcaccagtgctgttgtttccggtaccaccaagtatggtttaattccagaggaacagtggtctttcccatcatggatcgaccaagaaaaggctgcgttaaccagagaacaaatgaaggaaaagggaatcatttacggtgattcgaagtcgtacagacacatgtgtcgttacgaatctgggtttttctggagacacgagttgatgatggactacgactactactggagagtcgagccagatgtaaagatctactgtgacatcgactatgacgtgttcaagtggatgagcgacaacaacaaggcttatggtttcaccatctcattgcctgaatataaggaaaccatcccaactttgtgggacgtcaccaagaaattcatcaaggaaaacccacaacacgtcgccaaggacaacttgatggaatggatttccaacgacaacggtgaaacatacaacggatgtcacttctggtctaactttgaaatcgccagcttgaagttgtggagatccgaagcatacaccgcatacttcgacaccttggacaagaatggaggtttcttctacgagagatggggtgatgcgccaatccattcgatcgccgcagccttgttcttgcaaaaagaccaagtccacttctttgacgacgttggatactaccacgttccattccataactgtccggtctccaaggaaaccagattgaagaacaaatgtgtgtgtaatcctgatgaggatttcacctggaagggttactcgtgtactgctaaattctacacgatcaagaaccttcaaagacctaagggatgggaaaacttcacctag

SEQ ID NO: 45616 - protein, 418 aa, Debaryomyces hansenii CBS767
MGSSRSNARIIRFAVFALILIGCGFILSRGSYYNADANPGTNLQAKPASDGSISREGDVSGGNGGGNVQAELQMPNQNVPAAAKPKAEGGANKKDKVKATFVSLARNSDLNSLLGSIRQIEDRFNHKFNYDWVFLNDQPFSDEFKEVTSAVVSGTTKYGLIPEEQWSFPSWIDQEKAALTREQMKEKGIIYGDSKSYRHMCRYESGFFWRHELMMDYDYYWRVEPDVKIYCDIDYDVFKWMSDNNKAYGFTISLPEYKETIPTLWDVTKKFIKENPQHVAKDNLMEWISNDNGETYNGCHFWSNFEIASLKLWRSEAYTAYFDTLDKNGGFFYERWGDAPIHSIAAALFLQKDQVHFFDDVGYYHVPFHNCPVSKETRLKNKCVCNPDEDFTWKGYSCTAKFYTIKNLQRPKGWENFT

SEQ ID NO: 45617 - DNA, 1320 bp, Debaryomyces hansenii CBS767
  CDS (1)..(1320)
atgggcatgataagaactcctgctattagggtagcggccataggtatagcactattggtgttatatatgctttccgtgtttttaaggcctcaggttgtttatgtagataaggatactaatgaaatcgtgaaggacttccagggcagcgatatgggcggcgctatcaacgctgtggtggatccaccaagaaaagtgcaagatccgattaaaaataacgataaggaacatgaacaggcgcatatccagatcgaggaagcagaaatcaacgaagctactgaccaagtggtgagtgactcgagcgcaagccatgatcaggttgccggtgtaaatgatgtatatcccggtgaacgggtcaaagcgacgtttgtaacgttggccagaaacaaagaattgtacgacttaatcaagtcggtgaggcgagtggaggatcggttcaaccgtaaattcaactacgattgggtatttttgaacgacgagccattcaccgacgaattcaagaaattgaccacctcaattgtatcaggaaaaaccaaatatgggttgatccccaaggaacattggtcataccccgattggatcgacaaggaaaaggcagcggaatcgaggaacgccatgaaggctgccggtatcatttacggtgactcagaatcgtacagacacatgtgtcgatttgagtcgggattcttctggcaaaatccgttgttagacgagtacgattggtattggagagtcgagcctggcatccaaatacactgcgacttggactacgatcttttcaaatacatggaggacaataacaaggtgtacggattcacgatttcgatctacgagtttgaaaagacgatttcgtcgttgtggggccacgtcaaggacttcatcaagaaaaacccccaatacttggccgaagacaacctcatggacttcatttccgacaacaagggggaaacgtataatttgtgccacttctggtccaacttcgaggtggcctcgttgaaattctggcgttcgcaggcatacagagaatttttcgactacttggacaaaactgggggctttttctacgagagatggggcgacgccccaatccattcgattgctgcggcccttttcctttccaaggatcaggtccactacttcgaagacgttggctacaaccacggtgtatacactcagtgtccgcttaattctcaattcaggtacgatcacaagtgtcactgtgaccccaaatctgacttcacattcagaggctactcatgcggtaacaagtactacgacgttatgaagaaagaaaagccacaggaatgggtgaactatacctag

SEQ ID NO: 45618 - protein, 439 aa, Debaryomyces hansenii CBS767
MGMIRTPAIRVAAIGIALLVLYMLSVFLRPQVVYVDKDTNEIVKDFQGSDMGGAINAVVDPPRKVQDPIKNNDKEHEQAHIQIEEAEINEATDQVVSDSSASHDQVAGVNDVYPGERVKATFVTLARNKELYDLIKSVRRVEDRFNRKFNYDWVFLNDEPFTDEFKKLTTSIVSGKTKYGLIPKEHWSYPDWIDKEKAAESRNAMKAAGIIYGDSESYRHMCRFESGFFWQNPLLDEYDWYWRVEPGIQIHCDLDYDLFKYMEDNNKVYGFTISIYEFEKTISSLWGHVKDFIKKNPQYLAEDNLMDFISDNKGETYNLCHFWSNFEVASLKFWRSQAYREFFDYLDKTGGFFYERWGDAPIHSIAAALFLSKDQVHYFEDVGYNHGVYTQCPLNSQFRYDHKCHCDPKSDFTFRGYSCGNKYYDVMKKEKPQEWVNYT

SEQ ID NO: 45619 - DNA, 1419 bp, Debaryomyces hansenii CBS767
  CDS (1)..(1419)
atgatatctgcattctcattgagaataccaaaaccgttacttgtattaattatacctttgaatttagtgttaatatttggaataattgtttatgttgctgaaatacctacagatgaatatgtagatagggatatgattagtctggggtttcgacaacttacacagaagtttgattttgggtatttaaatcagaatgtttcagacgttgatttgcaaaatgttgatacttatagcacatatggctttaaaataaaacccaataatgtcaagttcaagtttgtgaaccccaagaagaagattggtactccggaggatatcctaaagaagaataaggaaacatttgaagaggtgatggcacaagaaatccatgagccaaaagatgcagaccttcagagcatgaggccaccatcaaaaaaagacatcgataaatacaagcatgcaaatgctacaataattgcattggtacgtaataacgaggccctggctataactaaaactatccgaagatttgaaacgagatttaattccaagttcagatacccatatacattcattaacgacgagccatttaccgagaggtttatgcaacgaatgcagaaattaagtgacgcccctatggaattcgttacaattccaagtgaattatggaagaagccatctgacattgatactgaacgcgaggagaaggctatgcagctcttgtccgatcaacggatttcgtatgcaaaaaagggatcttatcataatatgtgtaggttttacctgggtaatttctacaatgttccagaattgaaaaaataccaatattattggcgtattgaaccaaatgtctttttctacaatgatttggaatacgatgtctttaagtatatggaagtaaccaagaaagcttatggttttgcaattaatctctacgatatttcggaaactgtcgtatccttatggccggagactttaaaattcttgaataagggcgataactataaatatgtaaacccgaatggagcatttcagtggcttttagagaaccaacaaaatcccaagaataataaaaaggcaaacggatattctacttgtcatttctggtcaaatttcgaaattggtgacatggatttctaccgtggtgaagcgtataatgagtggtttaaatatttggattctactgggaacttctattatgaacgttggggagatgcacctgtacattctatggggttagcattatttgccgacaccaaggatatccactggtttagagatataggatattaccacgacccatacgttaattgtcctaattctcctgacacaattggttgcgaagctggccaatttagtagatgggaccatttggcagatcaaaactgtatggctagctggattgattacagtatggaagacccaagtgcaatttattaa

SEQ ID NO: 45620 - protein, 472 aa, Debaryomyces hansenii CBS767
MISAFSLRIPKPLLVLIIPLNLVLIFGIIVYVAEIPTDEYVDRDMISLGFRQLTQKFDFGYLNQNVSDVDLQNVDTYSTYGFKIKPNNVKFKFVNPKKKIGTPEDILKKNKETFEEVMAQEIHEPKDADLQSMRPPSKKDIDKYKHANATIIALVRNNEALAITKTIRRFETRFNSKFRYPYTFINDEPFTERFMQRMQKLSDAPMEFVTIPSELWKKPSDIDTEREEKAMQLLSDQRISYAKKGSYHNMCRFYLGNFYNVPELKKYQYYWRIEPNVFFYNDLEYDVFKYMEVTKKAYGFAINLYDISETVVSLWPETLKFLNKGDNYKYVNPNGAFQWLLENQQNPKNNKKANGYSTCHFWSNFEIGDMDFYRGEAYNEWFKYLDSTGNFYYERWGDAPVHSMGLALFADTKDIHWFRDIGYYHDPYVNCPNSPDTIGCEAGQFSRWDHLADQNCMASWIDYSMEDPSAIY

SEQ ID NO: 45621 - DNA, 1341 bp, Debaryomyces hansenii CBS767
  CDS (1)..(1341)
atgcacaatagatattacctaatacctattttagtttgtttatggggagtttactacagtattataacacattatatatctagtaataatcatgcatatatgtttcacaatgaagatttgaatgaaattttcaatcctactaaggcttcgtggaatatttcatttccttggattgacaggcttccaaggttttcaggtcctaatattaaaaccgtgcttcaaaagaaaggatcgcataaattgtcttcgaattcatacttacctaatgattttccatttagagaacggagtcaaataggtcaagaaaatgctacgatggtgatgttggtacgaaatcgggaattgagaggtgcattgcaatcaatgaggtcattagaagatagattcaacagaaattatagatatccatgggtgtttttaaatgacgagccttttgacaccgatttcatagaacaaactacattaatggctagcgggaaaacatattatgaattgataccgagtgaggactggcaaccgccttcgtttatcgatatggatttaatggaaaagaaactaatgaaggcgcatgaagatggcgttatctatggtggatcatggtcctataggaacatgtgtcactttaactcgggatttttttataaacaaaagagattacttgattatgaatggtatttcagggtggagcctgacgtcaagtacatgtgtgattttcagtatgacccctttacggtgttgagagaaaataataaaatatatgggtttgttctaactattcacgactacgaaaacacaatgccatcgttgtggcctaccgtcgagaacttcatgaaggaccacaaagatttaatccatcctaataattccatagacttcatcacgtctaatgaaacttccttgaactacgacttcgagttacccgaatcaaatacctcatataacctttgccatttttggtctaactttgaaattggaaacttagacttcttcagaagcgaagcctatgagacatacttcaaatatttggataaaacgggtggatttttctacgaaagatggggcgatgctccggttcattctatagggctaaacttgttagccgacaaaaacagaatacaccacttcgaagatatagggtattttcatgtaccgtatctagcatgtcctacttcaattgacgtacttgcatcaaaaagatgtgtatgtaagactaaaggtcttgaaaatcatgatcctgagacaccacatgacatccagcctttcagttgcttaagcagatggtggagatatggctctggcaaaaccttcttaaacgatatcgattatacgttcaacaattag

SEQ ID NO: 45622 - protein, 446 aa, Debaryomyces hansenii CBS767
MHNRYYLIPILVCLWGVYYSIITHYISSNNHAYMFHNEDLNEIFNPTKASWNISFPWIDRLPRFSGPNIKTVLQKKGSHKLSSNSYLPNDFPFRERSQIGQENATMVMLVRNRELRGALQSMRSLEDRFNRNYRYPWVFLNDEPFDTDFIEQTTLMASGKTYYELIPSEDWQPPSFIDMDLMEKKLMKAHEDGVIYGGSWSYRNMCHFNSGFFYKQKRLLDYEWYFRVEPDVKYMCDFQYDPFTVLRENNKIYGFVLTIHDYENTMPSLWPTVENFMKDHKDLIHPNNSIDFITSNETSLNYDFELPESNTSYNLCHFWSNFEIGNLDFFRSEAYETYFKYLDKTGGFFYERWGDAPVHSIGLNLLADKNRIHHFEDIGYFHVPYLACPTSIDVLASKRCVCKTKGLENHDPETPHDIQPFSCLSRWWRYGSGKTFLNDIDYTFNN

SEQ ID NO: 45623 - DNA, 1251 bp, Debaryomyces hansenii CBS767
  CDS (1)..(1251)
atgaataaggttgtttgtcggtttatatggctatttaatgtgctaggggtggtttgtgcaaatataaacgttcaagatcaacttcaagatcaacttccggacatacgaatagatacgttcaatgatatgcccgcaagcgtaaaaaatgtgactgtgggtgctggggagtttttatgggattgggacaaagagaacaactcacaggaattgaccgattttcttagacgcgagatagagggtcagcatgatgtgcagacgatagtggtgaataaaaataggccagaagacacgtaccaacgggagaatgctacgtttttggtgctctgtcgaaacgaagaggtttttgagttgcttgagtcgattcagagtatacaagaccggtttaaccaccggtacaactacgattgggtgtttttgaacgacaaggcattcgacgagcgattcatgtacattgtgtcgcagtacgtggtgcaagggaagttgagttttgggcagattccccgggaacactggggatatccatcctgggtgaaccagacgtacgcgagtgaacagcgggctcgtctagtagaggaggacgtggtgtacgcggatagcgaatcgtacagacatatgtgtcgattctacctgggatttttctacaaacatccacttgtagcacagtaccagtactactggcgcattgaaccgggtgttaagttctattgcgacgtttcctacgacgtgtttcacttcatgaaaactcacggcaagaagtacggttttgtaatgtcgatgttcgagtacaaaaagacaattccgtcgctttggggccatttcaagtctttcatcagacggtacgaccacgccaatggccagtatggtgagttgcttgatttcgtccagaacgacaatgtggccaaaacatacaatttatgtcacttttggtccaacttcgaaatcgccgatttatcgatattcaataaccctgattatcaggcgttttttgaccatttagatgctactggtggtttcttttacgagagatggggagatgctccagttcattctttggcggttctgtggttcttgtctaaacgcgacttatggtggtttggtgatatcggctactaccatgcaccatatctacaatgcccccagccattacaaaccagactcgaaaacaggtgtagctgtgatcccgatgaagactttctgttcagtttcatcagctgtacaccccatatactaaatttactaaactcccgatag

SEQ ID NO: 45624 - protein, 416 aa, Debaryomyces hansenii CBS767
MNKVVCRFIWLFNVLGVVCANINVQDQLQDQLPDIRIDTFNDMPASVKNVTVGAGEFLWDWDKENNSQELTDFLRREIEGQHDVQTIVVNKNRPEDTYQRENATFLVLCRNEEVFELLESIQSIQDRFNHRYNYDWVFLNDKAFDERFMYIVSQYVVQGKLSFGQIPREHWGYPSWVNQTYASEQRARLVEEDVVYADSESYRHMCRFYLGFFYKHPLVAQYQYYWRIEPGVKFYCDVSYDVFHFMKTHGKKYGFVMSMFEYKKTIPSLWGHFKSFIRRYDHANGQYGELLDFVQNDNVAKTYNLCHFWSNFEIADLSIFNNPDYQAFFDHLDATGGFFYERWGDAPVHSLAVLWFLSKRDLWWFGDIGYYHAPYLQCPQPLQTRLENRCSCDPDEDFLFSFISCTPHILNLLNSR

SEQ ID NO: 45625 - DNA, 1302 bp, Debaryomyces hansenii CBS767
  CDS (1)..(1302)
atgccaagtctaaatgataatccactaaatgttgaagagttggaaaataccgaagcgtctcttaaaaaggataaacaacgtgaaagtgtgtttcgattgggtgaccaggagctgttgctttcccaggatccggaatatgaggcactggagccatttaaagaaagcaaggttttttataataacaagtttgtcggtagagctgtaataggagaatctaataacaatattaccgatggaattgtagactaccagagggagaacgctacatttttctcgttggtcagaaatgaagactttctgggtattgccgaagccatacaatcagttgaatataggttcaataacaaatatcattatgactgggtatttgcaaatgatgaaccgtttcatccaacattcataaacgttatacaaaatttggtgagtggacaagcccattttgttcaaatatcgagagaaatatggagctatccggattggattgaccaagacaaagcaaacgaaacaaggcatacgatgaaagaaaataaggttaaatatggtgactctgtatcctacaggcatatgtgccgtttcaattcaggttttttctaccgattaccaataatgaagaactatagatactattggagagtagagccagaaattgaatttcagtgtgatatattccatcaagattggtttaaatatatgaaagaaaataataaaaagtatgcatttacattggctcctttagagctacatacaactgttacaaacttatgggaaacagtccaggagttttcccggaaaaacccaaaattggttgctaaagacaataatatggatttcttgactgaagatggaggagcaacctacaatatgtgtcatttttggtcaaattttgaaataggagatatggatttttatagactggaggcatattcaaaatttttcgaccatattgataaggccggtggattctactatagtcggtggggggatgcaccagttcattctatgggtgtttcgttacttttaagtaaggatgaactattctttatggataactcgggatattttcattcgccaaacggcgattgtccctgggatccaaaaattagaaaggaaagaagatgtacttgtctgactaaaaaggatgcaacatggttgaaaagctcgtgcattcctaaatggtttgagatccatgatatagaaaagccaccctttgttcctaaatatgccttcgtcaatcaacacaagcctcctgatgaagaagaagaaaaggaaaatgaagaagaatacgacaataaagacgaataa

SEQ ID NO: 45626 - protein, 433 aa, Debaryomyces hansenii CBS767
MPSLNDNPLNVEELENTEASLKKDKQRESVFRLGDQELLLSQDPEYEALEPFKESKVFYNNKFVGRAVIGESNNNITDGIVDYQRENATFFSLVRNEDFLGIAEAIQSVEYRFNNKYHYDWVFANDEPFHPTFINVIQNLVSGQAHFVQISREIWSYPDWIDQDKANETRHTMKENKVKYGDSVSYRHMCRFNSGFFYRLPIMKNYRYYWRVEPEIEFQCDIFHQDWFKYMKENNKKYAFTLAPLELHTTVTNLWETVQEFSRKNPKLVAKDNNMDFLTEDGGATYNMCHFWSNFEIGDMDFYRLEAYSKFFDHIDKAGGFYYSRWGDAPVHSMGVSLLLSKDELFFMDNSGYFHSPNGDCPWDPKIRKERRCTCLTKKDATWLKSSCIPKWFEIHDIEKPPFVPKYAFVNQHKPPDEEEEKENEEEYDNKDE

SEQ ID NO: 45627 - DNA, 1341 bp, Yarrowia lipolytica CLIB99
  CDS (1)..(1341)
atgcacaacgtgcacgaagcccccaacccaccccagaagaaaacgcagaaggtggtcaacacccacaacatcaacggcgactttggcaagtccatagacgagctcaaaaagggacacctggaggaggaagaggccaaggccaaggagctggaggaacagtaccagaaccgaggcgaggcccaggccgtgagcggctccgagactgaagacgaggagccctcccacacggaaatcattctgccgtccaactcggccacccccttcgtcatgaaggccccttctctcatgcattcgtcccctggttccaacccagaccccaacatccaaattgcattcgactaccccgctctccgtcagcagacggagcgagccaacgccactctagtttcgctggtccgaaacaaggagctcaaacagatggtgcgcacggtcaagaactacgaggaccgcttcaaccacaagttccgctacgactgggtcttcctcaacgatgagccctttgacgacgactttatcgagacaatgacaaacctcgtgtcgggtaaagccaagttcggacttgtccctaaagaacactggtctgtaccctcctgggttgacaaggagaaggcagacaaggcgagaaaggccatggccgagcaggtcatctacggagactcggagtcataccgacacatgtgccgattcaactctggcttcttcttccaccatcctctcatgcaggaatacagatactactggcgtgtggagcccgagaccgccatccactgcgacgtcaactacgacattttccagttcatgcagaccaataacaagacgtacggcttcaccatcaccttgctggaaaaccctctcacggttgcgtctctgtggcaggagaccaaggcttacaccaaggctcatcccgaggtgctggccaaggataacctgctcaactggctctcgtacgataagggtgagaactacaacatgtgccacttttggtctaatttcgaggtggccgacatggacttttggcggtcggaggcgtaccaaaagtatttcgaccatctggacaagtccggtgggttcttctatgagcggtggggtgatgcgcctgttcactccattgccgcagctctgtttctgcccaagagcgaagtgcatttctttaacgacattggatacacgcatcctcccttcactcactgtcccattgatggcgacacccggaaggagggcaagtgttcgtgtcttgctgaagagacgtttgattggaagccgtgctcgtgtctggggcggtatctggacgttcagcgaatcaagcggccccatgactgggagaactatagtgactggtag

SEQ ID NO: 45628 - protein, 446 aa, Yarrowia lipolytica CLIB99
MHNVHEAPNPPQKKTQKVVNTHNINGDFGKSIDELKKGHLEEEEAKAKELEEQYQNRGEAQAVSGSETEDEEPSHTEIILPSNSATPFVMKAPSLMHSSPGSNPDPNIQIAFDYPALRQQTERANATLVSLVRNKELKQMVRTVKNYEDRFNHKFRYDWVFLNDEPFDDDFIETMTNLVSGKAKFGLVPKEHWSVPSWVDKEKADKARKAMAEQVIYGDSESYRHMCRFNSGFFFHHPLMQEYRYYWRVEPETAIHCDVNYDIFQFMQTNNKTYGFTITLLENPLTVASLWQETKAYTKAHPEVLAKDNLLNWLSYDKGENYNMCHFWSNFEVADMDFWRSEAYQKYFDHLDKSGGFFYERWGDAPVHSIAAALFLPKSEVHFFNDIGYTHPPFTHCPIDGDTRKEGKCSCLAEETFDWKPCSCLGRYLDVQRIKRPHDWENYSDW

SEQ ID NO: 45629 - DNA, 1290 bp, Yarrowia lipolytica CLIB99
  CDS (1)..(1290)
atggtggaaaagaacccggcatcaccgaaacggacctccaagaaatcggtaccgtcgccgcgctcgctgcttttccccatcctactcctagcgggcatcctcatcttgctacttagccaaacggtgggcgtcctctcgatagtggaatctctcgcgtctctcaaacccgcagccacaaacccatatccgtatgaaaaccgcaaatggatttacgacttcacccatcagccgtggtccggggccgacaccaaagaccggcggcaaattgggcgagaaaacgccactctggtcatgctggtgcgaaaccgagagctcaaagaagctgtgctggccatgcgatcgatcgaggaccggttcaacaagaaatacaagtacccctgggtgtttatgaacgaccgagagttcaccgaagatttcaaggagtacaccaccggcatggcatcgggccacaccgagtactacaaggtgcccaaagaggcatggcaaatgactccaggaatcgaccgagacctagtgtttgagtccgtggaaaacttcaccaaggaaggcgtcatctacggagactccttgtcctacagacgtatgtgccggttcaattcagggtactttttccgaatggctcctctgctcaagtacaagtactactggcgggtggagccagacgtggagctctattgtgaccagcagtacgaccccttcaccttcatgcgcgaaaacaacaagctctatggctttgtcatggccatgtacgagtatcctcagactgtggctacgctggcagaacatgtccagggcttctttgacgttcatccgcaatacgtgcatcccaattcgtcggtagggtttctcaaggacaaacgggtgaaccggtttggcgatctcatgcccgagtggcacggcgagtggaatctgtgtcatttctggtccaattttgagattggcaatatggattttttccggtcgaaaaagtatctcgagttcttcgagtggctggaccgagccggtgggttcttctatgaacgctggggagacgcgcccgtccattctttggcggtgggttacatgatggacaaaactcaggttcatcagtttgcagatatcggatattatcatcctccgtttttcagatgtcctgcagatgagcagagtcacaagtcgggacgatgtgcgtgtcctgaggatctgaatgggtacaagaactttgattatgaacccatgagttgtctgccgagatggtggggcaatgcgggcaaggcgtggatgaaggatggggtgcatattaacgtgtga

SEQ ID NO: 45630 - protein, 429 aa, Yarrowia lipolytica CLIB99
MVEKNPASPKRTSKKSVPSPRSLLFPILLLAGILILLLSQTVGVLSIVESLASLKPAATNPYPYENRKWIYDFTHQPWSGADTKDRRQIGRENATLVMLVRNRELKEAVLAMRSIEDRFNKKYKYPWVFMNDREFTEDFKEYTTGMASGHTEYYKVPKEAWQMTPGIDRDLVFESVENFTKEGVIYGDSLSYRRMCRFNSGYFFRMAPLLKYKYYWRVEPDVELYCDQQYDPFTFMRENNKLYGFVMAMYEYPQTVATLAEHVQGFFDVHPQYVHPNSSVGFLKDKRVNRFGDLMPEWHGEWNLCHFWSNFEIGNMDFFRSKKYLEFFEWLDRAGGFFYERWGDAPVHSLAVGYMMDKTQVHQFADIGYYHPPFFRCPADEQSHKSGRCACPEDLNGYKNFDYEPMSCLPRWWGNAGKAWMKDGVHINV

SEQ ID NO: 45631 - DNA, 1242 bp, Yarrowia lipolytica CLIB99
  CDS (1)..(1242)
atgaccccgctgatagtcagaagactattcctgctgctggtgacggcttcgctcggtctgctcgtgttcctgatctacttctcgttacaagatgactggaccagaacacatgcggacttcttgaaagaggagagcatctacaagcaacccaacgatgcattcctgcaatatacggaaccaaaagaggacttaacgccgaagaacaatcccctgcttgaagaggtggacgagcctgtcagtgccaagcctcttgttcgcgccactgacacgcggcgaactaaagccgctcttatctctcttgttcgaaacaaagagctggacggtattgtggatgccatggtgcaggtcgaggacacattcaatcacaaattcggctacccttggatctttttcaatgatgaagagttcaccgacgagttcaaggaaaaggtgcgcgaacagactgactctgaagtcaagtttgagctgattgaaaagaaggactgggacgcccccagatggatcgacaaggacaaggccaagaaggccggcaagaagctggaagatgctggtgtacgatatggtgccatggactcctaccacaagatgtgcagatggaactcgggtatgttctacaagcacaaggccatggacgattatgactggtactggcgcgttgaacccgacacccaatactattgtgacatcgactacgatgtatttgcatacatggaggacaatgacaaggtgtatggcttcaccattgcattgtttgacaaccccaaaaccgttgccaccctatggccggaaactaaatccttcttgatgaagaacaaggagtatctgcacaaagacaatgccatgcaattcttgctgaaccccagcagaccagactggaacgcccaggctggcggatactccacttgccatttctggtccaactttgaaatcgcgtctctgaagttcttcaggggcgatgcatacgcccaatggtttgagcatctggataaacagggagggttcttttacgagagatggggagatgctcccgtgcactctgtcggcgcaggactatttgctaaccagtcacaaatccattggttcaaggacattggatattaccacttcccctatttcaattgccccaagtccaaaaagtgtcatggatgcaagcctggtcgattcaccacagacgatctcaaggattctctgatgcctgaaaactgtcttcctcagtacctcaaatacatgggcgaccgataa

SEQ ID NO: 45632 - protein, 413 aa, Yarrowia lipolytica CLIB99
MTPLIVRRLFLLLVTASLGLLVFLIYFSLQDDWTRTHADFLKEESIYKQPNDAFLQYTEPKEDLTPKNNPLLEEVDEPVSAKPLVRATDTRRTKAALISLVRNKELDGIVDAMVQVEDTFNHKFGYPWIFFNDEEFTDEFKEKVREQTDSEVKFELIEKKDWDAPRWIDKDKAKKAGKKLEDAGVRYGAMDSYHKMCRWNSGMFYKHKAMDDYDWYWRVEPDTQYYCDIDYDVFAYMEDNDKVYGFTIALFDNPKTVATLWPETKSFLMKNKEYLHKDNAMQFLLNPSRPDWNAQAGGYSTCHFWSNFEIASLKFFRGDAYAQWFEHLDKQGGFFYERWGDAPVHSVGAGLFANQSQIHWFKDIGYYHFPYFNCPKSKKCHGCKPGRFTTDDLKDSLMPENCLPQYLKYMGDR

SEQ ID NO: 45633 - DNA, 1527 bp, Yarrowia lipolytica CLIB99
  CDS (1)..(1527)
atgctacgacgcagatcttcagcatcatacccacaacagtcgctgcccaaaacacaggggacctggcagccgtccacaatgacgcagggagtgcggaccaaggcccggttctatctcagtcgcatgccgctcaaaatcctggctgttctcgcagcgctgctcatcacagccggctttgtgacattcaacttgcgccacccggccgagcaacaacccggcggaaacaagcagtacatcaaagagattgtgtttgagaacccagcactacatggaccctttgtggctggctgcagaccgatcgtagctaatcctgaagacaaggtcaacgcggcgtttgtcgtactggcccgaaaccaggaccaggagggcctactgtcgtccatcgcttcgctagaacggcatttcaaccagtggtacaactacccttacattttcctcaacgacgagcccttcaacgctacctttaaggccgcaatctccaagtccaccgctgctaagacggaatttggagttatccccgactctctgtgggacttcgacgacagcgtcgatcgaaaagagctcaagaaagcgttgcagaaccaggcggaccaaaatgtcatgtatggcgactcggaatcgtaccacaaaatgtgccgattctactcgggcaagttctacgaccacccgctactcaaggaccttgactggtactggcggctggagcccgacgtgcagttcttctgcgacctgacctacgaccccttccgatacatgcaggacaacaacaaggtgtacggctacaacattgccatcaaggaactcaaggagacggtgcctaacttgtggcgatacaccaagtcattcaagcagaaaaacaagatgcagtccaagggtatgtgggaaatgtttctgcagacagcggaggagcgagaacaacgaggaggccaccctctcaaggacgctcgaatgtccgacaagaacgacaaggtcaagggtaaggctgaaactaacaatcccacctccaagcggtttgctgatcctgattacgaggatatgggagaagaggcctacaacatgtgccacttctggtccaactttgagattggaaagctctccttcttcagatccaaagagtacagagactactttgactacctcgaggagaagaagggtttctggtccgaacgatggggagatgcacccgtacattccctagccgtgggtctgtttctggccccctccgaggtgcattatttccgagacatcggataccagcattcggacattttccactgtccttacaacgccaagggcgcccagttgcctcctcccgagcggtactgggagggcgtttccaagcgaaccggtctcaaactgactgacgagcagatcaaggaggacgagaagtggctggttcccgaccctgcggaggaaggcggcgtgggatgcagatgcatttgtcctctggataaggcagcgttcatcgagccgcgagacggaagttgcattgctcactgggttgagaccagagacaaggggttgtga

SEQ ID NO: 45634 - protein, 508 aa, Yarrowia lipolytica CLIB99
MLRRRSSASYPQQSLPKTQGTWQPSTMTQGVRTKARFYLSRMPLKILAVLAALLITAGFVTFNLRHPAEQQPGGNKQYIKEIVFENPALHGPFVAGCRPIVANPEDKVNAAFVVLARNQDQEGLLSSIASLERHFNQWYNYPYIFLNDEPFNATFKAAISKSTAAKTEFGVIPDSLWDFDDSVDRKELKKALQNQADQNVMYGDSESYHKMCRFYSGKFYDHPLLKDLDWYWRLEPDVQFFCDLTYDPFRYMQDNNKVYGYNIAIKELKETVPNLWRYTKSFKQKNKMQSKGMWEMFLQTAEEREQRGGHPLKDARMSDKNDKVKGKAETNNPTSKRFADPDYEDMGEEAYNMCHFWSNFEIGKLSFFRSKEYRDYFDYLEEKKGFWSERWGDAPVHSLAVGLFLAPSEVHYFRDIGYQHSDIFHCPYNAKGAQLPPPERYWEGVSKRTGLKLTDEQIKEDEKWLVPDPAEEGGVGCRCICPLDKAAFIEPRDGSCIAHWVETRDKGL

SEQ ID NO: 45635 - DNA, 1299 bp, Schizosaccharomyces pombe
  CDS (1)..(1299)
atgaagtttaatttaagagatggcgagttggcacctgttttagtaactttaccttggagctttgaaaaatgtattaaatctacatatattactagacattggaaaaccgttcatggttgtttgagattgtttcatttcgttgaatatcaaaacgatatgaaaagatatgatacattacatgtttggaaactaataaaattattaatatgcaaattccttttatttcatgattttggcactgcgttgttcacaagccttgtgaaagcctcaatgcttggattccataattggagacgtacatattggttgtacttgaagaaattgagacctattaatgatacatacgacgcgccgtttgcgataggatgtaagaatgtggcctatgaagcaagtcaatatcctagaatgaatgctacttttatggttttagcaagaaactctgaccttgacggtgttctatctagtatgaactcaatcgaacgtcgatttaatcgacacttcaagtatccttatgtcttcttaaacgatgaaccttttactacggaatttaaaaaagcggttaaggatgctacggattcttctattcaattcggtgttctcgatgatgaactatggaacttccctaaagatgtcgacaaggatatgatagatgagagtattgctgaacaagttggagtcgtatatgcgaactttcctagttatcataaaatgtgcagattcttttcgcgaaacttttacaaacatcccttaatgcaacagtacgagtggtattggagacttgaaccggaagtcactttttcttgtgacatctcttatgacccattttactacatggacaagcacaataaagtctacggatacgttattgctatcaaagaacttgcaaaaactgttccaaatctgtttcggtacactgttgctcatcaaaaaatatccaatttaccaactaccgatctttggagcttcttccttgataaacgctatgaaacgagaattaaaaagctgaaagaagaacaaaaagatcaaggatattacgttttaccggagccccctttaaaccgaattgatggccagatttataatctatgccatttttggagtaacttcgaaattgcacgcttagacttttacaatagtaaagagtataatgaatatgtcgacgcattggaaaatgctggaggattttggactgaaagggtatgtttttacagtttattcaaaaaaaaaaaagcattgtgttcttcgaagtgcaatcttcttcatacttttttcctatctctgattactaacttattttag

SEQ ID NO: 45636 - protein, 432 aa, Schizosaccharomyces pombe
MKFNLRDGELAPVLVTLPWSFEKCIKSTYITRHWKTVHGCLRLFHFVEYQNDMKRYDTLHVWKLIKLLICKFLLFHDFGTALFTSLVKASMLGFHNWRRTYWLYLKKLRPINDTYDAPFAIGCKNVAYEASQYPRMNATFMVLARNSDLDGVLSSMNSIERRFNRHFKYPYVFLNDEPFTTEFKKAVKDATDSSIQFGVLDDELWNFPKDVDKDMIDESIAEQVGVVYANFPSYHKMCRFFSRNFYKHPLMQQYEWYWRLEPEVTFSCDISYDPFYYMDKHNKVYGYVIAIKELAKTVPNLFRYTVAHQKISNLPTTDLWSFFLDKRYETRIKKLKEEQKDQGYYVLPEPPLNRIDGQIYNLCHFWSNFEIARLDFYNSKEYNEYVDALENAGGFWTERVCFYSLFKKKKALCSSKCNLLHTFFLSLITNLF

SEQ ID NO: 45637 - DNA, 1215 bp, Saccharomyces cerevisiae
  CDS (1)..(1215)
atgtctgtgcaccacaaaaagaagctaatgcccaaatcggcattgctgattagaaaataccaaaagggaatcagatcatcattcattgggctcatcatagtgttatcctttttatttttcatgagtggctcaaggtccccagaggtaccaatagctcagggcaccagtgtcagtcgtgtagccagtaaggattatttgatgccgtttactgacaagtcacaaggagtaatccatcccgtggacgatggaaagaaggaaaagggtgttatggtcacattggccaggaattcagatttacggaacttggtaaaatctattagacatgttgaagacaggttcaataacagatatcactacgattgggtgttcttgaatgaccaaccatttagtgatgagtttaaacgtgttaccagtgcattggtttcaggcaaggcaaaatatgggacaatcccaaaggaccattggtccattccatcttggatcgatactgaaaaattcgatgagaaaaggcttgcaatgggaaaattggatattccatatggtagttccgtgccttaccgtcacatgtgccgtttccagtcagggttcatatggagacacccactactggaggagtacgaatggttttggagagtggataccgatatcactttattctgtgatattcagtatgacatattcaagtttttaaaagtaaataacaagaaatatggattcattctttcggtaagtgaatatgagcgcacaatcccaaccttgtgggaaacgacaaagaaattcatcaagaaaaatcctaaattcttacacaaaaataacctcatgaaattcatttcgaatgatgatggtgacacttataatatgtgtcatttctggaccaacttcgaaatcggctctttagacttcttcaggtccgatgcatacagagaatactttgattacttagacagttctggtggattcttctacgaaagatggggggatgcgccagtgcactccatcgctgcctctttgttcttggacaagtcagaaatccatttctttgacggtcttggattccatcatccagatttcacctcttgtcctatcgaacagaagattagactacaaaacaagtgtatctgcgaacctagcaaggacgtcacctggactcctgactacttctgtactagaaagtacttttcagcaggaaattacaagcttccaccaggaatttaa

SEQ ID NO: 45638 - protein, 404 aa, Saccharomyces cerevisiae
MSVHHKKKLMPKSALLIRKYQKGIRSSFIGLIIVLSFLFFMSGSRSPEVPIAQGTSVSRVASKDYLMPFTDKSQGVIHPVDDGKKEKGVMVTLARNSDLRNLVKSIRHVEDRFNNRYHYDWVFLNDQPFSDEFKRVTSALVSGKAKYGTIPKDHWSIPSWIDTEKFDEKRLAMGKLDIPYGSSVPYRHMCRFQSGFIWRHPLLEEYEWFWRVDTDITLFCDIQYDIFKFLKVNNKKYGFILSVSEYERTIPTLWETTKKFIKKNPKFLHKNNLMKFISNDDGDTYNMCHFWTNFEIGSLDFFRSDAYREYFDYLDSSGGFFYERWGDAPVHSIAASLFLDKSEIHFFDGLGFHHPDFTSCPIEQKIRLQNKCICEPSKDVTWTPDYFCTRKYFSAGNYKLPPGI

SEQ ID NO: 45639 - DNA, 1233 bp, Candida albicans
  CDS (1)..(1233): transl_table=12
atgactagctattcgattgcatttataagtggtgttatactatctatttactactactttgttttgaactatttttctgagttaaagttcagcgaaccaccatatcaacgatataatccactagcgaaagaccaacctaaattagctagtaatcaatatttagacaaaatttatccaccagagaataggaaacagatagggaaagaaaatgccacgatggtaatgttagtgagaaacatcgaattagaaggagcattagaatcaatgcgatcattagaagatcgattcaatcgagattataaatatccttgggttttccttaatgatgaaccatttactgaagaatttatggagaaaaccacattaatggcaagtggtgaaactttttatgaattaatccctgtcgaagattggcaaccaccaatatttattaatgaaacaaaattacaagaaaatttagataattctaaaactaatgttatttatggtggagttagatcttatcgtaatatgtgtcattttaattctgggtttttttataaacaaaaaaaattattgaattatgattggtattttcgagttgaaccaaatgttgaatatatgtgtgattttcaatatgatccatttgaatttcttcgaattaataataaaatttatggatttattattgccattactgaatatgaaaatactattcctaatctttggcccacagtagaatcatttatgaaaaaacatccagaattacttcatccaaataatgccattgaatttttaacaagtaaagaaatttctttaaatcattatatggatttaattccttcagcaactgattataatctttgtcatttttggtcgaattttgaaattggtaatttgaattttttccgtaatgaatcatatgaaacttttttccaatatttagatcatacgggtgggttttattatgaaagatggggggatgctccagttcataccattggattgagtttattggctgataaagattcaattcatcattttgaagatattggatattatcatgcaccgtatttggcatgtcctctggctgacgatgttttggcttctaaaagatgtgtttgtgtttctcgacaatcagaagataaaataaatcgaaccattgatactaatatatatagttgtttacctcgatggtggaaatatggttctggtaaacgatttcttaatcaaattgattataaacgagattaa

SEQ ID NO: 45640 - protein, 410 aa, Candida albicans
MTSYSIAFISGVILSIYYYFVLNYFSELKFSEPPYQRYNPLAKDQPKLASNQYLDKIYPPENRKQIGKENATMVMLVRNIELEGALESMRSLEDRFNRDYKYPWVFLNDEPFTEEFMEKTTLMASGETFYELIPVEDWQPPIFINETKLQENLDNSKTNVIYGGVRSYRNMCHFNSGFFYKQKKLLNYDWYFRVEPNVEYMCDFQYDPFEFLRINNKIYGFIIAITEYENTIPNLWPTVESFMKKHPELLHPNNAIEFLTSKEISLNHYMDLIPSATDYNLCHFWSNFEIGNLNFFRNESYETFFQYLDHTGGFYYERWGDAPVHTIGLSLLADKDSIHHFEDIGYYHAPYLACPSADDVLASKRCVCVSRQSEDKINRTIDTNIYSCLPRWWKYGSGKRFLNQIDYKRD

SEQ ID NO: 45641 - DNA, 1443 bp, Candida albicans
  CDS (1)..(1443): transl_table=12
atgattagttttattagtcttcggagaagaaaattgatatcgattctagcgattttcaccatatttatccttctgggttcaatcattggatattataatggtcatcatcatataattaaaatggtggaaaattatacacctgatgattttcaaaattcaataactgcattgactaataaatttgatttttcatatttacctggatttaaaggaatcatcaccaaaaataatagcactagttttgaatcattagatgatcttgatatgaatggattttcattaatccctggtaatgttcaatttaaatttttaaataaaggtaataaaaagggtacaccagaacaaattcttgaacaaaatatgaaagattataaagaattattaggatcgaaaactattggacaaccaaaagatgccaaattggttccaccaccaccacctgaagaattaccaaattataaaagagccaatgcaactatattatcattagtacgtaatggtgaattaggggcaattggtattagtattaaacgattacaaaaaaaattcaattcgaaatataattatccttatacatttttaaatgatgaaccatttactgatcgatttaaacaacggattttgaaatatactgggaatgcacctgtcgaatttgttcaaattaaacctgaatattggcaaaaaccatcatttatagatacagttaaagaagctaaagaaatggaaattatgtttaaacatgatgttgcgtatgccaagaagcaatcatatcataatatgtgtcgattttatctgagtcaattttataaaattcctgaattacaaaaatataaatattattggcgagtggaacctaaagttaattttttcactgatattaattatgatgtttttaaatatatggaagacacccaaaaaatttatggatttaccattaatttatatgataatgaagaaaccgtgaaaactctttggcctgaaaccattaaatatttaaatcaaggtgataattataaatatattaatccgaaaggatcatttcaatggttattagaagatttacaaaatcctaaaaaaacaaaatttgctggaggttattcaacttgtcatttttggtcaaattttgaaattggtgattttgattttttccgtaatgaagcttatgataattgggttaaatatcttgattctacagggaaattttattatgaacgatggggtgatgcaccagtacattcaattggagttagtttatttgctgataaagataaaattcatttttttaaagatattggttatgatcatgatccttatactaattgtccaaatactgaaactactcaaatgtgtgaaattgggaaatttagtagatgggaacatttatatgatcaaaattgcttaatgaattggcttcatcatgatcaacccaaagatgtatattaa

SEQ ID NO: 45642 - protein, 480 aa, Candida albicans
MISFISLRRRKLISILAIFTIFILSGSIIGYYNGHHHIIKMVENYTPDDFQNSITALTNKFDFSYLPGFKGIITKNNSTSFESLDDLDMNGFSLIPGNVQFKFLNKGNKKGTPEQILEQNMKDYKELLGSKTIGQPKDAKLVPPPPPEELPNYKRANATILSLVRNGELGAIGISIKRLQKKFNSKYNYPYTFLNDEPFTDRFKQRILKYTGNAPVEFVQIKPEYWQKPSFIDTVKEAKEMEIMFKHDVAYAKKQSYHNMCRFYSSQFYKIPELQKYKYYWRVEPKVNFFTDINYDVFKYMEDTQKIYGFTINLYDNEETVKTLWPETIKYLNQGDNYKYINPKGSFQWLLEDLQNPKKTKFAGGYSTCHFWSNFEIGDFDFFRNEAYDNWVKYLDSTGKFYYERWGDAPVHSIGVSLFADKDKIHFFKDIGYDHDPYTNCPNTETTQMCEIGKFSRWEHLYDQNCLMNWLHHDQPKDVY

SEQ ID NO: 45643 - DNA, 1296 bp, Candida albicans
  CDS (1)..(1296): transl_table=12
atggcttctaccagatcgaatgctcgtttgattagatttgggatctttgcccttgttttaataggatgtggctatatccttacaagaggctcatcattccaacctccaaattatcaacaaacacaatcacccgccgctcatgaaaaacagaccggtaatgttgctgctggaggtggtgctggttcaggttccgcaggagctcaagttccattaggcaaaaatagaggtccaataccaaaagcaattatgggagctggtgaaggtggtagtgatgctccggttcctcaacaagatattcctgatagttataccctcaatgacaaaattaaggctacatttgtcactttggcccgtaactctgatttatattctttagctgaatcaattagacacgttgaagatcgtttcaataagaaattccattatgattgggttttcctcaatgatgaagaattcaatgatgaatttaaagaaactgttggtagtttagttagtggtaacactaaatttggtttgattccaaaggaacattggtcatatcctccatggattgatcaagaaaaagctgctttagtccgtgaacaaatgagagaaaagaagattatttatggtcattctgaatcttatcgtcacatgtgtagatttgaaagtgggtttttctggaggcaagaaattttaaacgattatgattactattggagagttgaaccagatatcaaattatattgtgatattgattatgatatctttaaatggatgaaagataataataaagattatgcattcactatttccttaccagaatataaagaaaccattcctactttatgggacactactaaagaatttattgaaaaaaacccacaatatttggctcaaaataacttgatggattgggtttctgacgataaaggtcaaacttataatggttgtcatttctggtccaattttgaaattggttctttggcattttggagaagtgaagcttacagaaaatattttgaacatttagataaagctggtggattcttttatgaaagatggggtgatgctccagttcattccattgctgcagcattatttttaccaagagaaaaaatccatttctttgaagatgttggttattatcatgttccatttaccaattgcccagttgataaagaagtcagaaaggcaagaaattgtaattgtgatcctaacaaagattttacttggagaggctattcttgtactaccaaatattacactttgaataatttcaaaagacaaaagggttgggaaaagtacactgcttaa

SEQ ID NO: 45644 - protein, 431 aa, Candida albicans
MASTRSNARLIRFGIFALVLIGCGYILTRGSSFQPPNYQQTQSPAAHEKQTGNVAAGGGAGSGSAGAQVPLGKNRGPIPKAIMGAGEGGSDAPVPQQDIPDSYTLNDKIKATFVTLARNSDLYSLAESIRHVEDRFNKKFHYDWVFLNDEEFNDEFKETVGSLVSGNTKFGLIPKEHWSYPPWIDQEKAALVREQMREKKIIYGHSESYRHMCRFESGFFWRQEILNDYDYYWRVEPDIKLYCDIDYDIFKWMKDNNKDYAFTISLPEYKETIPTLWDTTKEFIEKNPQYLAQNNLMDWVSDDKGQTYNGCHFWSNFEIGSLAFWRSEAYRKYFEHLDKAGGFFYERWGDAPVHSIAAALFLPREKIHFFEDVGYYHVPFTNCPVDKEVRKARNCNCDPNKDFTWRGYSCTTKYYTLNNFKRQKGWEKYTA

SEQ ID NO: 45645 - DNA, 1329 bp, Saccharomyces cerevisiae
  CDS (1)..(1329)
atggccctctttctcagtaagagactgttgagatttaccgtcattgcaggtgcggttattgttctcctcctaacattgaattccaacagtagaactcagcaatatattccgagttccatctccgctgcatttgattttacctcaggatctatatcccctgaacaacaagtcatctctgaggaaaatgatgctaaaaaattagagcaaagtgctctgaattcagaggcaagcgaagactccgaagccatggatgaagaatccaaggctctgaaagctgccgctgaaaaggcagatgccccgatcgacactaaaacaaccatggattatatcactccatcttttgctaacaaagctggtaagccaaaagcttgttacgtcactttggtgagaaacaaggagttgaaaggtttgctaagctccattaaatatgtggaaaacaaaattaacaagaaattcccatatccttgggttttcctaaacgatgaaccttttactgaagaattcaaggaagcagtcaccaaagctgtttcttccgaagttaagtttggtattttgcccaaggaacattggtcatatcctgaatggattaatcaaaccaaggctgctgaaattcgtgcagatgctgccaccaaatacatatacggtggctccgaatcttatagacacatgtgtcgttaccaatctgggtttttctggagacatgaattattagaagagtacgattggtactggcgtgtggaaccagacatcaagttatactgtgatattaattacgacgtttttaagtggatgcaagaaaacgaaaaagtttacggctttaccgtttctattcatgaatatgaagtgacgatcccaacactatggcaaacgtccatggatttcatcaaaaagaaccccgaatacttagatgaaaacaacctgatgagttttctttcgaacgataatggtaaaacatacaatctgtgccatttctggtcaaactttgaaattgcaaacttgaatttgtggaggtcaccagcctacagagagtattttgacactttggatcatcaaggtggatttttctacgaaagatggggcgatgctcccgttcattctattgctgctgctttgtttttgccaaaggataaaatccattatttttcagacattggttaccatcatccaccttatgataactgcccattggacaaggaggtctataacagtaacaactgtgaatgtgaccaaggtaatgatttcactttccaaggttactcttgtggtaaggaatattatgatgctcaagggttggtaaagccaaaaaactggaaaaaattccgtgagtag

SEQ ID NO: 45646 - protein, 442 aa, Saccharomyces cerevisiae
MALFLSKRLLRFTVIAGAVIVLLLTLNSNSRTQQYIPSSISAAFDFTSGSISPEQQVISEENDAKKLEQSALNSEASEDSEAMDEESKALKAAAEKADAPIDTKTTMDYITPSFANKAGKPKACYVTLVRNKELKGLLSSIKYVENKINKKFPYPWVFLNDEPFTEEFKEAVTKAVSSEVKFGILPKEHWSYPEWINQTKAAEIRADAATKYIYGGSESYRHMCRYQSGFFWRHELLEEYDWYWRVEPDIKLYCDINYDVFKWMQENEKVYGFTVSIHEYEVTIPTLWQTSMDFIKKNPEYLDENNLMSFLSNDNGKTYNLCHFWSNFEIANLNLWRSPAYREYFDTLDHQGGFFYERWGDAPVHSIAAALFLPKDKIHYFSDIGYHHPPYDNCPLDKEVYNSNNCECDQGNDFTFQGYSCGKEYYDAQGLVKPKNWKKFRE

SEQ ID NO: 45647 - DNA, 1182 bp, Saccharomyces cerevisiae
  CDS (1)..(1182)
atggcgaagattatgatcccagctagcaagcagcctgtttacaaaaaattaggacttcttctggtcgccgtgtttactgtgtatgtgttctttcatggagctcagtatgcgagaggctctgccccaagcccaaagtacagtaccgtgctatcttccggctcgggctataaatactcgaaagtggaactaccaaagtataccggtcctcgggaaaaggccacttttgtcactctagtgcgtaatagagatctatattcgttggctgagtctattaaatccgtggaagatagatttaactccaagttcaactatgattgggtgtttttgaatgatgaagagttcactgatgaattcaaaaacgttacgtcagctttagttagtggtacaacaaaatacggtgtcatcccaaaggaacattggtccttccctgagtggattgatgaagaaaaggccgctcaagtcaggaaggagatgggtgagaagagaatcatctacggtgattctatctcttacagacacatgtgtcgttttgaatcaggcttcttttacagacatcctttgatggatgactacgattggtattggcgtgtggaacctgatatcaagttgcactgtgatatcgactacgatgtcttcaaattcatgaaagacaataagaaaaagtatgcctttgccatttccattaaggagtatgaagctactatccccactttatgggagactactcgtaaattcatggaagcccatcctgagcttatccatgaaaataatatgttagactttgttagcgacgatcagggactttcatacaatttgtgccatttttggtctaattttgaaattgctgctttggatttgtggagatctccagcatactccgcatattttgattatttagatcgtgaaggtggattcttttatgaaagatggggtgatgctccagttcattctattggtgctgcgctgttcttggaccgctctgaaatccatcacttcggtgatattggttattaccatgttccatttcactcctgtccaatagacacaagtatcagactggctaacaaatgtgactgtgatccaagcaaagatttcacatggcacagttattcatgtactactaaattctacaatataaacaagttgccaaagcctgctggttggcaaaaccatatcggttga

SEQ ID NO: 45648 - protein, 393 aa, Saccharomyces cerevisiae
MAKIMIPASKQPVYKKLGLLLVAVFTVYVFFHGAQYARGSAPSPKYSTVLSSGSGYKYSKVELPKYTGPREKATFVTLVRNRDLYSLAESIKSVEDRFNSKFNYDWVFLNDEEFTDEFKNVTSALVSGTTKYGVIPKEHWSFPEWIDEEKAAQVRKEMGEKRIIYGDSISYRHMCRFESGFFYRHPLMDDYDWYWRVEPDIKLHCDIDYDVFKFMKDNKKKYAFAISIKEYEATIPTLWETTRKFMEAHPELIHENNMLDFVSDDQGLSYNLCHFWSNFEIAALDLWRSPAYSAYFDYLDREGGFFYERWGDAPVHSIGAALFLDRSEIHHFGDIGYYHVPFHSCPIDTSIRLANKCDCDPSKDFTWHSYSCTTKFYNINKLPKPAGWQNHIG

SEQ ID NO: 45649 - DNA, 1278 bp, Saccharomyces cerevisiae
  CDS (1)..(1278)
atgcaaatctgcaaggtatttcttacacaggttaaaaaactactttttgttagtcttctattttgcttgatagctcaaacatgttggcttgcacttgtaccatatcagagacagctgagcctagattcgtatttttttagaagatctcgagaagtttcatcgagatatgattttacaaggaggcgacatatgaatcagacgctgaagctatctagcaacacttataatgatgaaccactaaacaagaccaagggaataaaaaatcaaagagaaaatgctacattgttaatgcttgtgcgtaattgggaactttcgggggcactccgttccatgagatcactagaagaccgtttcaataaaaactaccagtatgactggacatttcttaatgatgtcccatttgatcaagagttcatcgaagccaccacagccatggctagtggtagaacgcaatacgctttaatccctgcggaggactggaacaggccatcttggatcaacgaaactctatttgaagaggctttacaattaatggaggaaaaaaatatcttgtacggtgggtcaaagtcatatagaaatatgtgccgatttaattctggatttttctttagacaaaagatattagatccgtacgatttttatttcagagttgagccagatgtagagtatttttgcgattttccctacgatccattcaaggtgatgaggcagaacaataagaaatatggctttgtgataactatgtatgaatacgaagatacaattccgagcctatgggaagctgtagaagaatatctcgaagaaacagagtcagcagatattgacatggaaagcaacgctttcgggttcgtatcaaatttcgacttcatcggtaaatcttttggtgtcatcgatagtaacagcggctataatttatgtcatttttggacaaattttgaaattggcgatttgaactttttcagaagtgagaaatacattagatttttcgagtacttggattcaaagggcggtttttactatgaaaggtggggagatgcaccagttcattcgattgctgcctcacttcttttgaaaaaagacgaaatcatccattttgatgaattaggctataagcatatgccttttggcacgtgtccatctgcatactacctgagacttcaacaaagatgtctttgtgatagcaatcacccagacaatattgatctcaatgtcatcagctgcctgagaagatggtggaaggacggcagcggtaaatacttcctcaaacacgattcatag

SEQ ID NO: 45650 - protein, 425 aa, Saccharomyces cerevisiae
MQICKVFLTQVKKLLFVSLLFCLIAQTCWLALVPYQRQLSLDSYFFRRSREVSSRYDFTRRRHMNQTLKLSSNTYNDEPLNKTKGIKNQRENATLLMLVRNWELSGALRSMRSLEDRFNKNYQYDWTFLNDVPFDQEFIEATTAMASGRTQYALIPAEDWNRPSWINETLFEEALQLMEEKNILYGGSKSYRNMCRFNSGFFFRQKILDPYDFYFRVEPDVEYFCDFPYDPFKVMRQNNKKYGFVITMYEYEDTIPSLWEAVEEYLEETESADIDMESNAFGFVSNFDFIGKSFGVIDSNSGYNLCHFWTNFEIGDLNFFRSEKYIRFFEYLDSKGGFYYERWGDAPVHSIAASLLLKKDEIIHFDELGYKHMPFGTCPSAYYLRLQQRCLCDSNHPDNIDLNVISCLRRWWKDGSGKYFLKHDS

SEQ ID NO: 45651 - DNA, 1215 bp, Saccharomyces cerevisiae
  CDS (1)..(1215)
atgtctgtgcaccacaaaaagaagctaatgcccaaatcggcattgctgattagaaaataccaaaagggaatcagatcatcattcattgggctcatcatagtgttatcctttttatttttcatgagtggctcaaggtccccagaggtaccaatagctcagggcaccagtgtcagtcgtgtagccagtaaggattatttgatgccgtttactgacaagtcacaaggagtaatccatcccgtggacgatggaaagaaggaaaagggtgttatggtcacattggccaggaattcagatttatggaacttggtaaaatctattagacatgttgaagacaggttcaataacagatatcactacgattgggtgttcttgaatgaccaaccatttagtgatgagtttaaacgtgttaccagtgcattggtttcaggcaaggcaaaatatgggacaatcccaaaggaccattggtccattccatcttggatcgatactgaaaaattcgatgagaaaaggcttgcaatgggaaaattggatattccatatggtagttccgtgccttaccgtcacatgtgccgtttccagtcagggttcatatggagacacccactactggaggagtacgaatggttttggagagtggataccgatatcactttattctgtgatattcagtatgacatattcaagtttttaaaagtaaataacaagaaatatggattcattctttcggtaagtgaatatgagcgcacaatcccaaccttgtgggaaacgacaaagaaattcatcaagaaaaatcctaaattcttacacaaaaataacctcatgaaattcatttcgaatgatgatggtgacacttataatatgtgtcatttctggaccaacttcgaaatcggctctttagacttcttcaggtccgatgcatacagagaatactttgattacttagacagttctggtggattcttctacgaaagatggggggatgcgccagtgcactccatcgctgcctctttgttcttggacaagtcagaaatccatttctttgacggtcttggattccatcatccagatttcacctcttgtcctatcgaacagaagattagactacaaaacaagtgtatctgcgaacctagcaaggacgtcacctggactcctgactacttctgtactagaaagtacttttcagcaggaaattacaagcttccaccaggaatttaa

SEQ ID NO: 45652 - protein, 404 aa, Saccharomyces cerevisiae
MSVHHKKKLMPKSALLIRKYQKGIRSSFIGLIIVLSFLFFMSGSRSPEVPIAQGTSVSRVASKDYLMPFTDKSQGVIHPVDDGKKEKGVMVTLARNSDLWNLVKSIRHVEDRFNNRYHYDWVFLNDQPFSDEFKRVTSALVSGKAKYGTIPKDHWSIPSWIDTEKFDEKRLAMGKLDIPYGSSVPYRHMCRFQSGFIWRHPLLEEYEWFWRVDTDITLFCDIQYDIFKFLKVNNKKYGFILSVSEYERTIPTLWETTKKFIKKNPKFLHKNNLMKFISNDDGDTYNMCHFWTNFEIGSLDFFRSDAYREYFDYLDSSGGFFYERWGDAPVHSIAASLFLDKSEIHFFDGLGFHHPDFTSCPIEQKIRLQNKCICEPSKDVTWTPDYFCTRKYFSAGNYKLPPGI

SEQ ID NO: 45653 - DNA, 1395 bp, Saccharomyces cerevisiae
  CDS (1)..(1395)
atgaggtttctttcaaaaaggatactgaaacctgtactttcagtgatcattctaatatcgattgccgtaaccgttgttctttactttttaacggcgaatgagaactatttgcaagcagtcaaggatagtgccaagtcccagtatgcttctctccgggagagctacaaaagtattacaggtaaaactgaaagcgctgatgaacttcctgatcatgatgctgaggtgttagatagcataatggacaggctacacgagcccctttatgaaaaggacacttttgacccgaatgaagtccttgctgaaaataaacagttgtacgaggagtttttacttcaagaaatttctgagccaaaggtggacaatttggtacgtagcggggatccgttagccggcaaggcaaaaggaactattttgagtttggtgagaaattctgatttagaggatataatttcttctattcaacagctagaagaggagtacaataagaattttggatatccctataccttccttaacgatgaggaatttactgacgaattcaaagatggaataaaaagtattcttcctaaggaccgtgtagtagaatttggcactattggtccagataactggaatatgcctgatagcatagatagggagagatacgaccaagaaatggacaaaatgagtaaagagaacattcagtatgcagaggtggaatcctatcataacatgtgtcgtttctattctaaagaattttaccatcatcctctgctatctaaatataaatatgtgtggagattagagccaaacgtgaatttctattgcaaaattaactatgacgttttccaatttatgaacaagaatgacaagatttatgggtttgttttgaacctctatgatagtccgcaaaccatcgaaacgctatggacttcaactatggattttgtcgaggaacacccaaactatttgaacgtcaacggagccttcgcatggctaaaagataactctcaaaatccaaaaaattatgattatactcaagggtattcaacttgtcatttctggaccaattttgaaatagtcgatttagactttttgaggtcagaaccttatgaaaaatatatgcaatatcttgaagaaaagggaggattctactatgaaaggtggggtgatgcccctgtaagaagtttggcacttgctttatttgcggataagtcaagcatccattggttcagggatataggttatcaccatactccgtacacgaactgtccaacttgtccagcagattcagataggtgtaatggaaattgtgtaccaggcaaattcactccttggagtgatctagacaaccaaaattgccaggcaacctggataagacactctatgtctgaggaagagttagaaatgtattga

SEQ ID NO: 45654 - protein, 464 aa, Saccharomyces cerevisiae
MRFLSKRILKPVLSVIILISIAVTVVLYFLTANENYLQAVKDSAKSQYASLRESYKSITGKTESADELPDHDAEVLDSIMDRLHEPLYEKDTFDPNEVLAENKQLYEEFLLQEISEPKVDNLVRSGDPLAGKAKGTILSLVRNSDLEDIISSIQQLEEEYNKNFGYPYTFLNDEEFTDEFKDGIKSILPKDRVVEFGTIGPDNWNMPDSIDRERYDQEMDKMSKENIQYAEVESYHNMCRFYSKEFYHHPLLSKYKYVWRLEPNVNFYCKINYDVFQFMNKNDKIYGFVLNLYDSPQTIETLWTSTMDFVEEHPNYLNVNGAFAWLKDNSQNPKNYDYTQGYSTCHFWTNFEIVDLDFLRSEPYEKYMQYLEEKGGFYYERWGDAPVRSLALALFADKSSIHWFRDIGYHHTPYTNCPTCPADSDRCNGNCVPGKFTPWSDLDNQNCQATWIRHSMSEEELEMY

SEQ ID NO: 45655 - DNA, 1569 bp, Saccharomyces cerevisiae
  CDS (1)..(1569)
atgttgctaataagaaggacgataaatgcatttctgggatgtatccattgcaatcttacggcgacgtgcatcctgattgccttcgtcataaccatgtatgtggtacttgtatctgagcctgcatccgtagacggaactatgggaaattttcttccgttttccaagatggatcttgcgacgaagagggacagacccttttattcgaattgtgtgaatactcaggactatttgttgaatccatcgtacatcaagcagaatgcctcgtttgtcatgctaacaaggaacggggagctagaagatgttatcaagactatcaacagtatagaagagcatttcaatcagtggttccactatccatatgtgttcttaaatgaccagccgtttgaagaggacttcaaagcaaaagtacgtgatgttacagtgggcgcgctggtggaatttggcactatcgatgagatatcttggaattttcccagtgacgtaaaggatacgttcgagttctacaacgcaattgaggatcaaggtgatagaagcatactttacggaaacttagaatcatatcataagatgtgccggttttattcaggattattttacaagcacccgctagtacagaagtacgaatggtattggagattggaacccgatgttgagtttttctgtgatattacctacgatccctttttggagatgctccgaactaataagaaatatggatttacgatcatcatccccgaattgtattggacagtcccaaatttgtttagacacactaaaagctttatcagtcaaaaaggcgttacgcttgggtcattatggaaactatttacaaaggattacgacatttttgaatccgatgatccggagttacgggactggatcaactatgattttcaggccaaggctaagatatccgaaaagatagccatcgagcagcttttgaaaaagggtgatgatttccaacagataaatgatgacaaagagggaataatgaatttgatacataaggctcgctctaggaagcatatcgtagaagacaaatttttcaatgaagagtacaatctatgccatttctggagtaattttgagattgcgcggctaagcgtgttcgacaatgacatttacaacagtttttttcaatatttggagaaaagtggtggattttggaaggaaagatggggggacgctcctgttcactctattggattgtcgctaactctggatttggacgatgtacactattttagagacatcggatatagacactccacaatacagcattgtccacataatgccatggggaatgaggaattctcctacttagccagtgactcaaaattcaaacgtaaaaacgcggcctacgacgagggaagggaatttgggtgtggctgcaggtgcagatgtcccaagaaaaagcgtgaaattgaggattccatgggtttctgcgtaaatatttgggtaaatctgcttaaccaacagaggggacacgaacgccacgtcgaagcactcaacggcaatgaaatggaggagcacataagggaagactatctaagacagttcggaaactag

SEQ ID NO: 45656 - protein, 522 aa, Saccharomyces cerevisiae
MLLIRRTINAFLGCIHCNLTATCILIAFVITMYVVLVSEPASVDGTMGNFLPFSKMDLATKRDRPFYSNCVNTQDYLLNPSYIKQNASFVMLTRNGELEDVIKTINSIEEHFNQWFHYPYVFLNDQPFEEDFKAKVRDVTVGALVEFGTIDEISWNFPSDVKDTFEFYNAIEDQGDRSILYGNLESYHKMCRFYSGLFYKHPLVQKYEWYWRLEPDVEFFCDITYDPFLEMLRTNKKYGFTIIIPELYWTVPNLFRHTKSFISQKGVTLGSLWKLFTKDYDIFESDDPELRDWINYDFQAKAKISEKIAIEQLLKKGDDFQQINDDKEGIMNLIHKARSRKHIVEDKFFNEEYNLCHFWSNFEIARLSVFDNDIYNSFFQYLEKSGGFWKERWGDAPVHSIGLSLTLDLDDVHYFRDIGYRHSTIQHCPHNAMGNEEFSYLASDSKFKRKNAAYDEGREFGCGCRCRCPKKKREIEDSMGFCVNIWVNLLNQQRGHERHVEALNGNEMEEHIREDYLRQFGN

SEQ ID NO: 45657 - DNA, 1341 bp, Saccharomyces cerevisiae
  CDS (1)..(1341)
atgcacgtactgctgagcaaaaaaatagcacgctttctgttgatttcgtttgttttcgtgcttgcgctaatggtgacaataaatcatccaaaaacaaagcagatgtctgaacagtatgttacaccataccttccgaaatctttgcaacctattgcaaaaattagtgcagaggaacaaaggcgtatacaaagtgaacaggaagaagccgaattgaagcaatctttagagggagaggccattagaaatgccaccgtgaatgccattaaggaaaagatcaaatcttatggtggtaatgaaacgacgctagggttcatggtgccatcgtatatcaatcatagaggatcaccaccaaaggcgtgctttgtctcactaattactgaaagggattccatgacccaaatcttacaatctattgatgaagtgcaggtgaagtttaacaaaaattttgcttatccttgggtttttattagtcagggggagcttgacggaatgaagcaagaaatgattcgtcaagccataactgattctatgaatggtgatcctgagttaattaatattaaatttgctgaaattcctgcagacgaatgggtataccctgaatggattgatgaaaataaagcagcagaatcgctaatttcattagcaaatgtaccggatggtgattctagagctgtaagatatcaagctagatattttgcagggtttttttggaggcatccagttctggatgagtttgattggtactggagagtagaccctggtattaaattgtactgtgatattgatcatgacctttttaggtggatgcaagatgaaggcaaagtgtttggtttcacattgagtatgagtgaagctaaggaagccaatgagaagatttgggatgttacgaaaaaatttgcaaaggattttccaaagtttatttccgagaataatttcaagtcatttattacaaaaaaggactctgaagattttaacaactgtgaattcacatcaaattttgaaattggtaatttgaacttttatagatcgccagcttacaggaaattttttaattacatcgacgaagagggcggtattttctactggaaatggtctgattccatcatccacacaattgggttatcgatgctgttgccaaaggataaaatacattttttcgaaaatataggattccattatgacaagtacaataactgtcccctaaacgatgatatatggaaccaatataattgtaactgtgaccagggtaacgatttcacgtttagaagtggttcatgtggcggacattacttcgacattatgaagaaagataagccagaaggttgggataggttaccataa

SEQ ID NO: 45658 - protein, 446 aa, Saccharomyces cerevisiae
MHVLLSKKIARFLLISFVFVLALMVTINHPKTKQMSEQYVTPYLPKSLQPIAKISAEEQRRIQSEQEEAELKQSLEGEAIRNATVNAIKEKIKSYGGNETTLGFMVPSYINHRGSPPKACFVSLITERDSMTQILQSIDEVQVKFNKNFAYPWVFISQGELDGMKQEMIRQAITDSMNGDPELINIKFAEIPADEWVYPEWIDENKAAESLISLANVPDGDSRAVRYQARYFAGFFWRHPVLDEFDWYWRVDPGIKLYCDIDHDLFRWMQDEGKVFGFTLSMSEAKEANEKIWDVTKKFAKDFPKFISENNFKSFITKKDSEDFNNCEFTSNFEIGNLNFYRSPAYRKFFNYIDEEGGIFYWKWSDSIIHTIGLSMLLPKDKIHFFENIGFHYDKYNNCPLNDDIWNQYNCNCDQGNDFTFRSGSCGGHYFDIMKKDKPEGWDRLP

SEQ ID NO: 45659 - DNA, 1554 bp, Saccharomyces cerevisiae
  CDS (1)..(1554)
atggctataagattgaatccaaaagtcagaaggttcttgctggataagtgtcgacaaaaacgatatggtttcctctttttaggatgtatcttcgccatactttactgtatggggacctggccatttttcgcaaaagatattgtacatgatccaaataatttgccttattccttacaggattattcgactgacaaagacgagccatttttccggggctgcactgatacaaagctgtacttgcaaaatcctgcttactccaaaatgaacgcatctttcgttatgctaacgagaaacgaagaaatagaagacgtactgaaaactatgagaagtatagagggccatttcaataagtggttcaaatatccgtacgttttcttgaatgatgacccctttacagatcattttaaggaccaaattcaagctgcaactaatgccactgtagagtttggcactgttgatgaaattatgtgggagtttcctgctaaggttcgtaattcattgcagtttaaggcttcattagaagaccaaaacgatcgcggtataatgtatggtaatatggaatcatatcacaagatgtgtcgattttactccgggatcttttataaacatccattagtttccaagtatgaatggtattggagaatagaacctgatgtggactttttttgtgacatctcgtatgatccctttttcgagatggccaaacataacaagaaatatgggtttaccgtacttataactgaactgtactggactgtccccaacttgttcagaacaaccaaaagctttataaaaaaaacggcaggtttaaaggaaaatctcggcacgttgtggaaattatttacatttaattataatattctagatacagatgatgaagaaatttctaggtgggtcaattttccctgggatgcaaagccaaagttgacagaaaagttgatggtagactttttgctagagaatcatggtcaagtcaataatgaggaagatttggaaggtatacaatatctcgttgaaagggcccgctctaaggtgccaatgctagaggattcccttgaaggggaagattacaatttgtgtcatttttggagtaactttgaaattgcccgcgttgatttattcgacaatgagatctataacgcctattttaaatttttggaagagtctggaggtttctggactgaaaggtggggtgacgcgccaattcattcaattgggttgggaatgaccttggatctagaagacgttcattatttcagagacattggttatagacactcatcgctgcagcattgtccgaagaatgccttacaaagccaagaaaatctcaacactttcgatgaaggttataacttcggatgtggatgtcgatgcgtgtgccccaagaaaggtgaagacatcgaagaccactccaccccttgcatggatattttttttgaattgcttcacggcagggaatatgagaaggaattccctggttgttacaagccctccataaaggacaaagacgtgattgaagagatcagaagagaaaattttagagtaattgaatag

SEQ ID NO: 45660 - protein, 517 aa, Saccharomyces cerevisiae
MAIRLNPKVRRFLLDKCRQKRYGFLFLGCIFAILYCMGTWPFFAKDIVHDPNNLPYSLQDYSTDKDEPFFRGCTDTKLYLQNPAYSKMNASFVMLTRNEEIEDVLKTMRSIEGHFNKWFKYPYVFLNDDPFTDHFKDQIQAATNATVEFGTVDEIMWEFPAKVRNSLQFKASLEDQNDRGIMYGNMESYHKMCRFYSGIFYKHPLVSKYEWYWRIEPDVDFFCDISYDPFFEMAKHNKKYGFTVLITELYWTVPNLFRTTKSFIKKTAGLKENLGTLWKLFTFNYNILDTDDEEISRWVNFPWDAKPKLTEKLMVDFLLENHGQVNNEEDLEGIQYLVERARSKVPMLEDSLEGEDYNLCHFWSNFEIARVDLFDNEIYNAYFKFLEESGGFWTERWGDAPIHSIGLGMTLDLEDVHYFRDIGYRHSSLQHCPKNALQSQENLNTFDEGYNFGCGCRCVCPKKGEDIEDHSTPCMDIFFELLHGREYEKEFPGCYKPSIKDKDVIEEIRRENFRVIE

SEQ ID NO: 45661 - DNA, 1386 bp, Candida albicans
  CDS (1)..(1386): transl_table=12
atgaagccttcaatattctatagttcgagacaaccctatctcaaatatttggcaatcatcttaaccaccatcaccatctatgttctaactcatagcagttatctggctgatcctaatatcaatgatgtcaccactaagccaatactggaaactgtgccacaaccaccaccacaatcaccttcatcaccagaacaacaacaacaacaacctgcaaaccaagatcaaatcgtcaaggtgcctgaagaattgaaaaacaaacctcaagatttagttgttgataacaataaagatcaaaaaccagctgtatctggtgtaccaaaatcctcctcctcctccccacagcaacaagagaaacaagacaccaaaaaagaactggaaaattcttcttcatcaaaagatcctgtgaaaccagaaaaagttaaagccacatttgtcactttagcccgtaattctgaattatatgatttgatcaaatctattcgtaatgttgaagaccgtttcaatagaaaattcaattatgattgggtatttcttaatgatgatgatttcacccaagaatttaaagatttaactacagcattagtttctggtaaaaccaaatatgggaaaattcctaaagaacattggtcatatcctgattggattgatttgaaaagagcagaagaaactcgtaaaaatatgaaattacaaaaaatcatttatggagatagtgaatcttatcgtcatatgtgtcgatttgaaagtgggtttttttggagacatccattattagatgattatgattggtattggagagttgaaccaagtattgatattcattgtgatttgaattatgatttattcaaatacatggaagataataataaagtttatggttttactatttcaattcatgaatttagagccaccattcctacattatgggataccacgaaaaaattcattaaagaaaatcctcaatatttagctgaaaataattttatggattttattagtgatgataaaggtgaaacttataatttatgtcatttttggtcgaattttgaaattgccaatttgaatttttggagaggtgaagcttatagaaaatattttgattatttagatcaaacgggtggatttttctatgaacgttggggtgatgctccaattcattctattgctgcagcattatttttaccaaaagataaaattcattattttgatgatgttggttataaacatagtgtttatactcaatgtccattaaatcctcaatttagatacgaacataaatgtcattgtaatccagataatgattttacttttagaggttattcttgtggtaagaaatattttgaaaaaatgggtttacaaaaacctaaagaatgggaaaaatatcaataa

SEQ ID NO: 45662 - protein, 461 aa, Candida albicans
MKPSIFYSSRQPYLKYLAIILTTITIYVLTHSSYSADPNINDVTTKPISETVPQPPPQSPSSPEQQQQQPANQDQIVKVPEELKNKPQDLVVDNNKDQKPAVSGVPKSSSSSPQQQEKQDTKKESENSSSSKDPVKPEKVKATFVTLARNSELYDLIKSIRNVEDRFNRKFNYDWVFLNDDDFTQEFKDLTTALVSGKTKYGKIPKEHWSYPDWIDLKRAEETRKNMKLQKIIYGDSESYRHMCRFESGFFWRHPLLDDYDWYWRVEPSIDIHCDLNYDLFKYMEDNNKVYGFTISIHEFRATIPTLWDTTKKFIKENPQYLAENNFMDFISDDKGETYNLCHFWSNFEIANLNFWRGEAYRKYFDYLDQTGGFFYERWGDAPIHSIAAALFLPKDKIHYFDDVGYKHSVYTQCPLNPQFRYEHKCHCNPDNDFTFRGYSCGKKYFEKMGLQKPKEWEKYQ

SEQ ID NO: 45663 - DNA, 1137 bp, Candida albicans
  CDS (1)..(1137): transl_table=12
atgctacggcatttggtatttattttgattgcaatacttttattgacattccctcctaaaatcgaatctttattcaaatcttttatcatcaataaaccaactaaaacaacatgttatcaatataccactcgtgaacaacttaaatcaatacttgaatcagatatccatgagacaaatttttgtattgaaaaaccttccacatcacccccaaaaacaaattctacattgttaatgttatgtcaaaattccgatatattttccgtattagaaaccattcaaaacattcaggatcgattcaatgataaatacaattatgattacacgtttttaaatgacgttcccttcaactatgagtttatttatttagtatcatcaattatccctcatgggaaaatcaattttggtcttataccaattgaacattggtcatatccatcacatataaatatatcattagctactgaaatcagacaaaattatgctaatgtcccttatggagattcagaaagttatcgacacatgtgtcgattttattctgggtttttttataaacatgaattggtcaaacaatatcaatattattggagaatagaacctggcattaaaatatattgtgatattgattatgatgtgtttgaatatatgataattaatgataaaaaatatggatttgtgatttcattatttgaatactcggaaactattcctacgttatggaatcatgttgttcaatatataaatgataatgaaatcaaatcagaattgttaccacttttgactaataaatataattggtataatttatgccatttttggtcgaattttgaaattgcaaatcttgatatatttaataatgatgattatgaaaattttttccaatatttggacaatttaggagggttttattatgaacgatggggtgatgctccaatacattccattgctatagcattgttcttacaaaaaaaggatattcattggtttgaaaatataggctactatcatgttccatatctacaatgtcctcaagatattgacttgtacgtcaagaataagtgtacttgtaaccccgatgaagattttacatggagtgaccttagttgtactaaccatttcttgaacattctacataattga

SEQ ID NO: 45664 - protein, 378 aa, Candida albicans
MLRHLVFILIAILLLTFPPKIESLFKSFIINKPTKTTCYQYTTREQLKSILESDIHETNFCIEKPSTSPPKTNSTLLMLCQNSDIFSVLETIQNIQDRFNDKYNYDYTFLNDVPFNYEFIYLVSSIIPHGKINFGLIPIEHWSYPSHINISLATEIRQNYANVPYGDSESYRHMCRFYSGFFYKHELVKQYQYYWRIEPGIKIYCDIDYDVFEYMIINDKKYGFVISLFEYSETIPTLWNHVVQYINDNEIKSELLPLLTNKYNWYNLCHFWSNFEIANLDIFNNDDYENFFQYLDNLGGFYYERWGDAPIHSIAIALFLQKKDIHWFENIGYYHVPYLQCPQDIDLYVKNKCTCNPDEDFTWSDLSCTNHFLNILHN

SEQ ID NO: 45665 - DNA, 23 bp, Artificial sequence
  (1)..(23): primer
atggcaaaaggaggctcgctata

SEQ ID NO: 45666 - DNA, 26 bp, Artificial sequence
  (1)..(26): primer
ttaaatctcgtcttgctcttctttta

SEQ ID NO: 45667 - protein, 464 aa, Artificial sequence
  Variant (2)..(3): xaa in position 2 to 3 is any amino acid
  Variant (5)..(6): xaa in position 5 to 6 is any amino acid
  Variant (8)..(8): xaa in position 8 is any amino acid
  Variant (10)..(10): xaa in position 10 is any amino acid
  Variant (13)..(13): xaa in position 13 is any amino acid
  Variant (16)..(17): xaa in position 16 to 17 is any amino acid
  Variant (19)..(20): xaa in position 19 to 20 is any amino acid
  Variant (23)..(24): xaa in position 23 to 24 is any amino acid
  Variant (27)..(28): xaa in position 27 to 28 is any amino acid
  Variant (31)..(32): xaa in position 31 to 32 is any amino acid
  Variant (33)..(34): xaa in position 33 to 34 is any or no amino acid
  Variant (36)..(36): xaa in position 36 is any amino acid
  Variant (38)..(38): xaa in position 38 is any amino acid
  Variant (40)..(40): xaa in position 40 is any amino acid
  Variant (45)..(46): xaa in position 45 to 46 is any amino acid
  Variant (48)..(50): xaa in position 48 to 50 is any amino acid
  Variant (52)..(63): xaa in position 52 to 63 is any amino acid
  Variant (64)..(74): xaa in position 64 to 74 is any or no amino acid
  Variant (76)..(77): xaa in position 76 to 77 is any amino acid
  Variant (79)..(82): xaa in position 79 to 82 is any amino acid
  Variant (84)..(85): xaa in position 84 to 85 is any amino acid
  Variant (87)..(88): xaa in position 87 to 88 is any amino acid
  Variant (90)..(103): xaa in position 90 to 103 is any amino acid
  Variant (104)..(108): xaa in position 104 to 108 is any or no amino acid
  Variant (110)..(110): xaa in position 110 is any or no amino acid
  Variant (113)..(114): xaa in position 113 to 114 is any amino acid
  Variant (115)..(115): xaa in position 115 is any or no amino acid
  Variant (118)..(119): xaa in position 118 to 119 is any or no amino acid
  Variant (124)..(124): xaa in position 124 is any or no amino acid
  Variant (127)..(127): xaa in position 127 is any or no amino acid
  Variant (130)..(134): xaa in position 130 to 134 is any or no amino acid
  Variant (136)..(141): xaa in position 136 to 141 is any or no amino acid
  Variant (143)..(143): xaa in position 143 is any or no amino acid
  Variant (151)..(151): xaa in position 151 is any amino acid
  Variant (153)..(155): xaa in position 153 to 155 is any amino acid
  Variant (159)..(159): xaa in position 159 is any amino acid
  Variant (160)..(160): xaa in position 160 is any or no amino acid
  Variant (163)..(163): xaa in position 163 is any amino acid
  Variant (165)..(166): xaa in position 165 to 166 is any amino acid
  Variant (168)..(171): xaa in position 168 to 171 is any amino acid
  Variant (173)..(173): xaa in position 173 is any amino acid
  Variant (177)..(177): xaa in position 177 is any amino acid
  Variant (179)..(179): xaa in position 179 is any amino acid
  Variant (181)..(181): xaa in position 181 is any or no amino acid
  Variant (183)..(185): xaa in position 183 to 185 is any amino acid
  Variant (188)..(189): xaa in position 188 to 189 is any amino acid
  Variant (192)..(196): xaa in position 192 to 196 is any amino acid
  Variant (198)..(214): xaa in position 198 to 214 is any amino acid
  Variant (215)..(296): xaa in position 215 to 296 is any or no amino acid
  Variant (298)..(299): xaa in position 298 to 299 is any amino acid
  Variant (310)..(310): xaa in position 310 is any amino acid
  Variant (312)..(313): xaa in position 312 to 313 is any amino acid
  Variant (316)..(318): xaa in position 316 to 318 is any amino acid
  Variant (320)..(321): xaa in position 320 to 321 is any amino acid
  Variant (322)..(323): xaa in position 322 to 323 is any or no amino acid
  Variant (326)..(327): xaa in position 326 to 327 is any amino acid
  Variant (330)..(331): xaa in position 330 to 331 is any amino acid
  Variant (336)..(336): xaa in position 336 is any amino acid
  Variant (349)..(350): xaa in position 349 to 350 is any amino acid
  Variant (352)..(357): xaa in position 352 to 357 is any amino acid
  Variant (360)..(360): xaa in position 360 is any amino acid
  Variant (362)..(362): xaa in position 362 is any amino acid
  Variant (367)..(367): xaa in position 367 is any amino acid
  Variant (369)..(372): xaa in position 369 to 372 is any amino acid
  Variant (373)..(375): xaa in position 373 to 375 is any or no amino acid
  Variant (378)..(381): xaa in position 378 to 381 is any amino acid
  Variant (382)..(430): xaa in position 382 to 430 is any or no amino acid
  Variant (432)..(443): xaa in position 432 to 443 is any amino acid
  Variant (444)..(459): xaa in position 444 to 459 is any or no amino acid
  Variant (461)..(463): xaa in position 461 to 463 is any amino acid
RXXAXXVXLXRNXELXXLXXSIXXVEXXFNXXXXFXYXWXFLNDXXFXXXFXXXXXXXXXXXXXXXXXXXXXXXFXXIXXXXWXXPXXIXXXXXXXXXXXXXXXXXXXIXYGXXXSYXXMCRFXSGXFYXXXXXLXXXXXXYXYYWRVEPXVXXXCDIXXYDXFXXMXXXXKXYGFXIXLXEXXXTIXXLWXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXCHFWSNFEIAXLXXFRXXXYXXXXYFXXLDXXGGFFXERWGDAPVHSIAXXLXXXXXXIHXFXDIGYXHXXXXXXXCPXXXXXXXXXXXXXXXXXXXXXXXXXXXXXXXXXXXXXXXXXXXXXXXXXXXXXCXXXXXXXXXXXXXXXXXXXXXXXXXXXXCXXXW

SEQ ID NO: 45668 - protein, 48 aa, Artificial sequence
  Variant (2)..(3): xaa in position 2 to 3 is any amino acid
  Variant (4)..(5): xaa in position 4 to 5 is any or no amino acid
  Variant (7)..(7): xaa in position 7 is any amino acid
  Variant (8)..(9): xaa in position 8 to 9 is any or no amino acid
  Variant (12)..(12): xaa in position 12 is any amino acid
  Variant (13)..(13): xaa in position 13 is Asp or Glu
  Variant (14)..(19): xaa in position 14 to 19 is any amino acid
  Variant (20)..(20): xaa in position 20 is Ala, Pro, Ser or Thr
  Variant (21)..(21): xaa in position 21 is Ile, Met or Val
  Variant (22)..(24): xaa in position 22 to 24 is any amino acid
  Variant (25)..(25): xaa in position 25 is Glu or Gln
  Variant (26)..(28): xaa in position 26 to 28 is any amino acid
  Variant (30)..(31): xaa in position 30 to 31 is any amino acid
  Variant (32)..(32): xaa in position 32 is Phe, His or Tyr
  Variant (33)..(33): xaa in position 33 is any amino acid
  Variant (35)..(35): xaa in position 35 is Asp, Gly or Pro
  Variant (36)..(37): xaa in position 36 to 37 is any amino acid
  Variant (39)..(39): xaa in position 39 is any amino acid
  Variant (41)..(41): xaa in position 41 is Asp or Asn
  Variant (42)..(43): xaa in position 42 to 43 is any amino acid
  Variant (44)..(44): xaa in position 44 is Phe or Trp
  Variant (45)..(47): xaa in position 45 to 47 is any amino acid
AXXXXLXXXRNXXXXXXXXXXXXXXXXXNXXXXYXXXFXNXXXXXXXF

SEQ ID NO: 45669 - protein, 18 aa, Artificial sequence
  Variant (2)..(2): xaa in position 2 is Ala or Gly
  Variant (3)..(5): xaa in position 3 to 5 is any amino acid
  Variant (6)..(6): xaa in position 6 is Pro or Ser
  Variant (8)..(8): xaa in position 8 is His or Arg
  Variant (9)..(9): xaa in position 9 is any amino acid
  Variant (13)..(13): xaa in position 13 is Phe, Trp or Tyr
  Variant (14)..(14): xaa in position 14 is any amino acid
  Variant (16)..(16): xaa in position 16 is any amino acid
  Variant (17)..(17): xaa in position 17 is any or no amino acid
YXXXXXYXXMCRXXSXXF

SEQ ID NO: 45670 - protein, 48 aa, Artificial sequence
  Variant (2)..(15): xaa in position 2 to 15 is any amino acid
  Variant (16)..(18): xaa in position 16 to 18 is any or no amino acid
  Variant (21)..(21): xaa in position 21 is Ile, Leu, Pro or Val
  Variant (23)..(24): xaa in position 23 to 24 is any amino acid
  Variant (25)..(25): xaa in position 25 is Leu or Met
  Variant (26)..(29): xaa in position 26 to 29 is any amino acid
  Variant (31)..(31): xaa in position 31 is any amino acid
  Variant (33)..(33): xaa in position 33 is Ala, Gly or Ser
  Variant (34)..(34): xaa in position 34 is Phe or Tyr
  Variant (35)..(35): xaa in position 35 is any amino acid
  Variant (36)..(36): xaa in position 36 is Ile, Leu, Met or Val
  Variant (37)..(37): xaa in position 37 is any amino acid
  Variant (38)..(38): xaa in position 38 is Ile, Leu, Met or Val
  Variant (39)..(39): xaa in position 39 is any amino acid
  Variant (40)..(40): xaa in position 40 is Asp or Glu
  Variant (41)..(43): xaa in position 41 to 43 is any amino acid
  Variant (44)..(44): xaa in position 44 is Ser or Thr
  Variant (45)..(46): xaa in position 45 to 46 is any amino acid
  Variant (47)..(47): xaa in position 47 is Gly, Asn, Ser or Thr
  Variant (48)..(48): xaa in position 48 is Ile or Leu
YXXXXXXXXXXXXXXXXXYDXFXXXXXXXKXYXXXXXXXXXXXXXXXX

SEQ ID NO: 45671 - protein, 75 aa, Artificial sequence
  Variant (2)..(2): xaa in position 2 is any amino acid
  Variant (3)..(4): xaa in position 3 to 4 is any or no amino acid
  Variant (6)..(6): xaa in position 6 is Ser or Thr
  Variant (8)..(8): xaa in position 8 is Phe or Leu
  Variant (10)..(10): xaa in position 10 is Ile or Val
  Variant (11)..(11): xaa in position 11 is Ala or Gly
  Variant (12)..(16): xaa in position 12 to 16 is any amino acid
  Variant (17)..(17): xaa in position 17 is Asp, Glu, Asn or Arg
  Variant (18)..(18): xaa in position 18 is Gly, Asn or Ser
  Variant (19)..(20): xaa in position 19 to 20 is any amino acid
  Variant (22)..(24): xaa in position 22 to 24 is any amino acid
  Variant (26)..(27): xaa in position 26 to 27 is any amino acid
  Variant (28)..(28): xaa in position 28 is Leu or Met
  Variant (29)..(29): xaa in position 29 is Asp or Glu
  Variant (30)..(32): xaa in position 30 to 32 is any amino acid
  Variant (33)..(33): xaa in position 33 is Gly or Asn
  Variant (35)..(35): xaa in position 35 is Phe, Trp or Tyr
  Variant (36)..(36): xaa in position 36 is any amino acid
  Variant (43)..(43): xaa in position 43 is Ala or Pro
  Variant (44)..(44): xaa in position 44 is Phe, Ile or Val
  Variant (46)..(46): xaa in position 46 is Ser or Thr
  Variant (47)..(47): xaa in position 47 is Ile, Leu, Met or Val
  Variant (48)..(48): xaa in position 48 is any amino acid
  Variant (49)..(49): xaa in position 49 is Ala, Ile, Leu or Val
  Variant (50)..(60): xaa in position 50 to 60 is any amino acid
  Variant (61)..(61): xaa in position 61 is Phe or Trp
  Variant (62)..(62): xaa in position 62 is any amino acid
  Variant (63)..(63): xaa in position 63 is Asp, Glu, Gly or Asn
  Variant (64)..(64): xaa in position 64 is Phe, Ile, Leu or Val
  Variant (65)..(65): xaa in position 65 is Ala, Gly or Ser
  Variant (66)..(66): xaa in position 66 is Phe or Tyr
  Variant (67)..(67): xaa in position 67 is any amino acid
  Variant (69)..(73): xaa in position 69 to 73 is any amino acid
  Variant (75)..(75): xaa in position 75 is Gly or Pro
HXXXWXNXEXXXXXXXXXXXYXXXFXXXXXXXXFXXERWGDAXXHXXXXXXXXXXXXXXXXXXXXXXHXXXXXCX

SEQ ID NO: 45672 - DNA, 1390 bp, Saccharomyces cerevisiae; identical to SEQ ID NO: 531
  CDS (303)..(1118)

SEQ ID NO: 45673 - protein, 271 aa, Saccharomyces cerevisiae; identical to SEQ ID NO: 532

SEQ ID NO: 45674 - DNA, 714 bp, Deinococcus radiodurans; identical to SEQ ID NO: 533
  CDS (1)..(714)

SEQ ID NO: 45675 - protein, 237 aa, Deinococcus radiodurans; identical to SEQ ID NO: 534

SEQ ID NO: 45676 - DNA, 1350 bp, Nostoc sp. PCC 7120; identical to SEQ ID NO: 535
  CDS (1)..(1350)

SEQ ID NO: 45677 - protein, 449 aa, Nostoc sp. PCC 7120; identical to SEQ ID NO: 536

SEQ ID NO: 45678 - DNA, 636 bp, Listeria monocytogenes; identical to SEQ ID NO: 537
  CDS (1)..(636)

SEQ ID NO: 45679 - protein, 211 aa, Listeria monocytogenes; identical to SEQ ID NO: 538

SEQ ID NO: 45680 - DNA, 636 bp, Listeria innocua; identical to SEQ ID NO: 539
  CDS (1)..(636)

SEQ ID NO: 45681 - protein, 211 aa, Listeria innocua; identical to SEQ ID NO: 540

SEQ ID NO: 45682 - DNA, 654 bp, Brucella melitensis; identical to SEQ ID NO: 541
  CDS (1)..(654)

SEQ ID NO: 45683 - protein, 217 aa, Brucella melitensis; identical to SEQ ID NO: 542

SEQ ID NO: 45684 - DNA, 813 bp, Nostoc sp. PCC 7120; identical to SEQ ID NO: 543
  CDS (1)..(813)

SEQ ID NO: 45685 - protein, 270 aa, Nostoc sp. PCC 7120; identical to SEQ ID NO: 544

SEQ ID NO: 45686 - DNA, 615 bp, Deinococcus radiodurans; identical to SEQ ID NO: 545
  CDS (1)..(615)

SEQ ID NO: 45687 - protein, 204 aa, Deinococcus radiodurans; identical to SEQ ID NO: 546

SEQ ID NO: 45688 - DNA, 714 bp, Caulobacter crescentus; identical to SEQ ID NO: 547
  CDS (1)..(714)

SEQ ID NO: 45689 - protein, 237 aa, Caulobacter crescentus; identical to SEQ ID NO: 548

SEQ ID NO: 45690 - DNA, 756 bp, Treponema pallidum subsp. pallidum (syphilis spirochete); identical to SEQ ID NO: 549
  CDS (1)..(756)

SEQ ID NO: 45691 - protein, 251 aa, Treponema pallidum subsp. pallidum (syphilis spirochete); identical to SEQ ID NO: 550

SEQ ID NO: 45692 - DNA, 645 bp, Xylella fastidiosa; identical to SEQ ID NO: 551
  CDS (1)..(645)

SEQ ID NO: 45693 - protein, 214 aa, Xylella fastidiosa; identical to SEQ ID NO: 552

SEQ ID NO: 45694 - DNA, 2034 bp, Arabidopsis thaliana (mouse-ear cress); identical to SEQ ID NO: 553
  CDS (1)..(2034)

SEQ ID NO: 45695 - protein, 677 aa, Arabidopsis thaliana (mouse-ear cress); identical to SEQ ID NO: 554

SEQ ID NO: 45696 - DNA, 582 bp, Bacillus subtilis; identical to SEQ ID NO: 555
  CDS (1)..(582)

SEQ ID NO: 45697 - protein, 193 aa, Bacillus subtilis; identical to SEQ ID NO: 556

SEQ ID NO: 45698 - DNA, 606 bp, Thermotoga maritima; identical to SEQ ID NO: 557
  CDS (1)..(606)

SEQ ID NO: 45699 - protein, 201 aa, Thermotoga maritima; identical to SEQ ID NO: 558

SEQ ID NO: 45700 - DNA, 660 bp, Clostridium acetobutylicum; identical to SEQ ID NO: 559
  CDS (1)..(660)

SEQ ID NO: 45701 - protein, 219 aa, Clostridium acetobutylicum; identical to SEQ ID NO: 560

SEQ ID NO: 45702 - DNA, 744 bp, Saccharomyces cerevisiae; identical to SEQ ID NO: 561
  CDS (1)..(744)

SEQ ID NO: 45703 - protein, 247 aa, Saccharomyces cerevisiae; identical to SEQ ID NO: 562

SEQ ID NO: 45704 - DNA, 1050 bp, Synechocystis sp; identical to SEQ ID NO: 563
  CDS (1)..(1050)

SEQ ID NO: 45705 - protein, 349 aa, Synechocystis sp; identical to SEQ ID NO: 564

SEQ ID NO: 45706 - DNA, 875 bp, Arabidopsis thaliana (mouse-ear cress); identical to SEQ ID NO: 565
  CDS (30)..(722)

SEQ ID NO: 45707 - protein, 230 aa, Arabidopsis thaliana (mouse-ear cress); identical to SEQ ID NO: 566

SEQ ID NO: 45708 - DNA, 741 bp, Debaryomyces hansenii; identical to SEQ ID NO: 567
  CDS (1)..(741)

SEQ ID NO: 45709 - protein, 246 aa, Debaryomyces hansenii; identical to SEQ ID NO: 568

SEQ ID NO: 45710 - DNA, 741 bp, Yarrowia lipolytica; identical to SEQ ID NO: 569
  CDS (1)..(741)

SEQ ID NO: 45711 - protein, 246 aa, Yarrowia lipolytica; identical to SEQ ID NO: 570

SEQ ID NO: 45712 - DNA, 816 bp, Kluyveromyces lactis; identical to SEQ ID NO: 571
  CDS (1)..(816)

SEQ ID NO: 45713 - protein, 271 aa, Kluyveromyces lactis; identical to SEQ ID NO: 572

SEQ ID NO: 45714 - DNA, 687 bp, Kluyveromyces lactis; identical to SEQ ID NO: 573
  CDS (1)..(687)

SEQ ID NO: 45715 - protein, 228 aa, Kluyveromyces lactis; identical to SEQ ID NO: 574

SEQ ID NO: 45716 - DNA, 651 bp, Erwinia carotovora subsp; identical to SEQ ID NO: 575
  CDS (1)..(651)

SEQ ID NO: 45717 - protein, 216 aa, Erwinia carotovora subsp; identical to SEQ ID NO: 576

SEQ ID NO: 45718 - DNA, 840 bp, Candida glabrata; identical to SEQ ID NO: 577
  CDS (1)..(840)

SEQ ID NO: 45719 - protein, 279 aa, Candida glabrata; identical to SEQ ID NO: 578

SEQ ID NO: 45720 - DNA, 744 bp, Candida glabrata; identical to SEQ ID NO: 579
  CDS (1)..(744)

SEQ ID NO: 45721 - protein, 247 aa, Candida glabrata; identical to SEQ ID NO: 580

SEQ ID NO: 45722 - DNA, 621 bp, Bartonella quintana; identical to SEQ ID NO: 581
  CDS (1)..(621)

SEQ ID NO: 45723 - protein, 206 aa, Bartonella quintana; identical to SEQ ID NO: 582

SEQ ID NO: 45724 - DNA, 648 bp, Parachlamydia sp; identical to SEQ ID NO: 583
  CDS (1)..(648)

SEQ ID NO: 45725 - protein, 215 aa, Parachlamydia sp; identical to SEQ ID NO: 584

SEQ ID NO: 45726 - DNA, 636 bp, Listeria monocytogenes; identical to SEQ ID NO: 585
  CDS (1)..(636)

SEQ ID NO: 45727 - protein, 211 aa, Listeria monocytogenes; identical to SEQ ID NO: 586

SEQ ID NO: 45728 - DNA, 633 bp, Thermus thermophilus; identical to SEQ ID NO: 587
  CDS (1)..(633)

SEQ ID NO: 45729 - protein, 210 aa, Thermus thermophilus; identical to SEQ ID NO: 588

SEQ ID NO: 45730 - DNA, 654 bp, Mycobacterium paratuberculosis; identical to SEQ ID NO: 589
  CDS (1)..(654)

SEQ ID NO: 45731 - protein, 217 aa, Mycobacterium paratuberculosis; identical to SEQ ID NO: 590

SEQ ID NO: 45732 - DNA, 1134 bp, Mycobacterium paratuberculosis; identical to SEQ ID NO: 591
  CDS (1)..(1134)

SEQ ID NO: 45733 - protein, 377 aa, Mycobacterium paratuberculosis; identical to SEQ ID NO: 592

SEQ ID NO: 45734 - DNA, 627 bp, Lactobacillus johnsonii; identical to SEQ ID NO: 593
  CDS (1)..(627)

SEQ ID NO: 45735 - protein, 208 aa, Lactobacillus johnsonii; identical to SEQ ID NO: 594

SEQ ID NO: 45736 - DNA, 807 bp, Ashbya gossypii; identical to SEQ ID NO: 595
  CDS (1)..(807)

SEQ ID NO: 45737 - protein, 268 aa, Ashbya gossypii; identical to SEQ ID NO: 596

SEQ ID NO: 45738 - DNA, 687 bp, Mycobacterium tuberculosis; identical to SEQ ID NO: 597
  CDS (1)..(687)

SEQ ID NO: 45739 - protein, 228 aa, Mycobacterium tuberculosis; identical to SEQ ID NO: 598

SEQ ID NO: 45740 - DNA, 618 bp, Photorhabdus luminescens; identical to SEQ ID NO: 599
  CDS (1)..(618)

SEQ ID NO: 45741 - protein, 205 aa, Photorhabdus luminescens; identical to SEQ ID NO: 600

SEQ ID NO: 45742 - DNA, 588 bp, Anopheles gambiae str; identical to SEQ ID NO: 601
  CDS (1)..(588)

SEQ ID NO: 45743 - protein, 195 aa, Anopheles gambiae str; identical to SEQ ID NO: 602

SEQ ID NO: 45744 - DNA, 3762 bp, Neurospora crassa; identical to SEQ ID NO: 603
  CDS (1)..(3762)

SEQ ID NO: 45745 - protein, 1253 aa, Neurospora crassa; identical to SEQ ID NO: 604

SEQ ID NO: 45746 - DNA, 567 bp, Synechococcus sp; identical to SEQ ID NO: 605
  CDS (1)..(567)

SEQ ID NO: 45747 - protein, 188 aa, Synechococcus sp; identical to SEQ ID NO: 606

SEQ ID NO: 45748 - DNA, 612 bp, Rhodopirellula baltica; identical to SEQ ID NO: 607
  CDS (1)..(612)

SEQ ID NO: 45749 - protein, 203 aa, Rhodopirellula baltica; identical to SEQ ID NO: 608

SEQ ID NO: 45750 - DNA, 1329 bp, Prochlorococcus marinus subsp; identical to SEQ ID NO: 609
  CDS (1)..(1329)

SEQ ID NO: 45751 - protein, 442 aa, Prochlorococcus marinus subsp; identical to SEQ ID NO: 610

SEQ ID NO: 45752 - DNA, 1332 bp, Prochlorococcus marinus; identical to SEQ ID NO: 611
  CDS (1)..(1332)

SEQ ID NO: 45753 - protein, 443 aa, Prochlorococcus marinus; identical to SEQ ID NO: 612

SEQ ID NO: 45754 - DNA, 591 bp, Prochlorococcus marinus; identical to SEQ ID NO: 613
  CDS (1)..(591)

SEQ ID NO: 45755 - protein, 196 aa, Prochlorococcus marinus; identical to SEQ ID NO: 614

SEQ ID NO: 45756 - DNA, 618 bp, Streptomyces avermitilis; identical to SEQ ID NO: 615
  CDS (1)..(618)

SEQ ID NO: 45757 - protein, 205 aa, Streptomyces avermitilis; identical to SEQ ID NO: 616

SEQ ID NO: 45758 - DNA, 600 bp, Streptomyces avermitilis; identical to SEQ ID NO: 617
  CDS (1)..(600)

SEQ ID NO: 45759 - protein, 199 aa, Streptomyces avermitilis; identical to SEQ ID NO: 618

SEQ ID NO: 45760 - DNA, 612 bp, Streptomyces avermitilis; identical to SEQ ID NO: 619
  CDS (1)..(612)

SEQ ID NO: 45761 - protein, 203 aa, Streptomyces avermitilis; identical to SEQ ID NO: 620

SEQ ID NO: 45762 - DNA, 645 bp, Enterococcus faecalis; identical to SEQ ID NO: 621
  CDS (1)..(645)

SEQ ID NO: 45763 - protein, 214 aa, Enterococcus faecalis; identical to SEQ ID NO: 622

SEQ ID NO: 45764 - DNA, 666 bp, Lactobacillus plantarum; identical to SEQ ID NO: 623
  CDS (1)..(666)

SEQ ID NO: 45765 - protein, 221 aa, Lactobacillus plantarum; identical to SEQ ID NO: 624

SEQ ID NO: 45766 - DNA, 642 bp, Clostridium tetani; identical to SEQ ID NO: 625
  CDS (1)..(642)

SEQ ID NO: 45767 - protein, 213 aa, Clostridium tetani; identical to SEQ ID NO: 626

SEQ ID NO: 45768 - DNA, 600 bp, Bradyrhizobium japonicum; identical to SEQ ID NO: 627
  CDS (1)..(600)

SEQ ID NO: 45769 - protein, 199 aa, Bradyrhizobium japonicum; identical to SEQ ID NO: 628

SEQ ID NO: 45770 - DNA, 1407 bp, Synechococcus elongatus; identical to SEQ ID NO: 629
  CDS (1)..(1407)

SEQ ID NO: 45771 - protein, 468 aa, Synechococcus elongatus; identical to SEQ ID NO: 630

SEQ ID NO: 45772 - DNA, 582 bp, Oceanobacillus iheyensis; identical to SEQ ID NO: 631
  CDS (1)..(582)

SEQ ID NO: 45773 - protein, 193 aa, Oceanobacillus iheyensis; identical to SEQ ID NO: 632

SEQ ID NO: 45774 - DNA, 648 bp, Bifidobacterium longum; identical to SEQ ID NO: 633
  CDS (1)..(648)

SEQ ID NO: 45775 - protein, 215 aa, Bifidobacterium longum; identical to SEQ ID NO: 634

SEQ ID NO: 45776 - DNA, 1005 bp, Arabidopsis thaliana; identical to SEQ ID NO: 635
  CDS (1)..(1005)

SEQ ID NO: 45777 - protein, 334 aa, Arabidopsis thaliana; identical to SEQ ID NO: 636

SEQ ID NO: 45778 - DNA, 645 bp, Xanthomonas campestris; identical to SEQ ID NO: 637
  CDS (1)..(645)

SEQ ID NO: 45779 - protein, 214 aa, Xanthomonas campestris; identical to SEQ ID NO: 638

SEQ ID NO: 45780 - DNA, 645 bp, Xanthomonas axonopodis; identical to SEQ ID NO: 639
  CDS (1)..(645)

SEQ ID NO: 45781 - protein, 214 aa, Xanthomonas axonopodis; identical to SEQ ID NO: 640

SEQ ID NO: 45782 - DNA, 621 bp, Thermoanaerobacter tengcongensis; identical to SEQ ID NO: 641
  CDS (1)..(621)

SEQ ID NO: 45783 - protein, 206 aa, Thermoanaerobacter tengcongensis; identical to SEQ ID NO: 642

SEQ ID NO: 45784 - DNA, 582 bp, Rhizobium loti; identical to SEQ ID NO: 643
  CDS (1)..(582)

SEQ ID NO: 45785 - protein, 193 aa, Rhizobium loti; identical to SEQ ID NO: 644

SEQ ID NO: 45786 - DNA, 651 bp, Pasteurella multocida; identical to SEQ ID NO: 645
  CDS (1)..(651)

SEQ ID NO: 45787 - protein, 216 aa, Pasteurella multocida; identical to SEQ ID NO: 646

SEQ ID NO: 45788 - DNA, 597 bp, Streptomyces coelicolor; identical to SEQ ID NO: 647
  CDS (1)..(597)

SEQ ID NO: 45789 - protein, 198 aa, Streptomyces coelicolor; identical to SEQ ID NO: 648

SEQ ID NO: 45790 - DNA, 600 bp, Streptomyces coelicolor; identical to SEQ ID NO: 649
  CDS (1)..(600)

SEQ ID NO: 45791 - protein, 199 aa, Streptomyces coelicolor; identical to SEQ ID NO: 650

SEQ ID NO: 45792 - DNA, 660 bp, Gloeobacter violaceus; identical to SEQ ID NO: 651
  CDS (1)..(660)

SEQ ID NO: 45793 - protein, 219 aa, Gloeobacter violaceus; identical to SEQ ID NO: 652

SEQ ID NO: 45794 - DNA, 621 bp, Bartonella henselae; identical to SEQ ID NO: 653
  CDS (1)..(621)

SEQ ID NO: 45795 - protein, 206 aa, Bartonella henselae; identical to SEQ ID NO: 654

SEQ ID NO: 45796 - DNA, 681 bp, Parachlamydia sp; identical to SEQ ID NO: 655
  CDS (1)..(681)

SEQ ID NO: 45797 - protein, 226 aa, Parachlamydia sp; identical to SEQ ID NO: 656

SEQ ID NO: 45798 - DNA, 636 bp, Rhizobium meliloti; identical to SEQ ID NO: 657
  CDS (1)..(636)

SEQ ID NO: 45799 - protein, 211 aa, Rhizobium meliloti; identical to SEQ ID NO: 658

SEQ ID NO: 45800 - DNA, 648 bp, Escherichia coli O6; identical to SEQ ID NO: 659
  CDS (1)..(648)

SEQ ID NO: 45801 - protein, 215 aa, Escherichia coli O6; identical to SEQ ID NO: 660

SEQ ID NO: 45802 - DNA, 648 bp, Photorhabdus luminescens; identical to SEQ ID NO: 661
  CDS (1)..(648)

SEQ ID NO: 45803 - protein, 215 aa, Photorhabdus luminescens; identical to SEQ ID NO: 662

SEQ ID NO: 45804 - DNA, 648 bp, Salmonella typhimurium; identical to SEQ ID NO: 663
  CDS (1)..(648)

SEQ ID NO: 45805 - protein, 215 aa, Salmonella typhimurium; identical to SEQ ID NO: 664

SEQ ID NO: 45806 - DNA, 22 bp, Artificial sequence
  (1)..(22): primer
atgccttcgctaacccccagat

SEQ ID NO: 45807 - DNA, 23 bp, Artificial sequence
  (1)..(23): primer
ttacacatcgccatgctgggatt

SEQ ID NO: 45808 - protein, 289 aa, Artificial sequence; identical to SEQ ID NO: 34983
  Variant (2)..(2): xaa in position 2 is any amino acid
  Variant (8)..(8): xaa in position 8 is any amino acid
  Variant (10)..(10): xaa in position 10 is any amino acid
  Variant (12)..(18): xaa in position 12 to 18 is any amino acid
  Variant (20)..(21): xaa in position 20 to 21 is any amino acid
  Variant (22)..(22): xaa in position 22 is any or no amino acid
  Variant (24)..(25): xaa in position 24 to 25 is any amino acid
  Variant (27)..(29): xaa in position 27 to 29 is any amino acid
  Variant (31)..(33): xaa in position 31 to 33 is any amino acid
  Variant (35)..(37): xaa in position 35 to 37 is any amino acid
  Variant (39)..(40): xaa in position 39 to 40 is any amino acid
  Variant (42)..(49): xaa in position 42 to 49 is any amino acid
  Variant (50)..(60): xaa in position 50 to 60 is any or no amino acid
  Variant (62)..(64): xaa in position 62 to 64 is any amino acid
  Variant (66)..(68): xaa in position 66 to 68 is any amino acid
  Variant (70)..(83): xaa in position 70 to 83 is any amino acid
  Variant (84)..(116): xaa in position 84 to 116 is any or no amino acid
  Variant (118)..(118): xaa in position 118 is any amino acid
  Variant (120)..(122): xaa in position 120 to 122 is any amino acid
  Variant (124)..(126): xaa in position 124 to 126 is any amino acid
  Variant (128)..(153): xaa in position 128 to 153 is any amino acid
  Variant (154)..(193): xaa in position 154 to 193 is any or no amino acid
  Variant (195)..(206): xaa in position 195 to 206 is any amino acid
  Variant (207)..(217): xaa in position 207 to 217 is any or no amino acid
  Variant (221)..(221): xaa in position 221 is any amino acid
  Variant (225)..(226): xaa in position 225 to 226 is any amino acid
  Variant (228)..(229): xaa in position 228 to 229 is any amino acid
  Variant (231)..(249): xaa in position 231 to 249 is any amino acid
  Variant (250)..(285): xaa in position 250 to 285 is any or no amino acid
  Variant (287)..(288): xaa in position 287 to 288 is any amino acid

SEQ ID NO: 45809 - protein, 65 aa, Artificial sequence; identical to SEQ ID NO: 1307
  Variant (4)..(4): xaa in position 4 is Glu, Gln, Lys or Ala
  Variant (5)..(5): xaa in position 5 is Thr or Ser
  Variant (6)..(6): xaa in position 6 is any amino acid
  Variant (7)..(7): xaa in position 7 is Trp, Phe or Tyr
  Variant (8)..(8): xaa in position 8 is Asn, Ser or Ala
  Variant (9)..(13): xaa in position 9 to 13 is any amino acid
  Variant (14)..(14): xaa in position 14 is Gln or Thr
  Variant (15)..(15): xaa in position 15 is Gly or Ser
  Variant (16)..(16): xaa in position 16 is any amino acid
  Variant (17)..(18): xaa in position 17 to 18 is any or no amino acid
  Variant (19)..(19): xaa in position 19 is Asp, Asn or Glu
  Variant (20)..(21): xaa in position 20 to 21 is any amino acid
  Variant (23)..(25): xaa in position 23 to 25 is any amino acid
  Variant (26)..(26): xaa in position 26 is Gly or Ser
  Variant (27)..(29): xaa in position 27 to 29 is any amino acid
  Variant (30)..(30): xaa in position 30 is Ala, Met, Val or Ile
  Variant (31)..(36): xaa in position 31 to 36 is any amino acid
  Variant (37)..(37): xaa in position 37 is Leu, Ile, Val, Ala or Phe
  Variant (38)..(44): xaa in position 38 to 44 is any amino acid
  Variant (45)..(55): xaa in position 45 to 55 is any or no amino acid
  Variant (56)..(56): xaa in position 56 is Thr, Ser, Ala or Val
  Variant (58)..(60): xaa in position 58 to 60 is any amino acid
  Variant (62)..(62): xaa in position 62 is Ala, Thr or Pro
  Variant (63)..(64): xaa in position 63 to 64 is any amino acid

SEQ ID NO: 45810 - DNA, 1272 bp, Saccharomyces cerevisiae
  CDS (1)..(1272)
atgattctccttctgattctttttccctgtatatattttctccccttctgtataaatcgtacagtcagaagtagtccagaatatagtgctgcagactattacaaaagttcaatacaatatcataaaagttatagtaacatgcctcactcagttacaccatccatagaacaagattcgttaaaaattgccattttaggtgctgccggtggtatcgggcagtcgttatcgctgcttttgaaagctcagttgcaataccagttaaaggagagcaaccggagcgttacccacattcatctggctctttacgatgtcaaccaagaagccatcaacggtgttaccgccgacttgtctcatatagacacccccatttccgtgtcgagccactctcctgcaggtggcattgagaactgtttgcataacgcttctattgttgtcattcctgcaggtgttccaagaaaacctggcatgactcgtgatgacttatttaacgtgaatgctggtatcattagccagctcggtgattctattgcagaatgttgtgatctttccaaggtcttcgttcttgtcatttccaaccctgttaattctttagtcccagtgatggtttctaacattcttaagaaccatcctcagtctagaaattccggcattgaaagaaggatcatgggtgtcaccaagctcgacattgtcagagcgtccacttttctacgtgagataaacattgagtcagggctaactcctcgtgttaactccatgcctgacgtccctgtaattggcgggcattctggcgagactattattccgttgttttcacagtcaaacttcctatcgagattaaatgaggatcaattgaaatatttaatacatagagtccaatacggtggtgatgaagtggtcaaggccaagaacggtaaaggtagtgctaccttatcgatggcccatgccggttataagtgtgttgtccaatttgtttctttgttattgggtaacattgagcagatccatggaacctactatgtgccattaaaagatgcgaacaacttccccattgctcctggggcagatcaattattgcctctggtggacggtgcagactactttgccataccattaactattactacaaagggtgtttcctatgtggattatgacatcgttaataggatgaacgacatggaacgcaaccaaatgttgccaatttgcgtctcccagttaaagaaaaatatcgataagggcttggaattcgttgcatcgagatctgcatcatcttaa

SEQ ID NO: 45811 - protein, 423 aa, Saccharomyces cerevisiae
MILLLILFPCIYFLPFCINRTVRSSPEYSAADYYKSSIQYHKSYSNMPHSVTPSIEQDSLKIAILGAAGGIGQSLSLLLKAQLQYQLKESNRSVTHIHLALYDVNQEAINGVTADLSHIDTPISVSSHSPAGGIENCLHNASIVVIPAGVPRKPGMTRDDLFNVNAGIISQLGDSIAECCDLSKVFVLVISNPVNSLVPVMVSNILKNHPQSRNSGIERRIMGVTKLDIVRASTFLREINIESGLTPRVNSMPDVPVIGGHSGETIIPLFSQSNFLSRLNEDQLKYLIHRVQYGGDEVVKAKNGKGSATLSMAHAGYKCVVQFVSLLLGNIEQIHGTYYVPLKDANNFPIAPGADQLLPLVDGADYFAIPLTITTKGVSYVDYDIVNRMNDMERNQMLPICVSQLKKNIDKGLEFVASRSASS

SEQ ID NO: 45812 - DNA, 1032 bp, Saccharomyces cerevisiae; identical to SEQ ID NO: 44996
  CDS (1)..(1032)

SEQ ID NO: 45813 - protein, 343 aa, Saccharomyces cerevisiae; identical to SEQ ID NO: 44997

SEQ ID NO: 45814 - DNA, 1017 bp, Rattus norvegicus
  CDS (1)..(1017)
atgctgtccgctctcgcccgtcctgtcggtgccgctctccgccgcagcttcagcacttcagcccagaacaatgctaaagtagctgtcctgggagcttctgggggcattgggcaacccctttcactcctcctgaagaacagtcccctcgtgagccgcctgaccctctatgacatcgctcacacacctggtgtggcagcagatctgagtcacatcgagaccagagcaaatgtgaaaggctacctcgggccggagcagctgccggactgcctaaaaggttgtgatgtggtggtcatcccagctggagtgcccaggaagccaggaatgacacgagatgacctgttcaacaccaatgctaccattgtggccacattgacggctgcctgtgcccagcactgtcctgaagccatgatttgcatcatttccaacccagttaactccaccatccccatcacagccgaagttttcaagaagcatggcgtatacaaccccaacaagatattcggtgtgacaacccttgacatcgtcagagcaaacacatttgtggcagagctaaagggtttggacccagctcgagtcaatgtgcctgtcattggtggccacgccgggaagacgatcatccccctgatctctcagtgtacccccaaggttgactttccccaagaccagctggccacactcaccgggaggatccaggaggctggcactgaagtcgtgaaggccaaggctggagcaggctctgccactctgtccatggcttatgctggagcccgctttgtcttctccctggtggacgccatgaatgggaaggaaggagtcatcgagtgctcttttgttcagtccaaagagacagagtgcacttatttctctacacccttgctgttggggaaaaaaggcctggagaagaacctaggcattggcaaaatcactccttttgaggagaaaatgattgccgaggccatccctgagctgaaagcctccatcaagaaaggcgaggactttgtgaagaacatgaagtga

SEQ ID NO: 45815 - protein, 338 aa, Rattus norvegicus
MLSALARPVGAALRRSFSTSAQNNAKVAVLGASGGIGQPLSLLLKNSPLVSRLTLYDIAHTPGVAADLSHIETRANVKGYLGPEQLPDCLKGCDVVVIPAGVPRKPGMTRDDLFNTNATIVATLTAACAQHCPEAMICIISNPVNSTIPITAEVFKKHGVYNPNKIFGVTTLDIVRANTFVAELKGLDPARVNVPVIGGHAGKTIIPLISQCTPKVDFPQDQLATLTGRIQEAGTEVVKAKAGAGSATLSMAYAGARFVFSLVDAMNGKEGVIECSFVQSKETECTYFSTPLLLGKKGLEKNLGIGKITPFEEKMIAEAIPELKASIKKGEDFVKNMK

SEQ ID NO: 45816 - DNA, 1026 bp, Arabidopsis thaliana; identical to SEQ ID NO: 45004
  CDS (1)..(1026)

SEQ ID NO: 45817 - protein, 341 aa, Arabidopsis thaliana; identical to SEQ ID NO: 45005

SEQ ID NO: 45818 - DNA, 1062 bp, Vibrio cholerae O1 biovar eltor str. N16961
  CDS (1)..(1062): transl_table=11
ttgcgcaaagtcgcaaagctgacgttaattgattgtaatcagattgtgattactatagcgtttgacggtcggatacacctaatcaccctacaaacatataagagattactctcaaggagatttacgatgaaagtcgctgttattggtgccgctggcggcattggtcaagcccttgctctgttactcaaaaaccgtcttcctgctggttctgatctcgcgctgtatgatattgcgcctgtcacaccgggtgtcgctgcggatctgagtcatatcccaacaccagttaccatcaaaggctatgcgggtgaagacccaacgcctgcgctggaaggtgcggatgtggttctggtttctgcgggtgttgcacgtaagccgggtatggatcgtgcggatctgttcaatgtgaacgctggcattgtgaaagcattggcagaaaaaattgctgtggtgtgtccgaaggcctgtgttggcattattactaacccagtgaacacaacggtccctatcgcagccgaagtgctgaaaaaagccggtgtgtatgacaagcgtaagctatttggtgtcaccacactggatgtgatccgctctgaaaccttcgttgccgcgctgaaagataaagatccgggccaagttcgtgtgcctgtgattggtggtcactcaggggttactattctgcctctgttgtcgcaagtagaaggcgtaagctttaccgatgaagaagttgccgctttgactaaacgtatccaaaacgcgggtaccgaggtggttgaagctaaggcgggtggcggttcagcgactctttctatgggccaagcggcatgtcgttttggtcttgcactggttaaagcactgcaaggcgaatctgatgttgttgagtacgcgtatgtagaaggtgagggggagtacgctccattctttgcccaacctatcaagctaggtaaaaatggcgttgaagcgttgctggatatcggcaaactgagcgcttatgagcaagccgcgctggatggcatgttagatacactcaaaggcgacattcaaatcggtgttgagtttgtaaaataa

SEQ ID NO: 45819 - protein, 353 aa, Vibrio cholerae O1 biovar eltor str. N16961
MRKVAKLTLIDCNQIVITIAFDGRIHLITLQTYKRLLSRRFTMKVAVIGAAGGIGQALALLLKNRLPAGSDLALYDIAPVTPGVAADLSHIPTPVTIKGYAGEDPTPALEGADVVLVSAGVARKPGMDRADLFNVNAGIVKALAEKIAVVCPKACVGIITNPVNTTVPIAAEVLKKAGVYDKRKLFGVTTLDVIRSETFVAALKDKDPGQVRVPVIGGHSGVTILPLLSQVEGVSFTDEEVAALTKRIQNAGTEVVEAKAGGGSATLSMGQAACRFGLALVKALQGESDVVEYAYVEGEGEYAPFFAQPIKLGKNGVEALLDIGKLSAYEQAALDGMLDTLKGDIQIGVEFVK

SEQ ID NO: 45820 - DNA, 1026 bp, Schizosaccharomyces pombe; identical to SEQ ID NO: 45014
  CDS (1)..(1026)

SEQ ID NO: 45821 - protein, 341 aa, Schizosaccharomyces pombe; identical to SEQ ID NO: 45015

SEQ ID NO: 45822 - DNA, 1050 bp, Drosophila melanogaster; identical to SEQ ID NO: 45016
  CDS (1)..(1050)

SEQ ID NO: 45823 - protein, 349 aa, Drosophila melanogaster; identical to SEQ ID NO: 45017

SEQ ID NO: 45824 - DNA, 1044 bp, Drosophila melanogaster; identical to SEQ ID NO: 45018
  CDS (1)..(1044)

SEQ ID NO: 45825 - protein, 347 aa, Drosophila melanogaster; identical to SEQ ID NO: 45019

SEQ ID NO: 45826 - DNA, 1011 bp, Drosophila melanogaster; identical to SEQ ID NO: 45020
  CDS (1)..(1011)

SEQ ID NO: 45827 - protein, 336 aa, Drosophila melanogaster; identical to SEQ ID NO: 45021

SEQ ID NO: 45828 - DNA, 942 bp, Plasmodium falciparum 3D7
  CDS (1)..(942)
atgactaaaattgccttaataggtagtggtcaaatcggagcaattgttggagaattgtgtttgctggaaaatcttggagaccttattttatatgatgtagtcccaggtataccacaaggaaaggctttagatttaaaacattttagtaccatattaggagtaaatagaaacattcttggtactaatcagatcgaagatattaaggatgcagatataatagttattacagcaggtgtacaaagaaaagaaggaatgactagagaagatttgataggggtcaatgggaaaataatgaaaagtgtagctgaatcagttaaattacattgttccaaagcttttgttatttgtgttagtaacccacttgatattatggtaaatgtttttcataagtttagtaatttacctcatgaaaaaatttgtggtatggcaggtatattagatacttctagatattgttcattaattgctgataaattaaaagtatcagctgaagatgttaatgctgttattttaggaggacatggggacttaatggtacccttacaaagatatacatcggtaaatggtgttcctttatctgaatttgtcaagaaaaatatgattagccaaaatgaaatacaagaaataattcaaaaaactagaaatatgggtgctgaaattattaaactagctaaagcatctgcagcatttgccccagctgctgctattacaaaaatgattaaatcatatttgtataatgaaaataatttatttacatgtgctgtttatttaaatggacattataactgttctaatttatttgttggatctactgctaaaattaataataagggggcacatccagttgaattccctttaacaaaggaggaacaagatctttacacggaatcgatagctagcgttcaaagcaacacacaaaaagctttcgacttaattaaataa

SEQ ID NO: 45829 - protein, 313 aa, Plasmodium falciparum 3D7
MTKIALIGSGQIGAIVGELCLLENLGDLILYDVVPGIPQGKALDLKHFSTILGVNRNILGTNQIEDIKDADIIVITAGVQRKEGMTREDLIGVNGKIMKSVAESVKLHCSKAFVICVSNPLDIMVNVFHKFSNLPHEKICGMAGILDTSRYCSLIADKLKVSAEDVNAVILGGHGDLMVPLQRYTSVNGVPLSEFVKKNMISQNEIQEIIQKTRNMGAEIIKLAKASAAFAPAAAITKMIKSYLYNENNLFTCAVYLNGHYNCSNLFVGSTAKINNKGAHPVEFPLTKEEQDLYTESIASVQSNTQKAFDLIK

SEQ ID NO: 45830 - DNA, 1215 bp, Oryza sativa (japonica cultivar-group); identical to SEQ ID NO: 45022
  CDS (1)..(1215)

SEQ ID NO: 45831 - protein, 404 aa, Oryza sativa (japonica cultivar-group); identical to SEQ ID NO: 45023

SEQ ID NO: 45832 - DNA, 1023 bp, Oryza sativa (japonica cultivar-group); identical to SEQ ID NO: 45024
  CDS (1)..(1023)

SEQ ID NO: 45833 - protein, 340 aa, Oryza sativa (japonica cultivar-group); identical to SEQ ID NO: 45025

SEQ ID NO: 45834 - DNA, 1215 bp, Oryza sativa (japonica cultivar-group); identical to SEQ ID NO: 45026
  CDS (1)..(1215)

SEQ ID NO: 45835 - protein, 404 aa, Oryza sativa (japonica cultivar-group); identical to SEQ ID NO: 45027

SEQ ID NO: 45836 - DNA, 1065 bp, Oryza sativa (japonica cultivar-group); identical to SEQ ID NO: 45028
  CDS (1)..(1065)

SEQ ID NO: 45837 - protein, 354 aa, Oryza sativa (japonica cultivar-group); identical to SEQ ID NO: 45029

SEQ ID NO: 45838 - DNA, 1146 bp, Eremothecium gossypii; identical to SEQ ID NO: 45030
  CDS (1)..(1146)

SEQ ID NO: 45839 - protein, 381 aa, Eremothecium gossypii; identical to SEQ ID NO: 45031

SEQ ID NO: 45840 - DNA, 999 bp, Eremothecium gossypii; identical to SEQ ID NO: 45032
  CDS (1)..(999)

SEQ ID NO: 45841 - protein, 332 aa, Eremothecium gossypii; identical to SEQ ID NO: 45033

SEQ ID NO: 45842 - DNA, 1458 bp, Eremothecium gossypii; identical to SEQ ID NO: 45034
  CDS (1)..(1458)

SEQ ID NO: 45843 - protein, 485 aa, Eremothecium gossypii; identical to SEQ ID NO: 45035

SEQ ID NO: 45844 - DNA, 1014 bp, Danio rerio; identical to SEQ ID NO: 45036
  CDS (1)..(1014)

SEQ ID NO: 45845 - protein, 337 aa, Danio rerio; identical to SEQ ID NO: 45037

SEQ ID NO: 45846 - DNA, 1011 bp, Neurospora crassa; identical to SEQ ID NO: 45038
  CDS (1)..(1011)

SEQ ID NO: 45847 - protein, 336 aa, Neurospora crassa; identical to SEQ ID NO: 45039

SEQ ID NO: 45848 - DNA, 993 bp, Neurospora crassa; identical to SEQ ID NO: 45040
  CDS (1)..(993)

SEQ ID NO: 45849 - protein, 330 aa, Neurospora crassa; identical to SEQ ID NO: 45041

SEQ ID NO: 45850 - DNA, 993 bp, Magnaporthe grisea 70-15; identical to SEQ ID NO: 45042
  CDS (1)..(993)

SEQ ID NO: 45851 - protein, 330 aa, Magnaporthe grisea 70-15; identical to SEQ ID NO: 45043

SEQ ID NO: 45852 - DNA, 1011 bp, Magnaporthe grisea 70-15; identical to SEQ ID NO: 45044
  CDS (1)..(1011)

SEQ ID NO: 45853 - protein, 336 aa, Magnaporthe grisea 70-15; identical to SEQ ID NO: 45045

SEQ ID NO: 45854 - DNA, 1011 bp, Gibberella zeae PH-1; identical to SEQ ID NO: 45046
  CDS (1)..(1011)

SEQ ID NO: 45855 - protein, 336 aa, Gibberella zeae PH-1; identical to SEQ ID NO: 45047

SEQ ID NO: 45856 - DNA, 993 bp, Gibberella zeae PH-1; identical to SEQ ID NO: 45048
  CDS (1)..(993)

SEQ ID NO: 45857 - protein, 330 aa, Gibberella zeae PH-1; identical to SEQ ID NO: 45049

SEQ ID NO: 45858 - DNA, 1035 bp, Ustilago maydis 521; identical to SEQ ID NO: 45052
  CDS (1)..(1035)

SEQ ID NO: 45859 - protein, 344 aa, Ustilago maydis 521; identical to SEQ ID NO: 45053

SEQ ID NO: 45860 - DNA, 1374 bp, Ustilago maydis 521; identical to SEQ ID NO: 45054
  CDS (1)..(1374)

SEQ ID NO: 45861 - protein, 457 aa, Ustilago maydis 521; identical to SEQ ID NO: 45055

SEQ ID NO: 45862 - DNA, 972 bp, Aspergillus nidulans FGSC A4; identical to SEQ ID NO: 45056
  CDS (1)..(972)

SEQ ID NO: 45863 - protein, 323 aa, Aspergillus nidulans FGSC A4; identical to SEQ ID NO: 45057

SEQ ID NO: 45864 - DNA, 963 bp, Aspergillus nidulans FGSC A4; identical to SEQ ID NO: 45058
  CDS (1)..(963)

SEQ ID NO: 45865 - protein, 320 aa, Aspergillus nidulans FGSC A4; identical to SEQ ID NO: 45059

SEQ ID NO: 45866 - DNA, 1077 bp, Aspergillus nidulans FGSC A4; identical to SEQ ID NO: 45060
  CDS (1)..(1077)

SEQ ID NO: 45867 - protein, 358 aa, Aspergillus nidulans FGSC A4; identical to SEQ ID NO: 45061

SEQ ID NO: 45868 - DNA, 1056 bp, Gallus gallus; identical to SEQ ID NO: 45062
  CDS (1)..(1056)

SEQ ID NO: 45869 - protein, 351 aa, Gallus gallus; identical to SEQ ID NO: 45063

SEQ ID NO: 45870 - DNA, 1089 bp, Candida glabrata CBS138; identical to SEQ ID NO: 45064
  CDS (1)..(1089)

SEQ ID NO: 45871 - protein, 362 aa, Candida glabrata CBS138; identical to SEQ ID NO: 45065

SEQ ID NO: 45872 - DNA, 1011 bp, Candida glabrata CBS138; identical to SEQ ID NO: 45066
  CDS (1)..(1011)

SEQ ID NO: 45873 - protein, 336 aa, Candida glabrata CBS138; identical to SEQ ID NO: 45067

SEQ ID NO: 45874 - DNA, 1122 bp, Candida glabrata CBS138; identical to SEQ ID NO: 45068
  CDS (1)..(1122)

SEQ ID NO: 45875 - protein, 373 aa, Candida glabrata CBS138; identical to SEQ ID NO: 45069

SEQ ID NO: 45876 - DNA, 1215 bp, Kluyveromyces lactis NRRL Y-1140; identical to SEQ ID NO: 45070
  CDS (1)..(1215)

SEQ ID NO: 45877 - protein, 404 aa, Kluyveromyces lactis NRRL Y-1140; identical to SEQ ID NO: 45071

SEQ ID NO: 45878 - DNA, 1017 bp, Kluyveromyces lactis NRRL Y-1140; identical to SEQ ID NO: 45072
  CDS (1)..(1017)

SEQ ID NO: 45879 - protein, 338 aa, Kluyveromyces lactis NRRL Y-1140; identical to SEQ ID NO: 45073

SEQ ID NO: 45880 - DNA, 1017 bp, Kluyveromyces lactis NRRL Y-1140; identical to SEQ ID NO: 45074
  CDS (1)..(1017)

SEQ ID NO: 45881 - protein, 338 aa, Kluyveromyces lactis NRRL Y-1140; identical to SEQ ID NO: 45075

SEQ ID NO: 45882 - DNA, 1017 bp, Debaryomyces hansenii CBS767; identical to SEQ ID NO: 45076
  CDS (1)..(1017)

SEQ ID NO: 45883 - protein, 338 aa, Debaryomyces hansenii CBS767; identical to SEQ ID NO: 45077

SEQ ID NO: 45884 - DNA, 999 bp, Debaryomyces hansenii CBS767; identical to SEQ ID NO: 45078
  CDS (1)..(999)

SEQ ID NO: 45885 - protein, 332 aa, Debaryomyces hansenii CBS767; identical to SEQ ID NO: 45079

SEQ ID NO: 45886 - DNA, 1041 bp, Debaryomyces hansenii CBS767; identical to SEQ ID NO: 45080
  CDS (1)..(1041)

SEQ ID NO: 45887 - protein, 346 aa, Debaryomyces hansenii CBS767; identical to SEQ ID NO: 45081

SEQ ID NO: 45888 - DNA, 1023 bp, Oryza sativa (japonica cultivar-group); identical to SEQ ID NO: 45082
  CDS (1)..(1023)

SEQ ID NO: 45889 - protein, 340 aa, Oryza sativa (japonica cultivar-group); identical to SEQ ID NO: 45083

SEQ ID NO: 45890 - DNA, 1194 bp, Oryza sativa (japonica cultivar-group); identical to SEQ ID NO: 45084
  CDS (1)..(1194)

SEQ ID NO: 45891 - protein, 397 aa, Oryza sativa (japonica cultivar-group); identical to SEQ ID NO: 45085

SEQ ID NO: 45892 - DNA, 1017 bp, Yarrowia lipolytica CLIB99; identical to SEQ ID NO: 45086
  CDS (1)..(1017)

SEQ ID NO: 45893 - protein, 338 aa, Yarrowia lipolytica CLIB99; identical to SEQ ID NO: 45087

SEQ ID NO: 45894 - DNA, 948 bp, Symbiobacterium thermophilum IAM 14863; identical to SEQ ID NO: 45090
  CDS (1)..(948): transl_table=11

SEQ ID NO: 45895 - protein, 315 aa, Symbiobacterium thermophilum IAM 14863; identical to SEQ ID NO: 45091

SEQ ID NO: 45896 - DNA, 939 bp, Mannheimia succiniciproducens MBEL55E; identical to SEQ ID NO: 45094
  CDS (1)..(939): transl_table=11

SEQ ID NO: 45897 - protein, 312 aa, Mannheimia succiniciproducens MBEL55E; identical to SEQ ID NO: 45095

SEQ ID NO: 45898 - DNA, 954 bp, Actinobacillus pleuropneumoniae serovar 1 str. 4074; identical to SEQ ID NO: 45106
  CDS (1)..(954)

SEQ ID NO: 45899 - protein, 317 aa, Actinobacillus pleuropneumoniae serovar 1 str. 4074; identical to SEQ ID NO: 45107

SEQ ID NO: 45900 - DNA, 936 bp, Haemophilus influenzae R2846
  CDS (1)..(936)
atgaaagttgctgtattaggagccgcaggtggtattggtcaagcattagcgttattactaaaacttcagttgccagcaggcaccgacttagcattatatgatattgccccagtaacaccaggtgttgcagtagatgtgagccatattccaacggcagtgaatgtgaaaggtttttctggcgaagatccaacacctgcacttgaaggtgcggatgttgtattaatttctgctggtgttgcacgtaaacctggtatggatcgttcagatttattcaatattaatgcaggtattgttcgtggtttaattgaaaaagtcgcggttacttgccctaaagcctgtgttggtattatcactaacccagtaaatactactgttgcgattgcggctgaagtgttgaaaaaagcaggtgtttacgacaaacgtaaattatttggtgtgacaactttagacgtgttacgttctgaaacttttgtggctgaattaaaaggtttaaatgtttctcgcaccagcgttcctgttattggtggtcactcaggtgtgactattcttccattactttctcaagttcaatatgcaaaatggaatgaagatgaaatcgaaccattaacaaaacgtatccaaaatgcaggtacagaagtggtcaatgcaaaagcgggtggtggttctgcaaccctttcaatggcgcaagctgcagcacgttttgctcgttctttagtgaaaggattgagtggcgagacagttgttgaatgtacttatgttgaaggcgatggcaaatatgctcgtttcttctctcagcccgttcgtttaggcaaagagggtgtagaagaaattttaccaattggcccattaagcaattttgaacaacaagccttagaaaatatgttgccaactttacgtgcagatattgaattaggcgaaaaatttattaatggttaa

SEQ ID NO: 45901 - protein, 311 aa, Haemophilus influenzae R2846
MKVAVLGAAGGIGQALALLLKLQLPAGTDLALYDIAPVTPGVAVDVSHIPTAVNVKGFSGEDPTPALEGADVVLISAGVARKPGMDRSDLFNINAGIVRGLIEKVAVTCPKACVGIITNPVNTTVAIAAEVLKKAGVYDKRKLFGVTTLDVLRSETFVAELKGLNVSRTSVPVIGGHSGVTILPLLSQVQYAKWNEDEIEPLTKRIQNAGTEVVNAKAGGGSATLSMAQAAARFARSLVKGLSGETVVECTYVEGDGKYARFFSQPVRLGKEGVEEILPIGPLSNFEQQALENMLPTLRADIELGEKFING

SEQ ID NO: 45902 - DNA, 957 bp, Rhodospirillum rubrum; identical to SEQ ID NO: 45116
  CDS (1)..(957)

SEQ ID NO: 45903 - protein, 318 aa, Rhodospirillum rubrum; identical to SEQ ID NO: 45117

SEQ ID NO: 45904 - DNA, 969 bp, Ferroplasma acidarmanus; identical to SEQ ID NO: 45122
  CDS (1)..(969)

SEQ ID NO: 45905 - protein, 322 aa, Ferroplasma acidarmanus; identical to SEQ ID NO: 45123

SEQ ID NO: 45906 - DNA, 957 bp, Trypanosoma brucei; identical to SEQ ID NO: 45132
  CDS (1)..(957)

SEQ ID NO: 45907 - protein, 318 aa, Trypanosoma brucei; identical to SEQ ID NO: 45133

SEQ ID NO: 45908 - DNA, 1077 bp, Medicago sativa; identical to SEQ ID NO: 45134
  CDS (1)..(1077)

SEQ ID NO: 45909 - protein, 358 aa, Medicago sativa; identical to SEQ ID NO: 45135

SEQ ID NO: 45910 - DNA, 1032 bp, Medicago sativa; identical to SEQ ID NO: 45136
  CDS (1)..(1032)

SEQ ID NO: 45911 - protein, 343 aa, Medicago sativa; identical to SEQ ID NO: 45137

SEQ ID NO: 45912 - DNA, 1227 bp, Medicago sativa; identical to SEQ ID NO: 45138
  CDS (1)..(1227)

SEQ ID NO: 45913 - protein, 408 aa, Medicago sativa; identical to SEQ ID NO: 45139

SEQ ID NO: 45914 - DNA, 972 bp, Trypanosoma cruzi; identical to SEQ ID NO: 45140
  CDS (1)..(972)

SEQ ID NO: 45915 - protein, 323 aa, Trypanosoma cruzi; identical to SEQ ID NO: 45141

SEQ ID NO: 45916 - DNA, 972 bp, Trypanosoma brucei; identical to SEQ ID NO: 45142
  CDS (1)..(972)

SEQ ID NO: 45917 - protein, 323 aa, Trypanosoma brucei; identical to SEQ ID NO: 45143

SEQ ID NO: 45918 - DNA, 1242 bp, Glycine max; identical to SEQ ID NO: 45144
  CDS (1)..(1242)

SEQ ID NO: 45919 - protein, 413 aa, Glycine max; identical to SEQ ID NO: 45145

SEQ ID NO: 45920 - DNA, 1197 bp, Pisum sativum; identical to SEQ ID NO: 45146
  CDS (1)..(1197)

SEQ ID NO: 45921 - protein, 398 aa, Pisum sativum; identical to SEQ ID NO: 45147

SEQ ID NO: 45922 - DNA, 1212 bp, Arabidopsis thaliana; identical to SEQ ID NO: 45148
  CDS (1)..(1212)

SEQ ID NO: 45923 - protein, 403 aa, Arabidopsis thaliana; identical to SEQ ID NO: 45149

SEQ ID NO: 45924 - DNA, 951 bp, Piromyces sp; identical to SEQ ID NO: 45150
  CDS (1)..(951)

SEQ ID NO: 45925 - protein, 316 aa, Piromyces sp; identical to SEQ ID NO: 45151

SEQ ID NO: 45926 - DNA, 1068 bp, Chlamydomonas reinhardtii; identical to SEQ ID NO: 45152
  CDS (1)..(1068)

SEQ ID NO: 45927 - protein, 355 aa, Chlamydomonas reinhardtii; identical to SEQ ID NO: 45153

SEQ ID NO: 45928 - DNA, 939 bp, Actinobacillus succinogenes; identical to SEQ ID NO: 45154
  CDS (1)..(939): transl_table=11

SEQ ID NO: 45929 - protein, 312 aa, Actinobacillus succinogenes; identical to SEQ ID NO: 45155

SEQ ID NO: 45930 - DNA, 1074 bp, Lycopersicon esculentum; identical to SEQ ID NO: 45158
  CDS (1)..(1074)

SEQ ID NO: 45931 - protein, 357 aa, Lycopersicon esculentum; identical to SEQ ID NO: 45159

SEQ ID NO: 45932 - DNA, 1041 bp, Lycopersicon esculentum; identical to SEQ ID NO: 45160
  CDS (1)..(1041): n means a or g or c or t/u, s means g or c

SEQ ID NO: 45933 - protein, 346 aa, Lycopersicon esculentum; identical to SEQ ID NO: 45161
  Xaa in position 256 is unknown

SEQ ID NO: 45934 - DNA, 939 bp, Moritella yayanosii
  CDS (1)..(939): transl_table=11
atgaaagtcgctgtattaggtgctgctggcggtatcggtcaagctttagccctacttttgaaaactcaactacctgctggttctgatttatcactttatgatatcgcccctgtaactccaggtgttgctgttgatttaagccatatccctacagacgttactattgctggttttgctggtacagatcctactgaagcacttgttggtgctgacgtggtacttatctctgcgggtgttgctcgtaaaccaggtatggaccgttcagatctattcaatatcaatgctgggatcatcaaaaatctagctgctaaatgtgcggaagtatgtccaaatgcatgtatcggcattatcactaacccagttaacaccacggtgccaattgctgctgaagtacttaagcaagcgggtgtttatgacaaacgtaaactattcggtatcaccacgctggatgttatccgttctgaaacttttgtaagtgagcttaaaggcatttcacttgctgacgttgaagtaccagtaattggtggtcactcaggcgtaacaattctgccgctactttctcaagtgaaaggcgttgaatttactgctgaagaaattgtgacacttacagcacgcattcaaaacgcaggtactgaagttgttgaagctaaagcgggtggcggttctgcgacactttctatgggtcaagcggcggcacgtttcggcctttctctggttcgcgcactacaaggtgaacaaggtatagttgagtgtacttatgttgatggtggctctgagcacgcaacattcttcgcacaacctgtactactaggtaaaaacggcgttgaagaagtactcgcatacggtgaactaagcgaatttgaagcaagcgcacgtgatgcaatgttagaagaactaaaagcgaacatcacgctaggtgaagaattcgttgctggttaa

SEQ ID NO: 45935 - protein, 312 aa, Moritella yayanosii
MKVAVLGAAGGIGQALALLLKTQLPAGSDLSLYDIAPVTPGVAVDLSHIPTDVTIAGFAGTDPTEALVGADVVLISAGVARKPGMDRSDLFNINAGIIKNLAAKCAEVCPNACIGIITNPVNTTVPIAAEVLKQAGVYDKRKLFGITTLDVIRSETFVSELKGISLADVEVPVIGGHSGVTILPLLSQVKGVEFTAEEIVTLTARIQNAGTEVVEAKAGGGSATLSMGQAAARFGLSLVRALQGEQGIVECTYVDGGSEHATFFAQPVLLGKNGVEEVLAYGELSEFEASARDAMLEELKANITLGEEFVAG

SEQ ID NO: 45936 - DNA, 1017 bp, Xenopus laevis; identical to SEQ ID NO: 45166
  CDS (1)..(1017)

SEQ ID NO: 45937 - protein, 338 aa, Xenopus laevis; identical to SEQ ID NO: 45167

SEQ ID NO: 45938 - DNA, 939 bp, Moritella sp; identical to SEQ ID NO: 45168
  CDS (1)..(939): transl_table=11

SEQ ID NO: 45939 - protein, 312 aa, Moritella sp; identical to SEQ ID NO: 45169

SEQ ID NO: 45940 - DNA, 936 bp, Shewanella sp; identical to SEQ ID NO: 45170
  CDS (1)..(936): transl_table=11

SEQ ID NO: 45941 - protein, 311 aa, Shewanella sp; identical to SEQ ID NO: 45171

SEQ ID NO: 45942 - DNA, 939 bp, Moritella sp; identical to SEQ ID NO: 45172
  CDS (1)..(939): transl_table=11

SEQ ID NO: 45943 - protein, 312 aa, Moritella sp; identical to SEQ ID NO: 45173

SEQ ID NO: 45944 - DNA, 939 bp, Moritella sp; identical to SEQ ID NO: 45174
  CDS (1)..(939): transl_table=11

SEQ ID NO: 45945 - protein, 312 aa, Moritella sp; identical to SEQ ID NO: 45175

SEQ ID NO: 45946 - DNA, 936 bp, Shewanella sp; identical to SEQ ID NO: 45176
  CDS (1)..(936): transl_table=11

SEQ ID NO: 45947 - protein, 311 aa, Shewanella sp; identical to SEQ ID NO: 45177

SEQ ID NO: 45948 - DNA, 939 bp, Moritella sp; identical to SEQ ID NO: 45178
  CDS (1)..(939): transl_table=11

SEQ ID NO: 45949 - protein, 312 aa, Moritella sp; identical to SEQ ID NO: 45179

SEQ ID NO: 45950 - DNA, 939 bp, Moritella sp; identical to SEQ ID NO: 45180
  CDS (1)..(939): transl_table=11

SEQ ID NO: 45951 - protein, 312 aa, Moritella sp; identical to SEQ ID NO: 45181

SEQ ID NO: 45952 - DNA, 939 bp, Moritella sp; identical to SEQ ID NO: 45182
  CDS (1)..(939): transl_table=11

SEQ ID NO: 45953 - protein, 312 aa, Moritella sp; identical to SEQ ID NO: 45183

SEQ ID NO: 45954 - DNA, 951 bp, Toxoplasma gondii; identical to SEQ ID NO: 45184
  CDS (1)..(951)

SEQ ID NO: 45955 - protein, 316 aa, Toxoplasma gondii; identical to SEQ ID NO: 45185

SEQ ID NO: 45956 - DNA, 1017 bp, Homo sapiens; identical to SEQ ID NO: 45186
  CDS (1)..(1017)

SEQ ID NO: 45957 - protein, 338 aa, Homo sapiens [sequence omitted]

SEQ ID NO: 45958 - DNA, 1017 bp, Xenopus laevis; identical to SEQ ID NO: 45188
  CDS (1)..(1017)

SEQ ID NO: 45959 - protein, 338 aa, Xenopus laevis; identical to SEQ ID NO: 45189

SEQ ID NO: 45960 - DNA, 951 bp, Cryptosporidium parvum; identical to SEQ ID NO: 45192
  CDS (1)..(951)

SEQ ID NO: 45961 - protein, 316 aa, Cryptosporidium parvum; identical to SEQ ID NO: 45193

SEQ ID NO: 45962 - DNA, 1023 bp, Branchiostoma belcheri tsingtaunese; identical to SEQ ID NO: 45194
  CDS (1)..(1023)

SEQ ID NO: 45963 - protein, 340 aa, Branchiostoma belcheri tsingtaunese; identical to SEQ ID NO: 45195

SEQ ID NO: 45964 - DNA, 1017 bp, Echinococcus granulosus; identical to SEQ ID NO: 45196
  CDS (1)..(1017)

SEQ ID NO: 45965 - protein, 338 aa, Echinococcus granulosus; identical to SEQ ID NO: 45197

SEQ ID NO: 45966 - DNA, 1023 bp, Paracoccidioides brasiliensis; identical to SEQ ID NO: 45198
  CDS (1)..(1023)

SEQ ID NO: 45967 - protein, 340 aa, Paracoccidioides brasiliensis; identical to SEQ ID NO: 45199

SEQ ID NO: 45968 - DNA, 990 bp, Entamoeba histolytica
  CDS (1)..(990)
atgcaacaaccaattccttgggaaaaagtcaatagaactgaaccattacatgttttaattactggggctgctggtcaaattggatataatttatgttttctcattggaaggggatttttatttgattgtgatgttattcttcatttgtatgatctaaatgatatggcattaaaaggattatcaatggaattaactgattgttgtttgccaaaactaaaaggaattatttctactacagaaattgcacttgcttttagtaatgttgatgttgcaattattgttgcaggtgttccacgaaaacctggaatgcaacgtagtgatttaattaatgtaaataaaaaagtaatggaaatgaatggaaaagcacttggaacttattcaaataaagatgttcgtgtggttgttgttgctaatcctgcaaacactaatgcctatgttatttgtaaaacatcaggtattccacctgagcacataactgcactaacacgtttagaccaaaatagagcaactgcgtttgttgctaatgaagttgggtgtcaacctgaatttgttcataatattattgtttggggaaatcactctaatacaatgcaaccagacctttcatattcatatcttgctgaccaaaatgggattaaaccattagctaattgtattgaagattttgatgcttttactgaaaaagttagatgtcgtggtgaagaagtaatcagtacaagaaaagcaagttctgctggatctgctgctcatgcaatttgtcaacacattaaagattggatttatggaactaagccaggaattatggttagtatgggagtttctagtaatggagaatatggaattgatacaggtcttttttattcaatgccagtgacatgttcagaaggagagtatcatattgttgattctttagtaatagaaccaagaatcaaagactcattaattctttcagaattagagttaattgatgaacgaaatattgttaattga

SEQ ID NO: 45969 - protein, 329 aa, Entamoeba histolytica
MQQPIPWEKVNRTEPLHVLITGAAGQIGYNLCFLIGRGFLFDCDVILHLYDLNDMALKGLSMELTDCCLPKLKGIISTTEIALAFSNVDVAIIVAGVPRKPGMQRSDLINVNKKVMEMNGKALGTYSNKDVRVVVVANPANTNAYVICKTSGIPPEHITALTRLDQNRATAFVANEVGCQPEFVHNIIVWGNHSNTMQPDLSYSYLADQNGIKPLANCIEDFDAFTEKVRCRGEEVISTRKASSAGSAAHAICQHIKDWIYGTKPGIMVSMGVSSNGEYGIDTGLFYSMPVTCSEGEYHIVDSLVIEPRIKDSLILSELELIDERNIVN

SEQ ID NO: 45970 - DNA, 1068 bp, Entamoeba histolytica
  CDS (1)..(1068)
atgaatactggtttagacattagtaaaacttggaaaagaattaatgttgatccaaatgttgaatcaaaaccacttcatgttcttgtaactggagctgcaggtcaaattggatataatcttcttttcttaattgctcatggtttaatgtttggtccaaatcaaacagtttatttacatttatatgatattatggttgaagctatggaaggagtaaaaatggaattagctgattgttgtttcccacttgttaaaggagttgtagcttcaaataaaacagaagttgcatttaaagatgttgaatgtgctattttagttgctggtatgccaagaaaagtaggtatggaaagaaaagaattaattggcattaacactagaattatgaaagaacaagctcttgctcttaagaattttgctaatcctcatgttagagttttagttgttgctaatccagctaatactaatgcacttgtagttgctaataatgctggaattgatgttaaacaaattacttgtttaactcgacttgatcaaaatagggctattgctcaaattgcaagtaaattaaattgtaaagttgaagatgtttctgatgcttttgtatggggaaatcattcagaaaaacaatgtccagatatttctcatgcagttgttcaaacaccaaatggaccaaaaagagtagctgaccttgttgaagagtcatggttagaatcttttaataaaactgttcaagaaagaggagctaaagtaattgaaatgagaaaggcatcatcagctgcttcagctgccaaagcaattgttgatcattttagagattggtgtcttggaacaaataaagaaaagatagtttgtatgggagtttatagtgaaggacaatatggtattccaaaaggaatattctttagtatgccagttgtctgttatggaggtgaatatcatattgttgatgacttagtactcagtgaatcaactagaacaatgttgaagaattctgaagaagaattattagaagaaaagaaattagagatagcatatgaagaaattaaacaacattccaatgttcacgaataa

SEQ ID NO: 45971 - protein, 355 aa, Entamoeba histolytica
MNTGLDISKTWKRINVDPNVESKPLHVLVTGAAGQIGYNLLFLIAHGLMFGPNQTVYLHLYDIMVEAMEGVKMELADCCFPLVKGVVASNKTEVAFKDVECAILVAGMPRKVGMERKELIGINTRIMKEQALALKNFANPHVRVLVVANPANTNALVVANNAGIDVKQITCLTRLDQNRAIAQIASKLNCKVEDVSDAFVWGNHSEKQCPDISHAVVQTPNGPKRVADLVEESWLESFNKTVQERGAKVIEMRKASSAASAAKAIVDHFRDWCLGTNKEKIVCMGVYSEGQYGIPKGIFFSMPVVCYGGEYHIVDDLVLSESTRTMLKNSEEELLEEKKLEIAYEEIKQHSNVHE

SEQ ID NO: 45972 - DNA, 960 bp, Francisella tularensis subsp; identical to SEQ ID NO: 45200
  CDS (1)..(960): transl_table=11

SEQ ID NO: 45973 - protein, 319 aa, Francisella tularensis subsp; identical to SEQ ID NO: 45201

SEQ ID NO: 45974 - DNA, 1035 bp, Solanum tuberosum; identical to SEQ ID NO: 45202
  CDS (1)..(1035)

SEQ ID NO: 45975 - protein, 344 aa, Solanum tuberosum; identical to SEQ ID NO: 45203

SEQ ID NO: 45976 - DNA, 1041 bp, Solanum tuberosum; identical to SEQ ID NO: 45204
  CDS (1)..(1041)

SEQ ID NO: 45977 - protein, 346 aa, Solanum tuberosum; identical to SEQ ID NO: 45205

SEQ ID NO: 45978 - DNA, 1041 bp, Solanum tuberosum; identical to SEQ ID NO: 45206
  CDS (1)..(1041)

SEQ ID NO: 45979 - protein, 346 aa, Solanum tuberosum; identical to SEQ ID NO: 45207

SEQ ID NO: 45980 - DNA, 1026 bp, Arabidopsis thaliana; identical to SEQ ID NO: 45208
  CDS (1)..(1026)

SEQ ID NO: 45981 - protein, 341 aa, Arabidopsis thaliana; identical to SEQ ID NO: 45209

SEQ ID NO: 45982 - DNA, 1044 bp, Drosophila melanogaster
  CDS (1)..(1044)
atgtttttggcctctagattgttaagccatgttggcaacttgcctcccaaggtccagcagcttggatatatcagccgaggtctcaaggtcgccgttgtgggatcggtgggtggaatcggtcagccgctgtcccttcttctcaagcataatccgcaaatctcgaccctgtcgctgtacgacattaagaatacaaccggtgtaggagtagacttatctcatatcaacacccgtgcttcagtgtgcccattcgagggtaagaatggtttaaaaaaagctatggataaggctgatatagtggtgataccggcgggtttgccacgtaagcccggaatgaagcgcgaagatttggtggacgtgaatgccagcgttgcctgcgaagtggcttttgcggctagcgaagtttgtcccggtgccatgcttgccttcataacgaaccccatcaatgtgatagtacccatcgtggccacgatccttaaagcaaagggtacatacgatccgaatcgactatttggtgtcaccactctggatgtggtacgagcccagacctttgtagcggacattctcaacgttgatccacagaaagtgaatatacccgtaatcggtggccatacaggtcggaccatcctgcccatactgtcgcagtgtgatcccccctttaagggtaccgataaggagcgcgaagcgttgatccaacgcatccaaaatgcgggcacagaagtggttaatgccaaggatggcctgggctcggccaccctatcgatggcctttgcagccactcagtttgtaaactcgttgataaagggtatcaagggttcaaaggacgagtgcattgtggaatgtgcctatgtggagtctgatgtcacggaggcccagttcttcgccaccccactgatactgggaccccagggtgtcaaggaaaacacaggattgcccgatttggacgatgaggaaaggaaggctctaaatggtatgctacccattttgaaggagagtatcgcaaagggcatcaaattgggcgagggtatgatatgcagttgtgcataa

SEQ ID NO: 45983 - protein, 347 aa, Drosophila melanogaster
MFLASRLLSHVGNLPPKVQQLGYISRGLKVAVVGSVGGIGQPLSLLLKHNPQISTLSLYDIKNTTGVGVDLSHINTRASVCPFEGKNGLKKAMDKADIVVIPAGLPRKPGMKREDLVDVNASVACEVAFAASEVCPGAMLAFITNPINVIVPIVATILKAKGTYDPNRLFGVTTLDVVRAQTFVADILNVDPQKVNIPVIGGHTGRTILPILSQCDPPFKGTDKEREALIQRIQNAGTEVVNAKDGLGSATLSMAFAATQFVNSLIKGIKGSKDECIVECAYVESDVTEAQFFATPLILGPQGVKENTGLPDLDDEERKALNGMLPILKESIAKGIKLGEGMICSCA

SEQ ID NO: 45984 - DNA, 1020 bp, Talaromyces emersonii; identical to SEQ ID NO: 45212
  CDS (1)..(1020)

SEQ ID NO: 45985 - protein, 339 aa, Talaromyces emersonii; identical to SEQ ID NO: 45213

SEQ ID NO: 45986 - DNA, 1014 bp, Sphyraena idiastes; identical to SEQ ID NO: 45214
  CDS (1)..(1014)

SEQ ID NO: 45987 - protein, 337 aa, Sphyraena idiastes; identical to SEQ ID NO: 45215

SEQ ID NO: 45988 - DNA, 1065 bp, Arabidopsis thaliana; identical to SEQ ID NO: 45216
  CDS (1)..(1065)

SEQ ID NO: 45989 - protein, 354 aa, Arabidopsis thaliana; identical to SEQ ID NO: 45217

SEQ ID NO: 45990 - DNA, 1029 bp, Nucella lapillus; identical to SEQ ID NO: 45218
  CDS (1)..(1029)

SEQ ID NO: 45991 - protein, 342 aa, Nucella lapillus; identical to SEQ ID NO: 45219

SEQ ID NO: 45992 - DNA, 969 bp, Phytomonas sp; identical to SEQ ID NO: 45220
  CDS (1)..(969)

SEQ ID NO: 45993 - protein, 322 aa, Phytomonas sp; identical to SEQ ID NO: 45221

SEQ ID NO: 45994 - DNA, 969 bp, Phytomonas sp; identical to SEQ ID NO: 45222
  CDS (1)..(969)

SEQ ID NO: 45995 - protein, 322 aa, Phytomonas sp; identical to SEQ ID NO: 45223

SEQ ID NO: 45996 - DNA, 1059 bp, Vitis vinifera; identical to SEQ ID NO: 45224
  CDS (1)..(1059)

SEQ ID NO: 45997 - protein, 352 aa, Vitis vinifera; identical to SEQ ID NO: 45225

SEQ ID NO: 45998 - DNA, 1026 bp, Nucella lapillus; identical to SEQ ID NO: 45226
  CDS (1)..(1026)

SEQ ID NO: 45999 - protein, 341 aa, Nucella lapillus; identical to SEQ ID NO: 45227

SEQ ID NO: 46000 - DNA, 1038 bp, Glycine max; identical to SEQ ID NO: 45228
  CDS (1)..(1038)

SEQ ID NO: 46001 - protein, 345 aa, Glycine max; identical to SEQ ID NO: 45229

SEQ ID NO: 46002 - DNA, 969 bp, Leishmania major; identical to SEQ ID NO: 45230
  CDS (1)..(969)

SEQ ID NO: 46003 - protein, 322 aa, Leishmania major; identical to SEQ ID NO: 45231

SEQ ID NO: 46004 - DNA, 1239 bp, Nicotiana tabacum; identical to SEQ ID NO: 45232
  CDS (1)..(1239): transl_table=11

SEQ ID NO: 46005 - protein, 412 aa, Nicotiana tabacum; identical to SEQ ID NO: 45233

SEQ ID NO: 46006 - DNA, 1029 bp, Malassezia furfur; identical to SEQ ID NO: 45234
  CDS (1)..(1029)

SEQ ID NO: 46007 - protein, 342 aa, Malassezia furfur; identical to SEQ ID NO: 45235

SEQ ID NO: 46008 - DNA, 1008 bp, Aquifex aeolicus; identical to SEQ ID NO: 45236
  CDS (1)..(1008): transl_table=11

SEQ ID NO: 46009 - protein, 335 aa, Aquifex aeolicus; identical to SEQ ID NO: 45237

SEQ ID NO: 46010 - DNA, 1005 bp, Aquifex aeolicus; identical to SEQ ID NO: 45238
  CDS (1)..(1005): transl_table=11

SEQ ID NO: 46011 - protein, 334 aa, Aquifex aeolicus; identical to SEQ ID NO: 45239

SEQ ID NO: 46012 - DNA, 1065 bp, Arabidopsis thaliana; identical to SEQ ID NO: 45240
  CDS (1)..(1065)

SEQ ID NO: 46013 - protein, 354 aa, Arabidopsis thaliana; identical to SEQ ID NO: 45241

SEQ ID NO: 46014 - DNA, 1077 bp, Brassica napus; identical to SEQ ID NO: 45242
  CDS (1)..(1077)

SEQ ID NO: 46015 - protein, 358 aa, Brassica napus; identical to SEQ ID NO: 45243

SEQ ID NO: 46016 - DNA, 1071 bp, Citrullus lanatus; identical to SEQ ID NO: 45244
  CDS (1)..(1071)

SEQ ID NO: 46017 - protein, 356 aa, Citrullus lanatus; identical to SEQ ID NO: 45245

SEQ ID NO: 46018 - DNA, 1071 bp, Cucumis sativus; identical to SEQ ID NO: 45246
  CDS (1)..(1071)

SEQ ID NO: 46019 - protein, 356 aa, Cucumis sativus; identical to SEQ ID NO: 45247

SEQ ID NO: 46020 - DNA, 1071 bp, Oryza sativa; identical to SEQ ID NO: 45248
  CDS (1)..(1071)

SEQ ID NO: 46021 - protein, 356 aa, Oryza sativa; identical to SEQ ID NO: 45249

SEQ ID NO: 46022 - DNA, 1077 bp, Brassica napus; identical to SEQ ID NO: 45250
  CDS (1)..(1077)

SEQ ID NO: 46023 - protein, 358 aa, Brassica napus; identical to SEQ ID NO: 45251

SEQ ID NO: 46024 - DNA, 1065 bp, Arabidopsis thaliana
  CDS (1)..(1065)
atggatccaaaccaacgtatcgcgagaatctctgctcatctcaatcctcctaatcttcataatcagattgctgacgggtcaggtttgaatcgggtggcttgtcgggcaaaaggtggatcacccggattcaaagtggcgatacttggagcagctggtggaattggacaacctcttgcgatgttgatgaagatgaatcctttggtttcggttcttcatctctatgatgttgctaatgctcctggtgttactgctgatattagtcatatggatactagtgccgttgttcgtggatttctcgggcagccgcagttagaggaagcacttacgggtatggatttagtgatcatacctgctggtgttccgaggaaaccagggatgacgagggatgatctgtttaacattaatgctgggattgtgaggacactctctgaagctatagctaaatgttgtcctaaagcaattgtgaatataatcagtaatccggtgaactccacggtgccaatcgcagctgaggttttcaagaaagctggaacctttgatccaaagaaactcatgggtgtcactatgcttgatgttgttagagctaatacctttgtggcggaagtaatgagtcttgatccccgtgaagttgaagttccggttgttggaggacacgcaggagttacgattttaccactgctttcgcaggtgaaacctccttgctcgttcactcaaaaagagattgaatatctcacagaccgcatccaaaacggtggcactgaagttgttgaggctaaagctggagcaggttctgcaacactatccatggcatatgcagcagtggagtttgcagatgcttgcctcaggggtctacgaggtgatgcaaacatcgttgagtgcgcatatgtggcatcccatgtgactgagcttcccttcttcgcatcgaaggtgcgtctgggacgatgtgggatcgatgaagtgtacggccttggaccattgaacgaatatgagaggatgggattagagaaggcaaagaaagagctttcagtaagtattcataaaggtgttacctttgcgaagaaataa

SEQ ID NO: 46025 - protein, 354 aa, Arabidopsis thaliana
MDPNQRIARISAHLNPPNLHNQIADGSGLNRVACRAKGGSPGFKVAILGAAGGIGQPLAMLMKMNPLVSVLHLYDVANAPGVTADISHMDTSAVVRGFLGQPQLEEALTGMDLVIIPAGVPRKPGMTRDDLFNINAGIVRTLSEAIAKCCPKAIVNIISNPVNSTVPIAAEVFKKAGTFDPKKLMGVTMLDVVRANTFVAEVMSLDPREVEVPVVGGHAGVTILPLLSQVKPPCSFTQKEIEYLTDRIQNGGTEVVEAKAGAGSATLSMAYAAVEFADACLRGLRGDANIVECAYVASHVTELPFFASKVRLGRCGIDEVYGLGPLNEYERMGLEKAKKELSVSIHKGVTFAKK

SEQ ID NO: 46026 - DNA, 1026 bp, Arabidopsis thaliana
  CDS (1)..(1026)
atgttcagatctatgctcgtccgatcttctgcctccgcgaagcaggcggttatccgccgtagcttctcctccggctccgtccccgagcgtaaagtcgccatccttggtgccgccggtggaattggtcagcctcttgctctcctcatgaagcttaatcctcttgtctcttccctctccctctacgatatcgctaacactcctggagttgctgctgatgttggtcacatcaacaccagatctgaggttgttggatacatgggcgatgataacttggccaaagctcttgaaggagctgatctcgttatcattccagctggtgtaccaaggaagcctggtatgacccgtgacgatcttttcaacattaatgctggaattgtcaagaacctttgcactgccatcgccaagtactgcccacatgcgcttattaatatgatcagcaaccctgtgaactctactgttccaattgcagctgagatatttaagaaggctggtatgtacgatgaaaagaaattgtttggtgttaccactcttgacgtcgtcagggccaggactttctatgctggaaaggcaaatgtcccagttgcagaagttaatgttccggtgattggtggtcatgctggggttactattctccctctcttctctcaggcaactcctcaagccaacttgtcaagtgacatacttaccgcccttactaagcgtacccaagatggaggtacagaagtcgtggaggcaaaagcaggaaaaggttcagctacattgtccatggcctatgccggagcattgttcgctgatgcatgcttgaaaggactcaacggtgttccagatgtcatagaatgctcatacgtgcaatctacaatcaccgagcttcctttctttgcctcgaaggtgaggttggggaagaatggtgtggaggaggttcttgacttgggaccactctcagactttgagaaggaaggcttggaagcattgaagccagaactcaagtcctccatagaaaagggagtcaagtttgccaaccagtga

SEQ ID NO: 46027 - protein, 341 aa, Arabidopsis thaliana
MFRSMLVRSSASAKQAVIRRSFSSGSVPERKVAILGAAGGIGQPLALLMKLNPLVSSLSLYDIANTPGVAADVGHINTRSEVVGYMGDDNLAKALEGADLVIIPAGVPRKPGMTRDDLFNINAGIVKNLCTAIAKYCPHALINMISNPVNSTVPIAAEIFKKAGMYDEKKLFGVTTLDVVRARTFYAGKANVPVAEVNVPVIGGHAGVTILPLFSQATPQANLSSDILTALTKRTQDGGTEVVEAKAGKGSATLSMAYAGALFADACLKGLNGVPDVIECSYVQSTITELPFFASKVRLGKNGVEEVLDLGPLSDFEKEGLEALKPELKSSIEKGVKFANQ

SEQ ID NO: 46028 - DNA, 1026 bp, Brassica napus; identical to SEQ ID NO: 45252
  CDS (1)..(1026)

SEQ ID NO: 46029 - protein, 341 aa, Brassica napus; identical to SEQ ID NO: 45253

SEQ ID NO: 46030 - DNA, 1026 bp, Caenorhabditis elegans; identical to SEQ ID NO: 45254
  CDS (1)..(1026)

SEQ ID NO: 46031 - protein, 341 aa, Caenorhabditis elegans; identical to SEQ ID NO: 45255

SEQ ID NO: 46032 - DNA, 1122 bp, Chlamydomonas reinhardtii; identical to SEQ ID NO: 45256
  CDS (1)..(1122)

SEQ ID NO: 46033 - protein, 373 aa, Chlamydomonas reinhardtii; identical to SEQ ID NO: 45257

SEQ ID NO: 46034 - DNA, 1044 bp, Citrullus lanatus; identical to SEQ ID NO: 45258
  CDS (1)..(1044)

SEQ ID NO: 46035 - protein, 347 aa, Citrullus lanatus; identical to SEQ ID NO: 45259

SEQ ID NO: 46036 - DNA, 1044 bp, Eucalyptus gunnii; identical to SEQ ID NO: 45260
  CDS (1)..(1044)

SEQ ID NO: 46037 - protein, 347 aa, Eucalyptus gunnii; identical to SEQ ID NO: 45261

SEQ ID NO: 46038 - DNA, 1005 bp, Saccharomyces cerevisiae; identical to SEQ ID NO: 45262
  CDS (1)..(1005)

SEQ ID NO: 46039 - protein, 334 aa, Saccharomyces cerevisiae; identical to SEQ ID NO: 45263

SEQ ID NO: 46040 - DNA, 963 bp, Bartonella henselae; identical to SEQ ID NO: 45274
  CDS (1)..(963): transl_table=11

SEQ ID NO: 46041 - protein, 320 aa, Bartonella henselae; identical to SEQ ID NO: 45275

SEQ ID NO: 46042 - DNA, 969 bp, Bradyrhizobium japonicum; identical to SEQ ID NO: 45278
  CDS (1)..(969)

SEQ ID NO: 46043 - protein, 322 aa, Bradyrhizobium japonicum; identical to SEQ ID NO: 45279

SEQ ID NO: 46044 - DNA, 963 bp, Brucella melitensis
  CDS (1)..(963)
atggcacgcaacaagattgccctcatcggctccggcatgatcggcggtacgctcgctcacctggccggtctgaaggaactcggtgacgtcgtccttttcgacattgcggaaggcaccccgcagggcaaggggctggatatcgccgaatcttctccggtcgatggtttcgatgcgaagttcactggcgcgaacgattacgccgccattgaaggcgcagacgtcgtcatcgtcaccgcaggggtgccgcgcaagccgggcatgagccgcgacgatctcctgggcatcaacctgaaggtgatggaacaggtgggcgcgggcatcaagaaatatgcgccggaagctttcgtcatctgcatcaccaacccgctcgacgccatggtctgggcgctgcagaagttctccggccttccggcccacaaggttgtcggcatggctggcgttctcgacagcgcccgcttccgttatttcctctcggaagaattcaacgtttcggtcgaggacgtcacggcattcgtgctgggtggccacggcgattcgatggttccgctggcgcgctactcgaccgttgccggcattccgctgtctgatctcgtcaagatgggctggaccagccaggacaagctcgacaagatcatccagcgcacccgtgacggcggcgcggaaatcgtgggccttctcaagaccggctcggctttctacgctccggcggcatcggccatccagatggctgaatcctacctcaaggacaagaagcgcgtcctgccggtcgcagcccagctttcgggccagtatggcgtgaaggacatgtatgtgggcgttccgaccgtgatcggcgccaatggcgtggagcgcatcatcgagatcgatctcgacaaggacgagaaggcgcagttcgacaagtcggtggcctccgtcgccggtctgtgcgaagcctgcatcggtattgctccgtcgctgaaataa

SEQ ID NO: 46045 - protein, 320 aa, Brucella melitensis
MARNKIALIGSGMIGGTLAHLAGLKELGDVVLFDIAEGTPQGKGLDIAESSPVDGFDAKFTGANDYAAIEGADVVIVTAGVPRKPGMSRDDLLGINLKVMEQVGAGIKKYAPEAFVICITNPLDAMVWALQKFSGLPAHKVVGMAGVLDSARFRYFLSEEFNVSVEDVTAFVLGGHGDSMVPLARYSTVAGIPLSDLVKMGWTSQDKLDKIIQRTRDGGAEIVGLLKTGSAFYAPAASAIQMAESYLKDKKRVLPVAAQLSGQYGVKDMYVGVPTVIGANGVERIIEIDLDKDEKAQFDKSVASVAGLCEACIGIAPSLK

SEQ ID NO: 46046 - DNA, 933 bp, Chlorobium tepidum
  CDS (1)..(933): transl_table=11
atgaaaatcaccgttattggcgcaggcaacgttggggcaaccacggctttccgtcttgcagaaaaacagcttgcaagagagctcgtgttgctcgatgtcgtcgaaggcatacctcagggaaaagcacttgacatgtacgaaagcggcccggtcggcctgttcgacacgaaggtaaccggctcaaacgactatgccgacactgcaaattccgatatcgtcgtcatcaccgccggtctgccgagaaaaccaggcatgactcgcgaggatctgctttcgatgaatgccggtatcgtcagggaggtgaccggacggatcatggagcactcgaaaaatccgatcatcgtggtggtttccaacccgctcgatatcatgacgcacgtggcctggcagaaaagcggattaccgaaagagcgggtcatcggcatggccggtgtgcttgactcggcgcgcttccgctccttcatcgccatggaacttggcgtttcgatgcaggatgtgaccgcatgcgtgctcggcggccacggcgacgcaatggtgccggtagtcaaatacaccacggtggcaggcattccggttgccgacctcatttccgcagaaaggatcgcggagctggtcgagcgcacccgcaccggcggcgcagagatcgtcaaccacctcaagcagggttcggcattttacgctccggcaacatcggtggtcgaaatggtagagtcgatcgtgctggatcgcaagcgcgtgctgacctgcgctgtaagcctcgacgggcagtacggcatcgacggcaccttcgttggcgtcccggtcaagctcggcaaaaacggcgtcgagcacatctacgaaatcaagctcgaccagagtgacctcgacctgttgcagaaatcggcaaagatcgtcgatgaaaactgcaaaatgctcgatgcatcgcagggctga

SEQ ID NO: 46047 - protein, 310 aa, Chlorobium tepidum
MKITVIGAGNVGATTAFRLAEKQLARELVLLDVVEGIPQGKALDMYESGPVGLFDTKVTGSNDYADTANSDIVVITAGLPRKPGMTREDLLSMNAGIVREVTGRIMEHSKNPIIVVVSNPLDIMTHVAWQKSGLPKERVIGMAGVLDSARFRSFIAMELGVSMQDVTACVLGGHGDAMVPVVKYTTVAGIPVADLISAERIAELVERTRTGGAEIVNHLKQGSAFYAPATSVVEMVESIVLDRKRVLTCAVSLDGQYGIDGTFVGVPVKLGKNGVEHIYEIKLDQSDLDLLQKSAKIVDENCKMLDASQG

SEQ ID NO: 46048 - DNA, 960 bp, Francisella novicida; identical to SEQ ID NO: 45284
  CDS (1)..(960): transl_table=11

SEQ ID NO: 46049 - protein, 319 aa, Francisella novicida; identical to SEQ ID NO: 45285

SEQ ID NO: 46050 - DNA, 975 bp, Haemophilus ducreyi; identical to SEQ ID NO: 45288
  CDS (1)..(975): transl_table=11

SEQ ID NO: 46051 - protein, 324 aa, Haemophilus ducreyi; identical to SEQ ID NO: 45289

SEQ ID NO: 46052 - DNA, 936 bp, Haemophilus influenzae; identical to SEQ ID NO: 45290
  CDS (1)..(936): transl_table=11

SEQ ID NO: 46053 - protein, 311 aa, Haemophilus influenzae; identical to SEQ ID NO: 45291

SEQ ID NO: 46054 - DNA, 963 bp, Methylobacterium extorquens; identical to SEQ ID NO: 45296
  CDS (1)..(963): transl_table=11

SEQ ID NO: 46055 - protein, 320 aa, Methylobacterium extorquens; identical to SEQ ID NO: 45297

SEQ ID NO: 46056 - DNA, 942 bp, Methanococcus jannaschii; identical to SEQ ID NO: 45298
  CDS (1)..(942): transl_table=11

SEQ ID NO: 46057 - protein, 313 aa, Methanococcus jannaschii; identical to SEQ ID NO: 45299

SEQ ID NO: 46058 - DNA, 939 bp, Moritella sp; identical to SEQ ID NO: 45306
  CDS (1)..(939): transl_table=11

SEQ ID NO: 46059 - protein, 312 aa, Moritella sp; identical to SEQ ID NO: 45307

SEQ ID NO: 46060 - DNA, 939 bp, Photorhabdus luminescens; identical to SEQ ID NO: 45314
  CDS (1)..(939): transl_table=11

SEQ ID NO: 46061 - protein, 312 aa, Photorhabdus luminescens; identical to SEQ ID NO: 45315

SEQ ID NO: 46062 - DNA, 939 bp, Photobacterium profundum
  CDS (1)..(939): transl_table=11
atgaaagttgctgtaattggtgctgcaggtggtattggccaggcattggctttactgttgaaaaacggcttacctgcaggttctgatcttgcgctatatgatattgctccagtaactcctggtgttgcggctgatcttagccatatcccaactcctgtttctattaagggttatggtggtgtcgatccaacacctgcactggaaggtgctgatgttgtattaatctctgctggtgttgcacgtaaacctggaatggatcgttctgatcttttcaacgtcaatgcgggtatcattaaatctttagctgaaaaaattgctgtagtatgtcctaaagcatgcgtcggtattattacgaaccctgtaaatacaacagtggcgattgctgctgatgtattgaaaaaagcaggtgtatacgacaagcgtcgtttatttggtatcacaacacttgatattattcgttcagaaacatttgttgctgaattaaaaggcaaaaccccaagtgacattcaagtgccagtcatcggtggtcactcaggtgtgactattctacctttattgtctcaagttgaaggtgttgagttttctgacgaagaaattaaagcattaacgccacgcattcaaaatgcaggtactgaagtagtagaagctaaagcgggtggtggttctgcaacactgtctatgggtcaagcggcttatcgctttggtctttcacttgttcgcgccctacaaggcgagcaaggtattgttgagtgtgcttatgttgaaggtgacggtaagcatgcacgtttctttgcacagcccgttctattaggcaaagatggtgtagaagaagtgattgattacggcaagttaagtacttttgaacaagaagcactaaataacatgctagataccctgacttcagatattacactaggtgaagagtttgctgctaaatag

SEQ ID NO: 46063 - protein, 312 aa, Photobacterium profundum
MKVAVIGAAGGIGQALALLLKNGLPAGSDLALYDIAPVTPGVAADLSHIPTPVSIKGYGGVDPTPALEGADVVLISAGVARKPGMDRSDLFNVNAGIIKSLAEKIAVVCPKACVGIITNPVNTTVAIAADVLKKAGVYDKRRLFGITTLDIIRSETFVAELKGKTPSDIQVPVIGGHSGVTILPLLSQVEGVEFSDEEIKALTPRIQNAGTEVVEAKAGGGSATLSMGQAAYRFGLSLVRALQGEQGIVECAYVEGDGKHARFFAQPVLLGKDGVEEVIDYGKLSTFEQEALNNMLDTLTSDITLGEEFAAK

SEQ ID NO: 46064 - DNA, 969 bp, Rhodopseudomonas palustris; identical to SEQ ID NO: 45326
  CDS (1)..(969): transl_table=11

SEQ ID NO: 46065 - protein, 322 aa, Rhodopseudomonas palustris; identical to SEQ ID NO: 45327

SEQ ID NO: 46066 - DNA, 945 bp, Rickettsia prowazekii; identical to SEQ ID NO: 45330
  CDS (1)..(945): transl_table=11

SEQ ID NO: 46067 - protein, 314 aa, Rickettsia prowazekii; identical to SEQ ID NO: 45331

SEQ ID NO: 46068 - DNA, 939 bp, Salmonella paratyphi
  CDS (1)..(939): transl_table=11
atgaaagtcgcagtcctcggcgctgctggtggtatcggtcaggcgctggcattacttttaaaaaaccaactgccttcaggttcagaactctccctgtacgacatcgctccagtgactcccggtgtggccgttgatttaagccacatccccaccgctgtaaaaatcaaaggtttctccggtgaagacgcaaccccggcgcttgaaggcgctgacgtagtactgatttctgcgggtgtggcgcgtaagccgggtatggaccgttccgacctgtttaacgttaacgccggcatcgtgaaaaacctggtgcagcagatcgctaaaacctgcccgaaagcgtgcgtgggcattatcaccaacccggtgaacaccaccgttgcgattgcggcggaagtgttgaaaaaagcaggcgtatacgacaaaaacaaactgtttggcgttaccacgctggatatcatccgctctaatacctttgtcgcagagctgaaaggtaagctgccaacggaagttgaagttccggtgattggcgggcactccggcgtgacgattctgccgctgctatcgcagattccaggcgtaagttttaccgaacaagaagcggccgagctgactaaacgtattcagaacgccggtactgaagtcgtcgaggcgaaagccggcggcggatcggcaaccctctctatgggccaggctgccgcgcgtttcggtctttctctggttcgcgctctgcagggcgaaaaaggcgtggtggaatgcgcctatgtggaaggcgacggtcagtatgcccgtttcttctctcagccgctgctgctgggtaaaaacggcgtagaagagcgtaaatccatcggcacactgagcactttcgagcaacattcgctggacgctatgctggatacgctgaaaaaagatattcagttgggtgaagattttattaataaataa

SEQ ID NO: 46069 - protein, 312 aa, Salmonella paratyphi
MKVAVLGAAGGIGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAAELTKRIQNAGTEVVEAKAGGGSATLSMGQAAARFGLSLVRALQGEKGVVECAYVEGDGQYARFFSQPLLLGKNGVEERKSIGTLSTFEQHSLDAMLDTLKKDIQLGEDFINK

SEQ ID NO: 46070 - DNA, 936 bp, Shewanella oneidensis; identical to SEQ ID NO: 45334
  CDS (1)..(936): transl_table=11

SEQ ID NO: 46071 - protein, 311 aa, Shewanella oneidensis; identical to SEQ ID NO: 45335

SEQ ID NO: 46072 - DNA, 978 bp, Thermoplasma acidophilum; identical to SEQ ID NO: 45338
  CDS (1)..(978): transl_table=11

SEQ ID NO: 46073 - protein, 325 aa, Thermoplasma acidophilum; identical to SEQ ID NO: 45339

SEQ ID NO: 46074 - DNA, 978 bp, Thermoplasma volcanium; identical to SEQ ID NO: 45340
  CDS (1)..(978)

SEQ ID NO: 46075 - protein, 325 aa, Thermoplasma volcanium; identical to SEQ ID NO: 45341

SEQ ID NO: 46076 - DNA, 951 bp, Wolbachia pipientis wMel; identical to SEQ ID NO: 45344
  CDS (1)..(951): transl_table=11

SEQ ID NO: 46077 - protein, 316 aa, Wolbachia pipientis wMel; identical to SEQ ID NO: 45345

SEQ ID NO: 46078 - DNA, 939 bp, Yersinia pestis
  CDS (1)..(939): transl_table=11
atgaaagttgcagttctcggtgccgctggtgggattggccaggccctcgctcttctactcaagacccagcttccttcaggttcagacctctctttatatgatatcgcgccagtaacgcctggtgttgctgttgatctgagccatatccctacagccgttaacattaaaggcttcagcggcgaagatgctacaccagcccttcaaggggcagatattgtgctgatttctgctggtgtcgcacgtaaacctggtatggatcgttcggatctgttcaacgtcaatgcgggcattgttcgtaatctggttgagcaaattgcacgtacttgcccgaacgcattgattggtatcatcactaacccagtcaacacaaccgtcgctattgcggctgaagtgctaaaaaaagcaggcgtttatgacaagaataagctgtttggtattaccactctggataccattcgctccaatacctttgttgccgaattaaaaggtaagcaaccccaggatatcgaagtgccggttattggtggccactctggtgtgactatcttgccattgctatcacagatccctggcgttagctttacagaacaagaagttgcagatttgaccaaacgtatccagaacgcgggtaccgaggttgtagaagctaaagccggtggcgggtccgcgacgctgtctatggggcaagctgcggcacgttttggtctttctttggtacgtgccctgcaaggtgaaagcaatgttgttgaatgctcttatgttgaaggcgatggcaaatatgcccgcttctttgctcagcctattctactgggtaaaaacggtgtcgctgaacgtaaagatatcggtaaactgagtgcttttgagcaacaagcgctggaaaatatgcttgatgttttacacaaagatatcgagttaggtgagaagttcgttaatcaataa

SEQ ID NO: 46079 - protein, 312 aa, Yersinia pestis
MKVAVLGAAGGIGQALALLLKTQLPSGSDLSLYDIAPVTPGVAVDLSHIPTAVNIKGFSGEDATPALQGADIVLISAGVARKPGMDRSDLFNVNAGIVRNLVEQIARTCPNALIGIITNPVNTTVAIAAEVLKKAGVYDKNKLFGITTLDTIRSNTFVAELKGKQPQDIEVPVIGGHSGVTILPLLSQIPGVSFTEQEVADLTKRIQNAGTEVVEAKAGGGSATLSMGQAAARFGLSLVRALQGESNVVECSYVEGDGKYARFFAQPILLGKNGVAERKDIGKLSAFEQQALENMLDVLHKDIELGEKFVNQ

SEQ ID NO: 46080 - DNA, 26 bp, Artificial sequence
  (1)..(26): primer
atgattctccttctgattctttttcc

SEQ ID NO: 46081 - DNA, 25 bp, Artificial sequence
  (1)..(25): primer
ttaagatgatgcagatctcgatgca

SEQ ID NO: 46082 - protein, 536 aa, Artificial sequence
  Variant (3)..(3): xaa in position 3 is any amino acid
  Variant (14)..(14): xaa in position 14 is any amino acid
  Variant (21)..(26): xaa in position 21 to 26 is any amino acid
  Variant (27)..(38): xaa in position 27 to 38 is any or no amino acid
  Variant (40)..(40): xaa in position 40 is any amino acid
  Variant (45)..(48): xaa in position 45 to 48 is any amino acid
  Variant (49)..(54): xaa in position 49 to 54 is any or no amino acid
  Variant (58)..(58): xaa in position 58 is any amino acid
  Variant (63)..(64): xaa in position 63 to 64 is any amino acid
  Variant (66)..(80): xaa in position 66 to 80 is any amino acid
  Variant (81)..(89): xaa in position 81 to 89 is any or no amino acid
  Variant (91)..(93): xaa in position 91 to 93 is any amino acid
  Variant (99)..(99): xaa in position 99 is any amino acid
  Variant (103)..(103): xaa in position 103 is any amino acid
  Variant (115)..(242): xaa in position 115 to 242 is any or no amino acid
  Variant (245)..(245): xaa in position 245 is any amino acid
  Variant (248)..(249): xaa in position 248 to 249 is any amino acid
  Variant (251)..(254): xaa in position 251 to 254 is any amino acid
  Variant (256)..(258): xaa in position 256 to 258 is any amino acid
  Variant (260)..(260): xaa in position 260 is any amino acid
  Variant (261)..(262): xaa in position 261 to 262 is any or no amino acid
  Variant (264)..(264): xaa in position 264 is any or no amino acid
  Variant (266)..(266): xaa in position 266 is any amino acid
  Variant (275)..(275): xaa in position 275 is any amino acid
  Variant (277)..(277): xaa in position 277 is any amino acid
  Variant (279)..(284): xaa in position 279 to 284 is any amino acid
  Variant (285)..(295): xaa in position 285 to 295 is any or no amino acid
  Variant (297)..(299): xaa in position 297 to 299 is any amino acid
  Variant (302)..(302): xaa in position 302 is any amino acid
  Variant (306)..(306): xaa in position 306 is any amino acid
  Variant (307)..(307): xaa in position 307 is any or no amino acid
  Variant (310)..(311): xaa in position 310 to 311 is any amino acid
  Variant (314)..(315): xaa in position 314 to 315 is any amino acid
  Variant (319)..(328): xaa in position 319 to 328 is any amino acid
  Variant (329)..(346): xaa in position 329 to 346 is any or no amino acid
  Variant (348)..(348): xaa in position 348 is any amino acid
  Variant (356)..(356): xaa in position 356 is any amino acid
  Variant (362)..(362): xaa in position 362 is any amino acid
  Variant (364)..(375): xaa in position 364 to 375 is any amino acid
  Variant (376)..(387): xaa in position 376 to 387 is any or no amino acid
  Variant (389)..(390): xaa in position 389 to 390 is any amino acid
  Variant (392)..(392): xaa in position 392 is any amino acid
  Variant (394)..(394): xaa in position 394 is any amino acid
  Variant (397)..(397): xaa in position 397 is any amino acid
  Variant (401)..(401): xaa in position 401 is any amino acid
  Variant (404)..(404): xaa in position 404 is any amino acid
  Variant (406)..(406): xaa in position 406 is any amino acid
  Variant (408)..(409): xaa in position 408 to 409 is any or no amino acid
  Variant (417)..(417): xaa in position 417 is any amino acid
  Variant (420)..(423): xaa in position 420 to 423 is any amino acid
  Variant (424)..(428): xaa in position 424 to 428 is any or no amino acid
  Variant (430)..(430): xaa in position 430 is any amino acid
  Variant (432)..(435): xaa in position 432 to 435 is any amino acid
  Variant (437)..(442): xaa in position 437 to 442 is any amino acid
  Variant (443)..(454): xaa in position 443 to 454 is any or no amino acid
  Variant (457)..(464): xaa in position 457 to 464 is any amino acid
  Variant (465)..(485): xaa in position 465 to 485 is any or no amino acid
  Variant (489)..(490): xaa in position 489 to 490 is any amino acid
  Variant (492)..(492): xaa in position 492 is any amino acid
  Variant (495)..(496): xaa in position 495 to 496 is any amino acid
  Variant (498)..(499): xaa in position 498 to 499 is any amino acid
  Variant (500)..(506): xaa in position 500 to 506 is any or no amino acid
  Variant (508)..(509): xaa in position 508 to 509 is any amino acid
  Variant (511)..(513): xaa in position 511 to 513 is any amino acid
  Variant (515)..(523): xaa in position 515 to 523 is any amino acid
  Variant (524)..(525): xaa in position 524 to 525 is any or no amino acid
  Variant (527)..(529): xaa in position 527 to 529 is any amino acid
  Variant (531)..(532): xaa in position 531 to 532 is any amino acid
  Variant (534)..(535): xaa in position 534 to 535 is any amino acid
KVXVLGAAGGIGQXLSLLLKXXXXXXXXXXXXXXXXXXLXLYDIXXXXXXXXXXGVAXDLSHXXTXXXXXXXXXXXXXXXXXXXXXXXXLXXXDVVVIXAGVXRKPGMTRDDLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNAXIVXXLXXXXAXXXPXXXAXVXIISNPVNSXVXIXXXXXXXXXXXXXXXXXYXXXKLXGVTXXLDXXRAXXFVAXXXXXXXXXXXXXXXXXXXXXXXXXXXXVXVIGGHSGXTILPLXSXXXXXXXXXXXXXXXXXXXXXXXXLXXRXQXGGXEVVXAKXGXGXXSATLSMAXAGXXXXXXXXXSXLXXXXGXXXXXXXXXXXXXXXXXXYVXXXXXXXXXXXXXXXXXXXXXXXXXXXXXFFAXXVXLGXXGXXXXXXXXXLXXLXXXEXXXXXXXXXXXLXXXIXXGXXF

SEQ ID NO: 46083 - protein, 13 aa, Artificial sequence
  Variant (2)..(2): xaa in position 2 is Ala or Ser
  Variant (3)..(3): xaa in position 3 is Ala, Gly, Asn, Ser or Val
  Variant (6)..(6): xaa in position 6 is any or no amino acid
  Variant (9)..(9): xaa in position 9 is Ala, Pro, Ser or Thr
  Variant (11)..(11): xaa in position 11 is Ala, Gly or Ser
  Variant (12)..(12): xaa in position 12 is Leu or Met
GXXGGXGQXLXXL

SEQ ID NO: 46084 - protein, 20 aa, Artificial sequence
  Variant (2)..(2): xaa in position 2 is any amino acid
  Variant (4)..(4): xaa in position 4 is Phe or Tyr
  Variant (6)..(10): xaa in position 6 to 10 is any amino acid
  Variant (11)..(12): xaa in position 11 to 12 is any or no amino acid
  Variant (14)..(14): xaa in position 14 is any amino acid
  Variant (15)..(15): xaa in position 15 is Ala, Gly or Thr
  Variant (16)..(16): xaa in position 16 is any amino acid
  Variant (18)..(18): xaa in position 18 is Ile, Leu or Val
  Variant (19)..(19): xaa in position 19 is Gly or Ser
LXLXDXXXXXXXGXXXDXXH

SEQ ID NO: 46085 - protein, 20 aa, Artificial sequence
  Variant (2)..(2): xaa in position 2 is any or no amino acid
  Variant (4)..(4): xaa in position 4 is any amino acid
  Variant (5)..(5): xaa in position 5 is any or no amino acid
  Variant (8)..(8): xaa in position 8 is Ile, Leu or Val
  Variant (9)..(9): xaa in position 9 is Ala or Pro
  Variant (15)..(15): xaa in position 15 is any amino acid
  Variant (17)..(17): xaa in position 17 is Ala, Asp, Glu or Ser
  Variant (20)..(20): xaa in position 20 is Phe, Ile, Leu or Val
VXIXXAGXXRKPGMXRXDLX

SEQ ID NO: 46086 - protein, 30 aa, Artificial sequence
  Variant (2)..(2): xaa in position 2 is Ala, Ile or Leu
  Variant (3)..(3): xaa in position 3 is any amino acid
  Variant (4)..(4): xaa in position 4 is Ile or Val
  Variant (5)..(5): xaa in position 5 is Ile, Leu or Val
  Variant (6)..(7): xaa in position 6 to 7 is any amino acid
  Variant (8)..(8): xaa in position 8 is Phe, Ile, Leu or Val
  Variant (9)..(15): xaa in position 9 to 15 is any amino acid
  Variant (16)..(16): xaa in position 16 is Ala, Cys or Ser
  Variant (17)..(18): xaa in position 17 to 18 is any amino acid
  Variant (19)..(19): xaa in position 19 is Ala or Ser
  Variant (20)..(22): xaa in position 20 to 22 is any amino acid
  Variant (23)..(23): xaa in position 23 is Ile, Leu, Met or Val
  Variant (24)..(24): xaa in position 24 is Ile, Leu or Val
  Variant (25)..(25): xaa in position 25 is Ala, Ser or Thr
  Variant (29)..(29): xaa in position 29 is Asp or Asn
  Variant (30)..(30): xaa in position 30 is Ala, Ser, Thr or Val
NXXXXXXXXXXXXXXXXXXXXXXXXNPVXX

SEQ ID NO: 46087 - protein, 13 aa, Artificial sequence
  Variant (2)..(2): xaa in position 2 is Ile or Val
  Variant (3)..(3): xaa in position 3 is Ser or Thr
  Variant (4)..(4): xaa in position 4 is any amino acid
  Variant (7)..(7): xaa in position 7 is any amino acid
  Variant (8)..(8): xaa in position 8 is Ala, Ile, Leu or Val
  Variant (10)..(10): xaa in position 10 is Ala or Ser
  Variant (11)..(12): xaa in position 11 to 12 is any amino acid
GXXXLDXXRXXXF

SEQ ID NO: 46088 - protein, 12 aa, Artificial sequence
  Variant (2)..(2): xaa in position 2 is Ile, Leu or Val
  Variant (6)..(6): xaa in position 6 is any or no amino acid
  Variant (8)..(8): xaa in position 8 is any amino acid
  Variant (10)..(10): xaa in position 10 is Ile or Met
  Variant (11)..(11): xaa in position 11 is Ile, Leu or Val
VXGGHXGXTXXP

SEQ ID NO: 46089 - protein, 27 aa, Artificial sequence
  Variant (2)..(4): xaa in position 2 to 4 is any amino acid
  Variant (5)..(6): xaa in position 5 to 6 is Ala or Gly
  Variant (7)..(7): xaa in position 7 is any amino acid
  Variant (9)..(9): xaa in position 9 is any or no amino acid
  Variant (11)..(11): xaa in position 11 is any amino acid
  Variant (12)..(12): xaa in position 12 is any or no amino acid
  Variant (15)..(15): xaa in position 15 is any amino acid
  Variant (17)..(17): xaa in position 17 is any amino acid
  Variant (21)..(21): xaa in position 21 is Ala or Thr
  Variant (23)..(23): xaa in position 23 is Ala or Ser
  Variant (25)..(25): xaa in position 25 is Ala or Gly
  Variant (26)..(26): xaa in position 26 is any amino acid
  Variant (27)..(27): xaa in position 27 is Ala or Ser
RXXXXXXEXVXXAKXGXGSAXLXMXXX

SEQ ID NO: 46090 - DNA, 1992 bp, Saccharomyces cerevisiae
  CDS (1)..(1992)
atgaagttactttttaaaagatattcgtctagtcatattggtaagctgattaaggactctttaatcactcctgaaatactaccacagctagggcgacagccatcatcgcataaacgtttaccaaataacaaaagaactaactcaataactgataaatggttgaaggatgcgctaacaagaaaagataaactgaatgaagataagctccaaaatgtaaatttacgattaaatgtggtactgactactctacagaagcttcgtacatccgataatcctgctttgtattttgcgttgttgaatcgtattggcacaggtcacataaaatggctaaataaaagtggccgacagattgatgcattcccacctgatcggctgcctttggaattttatcatgagctatctaatatgctctataaactatcgcttcggtccgcaaatgacaaaattgcactagctaaattttcattgcaattattggatcgctattattttcttaaaaccaaatctttaactatagaaggaaaatttcgggcaaacataaaatttttgaggaattgtactcttttaattgttaaatcccaatcgaactactacttaagggcaatacagcggttgttcgcggaaaattcggagggtcaattattagccaatttatcccagctggcattttatgtggagacctcccaatggacaagtatgttggatattttatcctcatgtgtaccggattctggtttaagaggttcgaaggagcgtgaaagagctattcaattgttggagttatttagtccatgcctagtcaaaagtctaaaagtaatgatagcacaaaatatggagaatgaagcttgtcagattttaaggagcttgtctgaatggaactttcattttgatcagcatgattcctccaacttgatacaattatcccagaaccattcttgcctcaaagttattgaaaccatgaatggattatcatcaactaccgctgtcactaggcaattcggacttgaaaaattaccaactgacgtgagtttgaagcagagcatacatattttatcaaaagataatttcgaacctctcaagcaagattcatttcttcaatttctatcgtttaaattaagtgatttgcctctgaacttagaagtatggaaaaagcacattaaggaggttgatgaccaaatgcaggctgagtccaacctgcattccttaagagctttttttattgatatgctactgtgtcacttatctgtgcgcaaggatttcgattttatgctttcattggtcgagcacatagtatacgaaaaaaatttatggcagccattattactcacagataatatagttggaaacaaagaaaattccacttttcattgcctctttcatggcgcctctcaagatatttctaccaaacttactctactggcattgtataaccagttgaatgaaatcggctatcaatttacctcccacgattttctctcgatgttgaaagtctgcaaaaactactctgattctgattttttctattttgctttctataatttgttggttacacaaagtcacaaattttttcttttcgataagtttagtgataagttttcgtggaggttgccaatacaaatcggagatgcaatttctgaatggctatccagcttagaaattgatatacaagaaaacaccgatagagttttgcagataacagatgacgtcggcgaatggtatgttgagaataaaccatttaagtcagaaaaagggaccattcaaccaataaacataatggaattgcgcaaaatttttggggagcgaaaaactctatttcatatggattcagaaattttccaaaaatctaaagcaaaaagagataaagaaatgcggaatgaagctttatttaccgcaaatgatgcggaatataattttgctgcggatgtatcctatgcaaagagagtagaaaatctattttcttacataagatctaagcaaatgcaacaaaaataa

SEQ ID NO: 46091 - protein, 663 aa, Saccharomyces cerevisiae
MKLLFKRYSSSHIGKLIKDSLITPEILPQLGRQPSSHKRLPNNKRTNSITDKWLKDALTRKDKLNEDKLQNVNLRLNVVLTTLQKLRTSDNPALYFALLNRIGTGHIKWLNKSGRQIDAFPPDRLPLEFYHELSNMLYKLSLRSANDKIALAKFSLQLLDRYYFLKTKSLTIEGKFRANIKFLRNCTLLIVKSQSNYYLRAIQRLFAENSEGQLLANLSQLAFYVETSQWTSMLDILSSCVPDSGLRGSKERERAIQLLELFSPCLVKSLKVMIAQNMENEACQILRSLSEWNFHFDQHDSSNLIQLSQNHSCLKVIETMNGLSSTTAVTRQFGLEKLPTDVSLKQSIHILSKDNFEPLKQDSFLQFLSFKLSDLPLNLEVWKKHIKEVDDQMQAESNLHSLRAFFIDMLLCHLSVRKDFDFMLSLVEHIVYEKNLWQPLLLTDNIVGNKENSTFHCLFHGASQDISTKLTLLALYNQLNEIGYQFTSHDFLSMLKVCKNYSDSDFFYFAFYNLLVTQSHKFFLFDKFSDKFSWRLPIQIGDAISEWLSSLEIDIQENTDRVLQITDDVGEWYVENKPFKSEKGTIQPINIMELRKIFGERKTLFHMDSEIFQKSKAKRDKEMRNEALFTANDAEYNFAADVSYAKRVENLFSYIRSKQMQQK

SEQ ID NO: 46092 - DNA, 28 bp, Artificial sequence
  (1)..(28): primer
atgaagttactttttaaaagatattcgt

SEQ ID NO: 46093 - DNA, 27 bp, Artificial sequence
  (1)..(27): primer
ttatttttgttgcatttgcttagatct

SEQ ID NO: 46094 - DNA, 1047 bp, Escherichia coli K12; identical to SEQ ID NO: 1323
  CDS (1)..(1047)

SEQ ID NO: 46095 - protein, 348 aa, Escherichia coli K12; identical to SEQ ID NO: 1324

SEQ ID NO: 46096 - DNA, 1235 bp, Salmonella typhimurium; identical to SEQ ID NO: 1325
  CDS (165)..(1235)

SEQ ID NO: 46097 - protein, 356 aa, Salmonella typhimurium; identical to SEQ ID NO: 1326

SEQ ID NO: 46098 - DNA, 1086 bp, Deinococcus radiodurans; identical to SEQ ID NO: 1327
  CDS (1)..(1086)

SEQ ID NO: 46099 - protein, 361 aa, Deinococcus radiodurans; identical to SEQ ID NO: 1328

SEQ ID NO: 46100 - DNA, 1056 bp, Neisseria meningitidis; identical to SEQ ID NO: 1329
  CDS (1)..(1056)

SEQ ID NO: 46101 - protein, 351 aa, Neisseria meningitidis; identical to SEQ ID NO: 1330

SEQ ID NO: 46102 - DNA, 1047 bp, Yersinia pestis; identical to SEQ ID NO: 1331
  CDS (1)..(1047)

SEQ ID NO: 46103 - protein, 348 aa, Yersinia pestis; identical to SEQ ID NO: 1332

SEQ ID NO: 46104 - DNA, 1071 bp, Escherichia coli; identical to SEQ ID NO: 1333
  CDS (1)..(1071)

SEQ ID NO: 46105 - protein, 356 aa, Escherichia coli; identical to SEQ ID NO: 1334

SEQ ID NO: 46106 - DNA, 1131 bp, Nostoc sp. PCC 7120; identical to SEQ ID NO: 1335
  CDS (1)..(1131)

SEQ ID NO: 46107 - protein, 376 aa, Nostoc sp. PCC 7120; identical to SEQ ID NO: 1336

SEQ ID NO: 46108 - DNA, 1053 bp, Salmonella enterica subsp. enterica serovar Typhi; identical to SEQ ID NO: 1337
  CDS (1)..(1053)

SEQ ID NO: 46109 - protein, 350 aa, Salmonella enterica subsp. enterica serovar Typhi; identical to SEQ ID NO: 1338

SEQ ID NO: 46110 - DNA, 1077 bp, Pseudomonas aeruginosa; identical to SEQ ID NO: 1339
  CDS (1)..(1077)

SEQ ID NO: 46111 - protein, 358 aa, Pseudomonas aeruginosa; identical to SEQ ID NO: 1340

SEQ ID NO: 46112 - DNA, 1047 bp, Buchnera sp; identical to SEQ ID NO: 1341
  CDS (1)..(1047)

SEQ ID NO: 46113 - protein, 348 aa, Buchnera sp; identical to SEQ ID NO: 1342

SEQ ID NO: 46114 - DNA, 1074 bp, Vibrio cholerae; identical to SEQ ID NO: 1343
  CDS (1)..(1074)

SEQ ID NO: 46115 - protein, 357 aa, Vibrio cholerae; identical to SEQ ID NO: 1344

SEQ ID NO: 46116 - DNA, 1038 bp, Lactococcus lactis subsp. lactis; identical to SEQ ID NO: 1345
  CDS (1)..(1038)

SEQ ID NO: 46117 - protein, 345 aa, Lactococcus lactis subsp. lactis; identical to SEQ ID NO: 1346

SEQ ID NO: 46118 - DNA, 1023 bp, Lactococcus lactis subsp. lactis; identical to SEQ ID NO: 1347
  CDS (1)..(1023)

SEQ ID NO: 46119 - protein, 340 aa, Lactococcus lactis subsp. lactis; identical to SEQ ID NO: 1348

SEQ ID NO: 46120 - DNA, 1032 bp, Streptococcus pneumoniae; identical to SEQ ID NO: 1349
  CDS (1)..(1032)

SEQ ID NO: 46121 - protein, 343 aa, Streptococcus pneumoniae; identical to SEQ ID NO: 1350

SEQ ID NO: 46122 - DNA, 1095 bp, Pseudomonas aeruginosa; identical to SEQ ID NO: 1351
  CDS (1)..(1095)

SEQ ID NO: 46123 - protein, 364 aa, Pseudomonas aeruginosa; identical to SEQ ID NO: 1352

SEQ ID NO: 46124 - DNA, 1110 bp, Caulobacter crescentus; identical to SEQ ID NO: 1353
  CDS (1)..(1110)

SEQ ID NO: 46125 - protein, 369 aa, Caulobacter crescentus; identical to SEQ ID NO: 1354

SEQ ID NO: 46126 - DNA, 1032 bp, Streptococcus pneumoniae; identical to SEQ ID NO: 1355
  CDS (1)..(1032)

SEQ ID NO: 46127 - protein, 343 aa, Streptococcus pneumoniae; identical to SEQ ID NO: 1356

SEQ ID NO: 46128 - DNA, 1047 bp, Buchnera aphidicola; identical to SEQ ID NO: 1357
  CDS (1)..(1047)

SEQ ID NO: 46129 - protein, 348 aa, Buchnera aphidicola; identical to SEQ ID NO: 1358

SEQ ID NO: 46130 - DNA, 1089 bp, Haemophilus influenzae; identical to SEQ ID NO: 1359
  CDS (1)..(1089)

SEQ ID NO: 46131 - protein, 362 aa, Haemophilus influenzae; identical to SEQ ID NO: 1360

SEQ ID NO: 46132 - DNA, 1502 bp, Candida albicans; identical to SEQ ID NO: 1361
  CDS (336)..(1442)

SEQ ID NO: 46133 - protein, 368 aa, Candida albicans; identical to SEQ ID NO: 1362

SEQ ID NO: 46134 - DNA, 1113 bp, Saccharomyces cerevisiae; identical to SEQ ID NO: 1363
  CDS (1)..(1113)

SEQ ID NO: 46135 - protein, 370 aa, Saccharomyces cerevisiae; identical to SEQ ID NO: 1364

SEQ ID NO: 46136 - DNA, 2048 bp, Saccharomyces cerevisiae; identical to SEQ ID NO: 1365
  CDS (619)..(1731)

SEQ ID NO: 46137 - protein, 370 aa, Saccharomyces cerevisiae; identical to SEQ ID NO: 1366

SEQ ID NO: 46138 - DNA, 1107 bp, Schizosaccharomyces pombe; identical to SEQ ID NO: 1367
  CDS (1)..(1107)

SEQ ID NO: 46139 - protein, 368 aa, Schizosaccharomyces pombe; identical to SEQ ID NO: 1368

SEQ ID NO: 46140 - DNA, 1089 bp, Amycolatopsis orientalis; identical to SEQ ID NO: 1369
  CDS (1)..(1089)

SEQ ID NO: 46141 - protein, 362 aa, Amycolatopsis orientalis; identical to SEQ ID NO: 1370

SEQ ID NO: 46142 - DNA, 1119 bp, Schizosaccharomyces pombe; identical to SEQ ID NO: 1371
  CDS (1)..(1119)

SEQ ID NO: 46143 - protein, 372 aa, Schizosaccharomyces pombe; identical to SEQ ID NO: 1372

SEQ ID NO: 46144 - DNA, 1248 bp, Corynebacterium glutamicum; identical to SEQ ID NO: 1373
  CDS (101)..(1228)

SEQ ID NO: 46145 - protein, 375 aa, Corynebacterium glutamicum; identical to SEQ ID NO: 1374

SEQ ID NO: 46146 - DNA, 1083 bp, Methylophilus methylotrophus; identical to SEQ ID NO: 1375
  CDS (1)..(1083)

SEQ ID NO: 46147 - protein, 360 aa, Methylophilus methylotrophus; identical to SEQ ID NO: 1376

SEQ ID NO: 46148 - DNA, 1107 bp, Debaryomyces hansenii; identical to SEQ ID NO: 1377
  CDS (1)..(1107)

SEQ ID NO: 46149 - protein, 368 aa, Debaryomyces hansenii; identical to SEQ ID NO: 1378

SEQ ID NO: 46150 - DNA, 1074 bp, Yarrowia lipolytica; identical to SEQ ID NO: 1379
  CDS (1)..(1074)

SEQ ID NO: 46151 - protein, 357 aa, Yarrowia lipolytica; identical to SEQ ID NO: 1380

SEQ ID NO: 46152 - DNA, 1089 bp, Yarrowia lipolytica; identical to SEQ ID NO: 1381
  CDS (1)..(1089)

SEQ ID NO: 46153 - protein, 362 aa, Yarrowia lipolytica; identical to SEQ ID NO: 1382

SEQ ID NO: 46154 - DNA, 1119 bp, Kluyveromyces lactis; identical to SEQ ID NO: 1383
  CDS (1)..(1119)

SEQ ID NO: 46155 - protein, 372 aa, Kluyveromyces lactis; identical to SEQ ID NO: 1384

SEQ ID NO: 46156 - DNA, 1095 bp, Kluyveromyces lactis; identical to SEQ ID NO: 1385
  CDS (1)..(1095)

SEQ ID NO: 46157 - protein, 364 aa, Kluyveromyces lactis; identical to SEQ ID NO: 1386

SEQ ID NO: 46158 - DNA, 1074 bp, Erwinia carotovora subsp; identical to SEQ ID NO: 1387
  CDS (1)..(1074)

SEQ ID NO: 46159 - protein, 357 aa, Erwinia carotovora subsp; identical to SEQ ID NO: 1388

SEQ ID NO: 46160 - DNA, 1047 bp, Erwinia carotovora subsp; identical to SEQ ID NO: 1389
  CDS (1)..(1047)

SEQ ID NO: 46161 - protein, 348 aa, Erwinia carotovora subsp; identical to SEQ ID NO: 1390

SEQ ID NO: 46162 - DNA, 1056 bp, Erwinia carotovora subsp; identical to SEQ ID NO: 1391
  CDS (1)..(1056)

SEQ ID NO: 46163 - protein, 351 aa, Erwinia carotovora subsp; identical to SEQ ID NO: 1392

SEQ ID NO: 46164 - DNA, 1113 bp, Acinetobacter sp; identical to SEQ ID NO: 1393
  CDS (1)..(1113)

SEQ ID NO: 46165 - protein, 370 aa, Acinetobacter sp; identical to SEQ ID NO: 1394

SEQ ID NO: 46166 - DNA, 1056 bp, Acinetobacter sp; identical to SEQ ID NO: 1395
  CDS (1)..(1056)

SEQ ID NO: 46167 - protein, 351 aa, Acinetobacter sp; identical to SEQ ID NO: 1396

SEQ ID NO: 46168 - DNA, 1119 bp, Candida glabrata; identical to SEQ ID NO: 1397
  CDS (1)..(1119)

SEQ ID NO: 46169 - protein, 372 aa, Candida glabrata; identical to SEQ ID NO: 1398

SEQ ID NO: 46170 - DNA, 1071 bp, Candida glabrata; identical to SEQ ID NO: 1399
  CDS (1)..(1071)

SEQ ID NO: 46171 - protein, 356 aa, Candida glabrata; identical to SEQ ID NO: 1400

SEQ ID NO: 46172 - DNA, 1083 bp, Photobacterium profundum; identical to SEQ ID NO: 1401
  CDS (1)..(1083)

SEQ ID NO: 46173 - protein, 360 aa, Photobacterium profundum; identical to SEQ ID NO: 1402

SEQ ID NO: 46174 - DNA, 1053 bp, Photobacterium profundum; identical to SEQ ID NO: 1403
  CDS (1)..(1053)

SEQ ID NO: 46175 - protein, 350 aa, Photobacterium profundum; identical to SEQ ID NO: 1404

SEQ ID NO: 46176 - DNA, 1113 bp, Photobacterium profundum; identical to SEQ ID NO: 1405
  CDS (1)..(1113)

SEQ ID NO: 46177 - protein, 370 aa, Photobacterium profundum; identical to SEQ ID NO: 1406

SEQ ID NO: 46178 - DNA, 1056 bp, Photobacterium profundum; identical to SEQ ID NO: 1407
  CDS (1)..(1056)

SEQ ID NO: 46179 - protein, 351 aa, Photobacterium profundum; identical to SEQ ID NO: 1408

SEQ ID NO: 46180 - DNA, 1092 bp, Parachlamydia sp; identical to SEQ ID NO: 1409
  CDS (1)..(1092)

SEQ ID NO: 46181 - protein, 363 aa, Parachlamydia sp; identical to SEQ ID NO: 1410

SEQ ID NO: 46182 - DNA, 1095 bp, Rhodopseudomonas palustris; identical to SEQ ID NO: 1411
  CDS (1)..(1095)

SEQ ID NO: 46183 - protein, 364 aa, Rhodopseudomonas palustris; identical to SEQ ID NO: 1412

SEQ ID NO: 46184 - DNA, 1100 bp, Amycolatopsis methanolica; identical to SEQ ID NO: 1413
  CDS (1)..(1086)

SEQ ID NO: 46185 - protein, 361 aa, Amycolatopsis methanolica; identical to SEQ ID NO: 1414

SEQ ID NO: 46186 - DNA, 1071 bp, Treponema denticola; identical to SEQ ID NO: 1415
  CDS (1)..(1071)

SEQ ID NO: 46187 - protein, 356 aa, Treponema denticola; identical to SEQ ID NO: 1416

SEQ ID NO: 46188 - DNA, 1068 bp, Geobacter sulfurreducens; identical to SEQ ID NO: 1417
  CDS (1)..(1068)

SEQ ID NO: 46189 - protein, 355 aa, Geobacter sulfurreducens; identical to SEQ ID NO: 1418

SEQ ID NO: 46190 - DNA, 1095 bp, Ashbya gossypii; identical to SEQ ID NO: 1419
  CDS (1)..(1095)

SEQ ID NO: 46191 - protein, 364 aa, Ashbya gossypii; identical to SEQ ID NO: 1420

SEQ ID NO: 46192 - DNA, 1122 bp, Ashbya gossypii; identical to SEQ ID NO: 1421
  CDS (1)..(1122)

SEQ ID NO: 46193 - protein, 373 aa, Ashbya gossypii; identical to SEQ ID NO: 1422

SEQ ID NO: 46194 - DNA, 1098 bp, Amycolatopsis balhimycina; identical to SEQ ID NO: 1423
  CDS (1)..(1098)

SEQ ID NO: 46195 - protein, 365 aa, Amycolatopsis balhimycina; identical to SEQ ID NO: 1424

SEQ ID NO: 46196 - DNA, 1071 bp, Vibrio vulnificus; identical to SEQ ID NO: 1425
  CDS (1)..(1071)

SEQ ID NO: 46197 - protein, 356 aa, Vibrio vulnificus; identical to SEQ ID NO: 1426

SEQ ID NO: 46198 - DNA, 1047 bp, Photorhabdus luminescens; identical to SEQ ID NO: 1427
  CDS (1)..(1047)

SEQ ID NO: 46199 - protein, 348 aa, Photorhabdus luminescens; identical to SEQ ID NO: 1428

SEQ ID NO: 46200 - DNA, 1053 bp, Photorhabdus luminescens; identical to SEQ ID NO: 1429
  CDS (1)..(1053)

SEQ ID NO: 46201 - protein, 350 aa, Photorhabdus luminescens; identical to SEQ ID NO: 1430

SEQ ID NO: 46202 - DNA, 1095 bp, Photorhabdus luminescens; identical to SEQ ID NO: 1431
  CDS (1)..(1095)

SEQ ID NO: 46203 - protein, 364 aa, Photorhabdus luminescens; identical to SEQ ID NO: 1432

SEQ ID NO: 46204 - DNA, 1119 bp, Gloeobacter violaceus; identical to SEQ ID NO: 1433
  CDS (1)..(1119)

SEQ ID NO: 46205 - protein, 372 aa, Gloeobacter violaceus; identical to SEQ ID NO: 1434

SEQ ID NO: 46206 - DNA, 1107 bp, Chromobacterium violaceum; identical to SEQ ID NO: 1435
  CDS (1)..(1107)

SEQ ID NO: 46207 - protein, 368 aa, Chromobacterium violaceum; identical to SEQ ID NO: 1436

SEQ ID NO: 46208 - DNA, 1059 bp, Chromobacterium violaceum; identical to SEQ ID NO: 1437
  CDS (1)..(1059)

SEQ ID NO: 46209 - protein, 352 aa, Chromobacterium violaceum; identical to SEQ ID NO: 1438

SEQ ID NO: 46210 - DNA, 1140 bp, Neurospora crassa; identical to SEQ ID NO: 1439
  CDS (1)..(1140)

SEQ ID NO: 46211 - protein, 379 aa, Neurospora crassa; identical to SEQ ID NO: 1440

SEQ ID NO: 46212 - DNA, 1092 bp, Neurospora crassa; identical to SEQ ID NO: 1441
  CDS (1)..(1092)

SEQ ID NO: 46213 - protein, 363 aa, Neurospora crassa; identical to SEQ ID NO: 1442

SEQ ID NO: 46214 - DNA, 1068 bp, Synechococcus sp; identical to SEQ ID NO: 1443
  CDS (1)..(1068)

SEQ ID NO: 46215 - protein, 355 aa, Synechococcus sp; identical to SEQ ID NO: 1444

SEQ ID NO: 46216 - DNA, 1053 bp, Rhodopirellula baltica; identical to SEQ ID NO: 1445
  CDS (1)..(1053)

SEQ ID NO: 46217 - protein, 350 aa, Rhodopirellula baltica; identical to SEQ ID NO: 1446

SEQ ID NO: 46218 - DNA, 1068 bp, Prochlorococcus marinus subsp; identical to SEQ ID NO: 1447
  CDS (1)..(1068)

SEQ ID NO: 46219 - protein, 355 aa, Prochlorococcus marinus subsp; identical to SEQ ID NO: 1448

SEQ ID NO: 46220 - DNA, 1083 bp, Prochlorococcus marinus; identical to SEQ ID NO: 1449
  CDS (1)..(1083)

SEQ ID NO: 46221 - protein, 360 aa, Prochlorococcus marinus; identical to SEQ ID NO: 1450

SEQ ID NO: 46222 - DNA, 1074 bp, Prochlorococcus marinus; identical to SEQ ID NO: 1451
  CDS (1)..(1074)

SEQ ID NO: 46223 - protein, 357 aa, Prochlorococcus marinus; identical to SEQ ID NO: 1452

SEQ ID NO: 46224 - DNA, 1113 bp, Haemophilus ducreyi; identical to SEQ ID NO: 1453
  CDS (1)..(1113)

SEQ ID NO: 46225 - protein, 370 aa, Haemophilus ducreyi; identical to SEQ ID NO: 1454

SEQ ID NO: 46226 - DNA, 1080 bp, Haemophilus ducreyi; identical to SEQ ID NO: 1455
  CDS (1)..(1080)

SEQ ID NO: 46227 - protein, 359 aa, Haemophilus ducreyi; identical to SEQ ID NO: 1456

SEQ ID NO: 46228 - DNA, 1086 bp, Candidatus Blochmannia floridanus; identical to SEQ ID NO: 1457
  CDS (1)..(1086)

SEQ ID NO: 46229 - protein, 361 aa, Candidatus Blochmannia floridanus; identical to SEQ ID NO: 1458

SEQ ID NO: 46230 - DNA, 1074 bp, Bordetella pertussis; identical to SEQ ID NO: 1459
  CDS (1)..(1074)

SEQ ID NO: 46231 - protein, 357 aa, Bordetella pertussis; identical to SEQ ID NO: 1460

SEQ ID NO: 46232 - DNA, 1119 bp, Bordetella bronchiseptica; identical to SEQ ID NO: 1461
  CDS (1)..(1119)

SEQ ID NO: 46233 - protein, 372 aa, Bordetella bronchiseptica; identical to SEQ ID NO: 1462

SEQ ID NO: 46234 - DNA, 1179 bp, Nitrosomonas europaea; identical to SEQ ID NO: 1463
  CDS (1)..(1179)

SEQ ID NO: 46235 - protein, 392 aa, Nitrosomonas europaea; identical to SEQ ID NO: 1464

SEQ ID NO: 46236 - DNA, 1083 bp, Coxiella burnetii; identical to SEQ ID NO: 1465
  CDS (1)..(1083)

SEQ ID NO: 46237 - protein, 360 aa, Coxiella burnetii; identical to SEQ ID NO: 1466

SEQ ID NO: 46238 - DNA, 834 bp, Vibrio anguillarum; identical to SEQ ID NO: 1467
  CDS (1)..(834)

SEQ ID NO: 46239 - protein, 277 aa, Vibrio anguillarum; identical to SEQ ID NO: 1468

SEQ ID NO: 46240 - DNA, 1143 bp, Xylella fastidiosa; identical to SEQ ID NO: 1469
  CDS (1)..(1143)

SEQ ID NO: 46241 - protein, 380 aa, Xylella fastidiosa; identical to SEQ ID NO: 1470

SEQ ID NO: 46242 - DNA, 1053 bp, Vibrio parahaemolyticus; identical to SEQ ID NO: 1471
  CDS (1)..(1053)

SEQ ID NO: 46243 - protein, 350 aa, Vibrio parahaemolyticus; identical to SEQ ID NO: 1472

SEQ ID NO: 46244 - DNA, 1053 bp, Vibrio parahaemolyticus; identical to SEQ ID NO: 1473
  CDS (1)..(1053)

SEQ ID NO: 46245 - protein, 350 aa, Vibrio parahaemolyticus; identical to SEQ ID NO: 1474

SEQ ID NO: 46246 - DNA, 1074 bp, Vibrio parahaemolyticus; identical to SEQ ID NO: 1475
  CDS (1)..(1074)

SEQ ID NO: 46247 - protein, 357 aa, Vibrio parahaemolyticus; identical to SEQ ID NO: 1476

SEQ ID NO: 46248 - DNA, 1083 bp, Pseudomonas syringae; identical to SEQ ID NO: 1477
  CDS (1)..(1083)

SEQ ID NO: 46249 - protein, 360 aa, Pseudomonas syringae; identical to SEQ ID NO: 1478

SEQ ID NO: 46250 - DNA, 1077 bp, Pseudomonas syringae; identical to SEQ ID NO: 1479
  CDS (1)..(1077)

SEQ ID NO: 46251 - protein, 358 aa, Pseudomonas syringae; identical to SEQ ID NO: 1480

SEQ ID NO: 46252 - DNA, 1062 bp, Pseudomonas putida; identical to SEQ ID NO: 1481
  CDS (1)..(1062)

SEQ ID NO: 46253 - protein, 353 aa, Pseudomonas putida; identical to SEQ ID NO: 1482

SEQ ID NO: 46254 - DNA, 1113 bp, Pseudomonas putida; identical to SEQ ID NO: 1483
  CDS (1)..(1113)

SEQ ID NO: 46255 - protein, 370 aa, Pseudomonas putida; identical to SEQ ID NO: 1484

SEQ ID NO: 46256 - DNA, 1086 bp, Bradyrhizobium japonicum; identical to SEQ ID NO: 1485
  CDS (1)..(1086)

SEQ ID NO: 46257 - protein, 361 aa, Bradyrhizobium japonicum; identical to SEQ ID NO: 1486

SEQ ID NO: 46258 - DNA, 1053 bp, Yersinia pestis; identical to SEQ ID NO: 1487
  CDS (1)..(1053)

SEQ ID NO: 46259 - protein, 350 aa, Yersinia pestis; identical to SEQ ID NO: 1488

SEQ ID NO: 46260 - DNA, 1077 bp, Yersinia pestis; identical to SEQ ID NO: 1489
  CDS (1)..(1077)

SEQ ID NO: 46261 - protein, 358 aa, Yersinia pestis; identical to SEQ ID NO: 1490

SEQ ID NO: 46262 - DNA, 1038 bp, Wigglesworthia glossinidia brevipalpis; identical to SEQ ID NO: 1491
  CDS (1)..(1038)

SEQ ID NO: 46263 - protein, 345 aa, Wigglesworthia glossinidia brevipalpis; identical to SEQ ID NO: 1492

SEQ ID NO: 46264 - DNA, 1053 bp, Vibrio vulnificus; identical to SEQ ID NO: 1493
  CDS (1)..(1053)

SEQ ID NO: 46265 - protein, 350 aa, Vibrio vulnificus; identical to SEQ ID NO: 1494

SEQ ID NO: 46266 - DNA, 1053 bp, Vibrio vulnificus; identical to SEQ ID NO: 1495
  CDS (1)..(1053)

SEQ ID NO: 46267 - protein, 350 aa, Vibrio vulnificus; identical to SEQ ID NO: 1496

SEQ ID NO: 46268 - DNA, 1071 bp, Vibrio vulnificus; identical to SEQ ID NO: 1497
  CDS (1)..(1071)

SEQ ID NO: 46269 - protein, 356 aa, Vibrio vulnificus; identical to SEQ ID NO: 1498

SEQ ID NO: 46270 - DNA, 1062 bp, Synechococcus elongatus; identical to SEQ ID NO: 1499
  CDS (1)..(1062)

SEQ ID NO: 46271 - protein, 353 aa, Synechococcus elongatus; identical to SEQ ID NO: 1500

SEQ ID NO: 46272 - DNA, 1032 bp, Streptococcus mutans; identical to SEQ ID NO: 1501
  CDS (1)..(1032)

SEQ ID NO: 46273 - protein, 343 aa, Streptococcus mutans; identical to SEQ ID NO: 1502

SEQ ID NO: 46274 - DNA, 1035 bp, Streptococcus mutans; identical to SEQ ID NO: 1503
  CDS (1)..(1035)

SEQ ID NO: 46275 - protein, 344 aa, Streptococcus mutans; identical to SEQ ID NO: 1504

SEQ ID NO: 46276 - DNA, 1008 bp, Streptococcus agalactiae; identical to SEQ ID NO: 1505
  CDS (1)..(1008)

SEQ ID NO: 46277 - protein, 335 aa, Streptococcus agalactiae; identical to SEQ ID NO: 1506

SEQ ID NO: 46278 - DNA, 1065 bp, Shewanella oneidensis; identical to SEQ ID NO: 1507
  CDS (1)..(1065)

SEQ ID NO: 46279 - protein, 354 aa, Shewanella oneidensis; identical to SEQ ID NO: 1508

SEQ ID NO: 46280 - DNA, 1092 bp, Shewanella oneidensis; identical to SEQ ID NO: 1509
  CDS (1)..(1092)

SEQ ID NO: 46281 - protein, 363 aa, Shewanella oneidensis; identical to SEQ ID NO: 1510

SEQ ID NO: 46282 - DNA, 1059 bp, Shewanella oneidensis; identical to SEQ ID NO: 1511
  CDS (1)..(1059)

SEQ ID NO: 46283 - protein, 352 aa, Shewanella oneidensis; identical to SEQ ID NO: 1512

SEQ ID NO: 46284 - DNA, 1053 bp, Escherichia coli O6; identical to SEQ ID NO: 1513
  CDS (1)..(1053)

SEQ ID NO: 46285 - protein, 350 aa, Escherichia coli O6; identical to SEQ ID NO: 1514

SEQ ID NO: 46286 - DNA, 1170 bp, Corynebacterium efficiens; identical to SEQ ID NO: 1515
  CDS (1)..(1170)

SEQ ID NO: 46287 - protein, 389 aa, Corynebacterium efficiens; identical to SEQ ID NO: 1516

SEQ ID NO: 46288 - DNA, 1134 bp, Bifidobacterium longum; identical to SEQ ID NO: 1517
  CDS (1)..(1134)

SEQ ID NO: 46289 - protein, 377 aa, Bifidobacterium longum; identical to SEQ ID NO: 1518

SEQ ID NO: 46290 - DNA, 1233 bp, Bifidobacterium longum; identical to SEQ ID NO: 1519
  CDS (1)..(1233)

SEQ ID NO: 46291 - protein, 410 aa, Bifidobacterium longum; identical to SEQ ID NO: 1520

SEQ ID NO: 46292 - DNA, 1221 bp, Phytophthora infestans; identical to SEQ ID NO: 1521
  CDS (20)..(1153)

SEQ ID NO: 46293 - protein, 377 aa, Phytophthora infestans; identical to SEQ ID NO: 1522

SEQ ID NO: 46294 - DNA, 1062 bp, Chlorobium tepidum; identical to SEQ ID NO: 1523
  CDS (1)..(1062)

SEQ ID NO: 46295 - protein, 353 aa, Chlorobium tepidum; identical to SEQ ID NO: 1524

SEQ ID NO: 46296 - DNA, 1074 bp, Xanthomonas campestris; identical to SEQ ID NO: 1525
  CDS (1)..(1074)

SEQ ID NO: 46297 - protein, 357 aa, Xanthomonas campestris; identical to SEQ ID NO: 1526

SEQ ID NO: 46298 - DNA, 1074 bp, Xanthomonas axonopodis; identical to SEQ ID NO: 1527
  CDS (1)..(1074)

SEQ ID NO: 46299 - protein, 357 aa, Xanthomonas axonopodis; identical to SEQ ID NO: 1528

SEQ ID NO: 46300 - DNA, 1080 bp, Ralstonia solanacearum; identical to SEQ ID NO: 1529
  CDS (1)..(1080)

SEQ ID NO: 46301 - protein, 359 aa, Ralstonia solanacearum; identical to SEQ ID NO: 1530

SEQ ID NO: 46302 - DNA, 1179 bp, Ralstonia solanacearum; identical to SEQ ID NO: 1531
  CDS (1)..(1179)

SEQ ID NO: 46303 - protein, 392 aa, Ralstonia solanacearum; identical to SEQ ID NO: 1532

SEQ ID NO: 46304 - DNA, 1065 bp, Synechococcus sp; identical to SEQ ID NO: 1533
  CDS (1)..(1065)

SEQ ID NO: 46305 - protein, 354 aa, Synechococcus sp; identical to SEQ ID NO: 1534

SEQ ID NO: 46306 - DNA, 1035 bp, Escherichia coli; identical to SEQ ID NO: 1535
  CDS (1)..(1035)

SEQ ID NO: 46307 - protein, 344 aa, Escherichia coli; identical to SEQ ID NO: 1536

SEQ ID NO: 46308 - DNA, 1200 bp, Stigmatella aurantiaca; identical to SEQ ID NO: 1537
  CDS (62)..(1147)

SEQ ID NO: 46309 - protein, 361 aa, Stigmatella aurantiaca; identical to SEQ ID NO: 1538

SEQ ID NO: 46310 - DNA, 1092 bp, Rhizobium loti; identical to SEQ ID NO: 1539
  CDS (1)..(1092)

SEQ ID NO: 46311 - protein, 363 aa, Rhizobium loti; identical to SEQ ID NO: 1540

SEQ ID NO: 46312 - DNA, 1083 bp, Amycolatopsis mediterranei; identical to SEQ ID NO: 1541
  CDS (1)..(1083)

SEQ ID NO: 46313 - protein, 360 aa, Amycolatopsis mediterranei; identical to SEQ ID NO: 1542

SEQ ID NO: 46314 - DNA, 1053 bp, Pasteurella multocida; identical to SEQ ID NO: 1543
  CDS (1)..(1053)

SEQ ID NO: 46315 - protein, 350 aa, Pasteurella multocida; identical to SEQ ID NO: 1544

SEQ ID NO: 46316 - DNA, 1086 bp, Pasteurella multocida; identical to SEQ ID NO: 1545
  CDS (1)..(1086)

SEQ ID NO: 46317 - protein, 361 aa, Pasteurella multocida; identical to SEQ ID NO: 1546

SEQ ID NO: 46318 - DNA, 1125 bp, Emericella nidulans; identical to SEQ ID NO: 1547
  CDS (1)..(1125)

SEQ ID NO: 46319 - protein, 374 aa, Emericella nidulans; identical to SEQ ID NO: 1548

SEQ ID NO: 46320 - DNA, 1089 bp, Emericella nidulans; identical to SEQ ID NO: 1549
  CDS (1)..(1089)

SEQ ID NO: 46321 - protein, 362 aa, Emericella nidulans; identical to SEQ ID NO: 1550

SEQ ID NO: 46322 - DNA, 1239 bp, Vibrio cholerae; identical to SEQ ID NO: 1551
  CDS (114)..(1175)

SEQ ID NO: 46323 - protein, 353 aa, Vibrio cholerae; identical to SEQ ID NO: 1552

SEQ ID NO: 46324 - DNA, 2184 bp, Candida albicans; identical to SEQ ID NO: 1553
  CDS (461)..(1573)

SEQ ID NO: 46325 - protein, 370 aa, Candida albicans; identical to SEQ ID NO: 1554

SEQ ID NO: 46326 - DNA, 1047 bp, Buchnera aphidicola; identical to SEQ ID NO: 1555
  CDS (1)..(1047)

SEQ ID NO: 46327 - protein, 348 aa, Buchnera aphidicola; identical to SEQ ID NO: 1556

SEQ ID NO: 46328 - DNA, 1047 bp, Buchnera aphidicola; identical to SEQ ID NO: 1557
  CDS (1)..(1047)

SEQ ID NO: 46329 - protein, 348 aa, Buchnera aphidicola; identical to SEQ ID NO: 1558

SEQ ID NO: 46330 - DNA, 1047 bp, Erwinia herbicola; identical to SEQ ID NO: 1559
  CDS (1)..(1047)

SEQ ID NO: 46331 - protein, 348 aa, Erwinia herbicola; identical to SEQ ID NO: 1560

SEQ ID NO: 46332 - DNA, 1047 bp, Salmonella typhimurium; identical to SEQ ID NO: 1561
  CDS (1)..(1047)

SEQ ID NO: 46333 - protein, 348 aa, Salmonella typhimurium; identical to SEQ ID NO: 1562

SEQ ID NO: 46334 - DNA, 23 bp, Artificial sequence
  (1)..(23): primer
atgaacagaactgacgaactccg

SEQ ID NO: 46335 - DNA, 24 bp, Artificial sequence
  (1)..(24): primer
ttagaagcgggtatctaccgcaga

SEQ ID NO: 46336 - protein, 352 aa, Artificial sequence; identical to SEQ ID NO: 19007
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(40): xaa in position 37 to 40 is any amino acid
  Variant (42)..(43): xaa in position 42 to 43 is any amino acid
  Variant (45)..(46): xaa in position 45 to 46 is any amino acid
  Variant (51)..(51): xaa in position 51 is any amino acid
  Variant (54)..(55): xaa in position 54 to 55 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(128): xaa in position 121 to 128 is any amino acid
  Variant (130)..(130): xaa in position 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(152): xaa in position 148 to 152 is any amino acid
  Variant (163)..(163): xaa in position 163 is any amino acid
  Variant (166)..(167): xaa in position 166 to 167 is any amino acid
  Variant (170)..(170): xaa in position 170 is any amino acid
  Variant (173)..(173): xaa in position 173 is any amino acid
  Variant (175)..(175): xaa in position 175 is any amino acid
  Variant (180)..(180): xaa in position 180 is any amino acid
  Variant (182)..(182): xaa in position 182 is any amino acid
  Variant (184)..(187): xaa in position 184 to 187 is any amino acid
  Variant (189)..(190): xaa in position 189 to 190 is any amino acid
  Variant (192)..(194): xaa in position 192 to 194 is any amino acid
  Variant (196)..(198): xaa in position 196 to 198 is any amino acid
  Variant (200)..(200): xaa in position 200 is any amino acid
  Variant (202)..(207): xaa in position 202 to 207 is any amino acid
  Variant (209)..(214): xaa in position 209 to 214 is any amino acid
  Variant (216)..(216): xaa in position 216 is any amino acid
  Variant (219)..(221): xaa in position 219 to 221 is any amino acid
  Variant (223)..(224): xaa in position 223 to 224 is any amino acid
  Variant (229)..(237): xaa in position 229 to 237 is any amino acid
  Variant (240)..(268): xaa in position 240 to 268 is any amino acid
  Variant (270)..(270): xaa in position 270 is any amino acid
  Variant (273)..(273): xaa in position 273 is any amino acid
  Variant (276)..(276): xaa in position 276 is any amino acid
  Variant (278)..(281): xaa in position 278 to 281 is any amino acid
  Variant (283)..(284): xaa in position 283 to 284 is any amino acid
  Variant (286)..(291): xaa in position 286 to 291 is any amino acid
  Variant (293)..(295): xaa in position 293 to 295 is any amino acid
  Variant (297)..(304): xaa in position 297 to 304 is any amino acid
  Variant (306)..(306): xaa in position 306 is any amino acid
  Variant (308)..(308): xaa in position 308 is any amino acid
  Variant (311)..(314): xaa in position 311 to 314 is any amino acid
  Variant (316)..(316): xaa in position 316 is any amino acid
  Variant (318)..(333): xaa in position 318 to 333 is any amino acid
  Variant (336)..(336): xaa in position 336 is any amino acid
  Variant (338)..(338): xaa in position 338 is any amino acid
  Variant (341)..(341): xaa in position 341 is any amino acid
  Variant (343)..(344): xaa in position 343 to 344 is any amino acid
  Variant (346)..(347): xaa in position 346 to 347 is any amino acid
  Variant (349)..(351): xaa in position 349 to 351 is any amino acid

SEQ ID NO: 46337 - protein, 24 aa, Artificial sequence
  Variant (2)..(2): xaa in position 2 is any amino acid
  Variant (3)..(3): xaa in position 3 is Leu, Val, Phe, Ile, Ala or Met
  Variant (4)..(4): xaa in position 4 is Val, Ile, Leu or Ala
  Variant (5)..(5): xaa in position 5 is Val or Ile
  Variant (6)..(6): xaa in position 6 is Val, Ile, Cys or Thr
  Variant (11)..(11): xaa in position 11 is Ile, Val, Ser or Leu
  Variant (12)..(12): xaa in position 12 is His or Asp
  Variant (13)..(13): xaa in position 13 is Asp or Asn
  Variant (14)..(15): xaa in position 14 to 15 is any amino acid
  Variant (16)..(16): xaa in position 16 is Ala, Ser, Gln or Thr
  Variant (17)..(17): xaa in position 17 is Ala, Val or Gly
  Variant (18)..(18): xaa in position 18 is any amino acid
  Variant (19)..(19): xaa in position 19 is Glu, Asp, Ala or Gln
  Variant (21)..(21): xaa in position 21 is Ala, Gly, Cys or Ser
  Variant (22)..(22): xaa in position 22 is any amino acid
  Variant (23)..(23): xaa in position 23 is Arg, Lys, Gln, His or Leu
  Variant (24)..(24): xaa in position 24 is Leu, Ile or Phe
RXXXXXGPCSXXXXXXXXXYXXXX

SEQ ID NO: 46338 - protein, 42 aa, Artificial sequence; identical to SEQ ID NO: 2884
  Variant (1)..(1): xaa in position 1 is Leu, Ile, Phe or Met
  Variant (2)..(2): xaa in position 2 is any amino acid
  Variant (3)..(3): xaa in position 3 is Ile, Val, Leu or Met
  Variant (4)..(4): xaa in position 4 is Val, Ile or Leu
  Variant (7)..(7): xaa in position 7 is Val, Ala or Thr
  Variant (9)..(9): xaa in position 9 is Phe, Leu, Thr or Val
  Variant (10)..(10): xaa in position 10 is Glu or Ala
  Variant (15)..(16): xaa in position 15 to 16 is any amino acid
  Variant (17)..(17): xaa in position 17 is any or no amino acid
  Variant (19)..(19): xaa in position 19 is Trp or Tyr
  Variant (20)..(20): xaa in position 20 is Lys or Arg
  Variant (22)..(22): xaa in position 22 is Leu, Phe, Met or Tyr
  Variant (23)..(23): xaa in position 23 is Ile, Val, Ala or Leu
  Variant (24)..(24): xaa in position 24 is any amino acid
  Variant (25)..(25): xaa in position 25 is Asp, Glu or Gln
  Variant (27)..(27): xaa in position 27 is any amino acid
  Variant (28)..(28): xaa in position 28 is Leu, Met, Ile, Val, Ala or Thr
  Variant (29)..(29): xaa in position 29 is Asp, Asn or Ser
  Variant (30)..(33): xaa in position 30 to 33 is any amino acid
  Variant (34)..(34): xaa in position 34 is Ile, Val, Leu or Met
  Variant (35)..(36): xaa in position 35 to 36 is any amino acid
  Variant (38)..(38): xaa in position 38 is Leu, Ile, Met or Val
  Variant (39)..(40): xaa in position 39 to 40 is any amino acid
  Variant (41)..(41): xaa in position 41 is Ala, Ser, Gly, Val or Thr

SEQ ID NO: 46339 - protein, 65 aa, Artificial sequence; identical to SEQ ID NO: 2885
  Variant (2)..(2): xaa in position 2 is any amino acid
  Variant (4)..(4): xaa in position 4 is Asp, Tyr, Gln, Asn or Glu
  Variant (5)..(9): xaa in position 5 to 9 is any amino acid
  Variant (10)..(10): xaa in position 10 is Tyr, Phe or Leu
  Variant (11)..(12): xaa in position 11 to 12 is any amino acid
  Variant (13)..(13): xaa in position 13 is Asp or Glu
  Variant (14)..(15): xaa in position 14 to 15 is any amino acid
  Variant (16)..(16): xaa in position 16 is Ser, Ala, Thr or Cys
  Variant (17)..(17): xaa in position 17 is Trp, Phe, Tyr, Leu or Val
  Variant (18)..(18): xaa in position 18 is any amino acid
  Variant (19)..(19): xaa in position 19 is Ala or Ser
  Variant (20)..(20): xaa in position 20 is Ile or Val
  Variant (24)..(24): xaa in position 24 is Thr, Ser or Asn
  Variant (25)..(25): xaa in position 25 is Thr, Val, Ala, Ser or Ile
  Variant (26)..(26): xaa in position 26 is Glu or Ala
  Variant (27)..(27): xaa in position 27 is Ser, Asp or Asn
  Variant (29)..(29): xaa in position 29 is any amino acid
  Variant (32)..(32): xaa in position 32 is Glu, Gln, Phe or Met
  Variant (33)..(33): xaa in position 33 is Leu, Met, Val, Ile or Phe
  Variant (34)..(34): xaa in position 34 is Ala, Ser, Thr, Cys or Val
  Variant (36)..(36): xaa in position 36 is Gly, Ala or Asn
  Variant (37)..(39): xaa in position 37 to 39 is any amino acid
  Variant (40)..(40): xaa in position 40 is Pro or Ala
  Variant (41)..(41): xaa in position 41 is Val, Ile, Thr or Leu
  Variant (43)..(43): xaa in position 43 is Phe, Met, Tyr or Ile
  Variant (46)..(46): xaa in position 46 is any amino acid
  Variant (47)..(47): xaa in position 47 is Thr, Ser or Arg
  Variant (48)..(48): xaa in position 48 is any amino acid
  Variant (50)..(53): xaa in position 50 to 53 is any amino acid
  Variant (54)..(54): xaa in position 54 is Ala or Met
  Variant (55)..(55): xaa in position 55 is any amino acid
  Variant (56)..(56): xaa in position 56 is Asp, Asn or Glu
  Variant (57)..(57): xaa in position 57 is Ala or Gly
  Variant (58)..(59): xaa in position 58 to 59 is any amino acid
  Variant (60)..(60): xaa in position 60 is Ala or Ser
  Variant (61)..(61): xaa in position 61 is Ala, Ser, Val or Thr
  Variant (62)..(64): xaa in position 62 to 64 is any amino acid
  Variant (65)..(65): xaa in position 65 is His or Gln

SEQ ID NO: 46340 - protein, 71 aa, Artificial sequence; identical to SEQ ID NO: 2886
  Variant (1)..(1): xaa in position 1 is Thr or Ser
  Variant (2)..(2): xaa in position 2 is any amino acid
  Variant (5)..(7): xaa in position 5 to 7 is any amino acid
  Variant (8)..(8): xaa in position 8 is His or Phe
  Variant (9)..(9): xaa in position 9 is Val, Ile, Leu or Ala
  Variant (10)..(10): xaa in position 10 is Ile or Val
  Variant (11)..(11): xaa in position 11 is Leu or Met
  Variant (14)..(14): xaa in position 14 is Gly, Ser or Ala
  Variant (15)..(16): xaa in position 15 to 16 is any amino acid
  Variant (17)..(22): xaa in position 17 to 22 is any or no amino acid
  Variant (23)..(23): xaa in position 23 is Pro, Thr or Ser
  Variant (25)..(25): xaa in position 25 is Tyr, Phe or His
  Variant (26)..(29): xaa in position 26 to 29 is any amino acid
  Variant (30)..(30): xaa in position 30 is Val, Ile or Leu
  Variant (31)..(36): xaa in position 31 to 36 is any amino acid
  Variant (37)..(37): xaa in position 37 is Leu, Met, Ile, Tyr or His
  Variant (38)..(40): xaa in position 38 to 40 is any amino acid
  Variant (41)..(51): xaa in position 41 to 51 is any or no amino acid
  Variant (52)..(52): xaa in position 52 is Leu, Ile or Val
  Variant (53)..(53): xaa in position 53 is Met, Val, Ile or Leu
  Variant (54)..(54): xaa in position 54 is Ile or Val
  Variant (56)..(56): xaa in position 56 is Cys, Phe, Ala, Thr, Tyr or Val
  Variant (57)..(57): xaa in position 57 is Ser, Asn or Ala
  Variant (59)..(59): xaa in position 59 is Gly, Ala or Asp
  Variant (61)..(61): xaa in position 61 is Ser or Cys
  Variant (62)..(62): xaa in position 62 is any amino acid
  Variant (64)..(66): xaa in position 64 to 66 is any amino acid
  Variant (67)..(67): xaa in position 67 is Arg, Asn, Lys, Leu or Glu
  Variant (69)..(70): xaa in position 69 to 70 is any amino acid
  Variant (71)..(71): xaa in position 71 is Val or Ile

SEQ ID NO: 46341 - protein, 41 aa, Artificial sequence; identical to SEQ ID NO: 2887
  Variant (2)..(2): xaa in position 2 is any amino acid
  Variant (4)..(4): xaa in position 4 is Ile, Leu, Val, Ala or Met
  Variant (7)..(7): xaa in position 7 is His, Asn, Phe or Tyr
  Variant (8)..(8): xaa in position 8 is Leu or Ile
  Variant (9)..(10): xaa in position 9 to 10 is any amino acid
  Variant (12)..(12): xaa in position 12 is any amino acid
  Variant (14)..(19): xaa in position 14 to 19 is any amino acid
  Variant (20)..(30): xaa in position 20 to 30 is any or no amino acid
  Variant (32)..(32): xaa in position 32 is any amino acid
  Variant (34)..(34): xaa in position 34 is Ile or Val
  Variant (37)..(37): xaa in position 37 is Ala, Pro, Gly, Lys, Ser or Glu
  Variant (39)..(39): xaa in position 39 is Ile, Leu or Val
  Variant (40)..(40): xaa in position 40 is any amino acid
  Variant (41)..(41): xaa in position 41 is Trp, Ile, Leu or Phe

SEQ ID NO: 46342 - DNA, 819 bp, Escherichia coli
  CDS (1)..(819)
atgatttacatcggtctaccgcaatggtcgcatcctaaatgggtgcggttggggatcaccagccttgaagagtatgcccgccactttaactgcgtggagggcaacaccacgctttacgccctgccgaaacccgaggttgtcctgcgctggcgtgagcagaccacagatgacttccgcttctgttttaagtttccggcgaccatttcgcatcaggcagcattacggcattgcgatgatttagtgactgaatttttgacccgcatgtcaccgttggctccgcgcattgggcaatactggctgcaactgcctgccacattcggcccacgggagctgcctgcgctttggcattttctcgattctcttcctggcgaatttaattatggcgtggaagtccgccatccacagtttttcgccaaaggagaagaggaacaaacgcttaatcgcggtttacatcagcgcggcgttaatcgggtgattttagacagccgcccggttcatgcagcacgtccacacagtgaagctattcgcgacgctcaacgaaaaaaacctaaagttccggtacatgctgtactgacggcgacaaatccgctgatccgttttatcggtagtgatgatatgacgcaaaaccgggaattatttcaggtctggttacaaaaattagcgcagtggcatcagaccactacgccttatctttttttacatacgccagacattgcccaggcaccggaactggtacataccctgtgggaagacttacgtaaaacgcttccagagatcggagcagttccggctattccacagcaatcttctcttttctga

SEQ ID NO: 46343 - protein, 272 aa, Escherichia coli
MIYIGLPQWSHPKWVRLGITSLEEYARHFNCVEGNTTLYALPKPEVVLRWREQTTDDFRFCFKFPATISHQAALRHCDDLVTEFLTRMSPLAPRIGQYWLQLPATFGPRELPALWHFLDSLPGEFNYGVEVRHPQFFAKGEEEQTLNRGLHQRGVNRVILDSRPVHAARPHSEAIRDAQRKKPKVPVHAVLTATNPLIRFIGSDDMTQNRELFQVWLQKLAQWHQTTTPYLFLHTPDIAQAPELVHTLWEDLRKTLPEIGAVPAIPQQSSLF

SEQ ID NO: 46344 - DNA, 774 bp, Thermoplasma volcanium GSS1
  CDS (1)..(774): transl_table=11
atgatattcgtcggctgttcaggctggtcttatgaggaatggaatggcgtattctatccaaaaagtaaaataaataagctaaaattctattccactatgttcaatacggtcgaagtcaattcaacattttacagagaaataaataatgatattataaatagatggatagaaacagtaagaggaaaaaatttcattttttcaataaaagttcctcagaatataacgcataaggccatattagagaaagatagcaattctaaaagcctatacgaaacattcattgacaaaactgttaggccgataagaaacgctagaatgcttggggctgtccttgtacagcttccacctagttttaattcaaatttacagacagaacttcttgataccatatgctgtgaaaacgaatacaggaccgctgtagaagtaagaaataaagatctctattcaaatgaggagctcaggaaagagttagaaaagaggggtatcgcaatagtcgacgtggatagcacagagcatcccttatccaatctcaactctggcttgaaatggtcttatgtaaggctccatggaagggctcagttgggatggaagtcacaaaacccatacgattaccgttactcggagcaagaaatttcagacctctcatcgaagattatggcgaagaattacgatgaaatattcgtatattttaacaatcacccaagaggaagcgcaccgatcaacgcattgaagatggcctcctgcttgggaattagtaataattggtttttttaa

SEQ ID NO: 46345 - protein, 257 aa, Thermoplasma volcanium GSS1
MIFVGCSGWSYEEWNGVFYPKSKINKLKFYSTMFNTVEVNSTFYREINNDIINRWIETVRGKNFIFSIKVPQNITHKAILEKDSNSKSLYETFIDKTVRPIRNARMLGAVLVQLPPSFNSNLQTELLDTICCENEYRTAVEVRNKDLYSNEELRKELEKRGIAIVDVDSTEHPLSNLNSGLKWSYVRLHGRAQLGWKSQNPYDYRYSEQEISDLSSKIMAKNYDEIFVYFNNHPRGSAPINALKMASCLGISNNWFF

SEQ ID NO: 46346 - DNA, 870 bp, Vibrio cholerae O1 biovar eltor str. N16961
  CDS (1)..(870): transl_table=11
gtgacgtcctctcttcccttgcgactcggtttaaccctgtggtctcaccctgcatggcagagtgagttttatggcagcggcacgcaagcttctgaacgccttgcgaaatacgccagcgtttttcacaccgtggaggggaataccaccttttacgcgtcgccctcgcccagtactgtgctcaactggcgcgccgcgactcatgatgactttcgcttcacctttaagctgcccaaaagcattacccaccagcatttactgcgcgactgtaaagaagagctgctgagttttttgcgtttaatgcagcccttgcacgaccgaattggcatgtggacgattcagctgcccgccgcttttgggcctgaacatctggcgcaattgaaaaactttcgagactggtttccagccgattttccactgggcgtggaggtgcgtcatttggccttttttggcaaaggcgaagcggaaaaagcgctcaatcaatggctgattgagcaaaacattgatcgcatcattatggacagtcgccccgttttttcggcgctgccgaataccgaagcggtaattgatgcgcacgagaaaaaaccgaaagtgccggtgcatgcgattgccaccgccaagcatccgatgatccgttttatcggccatcctgagattgaggccaacctaccctttttcggtgcttggctacataaactgcccgagtggattgcccaaggtaagcagccttatctaatgattcatacaccggataatgatttcgcgcctcagctggcggtgcaactttaccaacaattacaacaggctatcgcgctgcctgacttagccccttttcccgtcacaccagaacaaccacaactgagcatgttttga

SEQ ID NO: 46347 - protein, 289 aa, Vibrio cholerae O1 biovar eltor str. N16961
MTSSLPLRLGLTLWSHPAWQSEFYGSGTQASERLAKYASVFHTVEGNTTFYASPSPSTVLNWRAATHDDFRFTFKLPKSITHQHLLRDCKEELLSFLRLMQPLHDRIGMWTIQLPAAFGPEHLAQLKNFRDWFPADFPLGVEVRHLAFFGKGEAEKALNQWLIEQNIDRIIMDSRPVFSALPNTEAVIDAHEKKPKVPVHAIATAKHPMIRFIGHPEIEANLPFFGAWLHKLPEWIAQGKQPYLMIHTPDNDFAPQLAVQLYQQLQQAIALPDLAPFPVTPEQPQLSMF

SEQ ID NO: 46348 - DNA, 867 bp, Pseudomonas aeruginosa PAO1
  CDS (1)..(867): transl_table=11
gtggtttcccttccttatttcctcggttgtccatcctggaacgaggcggcctggcgcggcagcttctatccgcgcgaattgcgttccgccgactacctcggacactacggcggcatcttcaacgcggtcgagggcaataccaccttctatgcccggccttcggcggaaaccgtgcggcgctgggccgagacgatgccggcggggttccgcttctgtgccaagtttccccgcgatatcagtcacgaaggcgacctgcgcgaacggctcgaggccgccggcgacttcctcgaactgctggcgccacttggcgaaagggtcagcccgctgtggctgcaactgtcggcggcgttcaccccgcagcgcctgggcgaactgctgtatttcctcgatgagctgagtccgcgacggattgccgtggaagtacgccacccggcgttcttcgacaaaggcgaggacgagcgcctgctcaaccgccacctgcgcgagcgtggcgtggagcgcatctgcctggattcgcgggcgctgttcagttgccgttcggacgatccggcggtgctccacgcccagtcgaagaagccgcgcctgccgatccgtccggcggccttcagcgatacgccacaggtgcgtttcatcggcggtcccgacctgccggccaacgaggtgttccttttgccctgggtcgacaaggtggccgactggatcgaggccggcctgactccatacgtattcctgcatacccccgacaatcacctggcggcccagcaggcccagcgtttccatgcgctgctgggccagcgcctgccaggcttgccggcgctacccgagccgatcccggccccggaagtggagcaactgggcctgctctga

SEQ ID NO: 46349 - protein, 288 aa, Pseudomonas aeruginosa PAO1
MVSLPYFLGCPSWNEAAWRGSFYPRELRSADYLGHYGGIFNAVEGNTTFYARPSAETVRRWAETMPAGFRFCAKFPRDISHEGDLRERLEAAGDFLELLAPLGERVSPLWLQLSAAFTPQRLGELLYFLDELSPRRIAVEVRHPAFFDKGEDERLLNRHLRERGVERICLDSRALFSCRSDDPAVLHAQSKKPRLPIRPAAFSDTPQVRFIGGPDLPANEVFLLPWVDKVADWIEAGLTPYVFLHTPDNHLAAQQAQRFHALLGQRLPGLPALPEPIPAPEVEQLGLL

SEQ ID NO: 46350 - DNA, 798 bp, Deinococcus radiodurans R1
  CDS (1)..(798): transl_table=11
gtgatgaagctgctcgaaccgccgcagcaccagaagacacagcatgtcgccctgggcacggcaggctggggcctgagccgcgagcagcaggagcgcttcggcccaggcgacagcgtgctgcaacgctacgccacccgcttcaatgccgccgaaatcaattcgtcgttttaccgcccccaccgcccggccacctacgcgcgctgggcggccagcgtgcagcagggctttcgcttcagcgtcaaggtgcccaaagccgtgacgcacacggccagattgcgagagtgcgccgcgccgctggccgagtttgtagagcaggtcagccatctgggtgaaaagctggggccactgctagtgcagttgccacccagcctgagcttcgagcgggacgttgtagaggacttcttcagcttgctgcacgggatgaccctcgcccggactgtgtgcgaaccgcgtcacgccagctggttcaccccggaagtggacgccctgctgcgcgacctgaacgtgagccgcgtggccgccgaccccgcgaaggtgcccgccgccgcgcaccctggcggcagccttagcatggtgtattaccgctggcacggctcaccgaagatgtattccagcagctacttggattcacaactggcaaggttggcagcgcaggtgcaggcgaattctggcgacgtatgggtcatcttcgacaacacggcggtgggggcagcggtagaaaacgggctgattttacggaacttgttgagttcagcacagtcggaaaggcaaacctcttgccagcctgaccccaaatga

SEQ ID NO: 46351 - protein, 265 aa, Deinococcus radiodurans R1
MMKLLEPPQHQKTQHVALGTAGWGLSREQQERFGPGDSVLQRYATRFNAAEINSSFYRPHRPATYARWAASVQQGFRFSVKVPKAVTHTARLRECAAPLAEFVEQVSHLGEKLGPLLVQLPPSLSFERDVVEDFFSLLHGMTLARTVCEPRHASWFTPEVDALLRDLNVSRVAADPAKVPAAAHPGGSLSMVYYRWHGSPKMYSSSYLDSQLARLAAQVQANSGDVWVIFDNTAVGAAVENGLILRNLLSSAQSERQTSCQPDPK

SEQ ID NO: 46352 - DNA, 723 bp, Thermoplasma acidophilum DSM 1728
  CDS (1)..(723): transl_table=11
atgaacatcagaataggctgttcaggatggtattatccgcactgggccggcaagttctacccttctgacctgaataaaagcgagtggttcaggtattatgcacagaaattcgacacggtggagataaattccacgttttattcttttccaaatgcagcccgcgtaagatcctgggtcaagggatctccagagaattttgtgttcagcgtgaaggtgaaccgcaccataacgcatgtgaaaagattgaaggattgtgacgaagaaattggtctgttctatgagatcattgggtcacttgggaaaatgctgggctgtgtactcttccagttccccccatcgttcaaatattcgcatgataatctaatcatgatagaaaaagcattggaccaaagattctgcaacgttgtggaattcaggaacatttcatggttctctgaagatgccaggtgtgatctggagaagagtgatctgcatgtagtcgctgtaagctctgaaaggattccattgtggatcaaagaagattccgttgtatatgtaaggttgcacggcaatgtgaatggctatgctaccgattacaatgaggagtatctgacggatctggcacagaggataattgatgtaaaacctcagtcattgtacgtatatttcaataatgattatagcggctacgctcccaaaaatgcaatcatgctgaaatcgataatcaataatctcattttataa

SEQ ID NO: 46353 - protein, 240 aa, Thermoplasma acidophilum DSM 1728
MNIRIGCSGWYYPHWAGKFYPSDLNKSEWFRYYAQKFDTVEINSTFYSFPNAARVRSWVKGSPENFVFSVKVNRTITHVKRLKDCDEEIGLFYEIIGSLGKMLGCVLFQFPPSFKYSHDNLIMIEKALDQRFCNVVEFRNISWFSEDARCDLEKSDLHVVAVSSERIPLWIKEDSVVYVRLHGNVNGYATDYNEEYLTDLAQRIIDVKPQSLYVYFNNDYSGYAPKNAIMLKSIINNLIL

SEQ ID NO: 46354 - DNA, 843 bp, Listeria monocytogenes EGD-e
  CDS (1)..(843): transl_table=11
atggtaacaatcgggttaactgggtggagtgatcatgattctttattacaaacaaaaaaattaacattggctgattatgcggcacattttcctgtggtggaggttgatacgagtttttatgcgattccttctccgcgaacaacggcaaactgggcggcgcaaactccggatgattttcggtttgtgattaaggccttttcggcgatgacgaaacataaggaatggtcgcagtattttgatagtgaaaatgcgatgtatacggcttatatggatatgattgcaccgataagtgaaacggggaaactacaggcaattttatttcaatttccgccgtattttaattgtacgaaagaaaacgtgacttatttaaaatatattgcgtcgaaaatgggcgatttgccagtggcggttgagtttcgtcataattcttggtataacgagcaaaataccgaaaagacgctggatttgttgcgcgaattaggctttattcatacagttgtcgatgagccgcaagtcggggcgggcagtgtgccgattgtgcttcgcgagacgaatagtgatatgacattagtaaggcttcacggtcgaaatcagtatggctggatgaaagctaacagtcccgagtggcgcgaggttcgcacgctttaccgttacaatgaagaggaaattaacgaatgggctaaatacgtggaacatttgcaaaagttgtccaaagaagttgtcgtgatttttaataataacagcggcggggatgcggctgataatgcgaaacatttacaaaaggcactccaagtcgagtttcaaggcttggctccgatgcaaatggatttattttcggaataa

SEQ ID NO: 46355 - protein, 280 aa, Listeria monocytogenes EGD-e
MVTIGLTGWSDHDSLLQTKKLTLADYAAHFPVVEVDTSFYAIPSPRTTANWAAQTPDDFRFVIKAFSAMTKHKEWSQYFDSENAMYTAYMDMIAPISETGKLQAILFQFPPYFNCTKENVTYLKYIASKMGDLPVAVEFRHNSWYNEQNTEKTLDLLRELGFIHTVVDEPQVGAGSVPIVLRETNSDMTLVRLHGRNQYGWMKANSPEWREVRTLYRYNEEEINEWAKYVEHLQKLSKEVVVIFNNNSGGDAADNAKHLQKALQVEFQGLAPMQMDLFSE

SEQ ID NO: 46356 - DNA, 846 bp, Listeria innocua Clip11262
  CDS (1)..(846): transl_table=11
ttgatgattacaatcgggttaactggatggagtgatcatgattctttattacaaacaaaaaaattaacattagctgattatgcggcacattttcctgtggtagaagtcgatacgagtttttatgcgattccttctccgcgaacaacggcaaactgggcggcgcaaactccggatgattttcgttttgtgataaaggctttttcggcgatgacaaaacataaagaatggtcgcagtattttgatagcgaaaatgcgatgtatacggcttatatggatatgattgcgccgataagtgaaacgggaaaactacaggcaattttatatcaatttccaccgtattttaattgtacgaaagaaaatgtgacttatttaagatatatcgcttcgaaaatgggtgatttgcctgtagcaattgaatttcgtaataactcatggtatagcgaacaaaatacagaaaagacgttagatttactacgagaattaggttttattcatacggttgttgatgaaccacaagttggatctggaagtgtaccaattgtgcttcgtgagacaaatagtgagatgacgctagtaagactgcatggtcggaatcagtatggttggatgaaagcgagtagtccggaatggcgcgaggttcgcacgctttaccgttataatgaggaagaaataaacgagtggaccaaatatgtggaacatttacaaaaattgtccaaagaagttgtcgtgatatttaataataacagcggcggggatgctgctgataatgcgaaacatttacaaaaggcgctccaagtcgagtttcaaggtttggctccgatgcaaatggatttgttttcagaataa

SEQ ID NO: 46357 - protein, 281 aa, Listeria innocua Clip11262
MMITIGLTGWSDHDSLLQTKKLTLADYAAHFPVVEVDTSFYAIPSPRTTANWAAQTPDDFRFVIKAFSAMTKHKEWSQYFDSENAMYTAYMDMIAPISETGKLQAILYQFPPYFNCTKENVTYLRYIASKMGDLPVAIEFRNNSWYSEQNTEKTLDLLRELGFIHTVVDEPQVGSGSVPIVLRETNSEMTLVRLHGRNQYGWMKASSPEWREVRTLYRYNEEEINEWTKYVEHLQKLSKEVVVIFNNNSGGDAADNAKHLQKALQVEFQGLAPMQMDLFSE

SEQ ID NO: 46358 - DNA, 855 bp, Nostoc sp. PCC 7120
  CDS (1)..(855): transl_table=11
gtgaacttctctattggttgtgctgtttgggcttataaaggttgggtaggcgaactttatccccaaggaagtcgtgctggggaatttctccatctctacagtcgtcgcttcactaccgtagaaggtaatactactttctacgcagcaccaaatcaagaaactgtcagccgttgggcaaaagaaacaccaccaggctttgagttttgtttgaaattaccacgggatattacccatcaaggtttattaaaaccctatattcccgccgctttaaaatttctggaggggatgcagcctttgggtaagcatctcggccctatattttcccagttaccaccaagttacgcaccaacattaattgacgatttggctagttttctggaagcttggccgcgcacaacagcaccactagccttagaagtcagacatcctgactggtttcgagaaccccataaaagcaatttgacacagcttttagaaacgctgggtgtaggaagggtactactggattcacgccctatctacacgggagatgatgacccccagttacaatcagaacgacgtaaacccaaattaccgttacaattcagcgtcactgcaccttttagcctgattaggtttatttcccatcctaatttggcggtgaatcaagtatttatggaagagtgggtacaacaaattcaacagtggttacaagcagggacacgaatctatttctttgtacattgtcctatagaagagcgatcgcctaacactgcccgtcacttccaaaaactattagaacagaacggtgtaccagttccacccctaccctggaatcatctggactatccacctcatcaactaaatctctggtaa

SEQ ID NO: 46359 - protein, 284 aa, Nostoc sp. PCC 7120
MNFSIGCAVWAYKGWVGELYPQGSRAGEFLHLYSRRFTTVEGNTTFYAAPNQETVSRWAKETPPGFEFCLKLPRDITHQGLLKPYIPAALKFLEGMQPLGKHLGPIFSQLPPSYAPTLIDDLASFLEAWPRTTAPLALEVRHPDWFREPHKSNLTQLLETLGVGRVLLDSRPIYTGDDDPQLQSERRKPKLPLQFSVTAPFSLIRFISHPNLAVNQVFMEEWVQQIQQWLQAGTRIYFFVHCPIEERSPNTARHFQKLLEQNGVPVPPLPWNHLDYPPHQLNLW

SEQ ID NO: 46360 - DNA, 771 bp, Agrobacterium tumefaciens str. C58
  CDS (1)..(771): transl_table=11
ttgccaatcattgccaccgcagcgtggtcgataccaaaaaaagttgccagtcgttttccggaagagggcagtggcctgcaacggtatgcctccgtctttgacggcgtcgagatcaattccaccttttaccgtcggcacaaaacgtccacattcgcgcggtgggccggctttgtgccagacggctttcggttttctgtaaaaatgcccaaagaaatctcacatacgcgtgcgatgatcgatgtcgccgagccgttttgcagtttcattgaagatatcgccccacttggcgaaaaacgtggaccgcttctgtgccagttgccgccatcattggcttttgagagccgaaccttcgatattgcattcaaaacgatgcgcaataccgacatgggaccgattgtcatcgaggctcggcacaaaagttgggcctcgctcgaagctagcgatctgttgaagacatacgagatcgatagggttctcgctgatcctgccctcgtgtggcctgtcgaagttttcgacacacctcctcgatacattcgtttacatggaaagccaaaaatctactattctgtctacagtgacgaggagatcgagttctttttcaaaaacgtggcgcctgacggatggtgcgtcttcgataacaccgcctctggagctgcaattgagaacgctctgtctatgcttgggtcgagccatgcccctcgcaaaacactccggaaaggcaagagacctccggtggctgaagacgccgcggccaagtcagaaaacggttga

SEQ ID NO: 46361 - protein, 256 aa, Agrobacterium tumefaciens str. C58
MPIIATAAWSIPKKVASRFPEEGSGLQRYASVFDGVEINSTFYRRHKTSTFARWAGFVPDGFRFSVKMPKEISHTRAMIDVAEPFCSFIEDIAPLGEKRGPLLCQLPPSLAFESRTFDIAFKTMRNTDMGPIVIEARHKSWASLEASDLLKTYEIDRVLADPALVWPVEVFDTPPRYIRLHGKPKIYYSVYSDEEIEFFFKNVAPDGWCVFDNTASGAAIENALSMLGSSHAPRKTLRKGKRPPVAEDAAAKSENG

SEQ ID NO: 46362 - DNA, 741 bp, Thermoanaerobacter tengcongensis MB4
  CDS (1)..(741): transl_table=11
atggggaaaaagctctacatagggacatccggttgggcatactcccactggaaagaaattttttatccttctaaccttccttatgaagaaaggcttagcttttattcaaagcattttctgagcgctgaagtaaattcttctttctaccacttacctcaagaaaaaactttgatgaaatggtatacctctactcctgaaggtttcatcttttctgtaaaagcctcccgccacataactcacttaaaaaaactttgtgatgtggaagaagcgtggaacaatttcaaaaaaaggatagacctgttgaaggacaagttaggacctattctcctgcaattccctccaagttttaaaaaagaccaagaaaatgtagaaaaaatcataaactttttaagagggaaagaaaactacaaatttgccttggaattcaggcataaaagctggcttgatgaagaagtctatgaccttatgaggaaattgaaagtcgcctgggtaatagcagattcctcccggtatcctaaggcaaaagttgtcacagcagattttgcttacattagaatgcatgggcctgaagctttgttcagttcctcctattcagaagaagaacttgaggaattggcaaaagacatagaagaatatttaaaaaattgcgatgaaatttacgtgtatttcaacaatgacgtcaacggctgcgcaattcaaaatgccaaaactttaataaaactcacggcacatatgctttga

SEQ ID NO: 46363 - protein, 246 aa, Thermoanaerobacter tengcongensis MB4
MGKKLYIGTSGWAYSHWKEIFYPSNLPYEERLSFYSKHFLSAEVNSSFYHLPQEKTLMKWYTSTPEGFIFSVKASRHITHLKKLCDVEEAWNNFKKRIDLLKDKLGPILLQFPPSFKKDQENVEKIINFLRGKENYKFALEFRHKSWLDEEVYDLMRKLKVAWVIADSSRYPKAKVVTADFAYIRMHGPEALFSSSYSEEELEELAKDIEEYLKNCDEIYVYFNNDVNGCAIQNAKTLIKLTAHML

SEQ ID NO: 46364 - DNA, 768 bp, Streptomyces coelicolor A3(2)
  CDS (1)..(768): transl_table=11
atgaccctgttcgtcggcacgtctggctggcagtaccgggactggcgggagagcttctacccgcccggtctgccggtccggcgctggctggagcactatgcggccgccttcgcgacggtcgagatcaacaacgccttctaccgcctgcccgcccgggagaccttcaccgcctggcgggaccgcgtcccaccggacttcacggtcgcggtcaaggccagccgctacctgacgcacatcaaacgcctgcgcgacccggccgagccggtcgaccgcctgatgacccacgcggccggtctgggcgaccgtctcggcccggtcctgctgcaactgcccccgaccctgcgcgccgacccggacctcctggacgcctgcctggcctgcttcccgccgggcacccgggtcgcggtggaaccccggcacgagtcctggtggacggccgagacccgcgaggttctcgtcgcccggcgcgcggccctgtgctgggcggatgtccgcgcccgcccggtcaccccgttgtggcgcaccaccgactggggctacgtccgcttccacgagggccgggccgcggcctggccgcactacggccgccgctccctggtcacgtggatcgaccgcatcacggcggcctggccgcatacgagcgacgtctacacctacttcaacaacgacccgaacacggcggcggtgcaggacgccgcgacgttcgcacagtcggctcgcacgtcggcgctgacggtcacacgtacgccctcaggggcgcggggctga

SEQ ID NO: 46365 - protein, 255 aa, Streptomyces coelicolor A3(2)
MTLFVGTSGWQYRDWRESFYPPGLPVRRWLEHYAAAFATVEINNAFYRLPARETFTAWRDRVPPDFTVAVKASRYLTHIKRLRDPAEPVDRLMTHAAGLGDRLGPVLLQLPPTLRADPDLLDACLACFPPGTRVAVEPRHESWWTAETREVLVARRAALCWADVRARPVTPLWRTTDWGYVRFHEGRAAAWPHYGRRSLVTWIDRITAAWPHTSDVYTYFNNDPNTAAVQDAATFAQSARTSALTVTRTPSGARG

SEQ ID NO: 46366 - DNA, 771 bp, Xanthomonas axonopodis pv. citri str. 306
  CDS (1)..(771): transl_table=11
atgccagctcgtccatccggtgccattgcacgtgtgcgttgtggttgcgcaggctggtcgattcccgccgcagaccgcgcacagttcgacgagggcgccagcgtattgcagcgctacgccacgcgtttggacgcggtggaaatcaactcctcgttctatcgtccgcaccgcgccagcacctacgcgcgatgggccgacagcgtgccggaggactttcgtttttcggtcaagctgccacgcagcatcagccacgacgcacgcctgcacggcaccgggccgctgctggatgccttcctggcgcaggccggcgcgctgggaacacgactgggctgcctgctgctgcaactgccgcccagcgcggccttcgatgccgcggtggccgcgcggtttttcgcgatgctgcgccggcgctgggacggcggcgtggtctgcgaaccgcgccacgccagctggtttgccgcacctgcgcaggcgctgctggcgcgccatcggattgcacgctgcgccgccgacccggcgccggtgcccgcggcctcactgccgagcccggctgctgcaccgctgtattggcgctggcatggcgccccgcgtcgctactacagcagctacgcgcacaccgcactgcaggcgctggccgccacggtgcgcgccagccacccaggcagcacgcagcctccggccgaacgctgggtgatcttcgacaacaccgcagccgggtgcgcaacctccaatgcgctggaattgcagcgcttgctgaggaacgaacgctag

SEQ ID NO: 46367 - protein, 256 aa, Xanthomonas axonopodis pv. citri str. 306
MPARPSGAIARVRCGCAGWSIPAADRAQFDEGASVLQRYATRLDAVEINSSFYRPHRASTYARWADSVPEDFRFSVKLPRSISHDARLHGTGPLLDAFLAQAGALGTRLGCLLLQLPPSAAFDAAVAARFFAMLRRRWDGGVVCEPRHASWFAAPAQALLARHRIARCAADPAPVPAASLPSPAAAPLYWRWHGAPRRYYSSYAHTALQALAATVRASHPGSTQPPAERWVIFDNTAAGCATSNALELQRLLRNER

SEQ ID NO: 46368 - DNA, 909 bp, Xanthomonas axonopodis pv. citri str. 306
  CDS (1)..(909): transl_table=11
atgctcggggttatggctatttgcatcggcatttccggctggcgttacgcacgctggcgcggcacgttttacccggccggcctggcccaacggcgcgagctcgaatacgccgcgggctgctttcccagcgtggaaatcaatggctccttctattcgctgcagcgcccggaaagcttccagcgctggcatgacgaaacgcctgaggatttcgtcttttcggtcaagggtcctcgcttcatcacccatatgaagcgcttgcgcgattgcgagcaggcgctggccaacttcttcgcttccggggtgttgcggctgggcgccaaactgggtccgatcctgtggcagctaccgccgaccctacagttcgatgccgagctgctggacgcatttctcggcagcctgccgcgcgatagcgaggccgcgttggcgagggcgcgcaaacgcgacaccgcgctgatgcagggccgcagcgcgctggcgatcgatcgccggcgaccgatccgtcacgcattggaagtgcgtcacgacagcttctgcgatccggcctgcatgcggctgctgcggcgtcacaatgtcgcggtggtggtcgccgacaccgcagggaaattcccgtatctggaggacgtcagcgcagatttcgtctatgtgcgtctgcatggcgatgcgcagttgtacgccagcggctacagcgacaccgcactggatcgctgggcagcacgcatcgccgcgtgggccggcggagccgaaccggacgatgcagcccgcgtcggcgcacgcgcccgcaaacgcgcaatgcgcgatgtgtactgttatttcgacaacgacatgaaggtgcatgcgccgttcgatgcgcgcggcttgatgcaacggctgcagttgcctaccaactgcccggcacgcgaaaacacctag

SEQ ID NO: 46369 - protein, 302 aa, Xanthomonas axonopodis pv. citri str. 306
MLGVMAICIGISGWRYARWRGTFYPAGLAQRRELEYAAGCFPSVEINGSFYSLQRPESFQRWHDETPEDFVFSVKGPRFITHMKRLRDCEQALANFFASGVLRLGAKLGPILWQLPPTLQFDAELLDAFLGSLPRDSEAALARARKRDTALMQGRSALAIDRRRPIRHALEVRHDSFCDPACMRLLRRHNVAVVVADTAGKFPYLEDVSADFVYVRLHGDAQLYASGYSDTALDRWAARIAAWAGGAEPDDAARVGARARKRAMRDVYCYFDNDMKVHAPFDARGLMQRLQLPTNCPARENT

SEQ ID NO: 46370 - DNA, 816 bp, Yersinia pestis KIM
  CDS (1)..(816): transl_table=11
atgtatatcggactgccgcaatggcaacacccggcctggggccgactgggtcttcgagacttggcggactatagccgctattttaattgcgttgagggtaataccaccttttatgcattgccacggccagaaattgtgctgcgctggcgtgatatgacaccggacagtttccgtttctgctttaaattccccgccacaatcagccatcaggcggctctgcgtgactgtgataaagaactacaggctttttatcattgcctggctccgctgaatgatcgcattggtcaactgtggttacaactgcctgccgcctttgggccaaatgaattggaccgtttgtggcagtttatcgataagttacccgctggttttcagtatggcgtggaagtccgacacccagagttttttgccaaaggtgccgcagaattagcccttaatcaagggttacatcagcgttcaattaatcgggtgatgctcgatagccgccctattcacgccgccaagcctttaaccgccgccgttcgtgatgctcaaagtaagaaaccccgtttgccagtacatgctgtcgtcactggcggccaacctttagtgcgctttattggtggcgaccaattggatgacaacttggccctgtttgcaccctggctacaaaaactgcctttatgggaacagcaccatcaaccctacgtttttattcacacgcccgataacggcgactcaccgcagcaagctcaaaaaatttggcaaaagttggcagaagccatcccgacattgcccaccgcacccgattggccagagcaagagacactcttttag

SEQ ID NO: 46371 - protein, 271 aa, Yersinia pestis KIM
MYIGLPQWQHPAWGRLGLRDLADYSRYFNCVEGNTTFYALPRPEIVLRWRDMTPDSFRFCFKFPATISHQAALRDCDKELQAFYHCLAPLNDRIGQLWLQLPAAFGPNELDRLWQFIDKLPAGFQYGVEVRHPEFFAKGAAELALNQGLHQRSINRVMLDSRPIHAAKPLTAAVRDAQSKKPRLPVHAVVTGGQPLVRFIGGDQLDDNLALFAPWLQKLPLWEQHHQPYVFIHTPDNGDSPQQAQKIWQKLAEAIPTLPTAPDWPEQETLF

SEQ ID NO: 46372 - DNA, 870 bp, Pseudomonas putida KT2440
  CDS (1)..(870): transl_table=11
atgaatccctcaccactgccttactttctcggttgcccgtcgtggagcgaaaacgcctggcgcgactacctgtaccccgctgacgccaacagtaaccaaatgcttggcttctacagccaggtgttcaacgccgtcgaaggcaacaccactttctacgcacgtcccgctcccggcaccattgcccgctgggcgcagctcatgcccgagcactttcgcttcactgccaagtttccgcgggatgtcagccatgaaggcgacctgcgagaccagcttgagcctgccttcgacttcacccggctgatggccccgctgggccggcgcgtatcaccctactggctgcagttgccggcccagttcggcccggcgcgtttgggtgagctttgtcacttcctcgatcagattgccgtgcccgtggccgtggaagtgcgcaaccaggccttttttgccaagggtgaggaagaacgcctgctcaaccgcctgctgcacgaacgcggtgtggagcgtatctgcctcgacccgcgtgcgctgttcagttgtacctcgcgcgaccctgccgtgctgcatgcgcagtcgaagaagcccaaggtgcctccgcggccggcagccttcagccagcacccgcaggttcgcttcattggccatcctgaactggaggccaatcacaccttccttagcccttgggtagaaaaagtcgccgcctggatcgaagaaggccgcaatccctatatcttcctgcacacctcggacaatcgcctggctgcggcgctggcccagcgtttccatcaacgcctgatggcacgcctgccgggcctggcacctttgccggaattgccgcgcgcccctgaggtcgaacaattggggctactctga

SEQ ID NO: 46373 - protein, 289 aa, Pseudomonas putida KT2440
MNPSPLPYFLGCPSWSENAWRDYLYPADANSNQMLGFYSQVFNAVEGNTTFYARPAPGTIARWAQLMPEHFRFTAKFPRDVSHEGDLRDQLEPAFDFTRLMAPLGRRVSPYWLQLPAQFGPARLGELCHFLDQIAVPVAVEVRNQAFFAKGEEERLLNRLLHERGVERICLDPRALFSCTSRDPAVLHAQSKKPKVPPRPAAFSQHPQVRFIGHPELEANHTFLSPWVEKVAAWIEEGRNPYIFLHTSDNRLAAALAQRFHQRLMARLPGLAPLPELPRAPEVEQLGLL

SEQ ID NO: 46374 - DNA, 882 bp, Vibrio vulnificus CMCP6
  CDS (1)..(882): transl_table=11
atgcagcgagaaaccatgaacacgcttcctcttcgattgggtctgaccatgtggtcacacaatcagtggcaacaagacttttatggctcggggaccaaacccgcagagcgactggaaaagtacgcacaggtctttcacactgtcgaaggcaatacgaccttctacgcaacgccaaatacaccaaccgtactcaactggcgcgcggcgacgcatgacgattttcgtttcacctttaagttgccaaagcagattacccaccagcagatgcttaaaggctctcagggtttgttacgcgagtttttgagtgtcatggaaccgctgcacccgcgtattggccaatggacaatccaacttcctgcggctttctcaccagagcatttaccgctgctacaacgtttctgctcttactttcccgaagggtttccgctgggaatcgaagtgcgtcatttggctttttttgcgaaaggagaggatgagaaacgcttgaatcaatggttaatggaaacaaagattgatcgcatcatcatggatagccgtccggttttcgcagccccagcaacaacggaggccgttatcgatgcgcaccagaaaaaaccaaaggtgcccgttcacgccatcgcgacgggagagcatccaatgattcgctttattggtcatcccgatttagagagcaacctgcccttctttgccccttggctgagcaaattacccctttggattaccgagggtaagcaaccttatttaatgatccacacaccagataacgtagaaggcccccagttagccaaacgactttaccaacaattacagcaacaagtgaaactacccaatctgtctgattttcctgccaatagtggcaatagccaaatacagatgttctaa

SEQ ID NO: 46375 - protein, 293 aa, Vibrio vulnificus CMCP6
MQRETMNTLPLRLGLTMWSHNQWQQDFYGSGTKPAERLEKYAQVFHTVEGNTTFYATPNTPTVLNWRAATHDDFRFTFKLPKQITHQQMLKGSQGLLREFLSVMEPLHPRIGQWTIQLPAAFSPEHLPLLQRFCSYFPEGFPLGIEVRHLAFFAKGEDEKRLNQWLMETKIDRIIMDSRPVFAAPATTEAVIDAHQKKPKVPVHAIATGEHPMIRFIGHPDLESNLPFFAPWLSKLPLWITEGKQPYLMIHTPDNVEGPQLAKRLYQQLQQQVKLPNLSDFPANSGNSQIQMF

SEQ ID NO: 46376 - DNA, 765 bp, Bradyrhizobium japonicum USDA 110
  CDS (1)..(765): transl_table=11
atgagcgccgtagccgtgccagggagtggtgggcgaggtcgggccaaagcagcgcccgcgctgcggatcggtacggccgggtggagcatcgataaacgctatgccgacggacttccagcgccaggaagtaatctcgaacgctatgcgcgacgtctaaacgccgtcgagatcaattcctcgttccgaagaaggcacaaaccaagcacatacgagcgctgggcgagttcggtgcctgaagagttcaggttctctgtgaagctcccggaagaaatcactcacgatcggggcctggtcggctgcgatgaaatcctgaaaatctttgcggctgaaactgcgggcttgggatcgaaactcgggacgtggctcattcagctgccgccgaagctcgcattcgacgcgaagacattcgacagcttcttcgacttggtcaatggatgcagcgatgccatggtcgcgatcgagccgcggaatgccacttggttcactgaggaagtcgaaagcagattgattgaacgacgcatcgcgcgggtggcagcggatcccgctagggtgctgggctccggagagcctggtggttggcgcggtctggcctatttccgttggcatgggtccccccgcatgtactattccgactacgaccgccaggcccttttctcactggggcggcgtctcgaaagcgctcgcctttggggagccgagacgtggtgcatcttcgacaatacggcggctggggccgcattgggaaatgctctggagatatcgtag

SEQ ID NO: 46377 - protein, 254 aa, Bradyrhizobium japonicum USDA 110
MSAVAVPGSGGRGRAKAAPALRIGTAGWSIDKRYADGLPAPGSNLERYARRLNAVEINSSFRRRHKPSTYERWASSVPEEFRFSVKLPEEITHDRGLVGCDEILKIFAAETAGLGSKLGTWLIQLPPKLAFDAKTFDSFFDLVNGCSDAMVAIEPRNATWFTEEVESRLIERRIARVAADPARVLGSGEPGGWRGLAYFRWHGSPRMYYSDYDRQALFSLGRRLESARLWGAETWCIFDNTAAGAALGNALEIS

SEQ ID NO: 46378 - DNA, 738 bp, Shewanella oneidensis MR-1
  CDS (1)..(738): transl_table=11
atggattcatatttcttaggagtcagtttggagtcacttaagtcactgccgcgccaaaccaatcatttgcgtcttgggcttgccatgtggtcacattaccattggcaagatagtgtttatggttcaacaaccaaacaagccgagcgccttgcccgttatgcaaccatttttaacacggtagaagggaataccagtttttacgctacgccaaatgcacaaactatgatgaactggctcagagctaccccagatgactttcgctttacctttaagctaccgcagacgatcacccatcaaaagcaactacagcattgtcagcaggagcttctgcaattctttcaagtcatgtcgcccttggcagaaaaaaccgggctatggaagatccaacttcccgcccatttcggcccagaaaacttgcctgcgttagcgcaatttctcaatcaagtcccccaagggttaacctatggcgtcgaagtcaggcatgctgcgttttttgccaagggagaggctgagcgagcgctaaaccgcttgctgatggataaacaggtgaaccgcatcattatggacagtcggccactgtttgctctgccacccgctaacgaggcgattatcgatacccataagaaaaaaccgcgggtgccagtgcatgcaatcgcgactgccaatacgcctgtggttcgctttatcgggcaacctgacgatgcatgcagttgcacaactcgcgcagcaaggcgttag

SEQ ID NO: 46379 - protein, 245 aa, Shewanella oneidensis MR-1
MDSYFLGVSLESLKSLPRQTNHLRLGLAMWSHYHWQDSVYGSTTKQAERLARYATIFNTVEGNTSFYATPNAQTMMNWLRATPDDFRFTFKLPQTITHQKQLQHCQQELLQFFQVMSPLAEKTGLWKIQLPAHFGPENLPALAQFLNQVPQGLTYGVEVRHAAFFAKGEAERALNRLLMDKQVNRIIMDSRPLFALPPANEAIIDTHKKKPRVPVHAIATANTPVVRFIGQPDDACSCTTRAARR

SEQ ID NO: 46380 - DNA, 843 bp, Lactobacillus plantarum WCFS1
  CDS (1)..(843): transl_table=11
atgataacaattggcttaacaacttggacggaacaccctagtttactgggtggtactgaaaagctgaccttaactgaatattcgggagtcctaccagtcgtcgaagtggacacgccattctatggtattccgaaagtgacgacggtcgcgaagtggcaaaaggccgtccctgataagtttcagtttattttgaaagcaaatcaggtgatgacgctgcatgacacttatgacgaaggggtttcgatggatgcgctaaagacagcttatcgggaataccgtgcgatgctcaaaccgttaacgcagcaccagcaattaaaagcggtgctcttccaatttccgccgttttttgaacggtcgaaccgcaacttccattacctacaacggatggtcgagtggttacccggtgttccaatcgcagtcgaatttcgtaaccagagttggtacgaggagagtgtcaaagatgcggtctttagttttctgaaggatctggggattacccatgtgattgtcgatgagccgcacgctttaaatgatggcgttagtttcgagccggtcgtaacgaattcgaaattggcactcttacgcttacatggtcgtaaccagcagggctggtcagccaagggcgctaactggcgtagccaacggactttatatcggtatagtgatcaagaactagctgaattcaagcaaacggtggaacagttacaacagcaggcggacgaggtttgcgtcatctttaataataattctggtggtgacgcggccgataacgcgatggcactcaaagagttgctaggcgtttcgtttggtgatttaggaccgcatcaactggacttgttttaa

SEQ ID NO: 46381 - protein, 280 aa, Lactobacillus plantarum WCFS1
MITIGLTTWTEHPSLLGGTEKLTLTEYSGVLPVVEVDTPFYGIPKVTTVAKWQKAVPDKFQFILKANQVMTLHDTYDEGVSMDALKTAYREYRAMLKPLTQHQQLKAVLFQFPPFFERSNRNFHYLQRMVEWLPGVPIAVEFRNQSWYEESVKDAVFSFLKDLGITHVIVDEPHALNDGVSFEPVVTNSKLALLRLHGRNQQGWSAKGANWRSQRTLYRYSDQELAEFKQTVEQLQQQADEVCVIFNNNSGGDAADNAMALKELLGVSFGDLGPHQLDLF

SEQ ID NO: 46382 - DNA, 870 bp, Pseudomonas syringae pv. tomato str. DC3000
  CDS (1)..(870): transl_table=11
ttgattgtgactcgcctgccttactacctcggttgtccgtcatggagtgaaaacgcctggcgcgattcgttgtaccccgaagatgcccgtcccactgattttctgagcctctacacgcaagtgttcaacgtcgttgaaggcaacaccaccttctatgcacggcccgctgccactactgttcagcgttgggcagaaacaatgcccgaagactttcgcttcacggccaaattccataaagacatcagccacaacggcgaccttcgtcaacaggtcggcgcggcagaagcattcattcgcctgctcgcaccattgggtggccggatcgcgccgttctggctgcaattgcccgccagcttcaccccacagcggcttgccgaactggtcggttttatcgacgagctgaacgtcccgctggcagtagaagtgcgcaacatggcgtttttcatgaagggtgacgaggagcgcatgctcaatcgcctgttgctggatcgaggtgtcgagcgcatctgtctcgattcgcgcgcactgtttaactgcgtgtccagcgaccccgccgtgcttcacgcccagtccaagaaacccaaggtgccgccacgcccagcggcgctgacctcattccctcaggttcgcttcatcggcggcccggacctggaggccaataacgagtttcttgtgcaatgggtggagaaggtcgccgtgtggattgaagagggccgtacgccctatgtgtttctgcacacccccgataacctcaaggcgcccgagcaggccagacgttttcacgagcaattgatgttgcgcttgcctgggttgccggcgttgcctgaactggatcgtgggccgcaggtggaacagttgggcttgctctga

SEQ ID NO: 46383 - protein, 289 aa, Pseudomonas syringae pv. tomato str. DC3000
MIVTRLPYYLGCPSWSENAWRDSLYPEDARPTDFLSLYTQVFNVVEGNTTFYARPAATTVQRWAETMPEDFRFTAKFHKDISHNGDLRQQVGAAEAFIRLLAPLGGRIAPFWLQLPASFTPQRLAELVGFIDELNVPLAVEVRNMAFFMKGDEERMLNRLLLDRGVERICLDSRALFNCVSSDPAVLHAQSKKPKVPPRPAALTSFPQVRFIGGPDLEANNEFLVQWVEKVAVWIEEGRTPYVFLHTPDNLKAPEQARRFHEQLMLRLPGLPALPELDRGPQVEQLGLL

SEQ ID NO: 46384 - DNA, 870 bp, Vibrio parahaemolyticus RIMD 2210633
  CDS (1)..(870): transl_table=11
atgatggataatttaccccttcgacttggtttaaccatgtggtctcacaaccaatggcaacaaagcttttacggtagtggaactaaacctgctgagcgtttagaaaaatacgctcaggtatttcatactgtggaaggaaataccaccttttacgccacgccgacacacaacacggtgcaaaattggaaagcggcaacgcacgacgattttaagtttacgtttaagctccctaaggctatcactcatgaacaaatgctaagaggctgcaacgagcaacttcgtgattttatgaaaatcatggagcccctgcatgagcgcgtcggtcaatggacgatccaactcccagcagcttttggcccagagtatcttgaacgtttgaaaaagttttgcgccagtttcccgcctaactttccactaggcgtagaagtacgtcatatggcctttttctctaaaggcgaggaagagcgagcgcttaatcagtggttggtggaaaacggtattgaccgaataatcatggatagccgccctgtgtttgcggcaaagcctgacaatgaagccatcattgatgctcaaatgaagaagcccaaagttcccgttcatgcgattgcaaccgcttcacacccgatgattcgttttattggccatccggaagaacaaaaaaattacgacttctttgtgccttggctaagtaaattgccacaatggattgcggaaggtaaacagccatatgtgatgattcacacagcagacaatattattgctcctgagctggcagcgaacatttacaagaatctgcaaaatcatgtcgccctgccagatttagcccccttccctgccaatgatggcaactcgcagttacagatgttctaa

SEQ ID NO: 46385 - protein, 289 aa, Vibrio parahaemolyticus RIMD 2210633
MMDNLPLRLGLTMWSHNQWQQSFYGSGTKPAERLEKYAQVFHTVEGNTTFYATPTHNTVQNWKAATHDDFKFTFKLPKAITHEQMLRGCNEQLRDFMKIMEPLHERVGQWTIQLPAAFGPEYLERLKKFCASFPPNFPLGVEVRHMAFFSKGEEERALNQWLVENGIDRIIMDSRPVFAAKPDNEAIIDAQMKKPKVPVHAIATASHPMIRFIGHPEEQKNYDFFVPWLSKLPQWIAEGKQPYVMIHTADNIIAPELAANIYKNLQNHVALPDLAPFPANDGNSQLQMF

SEQ ID NO: 46386 - DNA, 834 bp, Enterococcus faecalis V583
  CDS (1)..(834): transl_table=11
atgattcgcttaggattaacatcttttagtgaacacgactatttaactggaaaaaaacggtccacgctttatgaatatgccagtcatttaccgctagttgaaatggacacggcgtattacgggattcctcccaaagaacgagtagctgaatgggtcaaagcagttcccgaaaactttcgctttgtcatgaaagtttatagtggaatcagttgtcaaggtgagtggcagacctattatgcaagtgaagaagaaatgatcaccgcctttttagaaagtatggccccattaattgaaagtaaaaaattatttgcctttctggtacaattttcaggaacatttggttgtacgaaagaaaatgtcgcttacttgcaaaaaattcgtcactggtttaaagacctacccatcgccattgaattacgaaataattcatggtatcaaccaaactttgtaaaacaaatgttgcaatttatgaaagaaaatcaattttcacttgtgattgtagatgaaccgcagattcctacgaatccagtgcccttttatccttatgtaacgaatcctaatctcgtgctcttccggtttcacggacgtaatgcggctggctggttagccaatgatgcagagtggcgaaaaaaaagaaccctttatcattataatacgcaggaaatcgctgatttaagcgaagctgttttaaaaatgtcgcaagaagctaaagaagtgggcgtaatttttaataataattctggcggcgatgccgcagaaaacgctctacagatgcaaaaagtcttgaatttgagttacgatgatttgaatccaaaacaattagatttattttga

SEQ ID NO: 46387 - protein, 277 aa, Enterococcus faecalis V583
MIRLGLTSFSEHDYLTGKKRSTLYEYASHLPLVEMDTAYYGIPPKERVAEWVKAVPENFRFVMKVYSGISCQGEWQTYYASEEEMITAFLESMAPLIESKKLFAFLVQFSGTFGCTKENVAYLQKIRHWFKDLPIAIELRNNSWYQPNFVKQMLQFMKENQFSLVIVDEPQIPTNPVPFYPYVTNPNLVLFRFHGRNAAGWLANDAEWRKKRTLYHYNTQEIADLSEAVLKMSQEAKEVGVIFNNNSGGDAAENALQMQKVLNLSYDDLNPKQLDLF

SEQ ID NO: 46388 - DNA, 765 bp, Streptomyces avermitilis MA-4680
  CDS (1)..(765): transl_table=11
atgaccctgttcgtcggcacctcggggtggcagtacaaggactggctgggcgccttgtacccgcccgggtgtcccacgcggctctggctggaggagtacgcgacccgtttcgccacggtcgagatcaacaacgccttctaccggctgccgtcgcggggcaccttcgagacctggcgggagcgcaccccgccggacttcgtggtcgccgtgaaggcgagccggtatctgacccacatcaagcggctgcgggaccccgaggagccggtccaccgcctgatgacccacgccgccggcctcggcgaccgcctgggcccggtacttgtccagcttccgcccacgctgcgtgccgaccccggtctgctggacgcctgtctcgcctgtttcccgtccggcacccggatcgcggtcgaaccgcgccacgactcctggtgggcaccggcggtgcgcgaggtgctcgaagcgcggggcgccgccctgtgctgggccgatgtcctgtcccggcccgccaccccgctgtggcgcaccgccgactgggggtacgtccgcttccacgagggccgcgcccgcaggtggccgcgctacggccgccaggccctggtgacctgggcgcggcgcatcgccgagacctggcccgacgatcacgaggtctacgcgtacttcaacaacgacccgcatgcggcggcggtcgaggacgcggcggtgttcgcccgggtggcgaaggcgacgggcctgacggtcacccgtactccgggcggtgacgaatga

SEQ ID NO: 46389 - protein, 254 aa, Streptomyces avermitilis MA-4680
MTLFVGTSGWQYKDWLGALYPPGCPTRLWLEEYATRFATVEINNAFYRLPSRGTFETWRERTPPDFVVAVKASRYLTHIKRLRDPEEPVHRLMTHAAGLGDRLGPVLVQLPPTLRADPGLLDACLACFPSGTRIAVEPRHDSWWAPAVREVLEARGAALCWADVLSRPATPLWRTADWGYVRFHEGRARRWPRYGRQALVTWARRIAETWPDDHEVYAYFNNDPHAAAVEDAAVFARVAKATGLTVTRTPGGDE

SEQ ID NO: 46390 - DNA, 924 bp, Rhodopirellula baltica SH 1
  CDS (1)..(924): transl_table=11
atgccgcctgaatctcgccgcgtgaaacagcccaacgaaacattttcgtcaccatcttggccgatgtcgattggtgctccagtttggtcctgcgacggatggggtgacgtggtctatcccaaaaagacacctcgaaccgagtggctttcgtggtacacgcgttcgttcaacacggtcgagggaaacagcacgttttatgcggtccccggcgagcagacttttcgcggttgggccgagcaagcggccgatggttttgagttctgcttcaaattcccgaagcgaatttcgcacgacagcatgctgcagcactgcgatgacgaggtgcgagagtttttggttcgattgcgcgtgattgccaaggagaatcgtttggggccgacgtttttgcagctcgggccgaactttggtccggatcgattgcctattctggcgaagttcctccgccgtttgccacgagaattgccgtgggcggtggagcttcggcatcacgattggtttgattcagcggacaatgaggctcgcgtgaatgatctgctgcgggacttgcagatcgacaaggtcacgtttgacagtcggccgctgtttcaatcgccgcccgatgatgccatcgaggaaaagtcgcaggcaagaaagccgcgtaccccggttcgccaaacggtcaccgccaaacgtccgatgctacgaattgtcgggcggaatcgggtggagcttgccgaagcgttcttggaccaatgggtgccaattgtggttggctggttggctcaaggactgcgaccaattgtgttcacgcacacgccggacgatcgtttggctccgctgtttgcggaattgctgctttcaaaaatgtccgatgcgatgccgggtgtggactttaccctgccccgccctccacaatctcctgaacagttgtcgcttctggattga

SEQ ID NO: 46391 - protein, 307 aa, Rhodopirellula baltica SH 1
MPPESRRVKQPNETFSSPSWPMSIGAPVWSCDGWGDVVYPKKTPRTEWLSWYTRSFNTVEGNSTFYAVPGEQTFRGWAEQAADGFEFCFKFPKRISHDSMLQHCDDEVREFLVRLRVIAKENRLGPTFLQLGPNFGPDRLPILAKFLRRLPRELPWAVELRHHDWFDSADNEARVNDLLRDLQIDKVTFDSRPLFQSPPDDAIEEKSQARKPRTPVRQTVTAKRPMLRIVGRNRVELAEAFLDQWVPIVVGWLAQGLRPIVFTHTPDDRLAPLFAELLLSKMSDAMPGVDFTLPRPPQSPEQLSLLD

SEQ ID NO: 46392 - DNA, 876 bp, Gloeobacter violaceus PCC 7421
  CDS (1)..(876): transl_table=11
atggcttcgatgtccgaggacacactcatttacgtcggctgccagggctggcgctacccggattggcggttggcttctgcggaagcggtgggcgatctgagtgccccgttctacccgcccaggctgcccgccgcccgcgaactgaagcattacgcccgcacattcgatctggtggaggttgattcgaccttttatgcggttcctcagattcgggtggtcaagaactgggcgacccaggtgcctgagacctttcgctttaccctgaagttgccccgcacccttacccacgagtaccgtcttgcgcggggaagggcgaccctttcggccttttgtgaatgcgcccgccccttgggagtccaattggcagctattctcatccagttgcctccgtcatttgcaacggacgaatttgcggcgctggagcgctttttgccccatctgcccgcggatttgccttttgccgttgaatttcgcgatcctgcctggctcagtgagcgcacggtcgaactgctggcggcccaccggatcgccctgaccctcggggataccccctggataccgacaccactggcgctcgcctggctcgacaggctacctaccgactggctctatctacggctgatgggatccaaatccaacggtctggagcactttacccaccggcaattcgaccgcacggacaccctcgatgcgtgggcggcggccgtttggcgcctggcggaaggcggcaaacgtgtctatgtgctgcttgacaaccatttcgaaggtttctcgccggggtcggcgacgctgcttgtgcgcaaattggggctggcagagcgcccctttccccacgactgccctgccgaaagcgagcaactcggcctcgaatggtag

SEQ ID NO: 46393 - protein, 291 aa, Gloeobacter violaceus PCC 7421
MASMSEDTLIYVGCQGWRYPDWRLASAEAVGDLSAPFYPPRLPAARELKHYARTFDLVEVDSTFYAVPQIRVVKNWATQVPETFRFTLKLPRTLTHEYRLARGRATLSAFCECARPLGVQLAAILIQLPPSFATDEFAALERFLPHLPADLPFAVEFRDPAWLSERTVELLAAHRIALTLGDTPWIPTPLALAWLDRLPTDWLYLRLMGSKSNGLEHFTHRQFDRTDTLDAWAAAVWRLAEGGKRVYVLLDNHFEGFSPGSATLLVRKLGLAERPFPHDCPAESEQLGLEW

SEQ ID NO: 46394 - DNA, 882 bp, Vibrio vulnificus YJ016
  CDS (1)..(882): transl_table=11
atgcagcgagaaaccatgaacacgcttcctcttcgattgggtctgaccatgtggtcacacaatcagtggcaacaagacttttatggctcggggaccaaacccgcagagcgactggaaaagtacgcacaggtctttcacactgtcgaaggcaatacgaccttctacgcgacgccaaacacaccaaccgtactcaactggcgcgcgaccacgcatgacgattttcgtttcacctttaagttgccaaagcagattacccatcagcagatgcttaaaggctctcagggtttgttacgcgagtttttgagtgtcatggaaccgctgcacccgcgtattggccaatggacaatccaacttcccgcggctttttcaccagagcatttaccgctgctacaacgtttctgctcttactttcccgaaggttttccgctgggaattgaagtgcgtcatttggctttttttgcgaaaggagaggatgagaaacgcttgaatcaatggttaatggaaaccaagattgatcgcatcatcatggatagccgtccggttttcgctgccccagcaacaacggaggccgttatcgatgcccaccagaaaaagccaagggtgcccgttcacgccatcgcgacgggagagcatccaatgattcgctttattggtcatcccgatttagagagcaacctgcccttctttgccccttggctgagcaaattacccctttggattgccgagggtaagcaaccttatttaatgatccacacaccagataacgtagaaggcccccaattagccaaacaactttaccaacaattacagcaacaagtgaaactgcccaatctgtctgattttcctgccaatagtggcaatagccaaatacagatgttctaa

SEQ ID NO: 46395 - protein, 293 aa, Vibrio vulnificus YJ016
MQRETMNTLPLRLGLTMWSHNQWQQDFYGSGTKPAERLEKYAQVFHTVEGNTTFYATPNTPTVLNWRATTHDDFRFTFKLPKQITHQQMLKGSQGLLREFLSVMEPLHPRIGQWTIQLPAAFSPEHLPLLQRFCSYFPEGFPLGIEVRHLAFFAKGEDEKRLNQWLMETKIDRIIMDSRPVFAAPATTEAVIDAHQKKPRVPVHAIATGEHPMIRFIGHPDLESNLPFFAPWLSKLPLWIAEGKQPYLMIHTPDNVEGPQLAKQLYQQLQQQVKLPNLSDFPANSGNSQIQMF

SEQ ID NO: 46396 - DNA, 726 bp, Mycobacterium avium subsp. paratuberculosis K-10
  CDS (1)..(726): transl_table=11
gtgaccgtgcgcatcggtacctccgggtggtcgtatgaccactgggcggatgtgctgtacccgccgggaacgccgtcggcgcgccggctggcccgctacatcgaggtgttcgacaccgtcgagttgaacgccagtttctaccgctggcccaaggattcgacgttcgcggggtggcgcgagcagttgccggacggcttcaccatgtcggtcaaggcgcaccgcggactcacccactaccgccggctggcctcccccgagccgtggatcgaacggttcgagcggtgctgggagttgctgggcgatcggcgcggcgtgctgctggtgcagttgcatcccgagcagcagcgcgacgatgcccgcctggattccttcttggagcgcatgcccgcgtccatccgggtcgccgtcgaactgcgccacccgtcgtggaacgaccccgcggtgtatgcgctgctggagcgccgccgtgcggcgtacgcggtgacgagcggccttgggctggcgtgcatcccgcgtgcgacgaccgacctggtctacgtccggatgcacggaccggacccggccgccaactatgccggctcgtactccgacgacgacttgcggtgctgggccgagcggatcaccgcctgggacggtgacggaaaggacgtgtggatgtatttcaacaacgacctgggcggccacgcggtacgcaacgcgctcgcgctgcgcgagctggtgggttga

SEQ ID NO: 46397 - protein, 241 aa, Mycobacterium avium subsp. paratuberculosis K-10
MTVRIGTSGWSYDHWADVLYPPGTPSARRLARYIEVFDTVELNASFYRWPKDSTFAGWREQLPDGFTMSVKAHRGLTHYRRLASPEPWIERFERCWELLGDRRGVLLVQLHPEQQRDDARLDSFLERMPASIRVAVELRHPSWNDPAVYALLERRRAAYAVTSGLGLACIPRATTDLVYVRMHGPDPAANYAGSYSDDDLRCWAERITAWDGDGKDVWMYFNNDLGGHAVRNALALRELVG

SEQ ID NO: 46398 - DNA, 843 bp, Listeria monocytogenes str. 4b F2365
  CDS (1)..(843): transl_table=11
atggtaacaatcgggttaactgggtggagtgatcatgattctttattacaatcaaaaaaattaacattggctgattatgcggcacattttcctgtggtggaggttgatacgagtttttatgcgattccttctccacgaacaacggcaaactgggcggcacaaactccggatgaatttcgttttgtgattaaagcattttcggcgatgacgaaacataaggaatggtcgcagtattttgatagtgaaaatgcgatgtacacggcttatatggatatgattgcaccgataagtgaaacggggaaactacaggcaattttatttcaatttccgccgtattttaattgtacgaaagaaaatgtgatttatttaaaatatattgcttcgaaaatgggtgatttaccggtggcgattgaatttcgccataattcttggtataacgagcaaaacaccgagaaaacactggagttgctgcgagaattaggttttattcatacagtcgttgatgaaccgcaagttggttctgggagcgtgccgattgtgctgcgtgagacgaatagcgatatgacattagtgcggcttcacggccggaatcagtatggttggatgaaagcaagcagtccagaatggcgcgaagttcggacactttaccgttataatgaggaagaaattaacgaatgggcaaaatatgtggaacatttacaaaaattgtccaaagaagttgtcgtgatttttaataataacagcggcggggatgcggctgataatgcgaaacatttacaaaaggcgttacaagttgagtttcaaggcttggctccgatgcaaatggatttgttttcagaataa

SEQ ID NO: 46399 - protein, 280 aa, Listeria monocytogenes str. 4b F2365
MVTIGLTGWSDHDSLLQSKKLTLADYAAHFPVVEVDTSFYAIPSPRTTANWAAQTPDEFRFVIKAFSAMTKHKEWSQYFDSENAMYTAYMDMIAPISETGKLQAILFQFPPYFNCTKENVIYLKYIASKMGDLPVAIEFRHNSWYNEQNTEKTLELLRELGFIHTVVDEPQVGSGSVPIVLRETNSDMTLVRLHGRNQYGWMKASSPEWREVRTLYRYNEEEINEWAKYVEHLQKLSKEVVVIFNNNSGGDAADNAKHLQKALQVEFQGLAPMQMDLFSE

SEQ ID NO: 46400 - DNA, 816 bp, Yersinia pseudotuberculosis IP 32953
  CDS (1)..(816): transl_table=11
atgtatatcggactgccgcaatggcaacacccggcctggggccgactgggtcttcgagacttggcggactatagccgctattttaattgcgttgagggtaataccaccttttatgcattgccacggccagaaattgtgctgcgctggcgtgatatgacaccggacagtttccgtttctgctttaaattccccgccacaatcagccatcaggcggctctgcgtgactgtgataaagaactacaggctttttatcattgcctggctccgctgaatgatcgcattggtcaactgtggttacaactgcctgccgcctttgggccaaatgaattggaccgtttgtggcagtttatcgataagttacccgctggttttcattatggcgtggaagtccgacacccagagttttttgccaaaggtgccgcagaattagcccttaatcaagggttacatcagcgttcaattaatcgggtgatgctcgatagccgccctattcacgccgccaagcctttaaccgccgccgttcgtgatgctcaaagtaagaaaccccgtttgccagtacatgctgtcgtcactggcggccaacctttagtgcgctttattggtggcgaccaattggatgacaacttggccctgtttgcaccctggctacaaaaactgcctttatgggaacagcaccatcaaccctacgtttttattcacacgcccgataacagcgattcaccacagcaagctcaaaaaatttggcaaaagttggcagaagccatcccgacattgcccaccgcacccgattggccagagcaagagacactcttttag

SEQ ID NO: 46401 - protein, 271 aa, Yersinia pseudotuberculosis IP 32953
MYIGLPQWQHPAWGRLGLRDLADYSRYFNCVEGNTTFYALPRPEIVLRWRDMTPDSFRFCFKFPATISHQAALRDCDKELQAFYHCLAPLNDRIGQLWLQLPAAFGPNELDRLWQFIDKLPAGFHYGVEVRHPEFFAKGAAELALNQGLHQRSINRVMLDSRPIHAAKPLTAAVRDAQSKKPRLPVHAVVTGGQPLVRFIGGDQLDDNLALFAPWLQKLPLWEQHHQPYVFIHTPDNSDSPQQAQKIWQKLAEAIPTLPTAPDWPEQETLF

SEQ ID NO: 46402 - DNA, 840 bp, Nocardia farcinica IFM 10152
  CDS (1)..(840): transl_table=11
atgcggcttcacgtgggatgtgcgatgtggacgcatccggcgtggcaggaccggcagatgccctcggcccagcggctgcggtggtacgccgagcgctgcgacgccgtcgagggcaatacgaccttctacgcgattccgtcgccgggcaccgtgcgctcctgggcacagcagaccggcccggacttccggttcgtggccaagctaccgcgcgcgatcacccacgagcgcaggctgaccggggccgccgccgagctgggcgcgttcctcgacgtgctggcgccgctcgggccgcgcctgcacacggtgtggattcagttgcccgcgtcgttcgggcccaccgatctcggcgcgctggccgcgttcctgcgtacgctcccggccggtccgtgccgcgcggtcgaggtgcgccatcgcgccttcttcgacgacgaacgcgccgcggcggcgctcgagcgggtgctcgaccgggcgggcgcggagtggacgatcttcgacaccaccgtcctgttcggcgcaccgccgcgcggccccgccgagcaggaggcgtgggcgaagaagccgcgggtgccccggcgcacccgggcactgaccgcgcacccgatggtgcgctaccacggccgcgacgatcccgccgagaccgtggcgggctggcagccgtggctgcccgtcgtggcgggctggctgcgcgagggccgttcaccgacggtgttcgtgcacacccccgacaacgcgggcgctctcgacctggcccggcgcttccacaccgaggtgcgcgcgctggtgccggagttggacccgctacccgaaccggtcgactccgagcctatgacgctgttctga

SEQ ID NO: 46403 - protein, 279 aa, Nocardia farcinica IFM 10152
MRLHVGCAMWTHPAWQDRQMPSAQRLRWYAERCDAVEGNTTFYAIPSPGTVRSWAQQTGPDFRFVAKLPRAITHERRLTGAAAELGAFLDVLAPLGPRLHTVWIQLPASFGPTDLGALAAFLRTLPAGPCRAVEVRHRAFFDDERAAAALERVLDRAGAEWTIFDTTVLFGAPPRGPAEQEAWAKKPRVPRRTRALTAHPMVRYHGRDDPAETVAGWQPWLPVVAGWLREGRSPTVFVHTPDNAGALDLARRFHTEVRALVPELDPLPEPVDSEPMTLF

SEQ ID NO: 46404 - DNA, 906 bp, Nocardia farcinica IFM 10152
  CDS (1)..(906): transl_table=11
gtgagtctacgacccaccgtccccgcgcccgcaccggaccggtggcgaaccgcccgcgtcccaccgaggaccggccgcgactgcgacgatggaggcatgggcgagatccggatcgggacatcgggctggcggtatccaccgtggcggggcgtgttctacccgccgggcctgccgcaccggcgggagttggcgtacctcgccgagcagctgaccagcgtggagatcaacgggtcgttctactcgctacagcgaccgtcgagctatctgaactgggcggcgcagacaccgcccggcttcgtcttcgccgtcaagggcagcagattcatcacgcacatgaagcggctgcgcgacggcgacgagtccctggccaacttcctcgcctccggcgtcctcgccctcggccccaaactcgggcccatcctctggcagctgccgcccacgttccgctacgaccccgacgtgctggccgcgttcttcgaccggctgccgcgcaccaccgcgcgggccgccgagatcgccgcggggcacgaccaccgcgtccgggagccgcacatcaccgtcgacgccgaccggccgatccggcacgcgctcgagatccggcacccgagcttcctgacaccggagttcaccgacctgctgcgcgccgacgacatcgccctggtgatcgccgacgcggccggcaagtacccgctgatcgaggaggtcaccaccgatttcgtctacatccgcctgcacgggcacgacgagctctacgtcagcgggtacaccgacgacggactggacatgtgggcgagcaagattcgacagtgggcgcgcaccggcgacgtgtacgtgtacttcgacaacgacgccaaggtgatggcgccccgggacgccctcgcgctgcgggaaagggtcgaccgatga

SEQ ID NO: 46405 - protein, 301 aa, Nocardia farcinica IFM 10152
MSLRPTVPAPAPDRWRTARVPPRTGRDCDDGGMGEIRIGTSGWRYPPWRGVFYPPGLPHRRELAYLAEQLTSVEINGSFYSLQRPSSYLNWAAQTPPGFVFAVKGSRFITHMKRLRDGDESLANFLASGVLALGPKLGPILWQLPPTFRYDPDVLAAFFDRLPRTTARAAEIAAGHDHRVREPHITVDADRPIRHALEIRHPSFLTPEFTDLLRADDIALVIADAAGKYPLIEEVTTDFVYIRLHGHDELYVSGYTDDGLDMWASKIRQWARTGDVYVYFDNDAKVMAPRDALALRERVDR

SEQ ID NO: 46406 - DNA, 891 bp, Photobacterium profundum SS9
  CDS (1)..(891): transl_table=11
atgacaattccaactaataggcctctttttctcggcctagctatgtggtctcataaccaatggcagaaaagtttatacggctctggatgtaaaaatagtgatcgtttagcgcgatacgcagaggtatttaatactgtcgagggtaacaccactttttatgcaacgcctgcaattaccacggtaaaaaaatggcatgatgcaaccccgagtgattttcgttttacctttaaattacccagcaccattactcatcaaaatcagctaatgcattgcgatcaacttttagcggattttttaaatgtgatggcccccctggaaagtaaagtggggttatggaaaattcaattacctgccaattttggtcctgatgcattacccgcactcaaaaagtttctacaaaagatccctaaacaccttacttatggtgttgaagtgaggcattacgccttctttaataaaggcgacgctgaaaaaaccttaaatggattgctggtcgagcaccaagccaaccgtattattatggatagccgcccagtgtttgccgccccaccgacctctgaagcggtgattgacgcccatcaaaaaaaaccacatgtacccgtgcatgccattgcaacggctacgcaaccaatgatccgctttattggtcaccctgaagatttaagtaacgaccctttctttgataactggctaacccgattacccaagtggatggcagatggaaaacaaccgtatttattcattcatacacccgacaatgtttttgcaccagagttagccattcgtttatatcaaaaattacaacaacgtattgcgaacagtacattatcattacctgatattgcgcttcctcctgaaccagaagcaagccctcaaattacattactctag

SEQ ID NO: 46407 - protein, 296 aa, Photobacterium profundum SS9
MTIPTNRPLFLGLAMWSHNQWQKSLYGSGCKNSDRLARYAEVFNTVEGNTTFYATPAITTVKKWHDATPSDFRFTFKLPSTITHQNQLMHCDQLLADFLNVMAPLESKVGLWKIQLPANFGPDALPALKKFLQKIPKHLTYGVEVRHYAFFNKGDAEKTLNGLLVEHQANRIIMDSRPVFAAPPTSEAVIDAHQKKPHVPVHAIATATQPMIRFIGHPEDLSNDPFFDNWLTRLPKWMADGKQPYLFIHTPDNVFAPELAIRLYQKLQQRIANSTLSLPDIALPPEPEASPQITLL

SEQ ID NO: 46408 - DNA, 819 bp, Salmonella enterica subsp. enterica serovar Paratyphi A str. ATCC
  CDS (1)..(819): transl_table=11
atgatctacattggcttgccgcaatggtcgcacccgaaatgggcgcggctcggcatcaccagtctggaagagtatgcccgccactttaactgcgtggagggcaacaccacgctttacgcgctgccgaaagcggaaattgtcgatcgctggtatgcgcaaactacggacgatttccgtttttgctttaaatttcccgccaccatttctcaccaggccgctctgcgccattgcgacgatctggtacaggcgttttttacccgcctggcgccgctggaaacgcgtattggccaatactggctgcagttgcccgccgcctttggaccgcgcgatctccccgccttatggcagtttcttgatgcgctccccgccacgtttacctatggcgtagaagttcgtcatccgtgtttttttgacaagggtgaggatgaacagcggctcaatcgcgggttacacgcgcgcggcgtaaaccgcgtgatcctggatagtcgtccggtacatgccgcccatccccacagcgaggccgtccgtgacgcgcagcgaaaaaaacccaaagtcccggtacatgcggtcgtgacggccagccatccgatggtgcgttttatcggtagcgataatatggcgcaaaaccgtgagtttttcgctgcctggttgcagaaactcccgcagtggcggcagaccaccacgccttttctgtttttacatactccggatatcgcgcaggcgccggaactggtgaatacgctttggcatgatttacgcagcgtcttaccggaaatcggcactgctccgtccattccacagcaatcttctcttttctga

SEQ ID NO: 46409 - protein, 272 aa, Salmonella enterica subsp. enterica serovar Paratyphi A str. ATCC
MIYIGLPQWSHPKWARLGITSLEEYARHFNCVEGNTTLYALPKAEIVDRWYAQTTDDFRFCFKFPATISHQAALRHCDDLVQAFFTRLAPLETRIGQYWLQLPAAFGPRDLPALWQFLDALPATFTYGVEVRHPCFFDKGEDEQRLNRGLHARGVNRVILDSRPVHAAHPHSEAVRDAQRKKPKVPVHAVVTASHPMVRFIGSDNMAQNREFFAAWLQKLPQWRQTTTPFLFLHTPDIAQAPELVNTLWHDLRSVLPEIGTAPSIPQQSSLF

SEQ ID NO: 46410 - DNA, 873 bp, Synechococcus elongatus PCC 6301
  CDS (1)..(873): transl_table=11
atgcctagtcctgtgactgatcgattttggttgggctgtgctgtgtgggcctatcgcaactgggtcggttccttctatcccccaggaacaggtagtgatgcattcctgcgctgctacggcgaacgcctgacggcggtggaaggcaacaccactttctactcgattccctcgaccgaaactgtccaacgctggcgtcaagaaacgcccgatcgcttccgcttctgtctgaagttgccgcgatcgctcagccatgccggtcccttggccgcccaaattgaagccgcggcggctttccgtcggcaactgcaacccctgggtgatcgcctcggccctgcctttctgcaactgccgccccgctatggtcccggtgcgatcgccgatctctcccagtttctggctgcttggccggtagttcaatggcccttggccgttgaaccccgtcatcccgactggttccagccccagccgcgtcaagcgctcaatcaattgttgcaacgctatggctgtggccgagtcctgctcgatacccgtcctgtttataacggtgtagatgatccccaagtgacgagtgatcgccgcaaacctcagctaccgctgcatccagatgtgatcggagagtacgccttagtgcgcttcatcagccatcccgatcgcgatcgtaatccggcttacctcgcggaatggcaggagcggatccgccactggctcgcgcagggaatcacggtctatttctttgtccactgcccccaagaaatttactcgcctgccactgcgatcgccttccaagcgcagctagagagggctgggatccccatcctgtctctcccgactccaccggctcctgcccaacagcagttgagcctcttctcctga

SEQ ID NO: 46411 - protein, 290 aa, Synechococcus elongatus PCC 6301
MPSPVTDRFWLGCAVWAYRNWVGSFYPPGTGSDAFLRCYGERLTAVEGNTTFYSIPSTETVQRWRQETPDRFRFCLKLPRSLSHAGPLAAQIEAAAAFRRQLQPLGDRLGPAFLQLPPRYGPGAIADLSQFLAAWPVVQWPLAVEPRHPDWFQPQPRQALNQLLQRYGCGRVLLDTRPVYNGVDDPQVTSDRRKPQLPLHPDVIGEYALVRFISHPDRDRNPAYLAEWQERIRHWLAQGITVYFFVHCPQEIYSPATAIAFQAQLERAGIPILSLPTPPAPAQQQLSLFS

SEQ ID NO: 46412 - DNA, 852 bp, Bacillus clausii KSM-K16
  CDS (1)..(852): transl_table=11
gtgatttacataggtttaagcggctggggtgaccatcatcgcttatacgaaggcgtaaagccagcagagaagttgcaaacgtatgcgggctattttccgattgtggagttggatgcctcgttttatgccgttccaccccaatcgtcgatccgaaaatggttagacgagacgccggcatcctttcagtttgttgtcaaagcgtatcaggaaataacaggacatcagcggggagagtcgccttctccttttcaatcgaagcaagagatgttttctgcatttatagaatcaatccaaccgatggcggaagcaggcaaactagcgatggttttatgccagtttcccccttggtttgatgttcagaaaaaacacgttgcttggcttcgtgtagtgcgcgaacagttgaaagattttccggtcgcgcttgaattcaggcatgaatcgtggtttctgcctgcttaccgtgagaaaacgctcgcgttgatgcgcgaggaaaattggattcacagcatttgtgatgaaccgcaagccggggcacgctcgattccaactgtgctcgagccaaccgaccgccaaaagacattggttcgtatgcatggacgcaatgtccatggttggaatgggccgagcaaagggcaagaatggcgtgatgttcgttatttgtatgattacaacgaacgggagcttgctgaatggaaaacgcgccttcagtcgctgcgacaacaatgtgagcacatttatgtggtttttaacaacaattctggcggtcatgccgcccaaaacgctcgcgcgttgatcgagatgatgggcatcgaatatacggacctggcgccaagacagttggatttattttaa

SEQ ID NO: 46413 - protein, 283 aa, Bacillus clausii KSM-K16
MIYIGLSGWGDHHRLYEGVKPAEKLQTYAGYFPIVELDASFYAVPPQSSIRKWLDETPASFQFVVKAYQEITGHQRGESPSPFQSKQEMFSAFIESIQPMAEAGKLAMVLCQFPPWFDVQKKHVAWLRVVREQLKDFPVALEFRHESWFLPAYREKTLALMREENWIHSICDEPQAGARSIPTVLEPTDRQKTLVRMHGRNVHGWNGPSKGQEWRDVRYLYDYNERELAEWKTRLQSLRQQCEHIYVVFNNNSGGHAAQNARALIEMMGIEYTDLAPRQLDLF

SEQ ID NO: 46414 - DNA, 852 bp, Xanthomonas oryzae pv. oryzae KACC10331
  CDS (1)..(852): transl_table=11
gtgatcgtgatgcacacgacatcctggcgcgcgtacctgcatggagtgctgccatcctcgcctcgcctgcccgctcgcccatccagtgcagttgcacgcgtgcgttgtggttgcgcaggcgggtccatgtccgccgccgaccacgcgcaggtcggccagggcgccagcgtgttgcagcgctacgccacgcgcgtcgatgcagtggaaatcaactcctcgttttatcgtccgcatcgcgccagcacctacgcgcgctgggccgacagcgtgctggaggatgttcgtttttcggtcaagctgccgcgcagtatcagccacgacgcgtggctgcacggcaccgggccgctgctggatgctttcctcgcgcaggtcggtgcactggggacgcggttgggctgcctgttgctgcaactgccacccagcgctgtcttcgatgcagcggtggcagccagattccttgcgatgctgcgccggcgctgggatgacggcgtggtctgcgagcggcgccacgcgagctggtttgccgcgcccgcacaggccctgctggaacgccaccgcattgctcgctgcgccgccgacccggcgccgttgtccgcggctgccatcccgcgcccggttgccgcgccgtcgtatcggcgctggcatgacgcgccgcgcatctactaccgcagctacgacgagaccgcgttgcaggcgttggccgctgcggtgcgcgccggcccacccagcaacgcgcagccgctggccgaacgctgggtgatcttcgacaacagcgcggccggctgcgcgacatccaatgcgctggaattgcagcgcttgctgggcatcgagcgcaagcgccaacgcgggtag

SEQ ID NO: 46415 - protein, 283 aa, Xanthomonas oryzae pv. oryzae KACC10331
MIVMHTTSWRAYLHGVLPSSPRLPARPSSAVARVRCGCAGGSMSAADHAQVGQGASVLQRYATRVDAVEINSSFYRPHRASTYARWADSVLEDVRFSVKLPRSISHDAWLHGTGPLLDAFLAQVGALGTRLGCLLLQLPPSAVFDAAVAARFLAMLRRRWDDGVVCERRHASWFAAPAQALLERHRIARCAADPAPLSAAAIPRPVAAPSYRRWHDAPRIYYRSYDETALQALAAAVRAGPPSNAQPLAERWVIFDNSAAGCATSNALELQRLLGIERKRQRG

SEQ ID NO: 46416 - DNA, 864 bp, Pseudomonas syringae pv. syringae B728a
  CDS (1)..(864): transl_table=11
gtgtctcgtctgccttactacctcggttgtccgtcatggagtgaaaacgcctggcgcgattcgctgtaccccgaaaatgcccgccccaatgatttcctgaacctctacactcaggtgttcaacgctgtcgaaggcaacaccacgttctatgcccgtcccgccgccactacggtgcagcgctgggcagaaataatgcccgacgattttcgcttcaccgccaaattccataaagacatcagtcacaacggcgaccttcgtgagcaggtgggcgccgctgaggaattcattcgcctgctcgcgcctctgggcgggcggatcgcgccgttctggctgcagttgccggccagcttcacgcccccgcgtctggccgagctggccggttttcttgacgagctcaaggtgtctgtagcagtggaagtgcgcaacatggctttcttcatgaaaggtgacgaagagcgcatgctcaatcgcctgttgctggatcgaggcgtcgagcgcatctgccttgattcgcgggcattgttcagctgtgtctcgagtgatcctgcagtcctgcacgcccaatcgaaaaagcccaaggtgccgcctcgtccggcttcgctgacgctgtttcctcaagtgcgcttcatcggcggtccggaccttgaggccaacgatcagtttctgctgcagtgggtggaaaaggtcgccgtgtggattgaagaggggcgcacgccgtatgtcttcctgcacactccggacaacatcagggctgccgagcaggccatgcgctttcaccagcaactgatggcgcgattgccgggcttgccggcattgttcgaactggatcgcgggcctcaggtggaacagttgggcttgctctga

SEQ ID NO: 46417 - protein, 287 aa, Pseudomonas syringae pv. syringae B728a
MSRLPYYLGCPSWSENAWRDSLYPENARPNDFLNLYTQVFNAVEGNTTFYARPAATTVQRWAEIMPDDFRFTAKFHKDISHNGDLREQVGAAEEFIRLLAPLGGRIAPFWLQLPASFTPPRLAELAGFLDELKVSVAVEVRNMAFFMKGDEERMLNRLLLDRGVERICLDSRALFSCVSSDPAVLHAQSKKPKVPPRPASLTLFPQVRFIGGPDLEANDQFLLQWVEKVAVWIEEGRTPYVFLHTPDNIRAAEQAMRFHQQLMARLPGLPALFELDRGPQVEQLGLL

SEQ ID NO: 46418 - DNA, 735 bp, Pseudomonas syringae pv. syringae B728a
  CDS (1)..(735): transl_table=11
atgccgccagtttatatcggttgtgcaggctggagccttgcgcgtgagtactggcccgactttcctgaacaaggcagccatttgcaacgctatgcttcgcgcttcaacgcggtcgagatcaacagctcgttctatcgccctcatcgcgctcagacctacgcacgctgggcgcaggcggtgcccgccgggtttcgcttctcggtcaagatgccgaaactcattacccacgaacaccgactgcgcgagtgcgagaccgttctgaccacgttcctttctcaatgcactgcgctgggtgacaaactgggctgtctgctggtccagcttccgccctctctggactatgcaccgcaggtagctgagaggtttttcagagcattacgcaatcagtacgccggcagcgtggtattggaaccgcgccatgaatcctggcggcaggctcaggcgctgctgatcgagcatcgcattgcgcaggtagccgccgatccgtcagtaatcagtgaagggcacttgcccggtgggtggcagggtgctcactactggcgcctgcacggtgcgccgaaaatttatcacagtgcctattccgtcgagcatctggaaggtttggctgggcgagcgtcggcgtctgtggcgcgggaaatcgagacctggtgcatctttgacaatacggccagcggagccgccgtccgtgacgcgctcgcgctgcaggcactggttgagcgcaacagggctgggtaa

SEQ ID NO: 46419 - protein, 244 aa, Pseudomonas syringae pv. syringae B728a
MPPVYIGCAGWSLAREYWPDFPEQGSHLQRYASRFNAVEINSSFYRPHRAQTYARWAQAVPAGFRFSVKMPKLITHEHRLRECETVLTTFLSQCTALGDKLGCLLVQLPPSLDYAPQVAERFFRALRNQYAGSVVLEPRHESWRQAQALLIEHRIAQVAADPSVISEGHLPGGWQGAHYWRLHGAPKIYHSAYSVEHLEGLAGRASASVAREIETWCIFDNTASGAAVRDALALQALVERNRAG

SEQ ID NO: 46420 - DNA, 792 bp, Xanthomonas campestris pv. campestris str. 8004
  CDS (1)..(792): transl_table=11
gtgtccacctccgcaccgcccccgcagcccgctgccaccgccctgccacgggtgtattgcggctgcgcgggctggtcgattcccgcagccgagcgcgcacagttcggcgccggcagcagcgtgctgcagcgctatgccacgcgcctgaatgcagtggagatcaactcctcgttctatcgcccgcatcgcacgtcgacctacgcgcgttgggccgacagcgtgccgacgcacttccgcttctcggtcaagctgccgcgcagcatcagccacgatgcgcgcctgcaccaggccggtccattgctggatgcgttcctggcgcaggcgggcgcgctgggcgagcgcctgggctgcctgctgctgcagttgccgcccagtgcggtgttcgatgcacgcgtggcggccagcttctttgccgtcctgcgccggcgctgggacggcgcagtggtgtgcgagccgcgccatcccagctggttcaccgcccaggcgcaggcgctgctgcaccgccaccgcatcgcgcggtgtgcggccgacccggcaccggtgcctgccgccgcgctgcccgacgcgccaggcatgcccggcgcgccggcatattggcgctggcacggcacccccaaggtctattacagcggatacgacaacgccgccttgcagcgcctggcggccgcggtccgcagcggcatggccgcgcatgcggcgaacgagcagtgggtgatcttcgacaacaccgctgccgggctggccgtgcccaatgccttgcagctgcagaagctgttgggaatcggccgctag

SEQ ID NO: 46421 - protein, 263 aa, Xanthomonas campestris pv. campestris str. 8004
MSTSAPPPQPAATALPRVYCGCAGWSIPAAERAQFGAGSSVLQRYATRLNAVEINSSFYRPHRTSTYARWADSVPTHFRFSVKLPRSISHDARLHQAGPLLDAFLAQAGALGERLGCLLLQLPPSAVFDARVAASFFAVLRRRWDGAVVCEPRHPSWFTAQAQALLHRHRIARCAADPAPVPAAALPDAPGMPGAPAYWRWHGTPKVYYSGYDNAALQRLAAAVRSGMAAHAANEQWVIFDNTAAGLAVPNALQLQKLLGIGR

SEQ ID NO: 46422 - DNA, 900 bp, Xanthomonas campestris pv. campestris str. 8004
  CDS (1)..(900): transl_table=11
atgagcatccgcatcggcatttcgggctggcgttatgcacgctggcgcggcacgttctacccgaccggcctggcccagcggcgcgagttggcctatgccgggcgctgttttcccagcgtggaaatcaatggctcgttttattcgctgcaacgcccggagagctaccagagctggcatgacgagacgccggacgacttcgtcttcgcggtcaaaggcccgcgttttgtcacgcatatgaagcggctgcgcgattgcgaacaggcgctggccaacttctttgcatccggcgtgctgcggctgggcgagaagctggggccgatcctgtggcaattgccgccaaccctgcgcttcgatgacgcggtgttggatgcatttctctccagcctgccgcgcgatacagaggcagcactcgccctggcgcgcaaacgcgataccaccttgatgcatgggcgtacggccctgagcatcgatcgcaagcgcccgctacggcatgcgctggagatgcgccaccccagcttctgcgacccgtcctgcatgaagctgctgcgcaagcacaaggtgggcgtggtggtggccgataccgctggcaaatttccgtatctcgaagatgtcaccgctgacttcgtctacctgcggctgcatggcgacgcgcaactctatgccagcggctacagcgaccacgccctggaccgctggggcgagcggattgcggcctgggctgcaggcggtgagccctccgacgcccagcgtgtcgggccgcgcgccagcaagcgcgcacggcgcgacgtgtactgctacttcgacaacgacatgaaggtgcatgcaccgttcgatgcgcgcggcctgatgcagcgtttggacctgcccaccgactgcccggcgcgcgaggaggtcgtgtaa

SEQ ID NO: 46423 - protein, 299 aa, Xanthomonas campestris pv. campestris str. 8004
MSIRIGISGWRYARWRGTFYPTGLAQRRELAYAGRCFPSVEINGSFYSLQRPESYQSWHDETPDDFVFAVKGPRFVTHMKRLRDCEQALANFFASGVLRLGEKLGPILWQLPPTLRFDDAVLDAFLSSLPRDTEAALALARKRDTTLMHGRTALSIDRKRPLRHALEMRHPSFCDPSCMKLLRKHKVGVVVADTAGKFPYLEDVTADFVYLRLHGDAQLYASGYSDHALDRWGERIAAWAAGGEPSDAQRVGPRASKRARRDVYCYFDNDMKVHAPFDARGLMQRLDLPTDCPAREEVV

SEQ ID NO: 46424 - DNA, 858 bp, Pseudomonas fluorescens Pf-5
  CDS (1)..(858): transl_table=11
atgctgccttatttcctcggttgtccttcctggagcgaaaacgcctggcgtgagtacctgtacccggaagacgcccggcccaatgatttcctcggcctgtattgccaggtcttcaacgccgtcgaaggcaataccaccttctatgcacggccggcgcccggaaccgtgcagcgctgggccgagatcatgcccgagcactttcgctttaccgccaagttccccggtgacatcagtcacggcggcgacctgcgcgagcagttgagcgccgctgagtcctttatccagctgctcagccccctgggtgagcgggtgtcgccgctgtggctgcaattgccggccagcttcgcgccccagcgtctggcggaactggccgggttcatcgatggcctggagcggccgctggcggtggaagtgcggcacccggagttcttcaccaagggcgatgccgagcgcatgctcaaccggctgctgcgcgagcgtggcgtggaacgcatctgcctcgacccgcgggccctgttcagttgcacgtcgaccgctcctgcggtgctgcatgcgcagtcgaaaaagcccaaggtgccaccgcgccccgcagccttcacccagtttccccaggtgcgcttcatcggtcatccggagcttgaggccaacgatcctttccttgaaccctggatcgacaaggtcgccggttggatcgaagaggggcgtacgccctacgtgttcctgcacacttcggacaaccgtctggcggctgaactggcgcggcgttttcacgcccggctgatgcaacgtttgcctggcttgcccgcattgcctgagttatacagagagcccgctgcggagcaactcggcttgctctga

SEQ ID NO: 46425 - protein, 285 aa, Pseudomonas fluorescens Pf-5
MLPYFLGCPSWSENAWREYLYPEDARPNDFLGLYCQVFNAVEGNTTFYARPAPGTVQRWAEIMPEHFRFTAKFPGDISHGGDLREQLSAAESFIQLLSPLGERVSPLWLQLPASFAPQRLAELAGFIDGLERPLAVEVRHPEFFTKGDAERMLNRLLRERGVERICLDPRALFSCTSTAPAVLHAQSKKPKVPPRPAAFTQFPQVRFIGHPELEANDPFLEPWIDKVAGWIEEGRTPYVFLHTSDNRLAAELARRFHARLMQRLPGLPALPELYREPAAEQLGLL

SEQ ID NO: 46426 - DNA, 864 bp, Pseudomonas syringae pv. phaseolicola 1448A
  CDS (1)..(864): transl_table=11
gtgtctcgcctgccttactacctcggttgtccgtcatggagtgaaaacgcctggcgagactcgttgtacccggaagacgcccgccccaatgatttcctgaatctctacactcaggtattcaacgctgtcgaaggcaacaccacattctatgcccgtcccgctgccacaacggtgcaacgctgggcggaaataatgcctgccgattttcgtttcactgcgaaatttcacaaagacatcagccacaacggcgacctgcgtgatcaggtgggtgccgccgaggaattcatccgtctgctcgcgccgttgggtgagcggattgcgccattctggcttcagttgcccgccagcttcacaccgcagcgccttgccgagttggtcgggttcctcgatgaactcaatgtgcctttggctgtggaagtgcgcaacatggcctttttcatgaaaggtgacgaagaacgcatgctcaaccgcctgctgctggatcgaggcgtcgagcgcatctgtctcgacccccgggcattgttcagctgtgtatcgagcgatcccgcagtcctgcacgcgcaatcgaaaaagcccaaggtgccgcctcgtccggctgcgctgacgctgtttccccaggtccgtttcatcggcggtcctgacctggaggccaatgatcagtttttggtgcagtgggtggaaaaggtcgccgtgtggatcgaagaggggcgcacgccttatgtcttcctgcacaccccggacaacgtcagggctgccgagcaggccatgcgctttcaccagcaactgatggcgcgattgcctggcttgccggcattgtttgagctggatcgtgggcctcaggtggaacagttgggcttgctctga

SEQ ID NO: 46427 - protein, 287 aa, Pseudomonas syringae pv. phaseolicola 1448A
MSRLPYYLGCPSWSENAWRDSLYPEDARPNDFLNLYTQVFNAVEGNTTFYARPAATTVQRWAEIMPADFRFTAKFHKDISHNGDLRDQVGAAEEFIRLLAPLGERIAPFWLQLPASFTPQRLAELVGFLDELNVPLAVEVRNMAFFMKGDEERMLNRLLLDRGVERICLDPRALFSCVSSDPAVLHAQSKKPKVPPRPAALTLFPQVRFIGGPDLEANDQFLVQWVEKVAVWIEEGRTPYVFLHTPDNVRAAEQAMRFHQQLMARLPGLPALFELDRGPQVEQLGLL

SEQ ID NO: 46428 - DNA, 930 bp, Ralstonia eutropha JMP134
  CDS (1)..(930): transl_table=11
atgtcagcacataccgcggtgaagtccactgccgcgccagcttcgcagcgcaagaccggttcgccgggaacaggcggaccgctgatacgcgtcggcatcggcggatggacctacgcgccgtggcgcgacaatttctatccggccgggctcgcgcagacgcgtgaactcgaatatgcgagccgccacctgacggccatcgagatcaacagcacctatcacggcacgcagaagcgcacgtcgttcgccaagtggcgagacgagacgcccgatgacttcgtattctcggtgaaggcctcgcgctttgccaccaaccgccgtgtgctggcggaatcgggcgagtcgattgcgcgctttatcgacagtggcattgcggaactcggcccgaagctcgggccgctggtctggcagttcgcaccgaccaagcagttcgatgccgaagacttcgaagccttcctgcagttgctgcccgattcggtggagggcgtgacactgcgccacgtgctggaggtccggcatgacagtttcctgtcgccggactacctgaagctggcgcgcaagtacaaagccgcgacggtgtacaccgactcgcccaagtttccatcgatggctgacctgagcagcgactttgtctacgcgcgcctgatggacagcagcgaaaagctgacgaccggctacgggccaaaggcgctggacacgtgggccgagcatgcgcgcacgtgggccgcgggcaaggcgccggcaaatctggagcagttggaggacaagcagccggctgcgaagcggcgcgaagtctttatcttcttcatcaacggcgccaaggagcgcgccccggcggccgctcaggcattgctgtcgcgccttggctgggaaccccaggaacaggtaccggcgaaggtgtcggcgaaggttccggcaaagaagcgtgcctga

SEQ ID NO: 46429 - protein, 309 aa, Ralstonia eutropha JMP134
MSAHTAVKSTAAPASQRKTGSPGTGGPLIRVGIGGWTYAPWRDNFYPAGLAQTRELEYASRHLTAIEINSTYHGTQKRTSFAKWRDETPDDFVFSVKASRFATNRRVLAESGESIARFIDSGIAELGPKLGPLVWQFAPTKQFDAEDFEAFLQLLPDSVEGVTLRHVLEVRHDSFLSPDYLKLARKYKAATVYTDSPKFPSMADLSSDFVYARLMDSSEKLTTGYGPKALDTWAEHARTWAAGKAPANLEQLEDKQPAAKRREVFIFFINGAKERAPAAAQALLSRLGWEPQEQVPAKVSAKVPAKKRA

SEQ ID NO: 46430 - DNA, 915 bp, Nostoc punctiforme PCC 73102
  CDS (1)..(915)
atgaatttacaaccaacctgtaaaattgaatatgatacatcaaggcttttaggcgttgtgaacttttttattggttgtgctgtttgggcatataaaggttgggtgggcgaactttacccccaaggtactcgcaccgccgattttctccatctctacagtcgtcgcttcaccactgtagaaggtaacaccaccttttatgctgtgcctaatcaagaaactgtaacccgttgggctgccgaaaccccagcaggttttgaattttgtctaaaattaccgcgagatattacccatcaagggttgctacaaccttatattccggcggctttaaaatttctggaagggatgcgccctttaggtaagcatcttggcccaatatttgcccagttaccacctagttatgcacctgcattgtttgacgatttgaccaactttctggaagcttggccgcgcacagatgcacccctagccctggaagttcgtcatcccgattggttcagagaaccccatgctagtaatttgacagcgcttttacaaaagctaggtgtaggacgggtacttttagactcgcgccccatttacactggagatgatgacccccagttacaatcagaacgacgtaaacctaaattaccgttgcaattgagtgtgacagcaccttttactctgattcggtttatttcccatccaaatttatcagtgaatcagccgtttatggaagagtgggtaaggcagattcagcaatggttacaggcgggagtgcgaatttatttctttgttcattgtccaatagaagcgcgatcgcctaacatagcgcgtcatttccaacagctattagaacagagtgatacaccagttccacccttaccttggaataaccttgagcatccacccaatcaactgagtttatggtcttga

SEQ ID NO: 46431 - protein, 304 aa, Nostoc punctiforme PCC 73102
MNLQPTCKIEYDTSRLLGVVNFFIGCAVWAYKGWVGELYPQGTRTADFLHLYSRRFTTVEGNTTFYAVPNQETVTRWAAETPAGFEFCLKLPRDITHQGLLQPYIPAALKFLEGMRPLGKHLGPIFAQLPPSYAPALFDDLTNFLEAWPRTDAPLALEVRHPDWFREPHASNLTALLQKLGVGRVLLDSRPIYTGDDDPQLQSERRKPKLPLQLSVTAPFTLIRFISHPNLSVNQPFMEEWVRQIQQWLQAGVRIYFFVHCPIEARSPNIARHFQQLLEQSDTPVPPLPWNNLEHPPNQLSLWS

SEQ ID NO: 46432 - DNA, 729 bp, Nostoc punctiforme PCC 73102
  CDS (1)..(729)
atgaataaactaaaaattggtactagtggttgggtttataaacattggatggatattttctatccaccaaatttacctagcgaccagcaactatcattttacgcccaacattttgctactgtagaaattaacttttccttttatcgtttgccagaacggtctgtctttgagacttggcacaagcaaacaccctctaactttctctttgctgttaaaggtagccgctatctcacccacatgaagaagttaaaagacccgatagagccactatctcgcataatggaacgcgcatctggactgcaagaaaagctcggccctattttatttcaatttcctcatacttggcatattaatattgaacgtcttcagccctttttagaattgctgcaaacctatccaaaacaaaaatttacagttgaatttcgtcattcaagctggctgattccacaagtttatcaactactagaaactgcgggtgtaggcctttgtctacctgtcagcccaacagttccccttgatatctgtttgactgccccttggacttatatccgtatgcacagtgggcaatggaatgtaggttataccgatgaagagctatctacatgggttgaacgtatccgttcatttctaatgcaggaaattgacgtttacgtgtatttcaacaacgaccccgatggaaacgctattcgtgatgctcaacgactctattgtttgctgggatcttgttga

SEQ ID NO: 46433 - protein, 242 aa, Nostoc punctiforme PCC 73102
MNKLKIGTSGWVYKHWMDIFYPPNLPSDQQLSFYAQHFATVEINFSFYRLPERSVFETWHKQTPSNFLFAVKGSRYLTHMKKLKDPIEPLSRIMERASGLQEKLGPILFQFPHTWHINIERLQPFLELLQTYPKQKFTVEFRHSSWLIPQVYQLLETAGVGLCLPVSPTVPLDICLTAPWTYIRMHSGQWNVGYTDEELSTWVERIRSFLMQEIDVYVYFNNDPDGNAIRDAQRLYCLLGSC

SEQ ID NO: 46434 - DNA, 789 bp, Pseudomonas aeruginosa UCBPP-PA14
  CDS (1)..(789)
ttgcgttccgccgactacctcggacactacggcggcatcttcaacgcggtcgagggcaataccaccttctatgcccggccttcggcggaaaccgtgcggcgctgggccgagacgatgccggcggggttccgcttctgtgccaagtttccccgcgatatcagtcacgaaggcgacctgcgcgaacggctcggggccgccgacgacttcctcgaactgctggcgccgcttggcgaaagggtcagcccgctgtggctgcaactgtcggcggcgttcaccccgcagcgcctgggcgaactgctgtatttcctcgatgagctgagtccgcgacggattgccgtggaagtacgccacccggcgttcttcgacaaaggcgaggacgagcgcctgctcaaccgccacctgcgcgagcgtggcgtggagcgcatctgcctggattcgcgggcgctgttcagttgccgttcggacgatccggcggtgctccacgcccagtcgaagaagccgcgcctgccgatccgtccggcggccttcagcgatacgccacaggtgcgtttcatcggcggtcccgacctgccggccaacgaggtgttccttttgccctgggtcgacaaggtggccgactggatcgaggccggcctgactccatacgtattcctgcatacccccgacaatcacctggcggcccagcaggcccagcgtttccatgcgctgctgggccagcgcctgccaggcttgccggcgctacccgagccgatcccggccccggaagtggagcaactgggcctgctctga

SEQ ID NO: 46435 - protein, 262 aa, Pseudomonas aeruginosa UCBPP-PA14
MRSADYLGHYGGIFNAVEGNTTFYARPSAETVRRWAETMPAGFRFCAKFPRDISHEGDLRERLGAADDFLELLAPLGERVSPLWLQLSAAFTPQRLGELLYFLDELSPRRIAVEVRHPAFFDKGEDERLLNRHLRERGVERICLDSRALFSCRSDDPAVLHAQSKKPRLPIRPAAFSDTPQVRFIGGPDLPANEVFLLPWVDKVADWIEAGLTPYVFLHTPDNHLAAQQAQRFHALLGQRLPGLPALPEPIPAPEVEQLGLL

SEQ ID NO: 46436 - DNA, 861 bp, Pseudomonas fluorescens PfO-1
  CDS (1)..(861)
atggatctgccttactacctcggttgcccgtcctggagcgaaaacgcctggcgcgagtacctgtatccggtagacgccaagacctccgatttgctcggactctattcgcaagtattcaacgccgtggaaggcaacacgaccttctacgccagcccgtcgccggccaccgtgcagcgctgggccgaggtgatgccggaacactttcgcttcaccgccaagttccccggtgacatcagccacagcggcgacttgcgcgatcaactgaccgccgccgaaaccttcctccagttgctcaagccgctcggtgagcgtgtctcgccaatgtggctgcaactgtcgaaaagcttcacgccacaccgcttgccggagcttgctgcgttcatcgatgcgctggattgcccgctggcggtggaagtgcgccacgaacaattcttcgccaagggcgagagtgagcgactgctcaaccggctgttgctggatcgcggcgtggagcgtatctgtcttgatccccgcgcgttgttcagttgcctgtccaccgaatcgtcggtgatccacgcccaatcgaaaaagccccgcgtaccgacgcggccggcagcgttcactcaattcccgcaggtgcgcttcattggccatccggagcttgaggccaacgatccgtttctggtgccgtgggtggcgaagatcgccgagtggatcgaagaggggcgcacgccgtacatcttcctgcacaccgccgacaacattcttgcggcgaagctggcgcaacgttttcacgcacaactgatgcaacgtttgcctggcctgccgtccctgcctgagctatacagagaacccgccgccgagcaacttggcctgctctga

SEQ ID NO: 46437 - protein, 286 aa, Pseudomonas fluorescens PfO-1
MDLPYYLGCPSWSENAWREYLYPVDAKTSDLLGLYSQVFNAVEGNTTFYASPSPATVQRWAEVMPEHFRFTAKFPGDISHSGDLRDQLTAAETFLQLLKPLGERVSPMWLQLSKSFTPHRLPELAAFIDALDCPLAVEVRHEQFFAKGESERLLNRLLLDRGVERICLDPRALFSCLSTESSVIHAQSKKPRVPTRPAAFTQFPQVRFIGHPELEANDPFLVPWVAKIAEWIEEGRTPYIFLHTADNILAAKLAQRFHAQLMQRLPGLPSLPELYREPAAEQLGLL

SEQ ID NO: 46438 - DNA, 882 bp, Cytophaga hutchinsonii
  CDS (1)..(882)
atgcaattcggaaaaacagatactcctgaagatattgattttacgttacctaaagatcatccggacactaaaaagattctctcggaagcaaagcccggcaagcattttaacgtgtatgtaggttgtgctaaatggaacaaaaccgatctgaaaaacttttacccaaaaggcacaaaagacgaactgcagtattatgcgacgcagtttaacagcatagaactgaatgctacgttttataagtctccctctaaagatcaggtgcagacatggaaagcgaaagcagccaaaggatttaaattcttccctaaaatacccaataccatcagtcattttaagcggttggttggcgtagaaacaatcgtggaggaattttgcgatgcggttgtgttgtttgaagaaaatctcggtatgagctttttacagatgcacgataacttcaaaccaaaagatatggataagcttgatgcgttcctgaaaaagtttccggcttctgtacctttagctgtagagctgcgaaacgaagaatggtattcggataaaaacgtacaggatgatctgcacgcgatgctggttaaatataaaaagacatttgtgcttgttgatactgccgcgcgcagagatatcatgcacatgcgcttaacgtcagataaagcatttatacgttatgtaggagctaatcacgaaagcgattatgcgcggctggatgattggatcaaacgtattaaaacctggcgtaaagaaggattaaacgaactatatttctttgtacaccagaatgtagaactggaatcacccttgctttctgcttattttattgaaaaaatgaataaggaatttgatctggatttaactgttccgcaaacaataaaaaagaaacagtag

SEQ ID NO: 46439 - protein, 293 aa, Cytophaga hutchinsonii
MQFGKTDTPEDIDFTLPKDHPDTKKILSEAKPGKHFNVYVGCAKWNKTDLKNFYPKGTKDELQYYATQFNSIELNATFYKSPSKDQVQTWKAKAAKGFKFFPKIPNTISHFKRLVGVETIVEEFCDAVVLFEENLGMSFLQMHDNFKPKDMDKLDAFLKKFPASVPLAVELRNEEWYSDKNVQDDLHAMLVKYKKTFVLVDTAARRDIMHMRLTSDKAFIRYVGANHESDYARLDDWIKRIKTWRKEGLNELYFFVHQNVELESPLLSAYFIEKMNKEFDLDLTVPQTIKKKQ

SEQ ID NO: 46440 - DNA, 849 bp, Pediococcus pentosaceus ATCC 25745
  CDS (1)..(849)
atgattcagattggactaagtacttgggccgatcatccagctttatcggttgaaggtaaacctaaatcaacgctagaagaatatgtaggccactttccgattgtggaagtggacagttctttttatgctattccatcgttgtccaatgtcgtcaattggcaacatcaagtcccagataattttaaattcatctttaaagcttctcgggttatgaccctccacgacggcgttgatggggatgaatatttaacaccagaacgacgaatagaatttactaactttaaaaaggtaatgcagcctttaatccaaaatggacagttggaatctgtattattccaatttccaccttcgtttcgatgtgatttgactaatatccgctacttatttgaaattcgccaaatgatggatcgaattccgattagtgttgagttcagaaatcccagttggttcatagaggcagtcgaatcggacactttatcatatttggagcgccttaaaatgataaatgtaattgtcgatgagccgtttgacggcaaccaagggatgcctttggtacttcaagtgactagtgctaaaaaagccatgtttcgtttgcacggacgtaatgctcagggatggtttacgagtggcaaagaatggcggaaagaacgcactaattatcgttattctacggatgaattaacggagttagcacagtgggttaaggcagtatctgaacgagttgaagaagtaaccattattttcaataataatggaaaccatgatgctgtcgataatgcgaaagagttgcaaaaaatcttaggaattcgctttgagggtctaggtccagttcagatggatttgttttga

SEQ ID NO: 46441 - protein, 282 aa, Pediococcus pentosaceus ATCC 25745
MIQIGLSTWADHPALSVEGKPKSTLEEYVGHFPIVEVDSSFYAIPSLSNVVNWQHQVPDNFKFIFKASRVMTLHDGVDGDEYLTPERRIEFTNFKKVMQPLIQNGQLESVLFQFPPSFRCDLTNIRYLFEIRQMMDRIPISVEFRNPSWFIEAVESDTLSYLERLKMINVIVDEPFDGNQGMPLVLQVTSAKKAMFRLHGRNAQGWFTSGKEWRKERTNYRYSTDELTELAQWVKAVSERVEEVTIIFNNNGNHDAVDNAKELQKILGIRFEGLGPVQMDLF

SEQ ID NO: 46442 - DNA, 939 bp, Pseudomonas aeruginosa UCBPP-PA14
  CDS (1)..(939)
atgagcgcaccggcacgcctgcgcatcggcatttccggctggcgctacgccccctggagaggtgacttctatcccgaggggctgcgccagaaggacgaactgcgcttcgcctcgcgggcggtgaacagcatcgagatcaacggcaccttctacgccctgcagacgcccgagcgcttccgcggctgggccgaggacacccccgaggacttcgttttcagcgtcaaggccccgcgttacatcacccacgtgcggcgcctgcgcgagatcgacgagccgctggcgaacttcttcgcctccggccccctcgccctgcgccagcgcctcggcccgttcctctggcagttcccgccgagcatgcgcttcgaccgcgagctgttcgccgacttcctcgcccgcctgccgcgcgacggcgccgccgcgcagaagctcgcccggcacagcgccgcgcgcctgcaccgcgagggctacctcgacggcgatccggcgcagcgcctgcggcatgccgtggaaatccgccatgagagcttcgtcgacccgacgttcatcgagctgctgcgcgaataccgggtggccctggtggtggccgataccgccggcaagtggccgctgctcggcgacgtctgcgccgacttcctctacctgcgcctgcatggcgacaaggagctgtaccgcagcggctactcggaagcggccctgggccagtggcaggcacggatccacgcctgggccagcggcggccaggccgacgacctgcgccgggccagccaggacgcaccggcgaaggcgacggcgcgcgacctgtactgctacttcgacaacgacgtcaaggtgcgcgcaccttacgacgcccggcgcctcctgcagctgctggaactcgacggcagcctgcgcacggtgcccggacagttgcccgatgacctgcgggagagtgccgcatga

SEQ ID NO: 46443 - protein, 312 aa, Pseudomonas aeruginosa UCBPP-PA14
MSAPARLRIGISGWRYAPWRGDFYPEGLRQKDELRFASRAVNSIEINGTFYALQTPERFRGWAEDTPEDFVFSVKAPRYITHVRRLREIDEPLANFFASGPLALRQRLGPFLWQFPPSMRFDRELFADFLARLPRDGAAAQKLARHSAARLHREGYLDGDPAQRLRHAVEIRHESFVDPTFIELLREYRVALVVADTAGKWPLLGDVCADFLYLRLHGDKELYRSGYSEAALGQWQARIHAWASGGQADDLRRASQDAPAKATARDLYCYFDNDVKVRAPYDARRLLQLLELDGSLRTVPGQLPDDLRESAA

SEQ ID NO: 46444 - DNA, 855 bp, Azotobacter vinelandii AvOP
  CDS (1)..(855): transl_table=11
atgctgccctattgtctcggctgtccctcctggagcgaggcgggttggcgcggccgcctctacccggacggcacgccggcgtccgactatctggcgctgtacgcccgggtgttcaatgcggtcgagggcaacaccaccttctacgcccgaccttcggcggcgaccgtgcagcgctgggcgcaacggatgccggcgcatttccgcttctgcgccaagctgccgcgcgacatcagccattcggccgagctgcgcctgcagatgccggccgcccgggccttcgtcgagtcgctggcgcccctgggcgagcgggtcacgccgttctggctgcaactgccggccagcttcgggccggcgcgcctcggcgagctggcggactttctcgccggcttcgagcgtcccctggcggtggaagtccgccacccggccttcttccagcgcggcgaggaggagcgggcactgaaccgcctgctgcgcgaccggggcgtcgagcgcctgtgcctggattcccggccgctcttcagttgccacgaggacacgccggcggtgcgccatgcccagtcgcgcaagccgcgcctgccggtgcgcccggcggccctcacggcgtttccgcaggtacgcttcatcggccatccgctgctcgccgccaacgatcccttcatggcgccctggctggacaaggtcgccgcctggatcgaggagggcaggcagccctacgttttcctgcataccccggacaacttgctggcccccgaactggctcggcgcttccatgaacggttgcgggagcgcctgccgggactgccgccgttgccggcgccggcggcggccgacgattcgcaactcgatctgctctga

SEQ ID NO: 46445 - protein, 284 aa, Azotobacter vinelandii AvOP
MLPYCLGCPSWSEAGWRGRLYPDGTPASDYLALYARVFNAVEGNTTFYARPSAATVQRWAQRMPAHFRFCAKLPRDISHSAELRLQMPAARAFVESLAPLGERVTPFWLQLPASFGPARLGELADFLAGFERPLAVEVRHPAFFQRGEEERALNRLLRDRGVERLCLDSRPLFSCHEDTPAVRHAQSRKPRLPVRPAALTAFPQVRFIGHPLLAANDPFMAPWLDKVAAWIEEGRQPYVFLHTPDNLLAPELARRFHERLRERLPGLPPLPAPAAADDSQLDLL

SEQ ID NO: 46446 - DNA, 870 bp, Chromohalobacter salexigens DSM 3043
  CDS (1)..(870): transl_table=11
atgacggggatcgggccgaggttcttcatggggctgccgatgtgggccaatggcgattggcgcgggagcttgtatgcgcgtcatgcgccgtcgtcgggcatgctgcacgactatggtgccgtgttcggcagcgtggagggcaataccaccttctacagcgggccgccgaaagcggacacggttgcccaatgggcacgccaggcgccggcggatttccgattctgtttcaaattgccggcgcaactgacccatgacaagcgcctcgtgggcatcgaagacgacttccggacattctgcgatgcgctggcgccgttacacgatcgcctggggccgaccatggtgcaattgccgcgcgatttcggcgctcgggaattgccggctctggcggcattcttggagaaatggccgtcggacatgccctgtgccgtggaggtgcgccatagtgaatttttccacaaaggggacgctgagcagcaattgaaccgcttgttgataactttgggcgtggaccgagtgatgctggatgtcaggccgcttttcgccacgcccgccggggacgatgcgcgcttgatcaaggcgcagagcgaaaagccgaaacgcccgctacacgtgatttccacgggacgaatgcctatcgtgcgtttcatcggccattgtgatatggagatcaacgagcggctttttgccccttggtgcgagcgcctggcgttgtggataaaacaggggaaaacccctttcttgtttgtgcacacgccggacaaccgtcaggcgccgcaattggcacggcgctttcatgcacgtctctcccggtgcgtgacgcttcctcccctgggcgactttcccggagagcgtcaaagcgccttgttctga

SEQ ID NO: 46447 - protein, 289 aa, Chromohalobacter salexigens DSM 3043
MTGIGPRFFMGLPMWANGDWRGSLYARHAPSSGMLHDYGAVFGSVEGNTTFYSGPPKADTVAQWARQAPADFRFCFKLPAQLTHDKRLVGIEDDFRTFCDALAPLHDRLGPTMVQLPRDFGARELPALAAFLEKWPSDMPCAVEVRHSEFFHKGDAEQQLNRLLITLGVDRVMLDVRPLFATPAGDDARLIKAQSEKPKRPLHVISTGRMPIVRFIGHCDMEINERLFAPWCERLALWIKQGKTPFLFVHTPDNRQAPQLARRFHARLSRCVTLPPLGDFPGERQSALF

SEQ ID NO: 46448 - DNA, 852 bp, Frankia sp. CcI3
  CDS (1)..(852): transl_table=11
atgcgtcttcatgtggggtgcgcgatgtgggctcacaagtcatggcaagggcgctttctggcgcatccgctcccgcctcacgaacgcctgcgaaactacgccagctggtgcaacgcggtcgaagggaatgcaacgttctatgcgactccggccaggagcgccgtggcctcgtgggcgcagcagaccgacgccgacttccgattcgtgatcaagctgccaaaaaccatcacgcacgaacgccgcctgacgggcgtcgacgaagcgttacacgccttcctggaagcgatcgagccactcggcccacgggcccatgccctctggatacagctaccaggatcgttcaccccggccgacgtccccgtgcttgcccgctttctgcgccggctcaccaggtcccaccggtacgctgtggaggtccgccaccccgcattcttcaacgaccctcgcgcagcgcgacttctcgaaggagtccttgccgccgcgaccgccgaatggattccattcgacaccaccacattctttcaaagcccgccaggcagcgatgccgaacgagaagcctggaccaggaaaccgcgcgtgccgctccgatcgctcgcgttgaccgaccggccgatcgtccgctacctcggccgcgacgcctccacgcagacgatcaaaggctggcagcgttggattgacactgccatcgagtggctgcgcgagggtcgatcacccaccgtgtttattcacaccccggacaacgccgacgcgctactactcgcccgctgcttccacgatgacgtacgggtacgggtgcctgagctcgatgcactgcctcagccgataccgaccgagcccctgaccctcttctga

SEQ ID NO: 46449 - protein, 283 aa, Frankia sp. CcI3
MRLHVGCAMWAHKSWQGRFLAHPLPPHERLRNYASWCNAVEGNATFYATPARSAVASWAQQTDADFRFVIKLPKTITHERRLTGVDEALHAFLEAIEPLGPRAHALWIQLPGSFTPADVPVLARFLRRLTRSHRYAVEVRHPAFFNDPRAARLLEGVLAAATAEWIPFDTTTFFQSPPGSDAEREAWTRKPRVPLRSLALTDRPIVRYLGRDASTQTIKGWQRWIDTAIEWLREGRSPTVFIHTPDNADALLLARCFHDDVRVRVPELDALPQPIPTEPLTLF

SEQ ID NO: 46450 - DNA, 852 bp, Frankia sp. EAN1pec
  CDS (1)..(852): transl_table=11
atgcatctgcacgtggggtgcgcgatgtggacccacaagtcctggcaggggcgcctgctggcccatccgctgccggcccacgagcgcctgcggcactacgccgcctggtgtaacgcggtcgaggggaacaccacgttctatgcgaccccggcccgggagaccgtggccacgtgggcgcggcagaccgaccccggcttccggttcgtggtcaagctgccgaaggtcatcacgcacgaacgccacctcaccgacgtcgacgaggtgcttcgctcgttcctgaacgcgatggagccactcggcccgcgggcgcacgccctctggattcagctgccgggggcgttcggcccggccgacgtgtcgctgctcgcccgctttctgcgccggctcgacacgtcccaccggtacgcggtggaggtccgccatccggccttcttcgccgacccgcgcgcggcgcgcctgctcgaggacgcactcgccaccgtgggcgccgaatggattccgttcgacacaaccgagttcttccgcagcccgccgacgagcgacgccgaacgggacgcctgggcgaagaagccccggatgccgctccggtcactcgcgctgaccgaccagccgatcgtccgctacctcggccgcgacgactccgcccggacggtcgagggctggcggcactgggtcgacaccaccgtcacgtggctgcgcgagggacgatcgcccaccgtcttcatccacaccccggacaacgccgacgctccgctgctcgcccgccgtttccacgacgaggtccgggcccgcgtccccgaactcggtcctctgccgcagccgataccagccgagcccctgaccctcttctga

SEQ ID NO: 46451 - protein, 283 aa, Frankia sp. EAN1pec
MHLHVGCAMWTHKSWQGRLLAHPLPAHERLRHYAAWCNAVEGNTTFYATPARETVATWARQTDPGFRFVVKLPKVITHERHLTDVDEVLRSFLNAMEPLGPRAHALWIQLPGAFGPADVSLLARFLRRLDTSHRYAVEVRHPAFFADPRAARLLEDALATVGAEWIPFDTTEFFRSPPTSDAERDAWAKKPRMPLRSLALTDQPIVRYLGRDDSARTVEGWRHWVDTTVTWLREGRSPTVFIHTPDNADAPLLARRFHDEVRARVPELGPLPQPIPAEPLTLF

SEQ ID NO: 46452 - DNA, 954 bp, Shewanella baltica OS155
  CDS (1)..(954): transl_table=11
ttggatgagttgcgttctgggttagataaacccagccattttcgccttggcctagccatgtggtcacactcgaattggcaagagagtgtctatggccatgggattaaacaagcggagcgactcgcccgttacgccacgatattcaacactgtcgaaggtaataccagcttctacgcgacgcctgcacagcaaaccgtgatgaactggcacagtgccacgcccgatgattttcgctttaccttcaagctgccgcaaaccattactcaccaaagactattgcaacactgcggccaagagttgaaggattttttccaagtaatggcgccattaatcgataaaacggggatctggaaaattcaacttcccgcccatttcggcccagaaaacttacctgtgttagcacaatttctcaatcaagtcccccaaggattaacctatggcgttgaagttaggcatgcagcgttttttgctaagggagacgccgagcgcgcactcaatcgattacttatcgataaaaaagtgaatcgcatcatcatggatagcaggcccttgtttgccctgccgcccagcaacgccgccattatcgacgcccataagaaaaagccgcgggtgccagtgcatgcgattgccaccgccaataatcctgtagtgcgctttatcggccaaccagacgatgccgtagcacaactcgcgcagcaaggtgttagcgctttgcctaagaataacgatgccttttttgataattggctcgcacagctcccgctgtggctcgcagaaggtcgagagccctatctgtttattcatactcccgataatgaaaccgcgcctgaactggccatccgtctctatcaaacattgcgcagccaaattgcagcgcagattcaactcgccgagctaagcctacttgagaagatacctgaggagacaagtacgcagatgggacttgcttggtaa

SEQ ID NO: 46453 - protein, 317 aa, Shewanella baltica OS155
MDELRSGLDKPSHFRLGLAMWSHSNWQESVYGHGIKQAERLARYATIFNTVEGNTSFYATPAQQTVMNWHSATPDDFRFTFKLPQTITHQRLLQHCGQELKDFFQVMAPLIDKTGIWKIQLPAHFGPENLPVLAQFLNQVPQGLTYGVEVRHAAFFAKGDAERALNRLLIDKKVNRIIMDSRPLFALPPSNAAIIDAHKKKPRVPVHAIATANNPVVRFIGQPDDAVAQLAQQGVSALPKNNDAFFDNWLAQLPLWLAEGREPYLFIHTPDNETAPELAIRLYQTLRSQIAAQIQLAELSLLEKIPEETSTQMGLAW

SEQ ID NO: 46454 - DNA, 942 bp, Shewanella amazonensis SB2B
  CDS (1)..(942): transl_table=11
atgtcactccccgagaccccaacaatccgcatcggtatggccatgtggtcccatcccggttggaaaaccgtgtttcccggtttggatgccgaagcgcggctgaccgcttacagccgggtatttggcacagtggaaggcaacaccagcttttatgccctgccatcggcgcagcaggtaagcatttggcaaagggcgacaccggaagactttcgttttactttcaaactgccaagacgcattacccacgagctttcactgcgtaattgccgcgaggaagtactgcagttttttcggttgtttgagcctttgatggccaaaaccggggtgtggaaaatccagttgccggcccgtttcggccctgaatctttatctgtgctgacacagtttctgtcattgttgcccgaggggattggtcttggcgttgaggtacgccacagggcgtttttcgccaagggagaggccgagaaagacttcaatcgcctgttgatggacaagggcatcaatcgcatcatcatggatacacggcccgtgtttgccctgccagccatcaacgaggcgataaccgatgcccaccagaaaaaaccacgggtgcctgtgcatcctcttgccacgggggcccatccggtggtgcgttttatcgcccagccccatacgcctgcagcttgggggccggggggcaaacccgccgaccttggctgcgccgataatctggcgtttttcgccccctggcttggcaaactggccggttggctggccgaaggtcgctctccttatctctttattcataccccggacaacagcgatgccccactgcttgcaagcgagctggcgaagcaggttgccgcacatctgcaggcattgcaccccggactgcctataccttcggtgatgctcgatagcgccgaatctgacggtggtcaaattggccttgggctccagtaa

SEQ ID NO: 46455 - protein, 313 aa, Shewanella amazonensis SB2B
MSLPETPTIRIGMAMWSHPGWKTVFPGLDAEARLTAYSRVFGTVEGNTSFYALPSAQQVSIWQRATPEDFRFTFKLPRRITHELSLRNCREEVLQFFRLFEPLMAKTGVWKIQLPARFGPESLSVLTQFLSLLPEGIGLGVEVRHRAFFAKGEAEKDFNRLLMDKGINRIIMDTRPVFALPAINEAITDAHQKKPRVPVHPLATGAHPVVRFIAQPHTPAAWGPGGKPADLGCADNLAFFAPWLGKLAGWLAEGRSPYLFIHTPDNSDAPLLASELAKQVAAHLQALHPGLPIPSVMLDSAESDGGQIGLGLQ

SEQ ID NO: 46456 - DNA, 729 bp, Rubrobacter xylanophilus DSM 9941
  CDS (1)..(729): transl_table=11
gtgggcggcagggtccacataggcacctccggctggcactacgaccactggcgggggacgttctacccgccggggctccccgcggaccgcctcctcgagcactacgcgacccgcttcgagaccgccgagataaacaactccttctaccggctccccgaggcgaagacgctggccggctggcgccggaggaccccgcggggcttcgtcttcgcggccaaggcctcccgctacctcacccacatgaagaagctccgggagccggaggagccgctccgcaggctcttcgggcggctggaggcgctgggcgagaagctcggcccggtcctcttccagctcccgccgcgctggcgggcgaacccggggaggctcgaggccctgctgaaggcgctgcctcccggccgccggtgcgccttcgagttccgggacgagagctggttctgcgaggaggtctaccgcctcctccaggagcacggggcggcgctgtgcgtctacgacctgggcgaaaggagctccccgcgccgcctcaccgccggcttcgcctacgcccggctccacggcccggagggcccctaccggggctgctacggcgagcggcagctcgcctcgtgggccgggctgctgggcggctgggccgaggaagggaccgaggtgtactgctacttcgacaacgacgaggcggggtacgccccccgcaacgccgcgcggctcaggcagatgatggaggtgtag

SEQ ID NO: 46457 - protein, 242 aa, Rubrobacter xylanophilus DSM 9941
MGGRVHIGTSGWHYDHWRGTFYPPGLPADRLLEHYATRFETAEINNSFYRLPEAKTLAGWRRRTPRGFVFAAKASRYLTHMKKLREPEEPLRRLFGRLEALGEKLGPVLFQLPPRWRANPGRLEALLKALPPGRRCAFEFRDESWFCEEVYRLLQEHGAALCVYDLGERSSPRRLTAGFAYARLHGPEGPYRGCYGERQLASWAGLLGGWAEEGTEVYCYFDNDEAGYAPRNAARLRQMMEV

SEQ ID NO: 46458 - DNA, 906 bp, Shewanella frigidimarina NCIMB 400
  CDS (1)..(906): transl_table=11
ttggacaacagcacttcaacagcgactattgatccgccattaagattaggtttagccatgtggtcacaaaaccaatggcaacaaaccgtttatggcaatagccaggcacatcgactggcacgttatgccgaaatatttaataccgtcgagggcaacactactttctatgccacgccgtcgttacagaatgtacaaaattggtacgctgcaacgcatgacgagtttaaatttacctttaaactgcccaaacacatcacccatgaattacagctccaacatgcaggcccagcgctacaacaattctttagcataatggagccccttattaaccgaaccggagtgtggaaaattcaacttcccgccagttttgggccacaatctttgccacaattagcacagtttttaactcaagtgccacaaggcctaacctatggtgtagaagttcgtaacagtgccttttttgctaaaggtgaagcagaacaagcattaaaccgcttattaatcgacaataactgcaatcgtatcattatggacacgaggcctgtttttgcagcagcgccaacaaccgcagcagtgatagatgcccaccagaaaaagccaaaagtgccagtacacgccattgcaaccgcacacaatcctgtggtgcgctttattggtcatccgcaagcggaagccaatatacattttttccaaaactggctaaaacaactgcctttatggatcgcgcaaaataaacaaccctatttatttatccacactccagacaatcacaatgcaccgcaattagcggtcgatttgtatcgtttactgcaacagcagttggcacaaagtacatctgcattgaccgacattaatctattacctcaacaacagcacaccacaactcaaatgggttttgatttgtga

SEQ ID NO: 46459 - protein, 301 aa, Shewanella frigidimarina NCIMB 400
MDNSTSTATIDPPLRLGLAMWSQNQWQQTVYGNSQAHRLARYAEIFNTVEGNTTFYATPSLQNVQNWYAATHDEFKFTFKLPKHITHELQLQHAGPALQQFFSIMEPLINRTGVWKIQLPASFGPQSLPQLAQFLTQVPQGLTYGVEVRNSAFFAKGEAEQALNRLLIDNNCNRIIMDTRPVFAAAPTTAAVIDAHQKKPKVPVHAIATAHNPVVRFIGHPQAEANIHFFQNWLKQLPLWIAQNKQPYLFIHTPDNHNAPQLAVDLYRLLQQQLAQSTSALTDINLLPQQQHTTTQMGFDL

SEQ ID NO: 46460 - DNA, 849 bp, Pseudoalteromonas haloplanktis TAC125
  CDS (1)..(849): transl_table=11
atgctatatattgggtgcccacagtggtcaagcaatgcgtggaaaggcaatttattttcgagccaatgtaaaaataccgatatgctaagccaatacgcgcaacattttaactctgtagagggaaataccagcttttacgccgacccatccccaagtactcttttacgctgggcaaacagtgtacccgacgattttaaatttacctttaagtttcatcggcgctttagccatgagctaaagctgactaatgtacacaacgagctaaccgcttggcttaacttatttgcaccaattttagagaaaactgggcaaattatgctgcagctgccaagtgcctttggccctaatgatttacccaagttagcgcaatttattagcctattacccaaagagctaaactttggggtagaagttcgccatccggcattttttcaaaagggtgaagccgaaatagcgcttaatcaattattaatggcaaataacataaaccgtatagccatggatacccgcgccctatttgcagttaaagcgaatacggaagcgctgattgatgcacaacaaaaaaagccgcatctgcccgtgcatgctattgctacaagtgagcaacccatggcacgttttgttattgctaatttacaaagtgaatataaaaccttttataagccttggcttagtaaagtaaaacagtggcttgatgaaggaaaaacgccctatgtattttttcataccgcagacaaccgagaagcaccgttattagcaaggcagttttgtaaggacctaggttataaccacaaggtactaaatccatttagcggcgaggcagaagcccaccagcaagcactgttttaa

SEQ ID NO: 46461 - protein, 282 aa, Pseudoalteromonas haloplanktis TAC125
MLYIGCPQWSSNAWKGNLFSSQCKNTDMLSQYAQHFNSVEGNTSFYADPSPSTLLRWANSVPDDFKFTFKFHRRFSHELKLTNVHNELTAWLNLFAPILEKTGQIMLQLPSAFGPNDLPKLAQFISLLPKELNFGVEVRHPAFFQKGEAEIALNQLLMANNINRIAMDTRALFAVKANTEALIDAQQKKPHLPVHAIATSEQPMARFVIANLQSEYKTFYKPWLSKVKQWLDEGKTPYVFFHTADNREAPLLARQFCKDLGYNHKVLNPFSGEAEAHQQALF

SEQ ID NO: 46462 - DNA, 726 bp, uncultured Acidobacteria bacterium
  CDS (1)..(726)
atgacccggttcgtcggtacagcagggtgggcaattccgcgacgatgggcggaactggcaccgagcgataggaaagggctagcgcgatacgcgagcgtcctgaacgcggtcgaaatcaactcgtcgttctaccggccccattcgcgcgatacatacgcgcgctgggcggcaaacgtgccggagagcttccggttctcggtcaagattcccaaagccattacccacgatgccaagctggtagacgtcgacgaaaccctgacgcggtttctcgaagaggcgagcgggcttggacgaaagcttggcgtcctcctcgtgcaactgcccgggcggtccgaattcgatggcgacgcggccaaggcgttcttcgcgatgcttcgaaccaagcatgctggtgacgtcgtctgcgaaccacgtcacccgagttggtttacgaacggcgcagatgcattgctacgcaagtatcgggtcgcgcgcgtcgctgcagatccacccaaaggacacaccgcatgtgagccgggcggctgggacagcttggtctatttccgcctgcacgggtcgccacggacatatttcacgccgtatcagcaacccttcctcgtagccatcgcgcagcgtgttttggagcgcgaggttccggcgtgggtcgtcttcgacaacaccggttctggcgctgcattcgagaacgccgcgcggatgagcgatctgctcgatctccagcggcgttag

SEQ ID NO: 46463 - protein, 241 aa, uncultured Acidobacteria bacterium
MTRFVGTAGWAIPRRWAELAPSDRKGLARYASVLNAVEINSSFYRPHSRDTYARWAANVPESFRFSVKIPKAITHDAKLVDVDETLTRFLEEASGLGRKLGVLLVQLPGRSEFDGDAAKAFFAMLRTKHAGDVVCEPRHPSWFTNGADALLRKYRVARVAADPPKGHTACEPGGWDSLVYFRLHGSPRTYFTPYQQPFLVAIAQRVLEREVPAWVVFDNTGSGAAFENAARMSDLLDLQRR

SEQ ID NO: 46464 - DNA, 24 bp, Artificial sequence
  (1)..(24): primer
atgatttacatcggtctaccgcaa

SEQ ID NO: 46465 - DNA, 27 bp, Artificial sequence
  (1)..(27): primer
ttagaaaagagaagattgctgtggaat

SEQ ID NO: 46466 - protein, 325 aa, Artificial sequence
  Variant (3)..(5): xaa in position 3 to 5 is any amino acid
  Variant (7)..(18): xaa in position 7 to 18 is any amino acid
  Variant (19)..(36): xaa in position 19 to 36 is any or no amino acid
  Variant (38)..(39): xaa in position 38 to 39 is any amino acid
  Variant (42)..(46): xaa in position 42 to 46 is any amino acid
  Variant (49)..(49): xaa in position 49 is any amino acid
  Variant (55)..(64): xaa in position 55 to 64 is any amino acid
  Variant (65)..(65): xaa in position 65 is any or no amino acid
  Variant (67)..(73): xaa in position 67 to 73 is any amino acid
  Variant (75)..(75): xaa in position 75 is any amino acid
  Variant (77)..(78): xaa in position 77 to 78 is any amino acid
  Variant (80)..(83): xaa in position 80 to 83 is any amino acid
  Variant (87)..(89): xaa in position 87 to 89 is any amino acid
  Variant (91)..(99): xaa in position 91 to 99 is any amino acid
  Variant (100)..(106): xaa in position 100 to 106 is any or no amino acid
  Variant (108)..(113): xaa in position 108 to 113 is any amino acid
  Variant (115)..(116): xaa in position 115 to 116 is any amino acid
  Variant (117)..(122): xaa in position 117 to 122 is any or no amino acid
  Variant (125)..(129): xaa in position 125 to 129 is any amino acid
  Variant (133)..(155): xaa in position 133 to 155 is any amino acid
  Variant (156)..(161): xaa in position 156 to 161 is any or no amino acid
  Variant (164)..(164): xaa in position 164 is any amino acid
  Variant (166)..(168): xaa in position 166 to 168 is any amino acid
  Variant (171)..(175): xaa in position 171 to 175 is any amino acid
  Variant (176)..(182): xaa in position 176 to 182 is any or no amino acid
  Variant (184)..(193): xaa in position 184 to 193 is any amino acid
  Variant (195)..(209): xaa in position 195 to 209 is any amino acid
  Variant (210)..(233): xaa in position 210 to 233 is any or no amino acid
  Variant (236)..(237): xaa in position 236 to 237 is any amino acid
  Variant (239)..(254): xaa in position 239 to 254 is any amino acid
  Variant (255)..(273): xaa in position 255 to 273 is any or no amino acid
  Variant (275)..(282): xaa in position 275 to 282 is any amino acid
  Variant (283)..(302): xaa in position 283 to 302 is any or no amino acid
  Variant (304)..(313): xaa in position 304 to 313 is any amino acid
  Variant (315)..(317): xaa in position 315 to 317 is any amino acid
  Variant (319)..(324): xaa in position 319 to 324 is any amino acid
IGXXXWXXXXXXXXXXXXXXXXXXXXXXXXXXXXXXLXXYAXXXXXVEXNTTFYXXXXXXXXXXXWXXXXXXXFXFXXKXXXXITHXXXLXXXXXXXXXXXXXXXXFXXXXXXLXXXXXXXXRLXXXXXQLPXXXXXXXXXXXXXXXXXXXXXXXXXXXXXVEXRXXXFFXXXXXXXXXXXXLXXXXXXXXXXDXXXXXXXXXXXXXXXXXXXXXXXXXXXXXXXXXXXXXXXVRXXGXXXXXXXXXXXXXXXXXXXXXXXXXXXXXXXXXXXVXXXXXXXXXXXXXXXXXXXXXXXXXXXXYXXXXXXXXXXAXXXAXXXXXXL

SEQ ID NO: 46467 - protein, 18 aa, Artificial sequence
  Variant (2)..(4): xaa in position 2 to 4 is any amino acid
  Variant (5)..(5): xaa in position 5 is Ala, Cys, Gly, Ser, Thr or Val
  Variant (6)..(10): xaa in position 6 to 10 is any amino acid
  Variant (13)..(13): xaa in position 13 is Gly, Ile, Leu or Val
  Variant (14)..(14): xaa in position 14 is Asp or Asn
  Variant (15)..(15): xaa in position 15 is any amino acid
  Variant (16)..(16): xaa in position 16 is Ala, Pro, Ser or Thr
LXXXXXXXXXVEXXXXFY

SEQ ID NO: 46468 - protein, 25 aa, Artificial sequence
  Variant (2)..(8): xaa in position 2 to 8 is any amino acid
  Variant (10)..(10): xaa in position 10 is any amino acid
  Variant (11)..(11): xaa in position 11 is Phe or Val
  Variant (12)..(13): xaa in position 12 to 13 is any amino acid
  Variant (15)..(18): xaa in position 15 to 18 is any amino acid
  Variant (19)..(19): xaa in position 19 is Phe, Ile, Leu or Val
  Variant (20)..(20): xaa in position 20 is Ser or Thr
  Variant (22)..(24): xaa in position 22 to 24 is any amino acid
WXXXXXXXFXXXXKXXXXXXHXXXL

SEQ ID NO: 46469 - protein, 13 aa, Artificial sequence
  Variant (2)..(9): xaa in position 2 to 9 is any amino acid
  Variant (10)..(10): xaa in position 10 is any or no amino acid
  Variant (12)..(12): xaa in position 12 is Phe or Leu
  Variant (13)..(13): xaa in position 13 is Pro or Ser
LXXXXXXXXXQXX

SEQ ID NO: 46470 - protein, 17 aa, Artificial sequence
  Variant (2)..(2): xaa in position 2 is any amino acid
  Variant (4)..(14): xaa in position 4 to 14 is any amino acid
  Variant (15)..(16): xaa in position 15 to 16 is any or no amino acid
EXRXXXXXXXXXXXXXL

SEQ ID NO: 46471 - DNA, 1122 bp, Escherichia coli K12; identical to SEQ ID NO: 21814
  CDS (1)..(1122)

SEQ ID NO: 46472 - protein, 373 aa, Escherichia coli K12; identical to SEQ ID NO: 21815

SEQ ID NO: 46473 - DNA, 1122 bp, Yersinia pestis; identical to SEQ ID NO: 21816
  CDS (1)..(1122)

SEQ ID NO: 46474 - protein, 373 aa, Yersinia pestis; identical to SEQ ID NO: 21817

SEQ ID NO: 46475 - DNA, 1122 bp, Salmonella enterica subsp. enterica serovar Typhi; identical to SEQ ID NO: 21818
  CDS (1)..(1122)

SEQ ID NO: 46476 - protein, 373 aa, Salmonella enterica subsp. enterica serovar Typhi; identical to SEQ ID NO: 21819

SEQ ID NO: 46477 - DNA, 1128 bp, Vibrio cholerae; identical to SEQ ID NO: 21820
  CDS (1)..(1128)

SEQ ID NO: 46478 - protein, 375 aa, Vibrio cholerae; identical to SEQ ID NO: 21821

SEQ ID NO: 46479 - DNA, 1134 bp, Haemophilus influenzae; identical to SEQ ID NO: 21822
  CDS (1)..(1134)

SEQ ID NO: 46480 - protein, 377 aa, Haemophilus influenzae; identical to SEQ ID NO: 21823

SEQ ID NO: 46481 - DNA, 1122 bp, Erwinia herbicola; identical to SEQ ID NO: 21824
  CDS (1)..(1122)

SEQ ID NO: 46482 - protein, 373 aa, Erwinia herbicola; identical to SEQ ID NO: 21825

SEQ ID NO: 46483 - DNA, 1131 bp, Mannheimia succiniciproducens MBEL55E; identical to SEQ ID NO: 21826
  CDS (1)..(1131)

SEQ ID NO: 46484 - protein, 376 aa, Mannheimia succiniciproducens MBEL55E; identical to SEQ ID NO: 21827

SEQ ID NO: 46485 - DNA, 1122 bp, Erwinia carotovora; identical to SEQ ID NO: 21828
  CDS (1)..(1122)

SEQ ID NO: 46486 - protein, 373 aa, Erwinia carotovora; identical to SEQ ID NO: 21829

SEQ ID NO: 46487 - DNA, 1128 bp, Photobacterium profundum; identical to SEQ ID NO: 21830
  CDS (1)..(1128)

SEQ ID NO: 46488 - protein, 375 aa, Photobacterium profundum; identical to SEQ ID NO: 21831

SEQ ID NO: 46489 - DNA, 1128 bp, Vibrio vulnificus; identical to SEQ ID NO: 21832
  CDS (1)..(1128)

SEQ ID NO: 46490 - protein, 375 aa, Vibrio vulnificus; identical to SEQ ID NO: 21833

SEQ ID NO: 46491 - DNA, 1122 bp, Photorhabdus luminescens; identical to SEQ ID NO: 21834
  CDS (1)..(1122)

SEQ ID NO: 46492 - protein, 373 aa, Photorhabdus luminescens; identical to SEQ ID NO: 21835

SEQ ID NO: 46493 - DNA, 1134 bp, Candidatus Blochmannia floridanus; identical to SEQ ID NO: 21836
  CDS (1)..(1134)

SEQ ID NO: 46494 - protein, 377 aa, Candidatus Blochmannia floridanus; identical to SEQ ID NO: 21837

SEQ ID NO: 46495 - DNA, 1128 bp, Vibrio parahaemolyticus; identical to SEQ ID NO: 21838
  CDS (1)..(1128)

SEQ ID NO: 46496 - protein, 375 aa, Vibrio parahaemolyticus; identical to SEQ ID NO: 21839

SEQ ID NO: 46497 - DNA, 1140 bp, Shewanella oneidensis; identical to SEQ ID NO: 21840
  CDS (1)..(1140)

SEQ ID NO: 46498 - protein, 379 aa, Shewanella oneidensis; identical to SEQ ID NO: 21841

SEQ ID NO: 46499 - DNA, 1125 bp, Pasteurella multocida; identical to SEQ ID NO: 21842
  CDS (1)..(1125)

SEQ ID NO: 46500 - protein, 374 aa, Pasteurella multocida; identical to SEQ ID NO: 21843

SEQ ID NO: 46501 - DNA, 24 bp, Artificial sequence
  (1)..(24): primer
atggttgctgaattgaccgcatta

SEQ ID NO: 46502 - DNA, 23 bp, Artificial sequence
  (1)..(23): primer
ttactggcgattgtcattcgcct

SEQ ID NO: 46503 - protein, 370 aa, Artificial sequence; identical to SEQ ID NO: 21846
  Variant (2)..(4): xaa in position 2 to 4 is any amino acid
  Variant (6)..(7): xaa in position 6 to 7 is any amino acid
  Variant (10)..(11): xaa in position 10 to 11 is any amino acid
  Variant (13)..(21): xaa in position 13 to 21 is any amino acid
  Variant (24)..(24): xaa in position 24 is any amino acid
  Variant (27)..(29): xaa in position 27 to 29 is any amino acid
  Variant (31)..(32): xaa in position 31 to 32 is any amino acid
  Variant (34)..(36): xaa in position 34 to 36 is any amino acid
  Variant (39)..(39): xaa in position 39 is any amino acid
  Variant (42)..(42): xaa in position 42 is any amino acid
  Variant (44)..(44): xaa in position 44 is any amino acid
  Variant (47)..(49): xaa in position 47 to 49 is any amino acid
  Variant (51)..(52): xaa in position 51 to 52 is any amino acid
  Variant (54)..(55): xaa in position 54 to 55 is any amino acid
  Variant (58)..(60): xaa in position 58 to 60 is any amino acid
  Variant (62)..(65): xaa in position 62 to 65 is any amino acid
  Variant (67)..(68): xaa in position 67 to 68 is any amino acid
  Variant (70)..(70): xaa in position 70 is any amino acid
  Variant (74)..(74): xaa in position 74 is any amino acid
  Variant (80)..(81): xaa in position 80 to 81 is any amino acid
  Variant (83)..(85): xaa in position 83 to 85 is any amino acid
  Variant (89)..(97): xaa in position 89 to 97 is any amino acid
  Variant (99)..(100): xaa in position 99 to 100 is any amino acid
  Variant (103)..(103): xaa in position 103 is any amino acid
  Variant (105)..(106): xaa in position 105 to 106 is any amino acid
  Variant (108)..(109): xaa in position 108 to 109 is any amino acid
  Variant (111)..(116): xaa in position 111 to 116 is any amino acid
  Variant (120)..(123): xaa in position 120 to 123 is any amino acid
  Variant (125)..(127): xaa in position 125 to 127 is any amino acid
  Variant (130)..(131): xaa in position 130 to 131 is any amino acid
  Variant (133)..(145): xaa in position 133 to 145 is any amino acid
  Variant (149)..(154): xaa in position 149 to 154 is any amino acid
  Variant (156)..(161): xaa in position 156 to 161 is any amino acid
  Variant (163)..(169): xaa in position 163 to 169 is any amino acid
  Variant (172)..(172): xaa in position 172 is any amino acid
  Variant (174)..(174): xaa in position 174 is any amino acid
  Variant (176)..(182): xaa in position 176 to 182 is any amino acid
  Variant (184)..(185): xaa in position 184 to 185 is any amino acid
  Variant (187)..(187): xaa in position 187 is any amino acid
  Variant (189)..(189): xaa in position 189 is any amino acid
  Variant (191)..(191): xaa in position 191 is any amino acid
  Variant (193)..(193): xaa in position 193 is any amino acid
  Variant (198)..(199): xaa in position 198 to 199 is any amino acid
  Variant (201)..(205): xaa in position 201 to 205 is any amino acid
  Variant (207)..(208): xaa in position 207 to 208 is any amino acid
  Variant (210)..(210): xaa in position 210 is any amino acid
  Variant (212)..(214): xaa in position 212 to 214 is any amino acid
  Variant (216)..(216): xaa in position 216 is any amino acid
  Variant (219)..(222): xaa in position 219 to 222 is any amino acid
  Variant (224)..(224): xaa in position 224 is any amino acid
  Variant (226)..(228): xaa in position 226 to 228 is any amino acid
  Variant (230)..(232): xaa in position 230 to 232 is any amino acid
  Variant (236)..(244): xaa in position 236 to 244 is any amino acid
  Variant (247)..(248): xaa in position 247 to 248 is any amino acid
  Variant (250)..(252): xaa in position 250 to 252 is any amino acid
  Variant (254)..(256): xaa in position 254 to 256 is any amino acid
  Variant (259)..(260): xaa in position 259 to 260 is any amino acid
  Variant (262)..(263): xaa in position 262 to 263 is any amino acid
  Variant (265)..(266): xaa in position 265 to 266 is any amino acid
  Variant (268)..(280): xaa in position 268 to 280 is any amino acid
  Variant (284)..(286): xaa in position 284 to 286 is any amino acid
  Variant (290)..(292): xaa in position 290 to 292 is any amino acid
  Variant (297)..(297): xaa in position 297 is any amino acid
  Variant (299)..(301): xaa in position 299 to 301 is any amino acid
  Variant (304)..(304): xaa in position 304 is any amino acid
  Variant (308)..(316): xaa in position 308 to 316 is any amino acid
  Variant (318)..(338): xaa in position 318 to 338 is any amino acid
  Variant (340)..(342): xaa in position 340 to 342 is any amino acid
  Variant (344)..(348): xaa in position 344 to 348 is any amino acid
  Variant (350)..(356): xaa in position 350 to 356 is any amino acid
  Variant (358)..(360): xaa in position 358 to 360 is any amino acid
  Variant (362)..(364): xaa in position 362 to 364 is any amino acid
  Variant (366)..(369): xaa in position 366 to 369 is any amino acid

SEQ ID NO: 46504 - protein, 370 aa, Artificial sequence; identical to SEQ ID NO: 21847
  Variant (2)..(3): xaa in position 2 to 3 is any amino acid
  Variant (6)..(7): xaa in position 6 to 7 is any amino acid
  Variant (10)..(10): xaa in position 10 is any amino acid
  Variant (13)..(17): xaa in position 13 to 17 is any amino acid
  Variant (21)..(21): xaa in position 21 is any amino acid
  Variant (24)..(24): xaa in position 24 is any amino acid
  Variant (27)..(28): xaa in position 27 to 28 is any amino acid
  Variant (31)..(31): xaa in position 31 is any amino acid
  Variant (34)..(36): xaa in position 34 to 36 is any amino acid
  Variant (42)..(42): xaa in position 42 is any amino acid
  Variant (44)..(44): xaa in position 44 is any amino acid
  Variant (48)..(48): xaa in position 48 is any amino acid
  Variant (51)..(52): xaa in position 51 to 52 is any amino acid
  Variant (55)..(55): xaa in position 55 is any amino acid
  Variant (58)..(60): xaa in position 58 to 60 is any amino acid
  Variant (62)..(63): xaa in position 62 to 63 is any amino acid
  Variant (65)..(65): xaa in position 65 is any amino acid
  Variant (70)..(70): xaa in position 70 is any amino acid
  Variant (74)..(74): xaa in position 74 is any amino acid
  Variant (80)..(81): xaa in position 80 to 81 is any amino acid
  Variant (83)..(85): xaa in position 83 to 85 is any amino acid
  Variant (89)..(91): xaa in position 89 to 91 is any amino acid
  Variant (93)..(97): xaa in position 93 to 97 is any amino acid
  Variant (100)..(100): xaa in position 100 is any amino acid
  Variant (103)..(103): xaa in position 103 is any amino acid
  Variant (105)..(106): xaa in position 105 to 106 is any amino acid
  Variant (108)..(108): xaa in position 108 is any amino acid
  Variant (111)..(115): xaa in position 111 to 115 is any amino acid
  Variant (120)..(120): xaa in position 120 is any amino acid
  Variant (122)..(123): xaa in position 122 to 123 is any amino acid
  Variant (125)..(127): xaa in position 125 to 127 is any amino acid
  Variant (130)..(131): xaa in position 130 to 131 is any amino acid
  Variant (133)..(135): xaa in position 133 to 135 is any amino acid
  Variant (137)..(138): xaa in position 137 to 138 is any amino acid
  Variant (141)..(141): xaa in position 141 is any amino acid
  Variant (143)..(143): xaa in position 143 is any amino acid
  Variant (145)..(145): xaa in position 145 is any amino acid
  Variant (149)..(150): xaa in position 149 to 150 is any amino acid
  Variant (152)..(154): xaa in position 152 to 154 is any amino acid
  Variant (156)..(157): xaa in position 156 to 157 is any amino acid
  Variant (159)..(161): xaa in position 159 to 161 is any amino acid
  Variant (163)..(164): xaa in position 163 to 164 is any amino acid
  Variant (169)..(169): xaa in position 169 is any amino acid
  Variant (172)..(172): xaa in position 172 is any amino acid
  Variant (174)..(174): xaa in position 174 is any amino acid
  Variant (176)..(177): xaa in position 176 to 177 is any amino acid
  Variant (180)..(180): xaa in position 180 is any amino acid
  Variant (184)..(185): xaa in position 184 to 185 is any amino acid
  Variant (187)..(187): xaa in position 187 is any amino acid
  Variant (191)..(191): xaa in position 191 is any amino acid
  Variant (201)..(205): xaa in position 201 to 205 is any amino acid
  Variant (207)..(207): xaa in position 207 is any amino acid
  Variant (212)..(212): xaa in position 212 is any amino acid
  Variant (214)..(214): xaa in position 214 is any amino acid
  Variant (219)..(222): xaa in position 219 to 222 is any amino acid
  Variant (226)..(226): xaa in position 226 is any amino acid
  Variant (228)..(228): xaa in position 228 is any amino acid
  Variant (230)..(232): xaa in position 230 to 232 is any amino acid
  Variant (236)..(241): xaa in position 236 to 241 is any amino acid
  Variant (243)..(243): xaa in position 243 is any amino acid
  Variant (247)..(248): xaa in position 247 to 248 is any amino acid
  Variant (250)..(251): xaa in position 250 to 251 is any amino acid
  Variant (259)..(260): xaa in position 259 to 260 is any amino acid
  Variant (263)..(263): xaa in position 263 is any amino acid
  Variant (265)..(265): xaa in position 265 is any amino acid
  Variant (268)..(269): xaa in position 268 to 269 is any amino acid
  Variant (271)..(273): xaa in position 271 to 273 is any amino acid
  Variant (275)..(276): xaa in position 275 to 276 is any amino acid
  Variant (279)..(279): xaa in position 279 is any amino acid
  Variant (292)..(292): xaa in position 292 is any amino acid
  Variant (300)..(301): xaa in position 300 to 301 is any amino acid
  Variant (308)..(312): xaa in position 308 to 312 is any amino acid
  Variant (314)..(316): xaa in position 314 to 316 is any amino acid
  Variant (318)..(326): xaa in position 318 to 326 is any amino acid
  Variant (328)..(334): xaa in position 328 to 334 is any amino acid
  Variant (337)..(338): xaa in position 337 to 338 is any amino acid
  Variant (340)..(342): xaa in position 340 to 342 is any amino acid
  Variant (344)..(345): xaa in position 344 to 345 is any amino acid
  Variant (347)..(348): xaa in position 347 to 348 is any amino acid
  Variant (352)..(352): xaa in position 352 is any amino acid
  Variant (354)..(356): xaa in position 354 to 356 is any amino acid
  Variant (358)..(359): xaa in position 358 to 359 is any amino acid
  Variant (362)..(363): xaa in position 362 to 363 is any amino acid
  Variant (366)..(366): xaa in position 366 is any amino acid

SEQ ID NO: 46505 - protein, 62 aa, Artificial sequence; identical to SEQ ID NO: 21848
  Variant (2)..(3): xaa in position 2 to 3 is any amino acid
  Variant (4)..(4): xaa in position 4 is Leu or Ile
  Variant (6)..(7): xaa in position 6 to 7 is any amino acid
  Variant (10)..(10): xaa in position 10 is any amino acid
  Variant (11)..(11): xaa in position 11 is Val, Leu or Ile
  Variant (13)..(13): xaa in position 13 is Lys, Gln or Arg
  Variant (14)..(14): xaa in position 14 is any amino acid
  Variant (15)..(15): xaa in position 15 is Leu or Met
  Variant (16)..(16): xaa in position 16 is Leu, Val or Ile
  Variant (17)..(17): xaa in position 17 is any amino acid
  Variant (18)..(18): xaa in position 18 is Leu or Val
  Variant (19)..(19): xaa in position 19 is Leu or Phe
  Variant (20)..(20): xaa in position 20 is Ala, Ser or Arg
  Variant (21)..(21): xaa in position 21 is Lys, Gln or Arg
  Variant (24)..(24): xaa in position 24 is any amino acid
  Variant (27)..(27): xaa in position 27 is any amino acid
  Variant (28)..(28): xaa in position 28 is Gln, Glu or Lys
  Variant (29)..(29): xaa in position 29 is Val or Ile
  Variant (31)..(31): xaa in position 31 is any amino acid
  Variant (32)..(32): xaa in position 32 is Val or Ile
  Variant (34)..(34): xaa in position 34 is Ser or His
  Variant (35)..(36): xaa in position 35 to 36 is any amino acid
  Variant (39)..(39): xaa in position 39 is any amino acid
  Variant (42)..(42): xaa in position 42 is Ala, Val or Asp
  Variant (44)..(44): xaa in position 44 is Asp, Glu or Gln
  Variant (47)..(48): xaa in position 47 to 48 is any amino acid
  Variant (49)..(49): xaa in position 49 is Met or Ile
  Variant (51)..(52): xaa in position 51 to 52 is any amino acid
  Variant (54)..(54): xaa in position 54 is Arg or Lys
  Variant (55)..(55): xaa in position 55 is any amino acid
  Variant (58)..(60): xaa in position 58 to 60 is any amino acid
  Variant (62)..(62): xaa in position 62 is Val or Ile

SEQ ID NO: 46506 - protein, 23 aa, Artificial sequence
  Variant (2)..(2): xaa in position 2 is Ile, Val or Leu
  Variant (3)..(3): xaa in position 3 is Glu or Arg
  Variant (5)..(5): xaa in position 5 is Ile, Val or Leu
  Variant (9)..(9): xaa in position 9 is any amino acid
  Variant (15)..(16): xaa in position 15 to 16 is any amino acid
  Variant (18)..(18): xaa in position 18 is Asn, Lys or His
  Variant (19)..(20): xaa in position 19 to 20 is any amino acid
LXXDXLRRXMRESYXXEXXXGFK

SEQ ID NO: 46507 - protein, 52 aa, Artificial sequence; identical to SEQ ID NO: 21850
  Variant (1)..(1): xaa in position 1 is Val, Ile or Leu
  Variant (3)..(3): xaa in position 3 is Ile, Val or Leu
  Variant (4)..(4): xaa in position 4 is Val, Ile or Leu
  Variant (7)..(7): xaa in position 7 is any amino acid
  Variant (9)..(9): xaa in position 9 is Gln, Lys or Arg
  Variant (10)..(10): xaa in position 10 is Leu or Met
  Variant (12)..(12): xaa in position 12 is any amino acid
  Variant (13)..(13): xaa in position 13 is Leu or Phe
  Variant (15)..(15): xaa in position 15 is any amino acid
  Variant (16)..(16): xaa in position 16 is Arg, Lys or Gln
  Variant (17)..(17): xaa in position 17 is any amino acid
  Variant (18)..(18): xaa in position 18 is Leu or Phe
  Variant (19)..(19): xaa in position 19 is any amino acid
  Variant (20)..(20): xaa in position 20 is Leu or Ala
  Variant (24)..(24): xaa in position 24 is any amino acid
  Variant (25)..(25): xaa in position 25 is Val or Ile
  Variant (26)..(27): xaa in position 26 to 27 is any amino acid
  Variant (29)..(29): xaa in position 29 is Glu, Gly or Asp
  Variant (30)..(31): xaa in position 30 to 31 is any amino acid
  Variant (34)..(35): xaa in position 34 to 35 is any amino acid
  Variant (37)..(38): xaa in position 37 to 38 is any amino acid
  Variant (39)..(39): xaa in position 39 is Ile or Leu
  Variant (40)..(40): xaa in position 40 is Leu, Val or Phe
  Variant (41)..(42): xaa in position 41 to 42 is any amino acid
  Variant (43)..(43): xaa in position 43 is Ala, Val or Thr
  Variant (44)..(44): xaa in position 44 is Gly, Asp or Asn
  Variant (45)..(45): xaa in position 45 is Met, Leu, Val or Ala
  Variant (46)..(46): xaa in position 46 is Val, Ile or Leu
  Variant (47)..(47): xaa in position 47 is Ile, Leu, Val or Phe
  Variant (48)..(48): xaa in position 48 is Val, Ile or Leu
  Variant (49)..(49): xaa in position 49 is Ser, Thr or Cys

SEQ ID NO: 46508 - protein, 34 aa, Artificial sequence; identical to SEQ ID NO: 21851
  Variant (1)..(1): xaa in position 1 is Ile, Leu or Val
  Variant (2)..(2): xaa in position 2 is Leu, Ile or Val
  Variant (3)..(3): xaa in position 3 is any amino acid
  Variant (6)..(6): xaa in position 6 is Thr, Ala or Ser
  Variant (8)..(8): xaa in position 8 is Val, Ile or Leu
  Variant (10)..(11): xaa in position 10 to 11 is any amino acid
  Variant (12)..(12): xaa in position 12 is Pro or Ser
  Variant (13)..(13): xaa in position 13 is Leu or Met
  Variant (14)..(15): xaa in position 14 to 15 is any amino acid
  Variant (16)..(16): xaa in position 16 is Met or Ile
  Variant (18)..(18): xaa in position 18 is any amino acid
  Variant (19)..(19): xaa in position 19 is Val, Ala or Ile
  Variant (21)..(21): xaa in position 21 is any amino acid
  Variant (23)..(23): xaa in position 23 is Pro or Ala
  Variant (25)..(25): xaa in position 25 is Leu, Val or Ile
  Variant (27)..(27): xaa in position 27 is Leu or Phe
  Variant (32)..(32): xaa in position 32 is Gly or Ser
  Variant (33)..(33): xaa in position 33 is Pro or Ala

SEQ ID NO: 46509 - protein, 30 aa, Artificial sequence; identical to SEQ ID NO: 21852
  Variant (2)..(2): xaa in position 2 is Leu or Met
  Variant (3)..(3): xaa in position 3 is Ala, Ile or Val
  Variant (5)..(5): xaa in position 5 is Gln or Lys
  Variant (7)..(8): xaa in position 7 to 8 is Val, Ile or Leu
  Variant (9)..(9): xaa in position 9 is any amino acid
  Variant (11)..(11): xaa in position 11 is Asp or His
  Variant (14)..(17): xaa in position 14 to 17 is any amino acid
  Variant (19)..(19): xaa in position 19 is Gln or Glu
  Variant (21)..(21): xaa in position 21 is Leu or Phe
  Variant (22)..(22): xaa in position 22 is Leu, Ile or Val
  Variant (23)..(23): xaa in position 23 is Glu, Gln or Thr
  Variant (25)..(25): xaa in position 25 is Ile, Phe or Leu
  Variant (26)..(26): xaa in position 26 is any amino acid
  Variant (27)..(27): xaa in position 27 is Ile, Val, Leu or Met

SEQ ID NO: 46510 - protein, 23 aa, Artificial sequence
  Variant (3)..(4): xaa in position 3 to 4 is any amino acid
  Variant (6)..(6): xaa in position 6 is any amino acid
  Variant (7)..(7): xaa in position 7 is Phe, Leu or Tyr
  Variant (8)..(8): xaa in position 8 is Ile or Val
  Variant (10)..(10): xaa in position 10 is Ala or Ser
  Variant (11)..(11): xaa in position 11 is Leu or Met
  Variant (12)..(12): xaa in position 12 is Arg or Cys
  Variant (15)..(15): xaa in position 15 is Ala, Thr or Ser
  Variant (16)..(16): xaa in position 16 is Thr, Ser or Ile
  Variant (18)..(18): xaa in position 18 is Ala or Val
  Variant (19)..(19): xaa in position 19 is any amino acid
  Variant (21)..(21): xaa in position 21 is any amino acid
  Variant (22)..(22): xaa in position 22 is His or Asn
HDXXMXXXQXXXHFXXFXXGXXL

SEQ ID NO: 46511 - protein, 37 aa, Artificial sequence; identical to SEQ ID NO: 21854
  Variant (4)..(4): xaa in position 4 is Ile, Met, Leu or Phe
  Variant (5)..(5): xaa in position 5 is Tyr or Phe
  Variant (6)..(6): xaa in position 6 is Arg, Gln or Cys
  Variant (10)..(10): xaa in position 10 is Ala or Ile
  Variant (11)..(11): xaa in position 11 is Met, Leu, Val or Ile
  Variant (12)..(12): xaa in position 12 is Val, Ile or Leu
  Variant (17)..(17): xaa in position 17 is Ala, Gly or Thr
  Variant (19)..(21): xaa in position 19 to 21 is any amino acid
  Variant (24)..(24): xaa in position 24 is Ala or Gly
  Variant (28)..(28): xaa in position 28 is Met, Leu or Phe
  Variant (29)..(29): xaa in position 29 is Ser, Asp or Ala
  Variant (30)..(32): xaa in position 30 to 32 is any amino acid
  Variant (33)..(33): xaa in position 33 is Asn or Ser
  Variant (34)..(34): xaa in position 34 is Leu, Ile, Val or Gln
  Variant (35)..(35): xaa in position 35 is any amino acid
  Variant (36)..(36): xaa in position 36 is Leu, Met, Val or Ala

SEQ ID NO: 46512 - DNA, 1071 bp, Escherichia coli K12; identical to SEQ ID NO: 1333
  CDS (1)..(1071)

SEQ ID NO: 46513 - protein, 356 aa, Escherichia coli K12; identical to SEQ ID NO: 1334

SEQ ID NO: 46514 - DNA, 1235 bp, Salmonella typhimurium; identical to SEQ ID NO: 1325
  CDS (165)..(1235)

SEQ ID NO: 46515 - protein, 356 aa, Salmonella typhimurium; identical to SEQ ID NO: 1326

SEQ ID NO: 46516 - DNA, 1086 bp, Deinococcus radiodurans; identical to SEQ ID NO: 1327
  CDS (1)..(1086)

SEQ ID NO: 46517 - protein, 361 aa, Deinococcus radiodurans; identical to SEQ ID NO: 1328

SEQ ID NO: 46518 - DNA, 1056 bp, Neisseria meningitidis; identical to SEQ ID NO: 1329
  CDS (1)..(1056)

SEQ ID NO: 46519 - protein, 351 aa, Neisseria meningitidis; identical to SEQ ID NO: 1330

SEQ ID NO: 46520 - DNA, 1047 bp, Yersinia pestis; identical to SEQ ID NO: 1331
  CDS (1)..(1047)

SEQ ID NO: 46521 - protein, 348 aa, Yersinia pestis; identical to SEQ ID NO: 1332

SEQ ID NO: 46522 - DNA, 1047 bp, Salmonella enterica subsp. enterica serovar Typhi; identical to SEQ ID NO: 1575
  CDS (1)..(1047)

SEQ ID NO: 46523 - protein, 348 aa, Salmonella enterica subsp. enterica serovar Typhi; identical to SEQ ID NO: 1576

SEQ ID NO: 46524 - DNA, 1047 bp, Escherichia coli; identical to SEQ ID NO: 1323
  CDS (1)..(1047)

SEQ ID NO: 46525 - protein, 348 aa, Escherichia coli; identical to SEQ ID NO: 1324

SEQ ID NO: 46526 - DNA, 1188 bp, Escherichia coli; identical to SEQ ID NO: 1579
  CDS (92)..(1144)

SEQ ID NO: 46527 - protein, 350 aa, Escherichia coli; identical to SEQ ID NO: 1580

SEQ ID NO: 46528 - DNA, 1131 bp, Nostoc sp. PCC 7120; identical to SEQ ID NO: 1335
  CDS (1)..(1131)

SEQ ID NO: 46529 - protein, 376 aa, Nostoc sp. PCC 7120; identical to SEQ ID NO: 1336

SEQ ID NO: 46530 - DNA, 1053 bp, Salmonella enterica subsp. enterica serovar Typhi; identical to SEQ ID NO: 1337
  CDS (1)..(1053)

SEQ ID NO: 46531 - protein, 350 aa, Salmonella enterica subsp. enterica serovar Typhi; identical to SEQ ID NO: 1338

SEQ ID NO: 46532 - DNA, 1077 bp, Pseudomonas aeruginosa; identical to SEQ ID NO: 1339
  CDS (1)..(1077)

SEQ ID NO: 46533 - protein, 358 aa, Pseudomonas aeruginosa; identical to SEQ ID NO: 1340

SEQ ID NO: 46534 - DNA, 1047 bp, Buchnera sp; identical to SEQ ID NO: 1341
  CDS (1)..(1047)

SEQ ID NO: 46535 - protein, 348 aa, Buchnera sp; identical to SEQ ID NO: 1342

SEQ ID NO: 46536 - DNA, 1032 bp, Streptococcus pneumoniae; identical to SEQ ID NO: 1589
  CDS (1)..(1032)

SEQ ID NO: 46537 - protein, 343 aa, Streptococcus pneumoniae; identical to SEQ ID NO: 1590

SEQ ID NO: 46538 - DNA, 1074 bp, Vibrio cholerae; identical to SEQ ID NO: 1343
  CDS (1)..(1074)

SEQ ID NO: 46539 - protein, 357 aa, Vibrio cholerae; identical to SEQ ID NO: 1344

SEQ ID NO: 46540 - DNA, 1038 bp, Lactococcus lactis subsp. lactis; identical to SEQ ID NO: 1345
  CDS (1)..(1038)

SEQ ID NO: 46541 - protein, 345 aa, Lactococcus lactis subsp. lactis; identical to SEQ ID NO: 1346

SEQ ID NO: 46542 - DNA, 1023 bp, Lactococcus lactis subsp. lactis; identical to SEQ ID NO: 1347
  CDS (1)..(1023)

SEQ ID NO: 46543 - protein, 340 aa, Lactococcus lactis subsp. lactis; identical to SEQ ID NO: 1348

SEQ ID NO: 46544 - DNA, 1032 bp, Streptococcus pneumoniae; identical to SEQ ID NO: 1597
  CDS (1)..(1032)

SEQ ID NO: 46545 - protein, 343 aa, Streptococcus pneumoniae; identical to SEQ ID NO: 1350

SEQ ID NO: 46546 - DNA, 1095 bp, Pseudomonas aeruginosa; identical to SEQ ID NO: 1351
  CDS (1)..(1095)

SEQ ID NO: 46547 - protein, 364 aa, Pseudomonas aeruginosa; identical to SEQ ID NO: 1352

SEQ ID NO: 46548 - DNA, 1110 bp, Caulobacter crescentus; identical to SEQ ID NO: 1353
  CDS (1)..(1110)

SEQ ID NO: 46549 - protein, 369 aa, Caulobacter crescentus; identical to SEQ ID NO: 1354

SEQ ID NO: 46550 - DNA, 1143 bp, Xylella fastidiosa; identical to SEQ ID NO: 1603
  CDS (1)..(1143)

SEQ ID NO: 46551 - protein, 380 aa, Xylella fastidiosa; identical to SEQ ID NO: 1604

SEQ ID NO: 46552 - DNA, 1047 bp, Buchnera aphidicola; identical to SEQ ID NO: 1357
  CDS (1)..(1047)

SEQ ID NO: 46553 - protein, 348 aa, Buchnera aphidicola; identical to SEQ ID NO: 1358

SEQ ID NO: 46554 - DNA, 1089 bp, Haemophilus influenzae; identical to SEQ ID NO: 1359
  CDS (1)..(1089)

SEQ ID NO: 46555 - protein, 362 aa, Haemophilus influenzae; identical to SEQ ID NO: 1360

SEQ ID NO: 46556 - DNA, 1502 bp, Candida albicans; identical to SEQ ID NO: 1361
  CDS (336)..(1442)

SEQ ID NO: 46557 - protein, 368 aa, Candida albicans; identical to SEQ ID NO: 1362

SEQ ID NO: 46558 - DNA, 1113 bp, Saccharomyces cerevisiae; identical to SEQ ID NO: 1363
  CDS (1)..(1113)

SEQ ID NO: 46559 - protein, 370 aa, Saccharomyces cerevisiae; identical to SEQ ID NO: 1364

SEQ ID NO: 46560 - DNA, 2048 bp, Saccharomyces cerevisiae; identical to SEQ ID NO: 1365
  CDS (619)..(1731)

SEQ ID NO: 46561 - protein, 370 aa, Saccharomyces cerevisiae; identical to SEQ ID NO: 1366

SEQ ID NO: 46562 - DNA, 1107 bp, Schizosaccharomyces pombe; identical to SEQ ID NO: 1367
  CDS (1)..(1107)

SEQ ID NO: 46563 - protein, 368 aa, Schizosaccharomyces pombe; identical to SEQ ID NO: 1368

SEQ ID NO: 46564 - DNA, 1089 bp, Amycolatopsis orientalis; identical to SEQ ID NO: 1369
  CDS (1)..(1089)

SEQ ID NO: 46565 - protein, 362 aa, Amycolatopsis orientalis; identical to SEQ ID NO: 1370

SEQ ID NO: 46566 - DNA, 1248 bp, Corynebacterium glutamicum; identical to SEQ ID NO: 1373
  CDS (101)..(1228)

SEQ ID NO: 46567 - protein, 375 aa, Corynebacterium glutamicum; identical to SEQ ID NO: 1374

SEQ ID NO: 46568 - DNA, 1083 bp, Methylophilus methylotrophus; identical to SEQ ID NO: 1375
  CDS (1)..(1083)

SEQ ID NO: 46569 - protein, 360 aa, Methylophilus methylotrophus; identical to SEQ ID NO: 1376

SEQ ID NO: 46570 - DNA, 1047 bp, Yersinia pseudotuberculosis IP 32953; identical to SEQ ID NO: 1623
  CDS (1)..(1047)

SEQ ID NO: 46571 - protein, 348 aa, Yersinia pseudotuberculosis IP 32953; identical to SEQ ID NO: 1624

SEQ ID NO: 46572 - DNA, 1053 bp, Yersinia pseudotuberculosis IP 32953; identical to SEQ ID NO: 1487
  CDS (1)..(1053)

SEQ ID NO: 46573 - protein, 350 aa, Yersinia pseudotuberculosis IP 32953; identical to SEQ ID NO: 1488

SEQ ID NO: 46574 - DNA, 1107 bp, Debaryomyces hansenii CBS767; identical to SEQ ID NO: 1377
  CDS (1)..(1107)

SEQ ID NO: 46575 - protein, 368 aa, Debaryomyces hansenii CBS767; identical to SEQ ID NO: 1378

SEQ ID NO: 46576 - DNA, 1074 bp, Yarrowia lipolytica CLIB99; identical to SEQ ID NO: 1379
  CDS (1)..(1074)

SEQ ID NO: 46577 - protein, 357 aa, Yarrowia lipolytica CLIB99; identical to SEQ ID NO: 1380

SEQ ID NO: 46578 - DNA, 1089 bp, Yarrowia lipolytica CLIB99; identical to SEQ ID NO: 1381
  CDS (1)..(1089)

SEQ ID NO: 46579 - protein, 362 aa, Yarrowia lipolytica CLIB99; identical to SEQ ID NO: 1382

SEQ ID NO: 46580 - DNA, 1119 bp, Kluyveromyces lactis NRRL Y; identical to SEQ ID NO: 1383
  CDS (1)..(1119)

SEQ ID NO: 46581 - protein, 372 aa, Kluyveromyces lactis NRRL Y; identical to SEQ ID NO: 1384

SEQ ID NO: 46582 - DNA, 1095 bp, Kluyveromyces lactis NRRL Y; identical to SEQ ID NO: 1385
  CDS (1)..(1095)

SEQ ID NO: 46583 - protein, 364 aa, Kluyveromyces lactis NRRL Y; identical to SEQ ID NO: 1386

SEQ ID NO: 46584 - DNA, 1074 bp, Erwinia carotovora; identical to SEQ ID NO: 1387
  CDS (1)..(1074)

SEQ ID NO: 46585 - protein, 357 aa, Erwinia carotovora; identical to SEQ ID NO: 1388

SEQ ID NO: 46586 - DNA, 1047 bp, Erwinia carotovora; identical to SEQ ID NO: 1389
  CDS (1)..(1047)

SEQ ID NO: 46587 - protein, 348 aa, Erwinia carotovora; identical to SEQ ID NO: 1390

SEQ ID NO: 46588 - DNA, 1056 bp, Erwinia carotovora; identical to SEQ ID NO: 1391
  CDS (1)..(1056)

SEQ ID NO: 46589 - protein, 351 aa, Erwinia carotovora; identical to SEQ ID NO: 1392

SEQ ID NO: 46590 - DNA, 1113 bp, Acinetobacter sp; identical to SEQ ID NO: 1393
  CDS (1)..(1113)

SEQ ID NO: 46591 - protein, 370 aa, Acinetobacter sp; identical to SEQ ID NO: 1394

SEQ ID NO: 46592 - DNA, 1056 bp, Acinetobacter sp; identical to SEQ ID NO: 1395
  CDS (1)..(1056)

SEQ ID NO: 46593 - protein, 351 aa, Acinetobacter sp; identical to SEQ ID NO: 1396

SEQ ID NO: 46594 - DNA, 1119 bp, Candida glabrata CBS138; identical to SEQ ID NO: 1397
  CDS (1)..(1119)

SEQ ID NO: 46595 - protein, 372 aa, Candida glabrata CBS138; identical to SEQ ID NO: 1398

SEQ ID NO: 46596 - DNA, 1071 bp, Candida glabrata CBS138; identical to SEQ ID NO: 1399
  CDS (1)..(1071)

SEQ ID NO: 46597 - protein, 356 aa, Candida glabrata CBS138; identical to SEQ ID NO: 1400

SEQ ID NO: 46598 - DNA, 1083 bp, Photobacterium profundum; identical to SEQ ID NO: 1401
  CDS (1)..(1083)

SEQ ID NO: 46599 - protein, 360 aa, Photobacterium profundum; identical to SEQ ID NO: 1402

SEQ ID NO: 46600 - DNA, 1053 bp, Photobacterium profundum; identical to SEQ ID NO: 1403
  CDS (1)..(1053)

SEQ ID NO: 46601 - protein, 350 aa, Photobacterium profundum; identical to SEQ ID NO: 1404

SEQ ID NO: 46602 - DNA, 1113 bp, Photobacterium profundum; identical to SEQ ID NO: 1405
  CDS (1)..(1113)

SEQ ID NO: 46603 - protein, 370 aa, Photobacterium profundum; identical to SEQ ID NO: 1406

SEQ ID NO: 46604 - DNA, 1056 bp, Photobacterium profundum; identical to SEQ ID NO: 1407
  CDS (1)..(1056)

SEQ ID NO: 46605 - protein, 351 aa, Photobacterium profundum; identical to SEQ ID NO: 1408

SEQ ID NO: 46606 - DNA, 1092 bp, Parachlamydia sp; identical to SEQ ID NO: 1409
  CDS (1)..(1092)

SEQ ID NO: 46607 - protein, 363 aa, Parachlamydia sp; identical to SEQ ID NO: 1410

SEQ ID NO: 46608 - DNA, 1095 bp, Rhodopseudomonas palustris; identical to SEQ ID NO: 1411
  CDS (1)..(1095)

SEQ ID NO: 46609 - protein, 364 aa, Rhodopseudomonas palustris; identical to SEQ ID NO: 1412

SEQ ID NO: 46610 - DNA, 1100 bp, Amycolatopsis methanolica; identical to SEQ ID NO: 1413
  CDS (1)..(1086)

SEQ ID NO: 46611 - protein, 361 aa, Amycolatopsis methanolica; identical to SEQ ID NO: 1414

SEQ ID NO: 46612 - DNA, 1071 bp, Treponema denticola; identical to SEQ ID NO: 1415
  CDS (1)..(1071)

SEQ ID NO: 46613 - protein, 356 aa, Treponema denticola; identical to SEQ ID NO: 1416

SEQ ID NO: 46614 - DNA, 1020 bp, Geobacter sulfurreducens; identical to SEQ ID NO: 1667
  CDS (1)..(1020)

SEQ ID NO: 46615 - protein, 339 aa, Geobacter sulfurreducens; identical to SEQ ID NO: 1668

SEQ ID NO: 46616 - DNA, 1068 bp, Geobacter sulfurreducens; identical to SEQ ID NO: 1417
  CDS (1)..(1068)

SEQ ID NO: 46617 - protein, 355 aa, Geobacter sulfurreducens; identical to SEQ ID NO: 1418

SEQ ID NO: 46618 - DNA, 1122 bp, Ashbya gossypii; identical to SEQ ID NO: 1421
  CDS (1)..(1122)

SEQ ID NO: 46619 - protein, 373 aa, Ashbya gossypii; identical to SEQ ID NO: 1422

SEQ ID NO: 46620 - DNA, 1098 bp, Amycolatopsis balhimycina; identical to SEQ ID NO: 1423
  CDS (1)..(1098)

SEQ ID NO: 46621 - protein, 365 aa, Amycolatopsis balhimycina; identical to SEQ ID NO: 1424

SEQ ID NO: 46622 - DNA, 1053 bp, Vibrio vulnificus; identical to SEQ ID NO: 1675
  CDS (1)..(1053)

SEQ ID NO: 46623 - protein, 350 aa, Vibrio vulnificus; identical to SEQ ID NO: 1676

SEQ ID NO: 46624 - DNA, 1047 bp, Photorhabdus luminescens; identical to SEQ ID NO: 1427
  CDS (1)..(1047)

SEQ ID NO: 46625 - protein, 348 aa, Photorhabdus luminescens; identical to SEQ ID NO: 1428

SEQ ID NO: 46626 - DNA, 1053 bp, Photorhabdus luminescens; identical to SEQ ID NO: 1429
  CDS (1)..(1053)

SEQ ID NO: 46627 - protein, 350 aa, Photorhabdus luminescens; identical to SEQ ID NO: 1430

SEQ ID NO: 46628 - DNA, 1095 bp, Photorhabdus luminescens; identical to SEQ ID NO: 1431
  CDS (1)..(1095)

SEQ ID NO: 46629 - protein, 364 aa, Photorhabdus luminescens; identical to SEQ ID NO: 1432

SEQ ID NO: 46630 - DNA, 1119 bp, Gloeobacter violaceus; identical to SEQ ID NO: 1433
  CDS (1)..(1119)

SEQ ID NO: 46631 - protein, 372 aa, Gloeobacter violaceus; identical to SEQ ID NO: 1434

SEQ ID NO: 46632 - DNA, 1107 bp, Chromobacterium violaceum; identical to SEQ ID NO: 1435
  CDS (1)..(1107)

SEQ ID NO: 46633 - protein, 368 aa, Chromobacterium violaceum; identical to SEQ ID NO: 1436

SEQ ID NO: 46634 - DNA, 1059 bp, Chromobacterium violaceum; identical to SEQ ID NO: 1437
  CDS (1)..(1059)

SEQ ID NO: 46635 - protein, 352 aa, Chromobacterium violaceum; identical to SEQ ID NO: 1438

SEQ ID NO: 46636 - DNA, 1140 bp, Neurospora crassa; identical to SEQ ID NO: 1439
  CDS (1)..(1140)

SEQ ID NO: 46637 - protein, 379 aa, Neurospora crassa; identical to SEQ ID NO: 1440

SEQ ID NO: 46638 - DNA, 1092 bp, Neurospora crassa; identical to SEQ ID NO: 1441
  CDS (1)..(1092)

SEQ ID NO: 46639 - protein, 363 aa, Neurospora crassa; identical to SEQ ID NO: 1442

SEQ ID NO: 46640 - DNA, 1068 bp, Synechococcus sp; identical to SEQ ID NO: 1443
  CDS (1)..(1068)

SEQ ID NO: 46641 - protein, 355 aa, Synechococcus sp; identical to SEQ ID NO: 1444

SEQ ID NO: 46642 - DNA, 1053 bp, Rhodopirellula baltica; identical to SEQ ID NO: 1445
  CDS (1)..(1053)

SEQ ID NO: 46643 - protein, 350 aa, Rhodopirellula baltica; identical to SEQ ID NO: 1446

SEQ ID NO: 46644 - DNA, 1068 bp, Prochlorococcus marinus subsp; identical to SEQ ID NO: 1447
  CDS (1)..(1068)

SEQ ID NO: 46645 - protein, 355 aa, Prochlorococcus marinus subsp; identical to SEQ ID NO: 1448

SEQ ID NO: 46646 - DNA, 1083 bp, Prochlorococcus marinus; identical to SEQ ID NO: 1449
  CDS (1)..(1083)

SEQ ID NO: 46647 - protein, 360 aa, Prochlorococcus marinus; identical to SEQ ID NO: 1450

SEQ ID NO: 46648 - DNA, 1074 bp, Prochlorococcus marinus; identical to SEQ ID NO: 1451
  CDS (1)..(1074)

SEQ ID NO: 46649 - protein, 357 aa, Prochlorococcus marinus; identical to SEQ ID NO: 1452

SEQ ID NO: 46650 - DNA, 1113 bp, Haemophilus ducreyi; identical to SEQ ID NO: 1453
  CDS (1)..(1113)

SEQ ID NO: 46651 - protein, 370 aa, Haemophilus ducreyi; identical to SEQ ID NO: 1454

SEQ ID NO: 46652 - DNA, 1080 bp, Haemophilus ducreyi; identical to SEQ ID NO: 1455
  CDS (1)..(1080)

SEQ ID NO: 46653 - protein, 359 aa, Haemophilus ducreyi; identical to SEQ ID NO: 1456

SEQ ID NO: 46654 - DNA, 1086 bp, Candidatus Blochmannia floridanus; identical to SEQ ID NO: 1457
  CDS (1)..(1086)

SEQ ID NO: 46655 - protein, 361 aa, Candidatus Blochmannia floridanus; identical to SEQ ID NO: 1458

SEQ ID NO: 46656 - DNA, 1074 bp, Bordetella pertussis; identical to SEQ ID NO: 1459
  CDS (1)..(1074)

SEQ ID NO: 46657 - protein, 357 aa, Bordetella pertussis; identical to SEQ ID NO: 1460

SEQ ID NO: 46658 - DNA, 1119 bp, Bordetella bronchiseptica; identical to SEQ ID NO: 1461
  CDS (1)..(1119)

SEQ ID NO: 46659 - protein, 372 aa, Bordetella bronchiseptica; identical to SEQ ID NO: 1462

SEQ ID NO: 46660 - DNA, 1179 bp, Nitrosomonas europaea; identical to SEQ ID NO: 1463
  CDS (1)..(1179)

SEQ ID NO: 46661 - protein, 392 aa, Nitrosomonas europaea; identical to SEQ ID NO: 1464

SEQ ID NO: 46662 - DNA, 1083 bp, Coxiella burnetii; identical to SEQ ID NO: 1465
  CDS (1)..(1083)

SEQ ID NO: 46663 - protein, 360 aa, Coxiella burnetii; identical to SEQ ID NO: 1466

SEQ ID NO: 46664 - DNA, 1143 bp, Xylella fastidiosa; identical to SEQ ID NO: 1469
  CDS (1)..(1143)

SEQ ID NO: 46665 - protein, 380 aa, Xylella fastidiosa; identical to SEQ ID NO: 1470

SEQ ID NO: 46666 - DNA, 1053 bp, Vibrio parahaemolyticus; identical to SEQ ID NO: 1471
  CDS (1)..(1053)

SEQ ID NO: 46667 - protein, 350 aa, Vibrio parahaemolyticus; identical to SEQ ID NO: 1472

SEQ ID NO: 46668 - DNA, 1053 bp, Vibrio parahaemolyticus; identical to SEQ ID NO: 1473
  CDS (1)..(1053)

SEQ ID NO: 46669 - protein, 350 aa, Vibrio parahaemolyticus; identical to SEQ ID NO: 1474

SEQ ID NO: 46670 - DNA, 1074 bp, Vibrio parahaemolyticus; identical to SEQ ID NO: 1475
  CDS (1)..(1074)

SEQ ID NO: 46671 - protein, 357 aa, Vibrio parahaemolyticus; identical to SEQ ID NO: 1476

SEQ ID NO: 46672 - DNA, 1083 bp, Pseudomonas syringae; identical to SEQ ID NO: 1477
  CDS (1)..(1083)

SEQ ID NO: 46673 - protein, 360 aa, Pseudomonas syringae; identical to SEQ ID NO: 1478

SEQ ID NO: 46674 - DNA, 1077 bp, Pseudomonas syringae; identical to SEQ ID NO: 1479
  CDS (1)..(1077)

SEQ ID NO: 46675 - protein, 358 aa, Pseudomonas syringae; identical to SEQ ID NO: 1480

SEQ ID NO: 46676 - DNA, 1062 bp, Pseudomonas putida; identical to SEQ ID NO: 1481
  CDS (1)..(1062)

SEQ ID NO: 46677 - protein, 353 aa, Pseudomonas putida; identical to SEQ ID NO: 1482

SEQ ID NO: 46678 - DNA, 1113 bp, Pseudomonas putida; identical to SEQ ID NO: 1483
  CDS (1)..(1113)

SEQ ID NO: 46679 - protein, 370 aa, Pseudomonas putida; identical to SEQ ID NO: 1484

SEQ ID NO: 46680 - DNA, 1086 bp, Bradyrhizobium japonicum; identical to SEQ ID NO: 1485
  CDS (1)..(1086)

SEQ ID NO: 46681 - protein, 361 aa, Bradyrhizobium japonicum; identical to SEQ ID NO: 1486

SEQ ID NO: 46682 - DNA, 1077 bp, Yersinia pestis; identical to SEQ ID NO: 1489
  CDS (1)..(1077)

SEQ ID NO: 46683 - protein, 358 aa, Yersinia pestis; identical to SEQ ID NO: 1490

SEQ ID NO: 46684 - DNA, 1038 bp, Wigglesworthia glossinidia brevipalpis; identical to SEQ ID NO: 1491
  CDS (1)..(1038)

SEQ ID NO: 46685 - protein, 345 aa, Wigglesworthia glossinidia brevipalpis; identical to SEQ ID NO: 1492

SEQ ID NO: 46686 - DNA, 1071 bp, Vibrio vulnificus; identical to SEQ ID NO: 1739
  CDS (1)..(1071)

SEQ ID NO: 46687 - protein, 356 aa, Vibrio vulnificus; identical to SEQ ID NO: 1740

SEQ ID NO: 46688 - DNA, 1053 bp, Vibrio vulnificus; identical to SEQ ID NO: 1495
  CDS (1)..(1053)

SEQ ID NO: 46689 - protein, 350 aa, Vibrio vulnificus; identical to SEQ ID NO: 1496

SEQ ID NO: 46690 - DNA, 1071 bp, Vibrio vulnificus; identical to SEQ ID NO: 1497
  CDS (1)..(1071)

SEQ ID NO: 46691 - protein, 356 aa, Vibrio vulnificus; identical to SEQ ID NO: 1498

SEQ ID NO: 46692 - DNA, 1062 bp, Synechococcus elongatus; identical to SEQ ID NO: 1499
  CDS (1)..(1062)

SEQ ID NO: 46693 - protein, 353 aa, Synechococcus elongatus; identical to SEQ ID NO: 1500

SEQ ID NO: 46694 - DNA, 1032 bp, Streptococcus mutans; identical to SEQ ID NO: 1501
  CDS (1)..(1032)

SEQ ID NO: 46695 - protein, 343 aa, Streptococcus mutans; identical to SEQ ID NO: 1502

SEQ ID NO: 46696 - DNA, 1035 bp, Streptococcus mutans; identical to SEQ ID NO: 1503
  CDS (1)..(1035)

SEQ ID NO: 46697 - protein, 344 aa, Streptococcus mutans; identical to SEQ ID NO: 1504

SEQ ID NO: 46698 - DNA, 1008 bp, Streptococcus agalactiae; identical to SEQ ID NO: 1505
  CDS (1)..(1008)

SEQ ID NO: 46699 - protein, 335 aa, Streptococcus agalactiae; identical to SEQ ID NO: 1506

SEQ ID NO: 46700 - DNA, 1065 bp, Shewanella oneidensis; identical to SEQ ID NO: 1507
  CDS (1)..(1065)

SEQ ID NO: 46701 - protein, 354 aa, Shewanella oneidensis; identical to SEQ ID NO: 1508

SEQ ID NO: 46702 - DNA, 1092 bp, Shewanella oneidensis; identical to SEQ ID NO: 1509
  CDS (1)..(1092)

SEQ ID NO: 46703 - protein, 363 aa, Shewanella oneidensis; identical to SEQ ID NO: 1510

SEQ ID NO: 46704 - DNA, 1059 bp, Shewanella oneidensis; identical to SEQ ID NO: 1511
  CDS (1)..(1059)

SEQ ID NO: 46705 - protein, 352 aa, Shewanella oneidensis; identical to SEQ ID NO: 1512

SEQ ID NO: 46706 - DNA, 1053 bp, Escherichia coli O6; identical to SEQ ID NO: 1513
  CDS (1)..(1053)

SEQ ID NO: 46707 - protein, 350 aa, Escherichia coli O6; identical to SEQ ID NO: 1514

SEQ ID NO: 46708 - DNA, 1170 bp, Corynebacterium efficiens; identical to SEQ ID NO: 1515
  CDS (1)..(1170)

SEQ ID NO: 46709 - protein, 389 aa, Corynebacterium efficiens; identical to SEQ ID NO: 1516

SEQ ID NO: 46710 - DNA, 1134 bp, Bifidobacterium longum; identical to SEQ ID NO: 1517
  CDS (1)..(1134)

SEQ ID NO: 46711 - protein, 377 aa, Bifidobacterium longum; identical to SEQ ID NO: 1518

SEQ ID NO: 46712 - DNA, 1233 bp, Bifidobacterium longum; identical to SEQ ID NO: 1519
  CDS (1)..(1233)

SEQ ID NO: 46713 - protein, 410 aa, Bifidobacterium longum; identical to SEQ ID NO: 1520

SEQ ID NO: 46714 - DNA, 1221 bp, Phytophthora infestans; identical to SEQ ID NO: 1521
  CDS (20)..(1153)

SEQ ID NO: 46715 - protein, 377 aa, Phytophthora infestans; identical to SEQ ID NO: 1522

SEQ ID NO: 46716 - DNA, 1062 bp, Chlorobium tepidum; identical to SEQ ID NO: 1523
  CDS (1)..(1062)

SEQ ID NO: 46717 - protein, 353 aa, Chlorobium tepidum; identical to SEQ ID NO: 1524

SEQ ID NO: 46718 - DNA, 1074 bp, Xanthomonas campestris; identical to SEQ ID NO: 1525
  CDS (1)..(1074)

SEQ ID NO: 46719 - protein, 357 aa, Xanthomonas campestris; identical to SEQ ID NO: 1526

SEQ ID NO: 46720 - DNA, 1074 bp, Xanthomonas axonopodis; identical to SEQ ID NO: 1527
  CDS (1)..(1074)

SEQ ID NO: 46721 - protein, 357 aa, Xanthomonas axonopodis; identical to SEQ ID NO: 1528

SEQ ID NO: 46722 - DNA, 1080 bp, Ralstonia solanacearum; identical to SEQ ID NO: 1529
  CDS (1)..(1080)

SEQ ID NO: 46723 - protein, 359 aa, Ralstonia solanacearum; identical to SEQ ID NO: 1530

SEQ ID NO: 46724 - DNA, 1179 bp, Ralstonia solanacearum; identical to SEQ ID NO: 1531
  CDS (1)..(1179)

SEQ ID NO: 46725 - protein, 392 aa, Ralstonia solanacearum; identical to SEQ ID NO: 1532

SEQ ID NO: 46726 - DNA, 1065 bp, Synechococcus sp; identical to SEQ ID NO: 1533
  CDS (1)..(1065)

SEQ ID NO: 46727 - protein, 354 aa, Synechococcus sp; identical to SEQ ID NO: 1534

SEQ ID NO: 46728 - DNA, 1035 bp, Escherichia coli; identical to SEQ ID NO: 1535
  CDS (1)..(1035)

SEQ ID NO: 46729 - protein, 344 aa, Escherichia coli; identical to SEQ ID NO: 1536

SEQ ID NO: 46730 - DNA, 1200 bp, Stigmatella aurantiaca; identical to SEQ ID NO: 1537
  CDS (62)..(1147)

SEQ ID NO: 46731 - protein, 361 aa, Stigmatella aurantiaca; identical to SEQ ID NO: 1538

SEQ ID NO: 46732 - DNA, 1092 bp, Rhizobium loti; identical to SEQ ID NO: 1539
  CDS (1)..(1092)

SEQ ID NO: 46733 - protein, 363 aa, Rhizobium loti; identical to SEQ ID NO: 1540

SEQ ID NO: 46734 - DNA, 1083 bp, Amycolatopsis mediterranei; identical to SEQ ID NO: 1541
  CDS (1)..(1083)

SEQ ID NO: 46735 - protein, 360 aa, Amycolatopsis mediterranei; identical to SEQ ID NO: 1542

SEQ ID NO: 46736 - DNA, 1053 bp, Pasteurella multocida; identical to SEQ ID NO: 1543
  CDS (1)..(1053)

SEQ ID NO: 46737 - protein, 350 aa, Pasteurella multocida; identical to SEQ ID NO: 1544

SEQ ID NO: 46738 - DNA, 1086 bp, Pasteurella multocida; identical to SEQ ID NO: 1545
  CDS (1)..(1086)

SEQ ID NO: 46739 - protein, 361 aa, Pasteurella multocida; identical to SEQ ID NO: 1546

SEQ ID NO: 46740 - DNA, 1089 bp, Emericella nidulans; identical to SEQ ID NO: 1549
  CDS (1)..(1089)

SEQ ID NO: 46741 - protein, 362 aa, Emericella nidulans; identical to SEQ ID NO: 1550

SEQ ID NO: 46742 - DNA, 1239 bp, Vibrio cholerae; identical to SEQ ID NO: 1551
  CDS (114)..(1175)

SEQ ID NO: 46743 - protein, 353 aa, Vibrio cholerae; identical to SEQ ID NO: 1552

SEQ ID NO: 46744 - DNA, 1113 bp, Candida albicans; identical to SEQ ID NO: 1797
  CDS (1)..(1113)

SEQ ID NO: 46745 - protein, 370 aa, Candida albicans; identical to SEQ ID NO: 1554

SEQ ID NO: 46746 - DNA, 1047 bp, Buchnera aphidicola; identical to SEQ ID NO: 1557
  CDS (1)..(1047)

SEQ ID NO: 46747 - protein, 348 aa, Buchnera aphidicola; identical to SEQ ID NO: 1558

SEQ ID NO: 46748 - DNA, 1047 bp, Erwinia herbicola; identical to SEQ ID NO: 1559
  CDS (1)..(1047)

SEQ ID NO: 46749 - protein, 348 aa, Erwinia herbicola; identical to SEQ ID NO: 1560

SEQ ID NO: 46750 - DNA, 23 bp, Artificial sequence
  (1)..(23): primer
atgcaaaaagacgcgctgaataa

SEQ ID NO: 46751 - DNA, 21 bp, Artificial sequence
  (1)..(21): primer
ttaagccacgcgagccgtcag

SEQ ID NO: 46752 - protein, 296 aa, Artificial sequence; identical to SEQ ID NO: 2896
  Variant (5)..(35): xaa in position 5 to 35 is any amino acid
  Variant (37)..(37): xaa in position 37 is any amino acid
  Variant (39)..(40): xaa in position 39 to 40 is any amino acid
  Variant (42)..(42): xaa in position 42 is any amino acid
  Variant (45)..(47): xaa in position 45 to 47 is any amino acid
  Variant (49)..(50): xaa in position 49 to 50 is any amino acid
  Variant (52)..(55): xaa in position 52 to 55 is any amino acid
  Variant (57)..(66): xaa in position 57 to 66 is any amino acid
  Variant (68)..(71): xaa in position 68 to 71 is any amino acid
  Variant (73)..(108): xaa in position 73 to 108 is any amino acid
  Variant (112)..(117): xaa in position 112 to 117 is any amino acid
  Variant (120)..(122): xaa in position 120 to 122 is any amino acid
  Variant (124)..(131): xaa in position 124 to 131 is any amino acid
  Variant (134)..(136): xaa in position 134 to 136 is any amino acid
  Variant (138)..(170): xaa in position 138 to 170 is any amino acid
  Variant (173)..(179): xaa in position 173 to 179 is any amino acid
  Variant (182)..(191): xaa in position 182 to 191 is any amino acid
  Variant (193)..(222): xaa in position 193 to 222 is any amino acid
  Variant (224)..(225): xaa in position 224 to 225 is any amino acid
  Variant (227)..(227): xaa in position 227 is any amino acid
  Variant (229)..(260): xaa in position 229 to 260 is any amino acid
  Variant (262)..(262): xaa in position 262 is any amino acid
  Variant (264)..(268): xaa in position 264 to 268 is any amino acid
  Variant (270)..(288): xaa in position 270 to 288 is any amino acid
  Variant (290)..(290): xaa in position 290 is any amino acid
  Variant (292)..(292): xaa in position 292 is any amino acid
  Variant (295)..(295): xaa in position 295 is any amino acid

SEQ ID NO: 46753 - protein, 352 aa, Artificial sequence; identical to SEQ ID NO: 2895
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(40): xaa in position 37 to 40 is any amino acid
  Variant (43)..(43): xaa in position 43 is any amino acid
  Variant (45)..(46): xaa in position 45 to 46 is any amino acid
  Variant (51)..(51): xaa in position 51 is any amino acid
  Variant (54)..(55): xaa in position 54 to 55 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(130): xaa in position 121 to 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(150): xaa in position 148 to 150 is any amino acid
  Variant (152)..(152): xaa in position 152 is any amino acid
  Variant (163)..(163): xaa in position 163 is any amino acid
  Variant (167)..(167): xaa in position 167 is any amino acid
  Variant (170)..(170): xaa in position 170 is any amino acid
  Variant (173)..(173): xaa in position 173 is any amino acid
  Variant (175)..(175): xaa in position 175 is any amino acid
  Variant (182)..(182): xaa in position 182 is any amino acid
  Variant (184)..(187): xaa in position 184 to 187 is any amino acid
  Variant (189)..(190): xaa in position 189 to 190 is any amino acid
  Variant (192)..(194): xaa in position 192 to 194 is any amino acid
  Variant (196)..(198): xaa in position 196 to 198 is any amino acid
  Variant (200)..(200): xaa in position 200 is any amino acid
  Variant (202)..(207): xaa in position 202 to 207 is any amino acid
  Variant (209)..(214): xaa in position 209 to 214 is any amino acid
  Variant (216)..(216): xaa in position 216 is any amino acid
  Variant (219)..(221): xaa in position 219 to 221 is any amino acid
  Variant (223)..(224): xaa in position 223 to 224 is any amino acid
  Variant (229)..(237): xaa in position 229 to 237 is any amino acid
  Variant (240)..(268): xaa in position 240 to 268 is any amino acid
  Variant (270)..(270): xaa in position 270 is any amino acid
  Variant (273)..(273): xaa in position 273 is any amino acid
  Variant (276)..(276): xaa in position 276 is any amino acid
  Variant (278)..(281): xaa in position 278 to 281 is any amino acid
  Variant (283)..(284): xaa in position 283 to 284 is any amino acid
  Variant (286)..(291): xaa in position 286 to 291 is any amino acid
  Variant (293)..(295): xaa in position 293 to 295 is any amino acid
  Variant (297)..(304): xaa in position 297 to 304 is any amino acid
  Variant (306)..(306): xaa in position 306 is any amino acid
  Variant (308)..(308): xaa in position 308 is any amino acid
  Variant (311)..(314): xaa in position 311 to 314 is any amino acid
  Variant (316)..(316): xaa in position 316 is any amino acid
  Variant (318)..(333): xaa in position 318 to 333 is any amino acid
  Variant (336)..(336): xaa in position 336 is any amino acid
  Variant (338)..(338): xaa in position 338 is any amino acid
  Variant (341)..(341): xaa in position 341 is any amino acid
  Variant (343)..(344): xaa in position 343 to 344 is any amino acid
  Variant (346)..(347): xaa in position 346 to 347 is any amino acid
  Variant (349)..(351): xaa in position 349 to 351 is any amino acid

SEQ ID NO: 46754 - protein, 26 aa, Artificial sequence
  Variant (1)..(1): xaa in position 1 is Asp or Asn
  Variant (2)..(2): xaa in position 2 is any amino acid
  Variant (4)..(4): xaa in position 4 is any amino acid
  Variant (5)..(5): xaa in position 5 is Leu, Val, Ile, Phe, Ala or Met
  Variant (6)..(6): xaa in position 6 is Val, Ile, Leu or Ala
  Variant (7)..(7): xaa in position 7 is Val or Ile
  Variant (8)..(8): xaa in position 8 is Val, Ile, Cys or Thr
  Variant (13)..(13): xaa in position 13 is Ile, Val, Ser or Leu
  Variant (14)..(14): xaa in position 14 is His or Asp
  Variant (15)..(15): xaa in position 15 is Asp or Asn
  Variant (16)..(18): xaa in position 16 to 18 is any amino acid
  Variant (19)..(19): xaa in position 19 is Ala, Val or Gly
  Variant (20)..(20): xaa in position 20 is any amino acid
  Variant (21)..(21): xaa in position 21 is Glu, Asp, Ala or Gln
  Variant (23)..(23): xaa in position 23 is Ala, Gly, Ser or Cys
  Variant (24)..(25): xaa in position 24 to 25 is any amino acid
  Variant (26)..(26): xaa in position 26 is Leu, Ile or Phe
XXRXXXXXGPCSXXXXXXXXXYXXXX

SEQ ID NO: 46755 - protein, 40 aa, Artificial sequence; identical to SEQ ID NO: 2890
  Variant (1)..(1): xaa in position 1 is Ile, Val, Leu or Met
  Variant (2)..(2): xaa in position 2 is Val, Ile or Leu
  Variant (5)..(5): xaa in position 5 is Val, Ala or Thr
  Variant (7)..(7): xaa in position 7 is Phe, Leu, Thr or Val
  Variant (8)..(8): xaa in position 8 is Glu, Ala or Gln
  Variant (13)..(14): xaa in position 13 to 14 is any amino acid
  Variant (15)..(15): xaa in position 15 is any or no amino acid
  Variant (17)..(17): xaa in position 17 is Trp or Tyr
  Variant (18)..(18): xaa in position 18 is Lys or Arg
  Variant (20)..(20): xaa in position 20 is Leu, Phe, Tyr or Met
  Variant (21)..(21): xaa in position 21 is Ile, Val, Ala or Leu
  Variant (22)..(22): xaa in position 22 is any amino acid
  Variant (23)..(23): xaa in position 23 is Asp, Glu or Gln
  Variant (25)..(25): xaa in position 25 is any amino acid
  Variant (26)..(26): xaa in position 26 is Leu, Met, Ile, Val, Ala or Thr
  Variant (27)..(27): xaa in position 27 is Asp, Asn or Ser
  Variant (28)..(31): xaa in position 28 to 31 is any amino acid
  Variant (32)..(32): xaa in position 32 is Ile, Val, Leu or Met
  Variant (33)..(34): xaa in position 33 to 34 is any amino acid
  Variant (36)..(36): xaa in position 36 is Leu, Ile, Met or Val
  Variant (37)..(38): xaa in position 37 to 38 is any amino acid
  Variant (39)..(39): xaa in position 39 is Ala, Ser, Gly, Val or Thr

SEQ ID NO: 46756 - protein, 58 aa, Artificial sequence; identical to SEQ ID NO: 2891
  Variant (1)..(1): xaa in position 1 is Tyr, Phe or Leu
  Variant (2)..(3): xaa in position 2 to 3 is any amino acid
  Variant (4)..(4): xaa in position 4 is Asp or Glu
  Variant (5)..(6): xaa in position 5 to 6 is any amino acid
  Variant (7)..(7): xaa in position 7 is Ser, Ala, Thr or Cys
  Variant (8)..(8): xaa in position 8 is Trp, Leu, Phe, Tyr or Val
  Variant (9)..(9): xaa in position 9 is any amino acid
  Variant (10)..(10): xaa in position 10 is Ala or Ser
  Variant (11)..(11): xaa in position 11 is Ile or Val
  Variant (15)..(15): xaa in position 15 is Thr, Ser or Asn
  Variant (16)..(16): xaa in position 16 is Thr, Val, Ala or Ser
  Variant (17)..(17): xaa in position 17 is Glu or Ala
  Variant (18)..(18): xaa in position 18 is Ser, Asp or Asn
  Variant (20)..(20): xaa in position 20 is any amino acid
  Variant (23)..(23): xaa in position 23 is Glu, Gln, Phe or Met
  Variant (24)..(24): xaa in position 24 is Leu, Met, Val or Ile
  Variant (25)..(25): xaa in position 25 is Ala, Ser, Thr, Cys or Val
  Variant (27)..(27): xaa in position 27 is Gly or Ala
  Variant (28)..(28): xaa in position 28 is Leu, Ile, Met or Val
  Variant (29)..(30): xaa in position 29 to 30 is any amino acid
  Variant (31)..(31): xaa in position 31 is Pro or Ala
  Variant (32)..(32): xaa in position 32 is Val, Ile or Thr
  Variant (34)..(34): xaa in position 34 is Phe, Met, Tyr or Ile
  Variant (37)..(37): xaa in position 37 is any amino acid
  Variant (38)..(38): xaa in position 38 is Thr or Arg
  Variant (39)..(39): xaa in position 39 is any amino acid
  Variant (41)..(41): xaa in position 41 is any amino acid
  Variant (42)..(42): xaa in position 42 is Leu, Ile, Val, Ala, Thr or Phe
  Variant (43)..(44): xaa in position 43 to 44 is any amino acid
  Variant (45)..(45): xaa in position 45 is Ala or Met
  Variant (46)..(46): xaa in position 46 is any amino acid
  Variant (47)..(47): xaa in position 47 is Asp, Asn or Glu
  Variant (48)..(48): xaa in position 48 is Ala or Gly
  Variant (49)..(50): xaa in position 49 to 50 is any amino acid
  Variant (51)..(51): xaa in position 51 is Ala or Ser
  Variant (52)..(52): xaa in position 52 is Ala, Ser, Val or Thr
  Variant (53)..(55): xaa in position 53 to 55 is any amino acid
  Variant (56)..(56): xaa in position 56 is His or Gln
  Variant (57)..(57): xaa in position 57 is any amino acid
  Variant (58)..(58): xaa in position 58 is Phe, Tyr, His or Val

SEQ ID NO: 46757 - protein, 25 aa, Artificial sequence
  Variant (1)..(1): xaa in position 1 is Thr or Ser
  Variant (2)..(2): xaa in position 2 is any amino acid
  Variant (5)..(7): xaa in position 5 to 7 is any amino acid
  Variant (8)..(8): xaa in position 8 is His or Phe
  Variant (9)..(9): xaa in position 9 is Val, Ile, Leu or Ala
  Variant (10)..(10): xaa in position 10 is Ile or Val
  Variant (11)..(11): xaa in position 11 is Leu or Met
  Variant (14)..(14): xaa in position 14 is Gly, Ser or Ala
  Variant (15)..(16): xaa in position 15 to 16 is any amino acid
  Variant (17)..(22): xaa in position 17 to 22 is any or no amino acid
  Variant (23)..(23): xaa in position 23 is Pro, Thr or Ser
  Variant (25)..(25): xaa in position 25 is Tyr, Phe or His
XXGNXXXXXXXRGXXXXXXXXXXNX

SEQ ID NO: 46758 - protein, 52 aa, Artificial sequence; identical to SEQ ID NO: 2893
  Variant (1)..(1): xaa in position 1 is Leu, Ile or Val
  Variant (2)..(2): xaa in position 2 is Met, Val, Ile or Leu
  Variant (3)..(3): xaa in position 3 is Ile or Val
  Variant (5)..(5): xaa in position 5 is any amino acid
  Variant (6)..(6): xaa in position 6 is Ser, Asn or Ala
  Variant (8)..(8): xaa in position 8 is Ala, Gly or Asp
  Variant (10)..(10): xaa in position 10 is Ser or Cys
  Variant (11)..(11): xaa in position 11 is any amino acid
  Variant (13)..(15): xaa in position 13 to 15 is any amino acid
  Variant (16)..(16): xaa in position 16 is Arg, Asn, Lys, Leu or Glu
  Variant (18)..(19): xaa in position 18 to 19 is any amino acid
  Variant (20)..(20): xaa in position 20 is Val or Ile
  Variant (21)..(23): xaa in position 21 to 23 is any amino acid
  Variant (24)..(24): xaa in position 24 is Val, Ile, Leu, Thr or Ala
  Variant (25)..(26): xaa in position 25 to 26 is any amino acid
  Variant (27)..(27): xaa in position 27 is Gln, Asn or Arg
  Variant (28)..(28): xaa in position 28 is Ile, Leu, Val, Arg or Met
  Variant (29)..(30): xaa in position 29 to 30 is any amino acid
  Variant (31)..(31): xaa in position 31 is Gly, Asn or Asp
  Variant (32)..(34): xaa in position 32 to 34 is any amino acid
  Variant (35)..(37): xaa in position 35 to 37 is any or no amino acid
  Variant (38)..(38): xaa in position 38 is Ile, Val or Leu
  Variant (39)..(39): xaa in position 39 is any amino acid
  Variant (41)..(41): xaa in position 41 is any amino acid
  Variant (43)..(43): xaa in position 43 is Ile, Leu, Val, Ala or Met
  Variant (46)..(46): xaa in position 46 is His, Phe, Asn or Tyr
  Variant (47)..(47): xaa in position 47 is Leu or Ile
  Variant (48)..(49): xaa in position 48 to 49 is any amino acid
  Variant (51)..(51): xaa in position 51 is any amino acid

SEQ ID NO: 46759 - protein, 19 aa, Artificial sequence
  Variant (1)..(1): xaa in position 1 is Tyr, Phe, Lys or Arg
  Variant (3)..(3): xaa in position 3 is any amino acid
  Variant (5)..(5): xaa in position 5 is Ile or Val
  Variant (8)..(8): xaa in position 8 is any amino acid
  Variant (10)..(10): xaa in position 10 is Ile, Leu or Val
  Variant (11)..(11): xaa in position 11 is any amino acid
  Variant (12)..(12): xaa in position 12 is Trp, Ile, Phe or Leu
  Variant (13)..(14): xaa in position 13 to 14 is any amino acid
  Variant (15)..(15): xaa in position 15 is Thr or Ser
  Variant (16)..(18): xaa in position 16 to 18 is any amino acid
  Variant (19)..(19): xaa in position 19 is Leu, Ile, Val or Phe
XGXSXTDXCXXXXXXXXXX

SEQ ID NO: 46760 - DNA, 2374 bp, Escherichia coli K12; identical to SEQ ID NO: 1805
  CDS (86)..(2281)

SEQ ID NO: 46761 - protein, 731 aa, Escherichia coli K12; identical to SEQ ID NO: 1806

SEQ ID NO: 46762 - DNA, 2961 bp, Hafnia alvei; identical to SEQ ID NO: 1807
  CDS (185)..(2404)

SEQ ID NO: 46763 - protein, 739 aa, Hafnia alvei; identical to SEQ ID NO: 1808

SEQ ID NO: 46764 - DNA, 4341 bp, Escherichia coli; identical to SEQ ID NO: 1809
  CDS (660)..(2858)

SEQ ID NO: 46765 - protein, 732 aa, Escherichia coli; identical to SEQ ID NO: 1810

SEQ ID NO: 46766 - DNA, 1850 bp, Bacillus subtilis; identical to SEQ ID NO: 1811
  CDS (312)..(1784)

SEQ ID NO: 46767 - protein, 490 aa, Bacillus subtilis; identical to SEQ ID NO: 1812

SEQ ID NO: 46768 - DNA, 3091 bp, Lactobacillus sp; identical to SEQ ID NO: 1813
  CDS (572)..(2767)

SEQ ID NO: 46769 - protein, 731 aa, Lactobacillus sp; identical to SEQ ID NO: 1814

SEQ ID NO: 46770 - DNA, 1449 bp, Bacillus halodurans; identical to SEQ ID NO: 1815
  CDS (1)..(1449)

SEQ ID NO: 46771 - protein, 482 aa, Bacillus halodurans; identical to SEQ ID NO: 1816

SEQ ID NO: 46772 - DNA, 2196 bp, Sinorhizobium meliloti; identical to SEQ ID NO: 1817
  CDS (1)..(2196)

SEQ ID NO: 46773 - protein, 731 aa, Sinorhizobium meliloti; identical to SEQ ID NO: 1818

SEQ ID NO: 46774 - DNA, 1380 bp, Listeria innocua; identical to SEQ ID NO: 1819
  CDS (1)..(1380)

SEQ ID NO: 46775 - protein, 459 aa, Listeria innocua; identical to SEQ ID NO: 1820

SEQ ID NO: 46776 - DNA, 2307 bp, Yersinia pestis; identical to SEQ ID NO: 1821
  CDS (1)..(2307)

SEQ ID NO: 46777 - protein, 768 aa, Yersinia pestis; identical to SEQ ID NO: 1822

SEQ ID NO: 46778 - DNA, 2145 bp, Salmonella enterica subsp. enterica serovar Typhi; identical to SEQ ID NO: 1823
  CDS (1)..(2145)

SEQ ID NO: 46779 - protein, 714 aa, Salmonella enterica subsp. enterica serovar Typhi; identical to SEQ ID NO: 1824

SEQ ID NO: 46780 - DNA, 1467 bp, Nostoc sp. PCC 7120; identical to SEQ ID NO: 1825
  CDS (1)..(1467)

SEQ ID NO: 46781 - protein, 488 aa, Nostoc sp. PCC 7120; identical to SEQ ID NO: 1826

SEQ ID NO: 46782 - DNA, 2163 bp, Yersinia pestis; identical to SEQ ID NO: 1827
  CDS (1)..(2163)

SEQ ID NO: 46783 - protein, 720 aa, Yersinia pestis; identical to SEQ ID NO: 1828

SEQ ID NO: 46784 - DNA, 2271 bp, Salmonella enterica subsp. enterica serovar Typhi; identical to SEQ ID NO: 1829
  CDS (1)..(2271)

SEQ ID NO: 46785 - protein, 756 aa, Salmonella enterica subsp. enterica serovar Typhi; identical to SEQ ID NO: 1830

SEQ ID NO: 46786 - DNA, 2148 bp, Escherichia coli; identical to SEQ ID NO: 1831
  CDS (1)..(2148)

SEQ ID NO: 46787 - protein, 715 aa, Escherichia coli; identical to SEQ ID NO: 1832

SEQ ID NO: 46788 - DNA, 2835 bp, Escherichia coli; identical to SEQ ID NO: 1833
  CDS (571)..(2712)

SEQ ID NO: 46789 - protein, 713 aa, Escherichia coli; identical to SEQ ID NO: 1834

SEQ ID NO: 46790 - DNA, 1446 bp, Clostridium acetobutylicum; identical to SEQ ID NO: 1835
  CDS (1)..(1446)

SEQ ID NO: 46791 - protein, 481 aa, Clostridium acetobutylicum; identical to SEQ ID NO: 1836

SEQ ID NO: 46792 - DNA, 1464 bp, Clostridium acetobutylicum; identical to SEQ ID NO: 1837
  CDS (1)..(1464)

SEQ ID NO: 46793 - protein, 487 aa, Clostridium acetobutylicum; identical to SEQ ID NO: 1838

SEQ ID NO: 46794 - DNA, 2256 bp, Pseudomonas aeruginosa; identical to SEQ ID NO: 1839
  CDS (1)..(2256)

SEQ ID NO: 46795 - protein, 751 aa, Pseudomonas aeruginosa; identical to SEQ ID NO: 1840

SEQ ID NO: 46796 - DNA, 2853 bp, Mycobacterium leprae; identical to SEQ ID NO: 1841
  CDS (1)..(2853)

SEQ ID NO: 46797 - protein, 950 aa, Mycobacterium leprae; identical to SEQ ID NO: 1842

SEQ ID NO: 46798 - DNA, 2202 bp, Vibrio cholerae; identical to SEQ ID NO: 1843
  CDS (1)..(2202)

SEQ ID NO: 46799 - protein, 733 aa, Vibrio cholerae; identical to SEQ ID NO: 1844

SEQ ID NO: 46800 - DNA, 2163 bp, Vibrio cholerae; identical to SEQ ID NO: 1845
  CDS (1)..(2163)

SEQ ID NO: 46801 - protein, 720 aa, Vibrio cholerae; identical to SEQ ID NO: 1846

SEQ ID NO: 46802 - DNA, 2163 bp, Haemophilus influenzae; identical to SEQ ID NO: 1847
  CDS (1)..(2163)

SEQ ID NO: 46803 - protein, 720 aa, Haemophilus influenzae; identical to SEQ ID NO: 1848

SEQ ID NO: 46804 - DNA, 2844 bp, Mycobacterium tuberculosis; identical to SEQ ID NO: 1849
  CDS (1)..(2844)

SEQ ID NO: 46805 - protein, 947 aa, Mycobacterium tuberculosis; identical to SEQ ID NO: 1850

SEQ ID NO: 46806 - DNA, 1476 bp, Streptococcus pneumoniae; identical to SEQ ID NO: 1851
  CDS (1)..(1476)

SEQ ID NO: 46807 - protein, 491 aa, Streptococcus pneumoniae; identical to SEQ ID NO: 1852

SEQ ID NO: 46808 - DNA, 1476 bp, Bacillus halodurans; identical to SEQ ID NO: 1853
  CDS (1)..(1476)

SEQ ID NO: 46809 - protein, 491 aa, Bacillus halodurans; identical to SEQ ID NO: 1854

SEQ ID NO: 46810 - DNA, 2349 bp, Sinorhizobium meliloti; identical to SEQ ID NO: 1855
  CDS (1)..(2349)

SEQ ID NO: 46811 - protein, 782 aa, Sinorhizobium meliloti; identical to SEQ ID NO: 1856

SEQ ID NO: 46812 - DNA, 1476 bp, Streptococcus pneumoniae; identical to SEQ ID NO: 1857
  CDS (1)..(1476)

SEQ ID NO: 46813 - protein, 491 aa, Streptococcus pneumoniae; identical to SEQ ID NO: 1858

SEQ ID NO: 46814 - DNA, 2271 bp, Escherichia coli; identical to SEQ ID NO: 1859
  CDS (1)..(2271)

SEQ ID NO: 46815 - protein, 756 aa, Escherichia coli; identical to SEQ ID NO: 1860

SEQ ID NO: 46816 - DNA, 1443 bp, Bacillus subtilis; identical to SEQ ID NO: 1861
  CDS (1)..(1443)

SEQ ID NO: 46817 - protein, 480 aa, Bacillus subtilis; identical to SEQ ID NO: 1862

SEQ ID NO: 46818 - DNA, 1452 bp, Synechocystis sp; identical to SEQ ID NO: 1863
  CDS (1)..(1452)

SEQ ID NO: 46819 - protein, 483 aa, Synechocystis sp; identical to SEQ ID NO: 1864

SEQ ID NO: 46820 - DNA, 2307 bp, Yersinia pseudotuberculosis IP 32953; identical to SEQ ID NO: 1865
  CDS (1)..(2307)

SEQ ID NO: 46821 - protein, 768 aa, Yersinia pseudotuberculosis IP 32953; identical to SEQ ID NO: 1866

SEQ ID NO: 46822 - DNA, 1467 bp, Symbiobacterium thermophilum; identical to SEQ ID NO: 1867
  CDS (1)..(1467)

SEQ ID NO: 46823 - protein, 488 aa, Symbiobacterium thermophilum; identical to SEQ ID NO: 1868

SEQ ID NO: 46824 - DNA, 1410 bp, Symbiobacterium thermophilum; identical to SEQ ID NO: 1869
  CDS (1)..(1410)

SEQ ID NO: 46825 - protein, 469 aa, Symbiobacterium thermophilum; identical to SEQ ID NO: 1870

SEQ ID NO: 46826 - DNA, 2154 bp, Erwinia carotovora; identical to SEQ ID NO: 1871
  CDS (1)..(2154)

SEQ ID NO: 46827 - protein, 717 aa, Erwinia carotovora; identical to SEQ ID NO: 1872

SEQ ID NO: 46828 - DNA, 2790 bp, Acinetobacter sp; identical to SEQ ID NO: 1873
  CDS (1)..(2790)

SEQ ID NO: 46829 - protein, 929 aa, Acinetobacter sp; identical to SEQ ID NO: 1874

SEQ ID NO: 46830 - DNA, 1482 bp, Bacillus thuringiensis; identical to SEQ ID NO: 1875
  CDS (1)..(1482)

SEQ ID NO: 46831 - protein, 493 aa, Bacillus thuringiensis; identical to SEQ ID NO: 1876

SEQ ID NO: 46832 - DNA, 1422 bp, Bacillus thuringiensis; identical to SEQ ID NO: 1877
  CDS (1)..(1422)

SEQ ID NO: 46833 - protein, 473 aa, Bacillus thuringiensis; identical to SEQ ID NO: 1878

SEQ ID NO: 46834 - DNA, 2358 bp, Rhodopseudomonas palustris; identical to SEQ ID NO: 1879
  CDS (1)..(2358)

SEQ ID NO: 46835 - protein, 785 aa, Rhodopseudomonas palustris; identical to SEQ ID NO: 1880

SEQ ID NO: 46836 - DNA, 2837 bp, Shigella boydii; identical to SEQ ID NO: 1881
  CDS (165)..(2435)

SEQ ID NO: 46837 - protein, 756 aa, Shigella boydii; identical to SEQ ID NO: 1882

SEQ ID NO: 46838 - DNA, 1380 bp, Listeria monocytogenes; identical to SEQ ID NO: 1883
  CDS (1)..(1380)

SEQ ID NO: 46839 - protein, 459 aa, Listeria monocytogenes; identical to SEQ ID NO: 1884

SEQ ID NO: 46840 - DNA, 1482 bp, Bacillus cereus; identical to SEQ ID NO: 1885
  CDS (1)..(1482)

SEQ ID NO: 46841 - protein, 493 aa, Bacillus cereus; identical to SEQ ID NO: 1886

SEQ ID NO: 46842 - DNA, 1422 bp, Bacillus cereus; identical to SEQ ID NO: 1887
  CDS (1)..(1422)

SEQ ID NO: 46843 - protein, 473 aa, Bacillus cereus; identical to SEQ ID NO: 1888

SEQ ID NO: 46844 - DNA, 1458 bp, Mycobacterium paratuberculosis; identical to SEQ ID NO: 1889
  CDS (1)..(1458)

SEQ ID NO: 46845 - protein, 485 aa, Mycobacterium paratuberculosis; identical to SEQ ID NO: 1890

SEQ ID NO: 46846 - DNA, 2853 bp, Mycobacterium paratuberculosis; identical to SEQ ID NO: 1891
  CDS (1)..(2853)

SEQ ID NO: 46847 - protein, 950 aa, Mycobacterium paratuberculosis; identical to SEQ ID NO: 1892

SEQ ID NO: 46848 - DNA, 2100 bp, Lactobacillus johnsonii; identical to SEQ ID NO: 1893
  CDS (1)..(2100)

SEQ ID NO: 46849 - protein, 699 aa, Lactobacillus johnsonii; identical to SEQ ID NO: 1894

SEQ ID NO: 46850 - DNA, 3625 bp, Vibrio parahaemolyticus; identical to SEQ ID NO: 1895
  CDS (1451)..(3625)

SEQ ID NO: 46851 - protein, 724 aa, Vibrio parahaemolyticus; identical to SEQ ID NO: 1896

SEQ ID NO: 46852 - DNA, 2142 bp, Shigella flexneri; identical to SEQ ID NO: 1897
  CDS (1)..(2142)

SEQ ID NO: 46853 - protein, 713 aa, Shigella flexneri; identical to SEQ ID NO: 1898

SEQ ID NO: 46854 - DNA, 2181 bp, Vibrio vulnificus; identical to SEQ ID NO: 1899
  CDS (1)..(2181)

SEQ ID NO: 46855 - protein, 726 aa, Vibrio vulnificus; identical to SEQ ID NO: 1900

SEQ ID NO: 46856 - DNA, 2307 bp, Photorhabdus luminescens; identical to SEQ ID NO: 1901
  CDS (1)..(2307)

SEQ ID NO: 46857 - protein, 768 aa, Photorhabdus luminescens; identical to SEQ ID NO: 1902

SEQ ID NO: 46858 - DNA, 1404 bp, Gloeobacter violaceus; identical to SEQ ID NO: 1903
  CDS (1)..(1404)

SEQ ID NO: 46859 - protein, 467 aa, Gloeobacter violaceus; identical to SEQ ID NO: 1904

SEQ ID NO: 46860 - DNA, 2259 bp, Chromobacterium violaceum; identical to SEQ ID NO: 1905
  CDS (1)..(2259)

SEQ ID NO: 46861 - protein, 752 aa, Chromobacterium violaceum; identical to SEQ ID NO: 1906

SEQ ID NO: 46862 - DNA, 1251 bp, Chromobacterium violaceum; identical to SEQ ID NO: 1907
  CDS (1)..(1251)

SEQ ID NO: 46863 - protein, 416 aa, Chromobacterium violaceum; identical to SEQ ID NO: 1908

SEQ ID NO: 46864 - DNA, 2352 bp, Fusobacterium nucleatum subsp; identical to SEQ ID NO: 1909
  CDS (1)..(2352)

SEQ ID NO: 46865 - protein, 783 aa, Fusobacterium nucleatum subsp; identical to SEQ ID NO: 1910

SEQ ID NO: 46866 - DNA, 2196 bp, Shigella flexneri; identical to SEQ ID NO: 1911
  CDS (1)..(2196)

SEQ ID NO: 46867 - protein, 731 aa, Shigella flexneri; identical to SEQ ID NO: 1912

SEQ ID NO: 46868 - DNA, 2271 bp, Bordetella pertussis; identical to SEQ ID NO: 1913
  CDS (1)..(2271)

SEQ ID NO: 46869 - protein, 756 aa, Bordetella pertussis; identical to SEQ ID NO: 1914

SEQ ID NO: 46870 - DNA, 2271 bp, Bordetella parapertussis; identical to SEQ ID NO: 1915
  CDS (1)..(2271)

SEQ ID NO: 46871 - protein, 756 aa, Bordetella parapertussis; identical to SEQ ID NO: 1916

SEQ ID NO: 46872 - DNA, 1422 bp, Bacillus cereus; identical to SEQ ID NO: 1917
  CDS (1)..(1422)

SEQ ID NO: 46873 - protein, 473 aa, Bacillus cereus; identical to SEQ ID NO: 1918

SEQ ID NO: 46874 - DNA, 1422 bp, Bacillus anthracis; identical to SEQ ID NO: 1919
  CDS (1)..(1422)

SEQ ID NO: 46875 - protein, 473 aa, Bacillus anthracis; identical to SEQ ID NO: 1920

SEQ ID NO: 46876 - DNA, 2271 bp, Shigella flexneri; identical to SEQ ID NO: 1921
  CDS (1)..(2271)

SEQ ID NO: 46877 - protein, 756 aa, Shigella flexneri; identical to SEQ ID NO: 1922

SEQ ID NO: 46878 - DNA, 2136 bp, Shigella flexneri; identical to SEQ ID NO: 1923
  CDS (1)..(2136)

SEQ ID NO: 46879 - protein, 711 aa, Shigella flexneri; identical to SEQ ID NO: 1924

SEQ ID NO: 46880 - DNA, 2127 bp, Escherichia coli; identical to SEQ ID NO: 1925
  CDS (1)..(2127)

SEQ ID NO: 46881 - protein, 708 aa, Escherichia coli; identical to SEQ ID NO: 1926

SEQ ID NO: 46882 - DNA, 1563 bp, Oryza sativa; identical to SEQ ID NO: 1927
  CDS (1)..(1563)

SEQ ID NO: 46883 - protein, 520 aa, Oryza sativa; identical to SEQ ID NO: 1928

SEQ ID NO: 46884 - DNA, 2181 bp, Vibrio parahaemolyticus; identical to SEQ ID NO: 1929
  CDS (1)..(2181)

SEQ ID NO: 46885 - protein, 726 aa, Vibrio parahaemolyticus; identical to SEQ ID NO: 1930

SEQ ID NO: 46886 - DNA, 4026 bp, Vibrio parahaemolyticus; identical to SEQ ID NO: 1931
  CDS (1779)..(3914)

SEQ ID NO: 46887 - protein, 711 aa, Vibrio parahaemolyticus; identical to SEQ ID NO: 1932

SEQ ID NO: 46888 - DNA, 1461 bp, Clostridium tetani; identical to SEQ ID NO: 1933
  CDS (1)..(1461)

SEQ ID NO: 46889 - protein, 486 aa, Clostridium tetani; identical to SEQ ID NO: 1934

SEQ ID NO: 46890 - DNA, 1416 bp, Clostridium tetani; identical to SEQ ID NO: 1935
  CDS (1)..(1416)

SEQ ID NO: 46891 - protein, 471 aa, Clostridium tetani; identical to SEQ ID NO: 1936

SEQ ID NO: 46892 - DNA, 2766 bp, Bradyrhizobium japonicum; identical to SEQ ID NO: 1937
  CDS (1)..(2766)

SEQ ID NO: 46893 - protein, 921 aa, Bradyrhizobium japonicum; identical to SEQ ID NO: 1938

SEQ ID NO: 46894 - DNA, 2517 bp, Bradyrhizobium japonicum; identical to SEQ ID NO: 1939
  CDS (1)..(2517)

SEQ ID NO: 46895 - protein, 838 aa, Bradyrhizobium japonicum; identical to SEQ ID NO: 1940

SEQ ID NO: 46896 - DNA, 2181 bp, Vibrio vulnificus; identical to SEQ ID NO: 1941
  CDS (1)..(2181)

SEQ ID NO: 46897 - protein, 726 aa, Vibrio vulnificus; identical to SEQ ID NO: 1942

SEQ ID NO: 46898 - DNA, 2109 bp, Vibrio vulnificus; identical to SEQ ID NO: 1943
  CDS (1)..(2109)

SEQ ID NO: 46899 - protein, 702 aa, Vibrio vulnificus; identical to SEQ ID NO: 1944

SEQ ID NO: 46900 - DNA, 2163 bp, Shewanella oneidensis; identical to SEQ ID NO: 1945
  CDS (1)..(2163)

SEQ ID NO: 46901 - protein, 720 aa, Shewanella oneidensis; identical to SEQ ID NO: 1946

SEQ ID NO: 46902 - DNA, 1419 bp, Oceanobacillus iheyensis; identical to SEQ ID NO: 1947
  CDS (1)..(1419)

SEQ ID NO: 46903 - protein, 472 aa, Oceanobacillus iheyensis; identical to SEQ ID NO: 1948

SEQ ID NO: 46904 - DNA, 2154 bp, Escherichia coli O6; identical to SEQ ID NO: 1949
  CDS (1)..(2154)

SEQ ID NO: 46905 - protein, 717 aa, Escherichia coli O6; identical to SEQ ID NO: 1950

SEQ ID NO: 46906 - DNA, 2271 bp, Escherichia coli O6; identical to SEQ ID NO: 1951
  CDS (1)..(2271)

SEQ ID NO: 46907 - protein, 756 aa, Escherichia coli O6; identical to SEQ ID NO: 1952

SEQ ID NO: 46908 - DNA, 2370 bp, Escherichia coli O6; identical to SEQ ID NO: 1953
  CDS (1)..(2370)

SEQ ID NO: 46909 - protein, 789 aa, Escherichia coli O6; identical to SEQ ID NO: 1954

SEQ ID NO: 46910 - DNA, 2136 bp, Escherichia coli O6; identical to SEQ ID NO: 1955
  CDS (1)..(2136)

SEQ ID NO: 46911 - protein, 711 aa, Escherichia coli O6; identical to SEQ ID NO: 1956

SEQ ID NO: 46912 - DNA, 2208 bp, Escherichia coli O6; identical to SEQ ID NO: 1957
  CDS (1)..(2208)

SEQ ID NO: 46913 - protein, 735 aa, Escherichia coli O6; identical to SEQ ID NO: 1958

SEQ ID NO: 46914 - DNA, 2142 bp, Escherichia coli O6; identical to SEQ ID NO: 1959
  CDS (1)..(2142)

SEQ ID NO: 46915 - protein, 713 aa, Escherichia coli O6; identical to SEQ ID NO: 1960

SEQ ID NO: 46916 - DNA, 1488 bp, Thermoanaerobacter tengcongensis; identical to SEQ ID NO: 1961
  CDS (1)..(1488)

SEQ ID NO: 46917 - protein, 495 aa, Thermoanaerobacter tengcongensis; identical to SEQ ID NO: 1962

SEQ ID NO: 46918 - DNA, 1419 bp, Thermoanaerobacter tengcongensis; identical to SEQ ID NO: 1963
  CDS (1)..(1419)

SEQ ID NO: 46919 - protein, 472 aa, Thermoanaerobacter tengcongensis; identical to SEQ ID NO: 1964

SEQ ID NO: 46920 - DNA, 2352 bp, Fusobacterium nucleatum; identical to SEQ ID NO: 1965
  CDS (1)..(2352)

SEQ ID NO: 46921 - protein, 783 aa, Fusobacterium nucleatum; identical to SEQ ID NO: 1966

SEQ ID NO: 46922 - DNA, 1431 bp, Clostridium perfringens; identical to SEQ ID NO: 1967
  CDS (1)..(1431)

SEQ ID NO: 46923 - protein, 476 aa, Clostridium perfringens; identical to SEQ ID NO: 1968

SEQ ID NO: 46924 - DNA, 1455 bp, Clostridium perfringens; identical to SEQ ID NO: 1969
  CDS (1)..(1455)

SEQ ID NO: 46925 - protein, 484 aa, Clostridium perfringens; identical to SEQ ID NO: 1970

SEQ ID NO: 46926 - DNA, 2280 bp, Ralstonia solanacearum; identical to SEQ ID NO: 1971
  CDS (1)..(2280)

SEQ ID NO: 46927 - protein, 759 aa, Ralstonia solanacearum; identical to SEQ ID NO: 1972

SEQ ID NO: 46928 - DNA, 2271 bp, Salmonella typhimurium; identical to SEQ ID NO: 1973
  CDS (1)..(2271)

SEQ ID NO: 46929 - protein, 756 aa, Salmonella typhimurium; identical to SEQ ID NO: 1974

SEQ ID NO: 46930 - DNA, 2136 bp, Salmonella typhimurium; identical to SEQ ID NO: 1975
  CDS (1)..(2136)

SEQ ID NO: 46931 - protein, 711 aa, Salmonella typhimurium; identical to SEQ ID NO: 1976

SEQ ID NO: 46932 - DNA, 2199 bp, Salmonella typhimurium; identical to SEQ ID NO: 1977
  CDS (1)..(2199)

SEQ ID NO: 46933 - protein, 732 aa, Salmonella typhimurium; identical to SEQ ID NO: 1978

SEQ ID NO: 46934 - DNA, 2142 bp, Salmonella typhimurium; identical to SEQ ID NO: 1979
  CDS (1)..(2142)

SEQ ID NO: 46935 - protein, 713 aa, Salmonella typhimurium; identical to SEQ ID NO: 1980

SEQ ID NO: 46936 - DNA, 2136 bp, Vibrio vulnificus; identical to SEQ ID NO: 1981
  CDS (1)..(2136)

SEQ ID NO: 46937 - protein, 711 aa, Vibrio vulnificus; identical to SEQ ID NO: 1982

SEQ ID NO: 46938 - DNA, 2163 bp, Pasteurella multocida; identical to SEQ ID NO: 1983
  CDS (1)..(2163)

SEQ ID NO: 46939 - protein, 720 aa, Pasteurella multocida; identical to SEQ ID NO: 1984

SEQ ID NO: 46940 - DNA, 2139 bp, Moritella japonica; identical to SEQ ID NO: 1985
  CDS (1)..(2139)

SEQ ID NO: 46941 - protein, 712 aa, Moritella japonica; identical to SEQ ID NO: 1986

SEQ ID NO: 46942 - DNA, 1479 bp, Streptomyces coelicolor; identical to SEQ ID NO: 1987
  CDS (1)..(1479)

SEQ ID NO: 46943 - protein, 492 aa, Streptomyces coelicolor; identical to SEQ ID NO: 1988

SEQ ID NO: 46944 - DNA, 2130 bp, Eikenella corrodens; identical to SEQ ID NO: 1989
  CDS (1)..(2130)

SEQ ID NO: 46945 - protein, 709 aa, Eikenella corrodens; identical to SEQ ID NO: 1990

SEQ ID NO: 46946 - DNA, 2271 bp, Escherichia coli; identical to SEQ ID NO: 1859
  CDS (4)..(2271)

SEQ ID NO: 46947 - protein, 755 aa, Escherichia coli; identical to SEQ ID NO: 1992

SEQ ID NO: 46948 - DNA, 2196 bp, Lactobacillus sp; identical to SEQ ID NO: 1993
  CDS (1)..(2196)

SEQ ID NO: 46949 - protein, 731 aa, Lactobacillus sp; identical to SEQ ID NO: 1814

SEQ ID NO: 46950 - DNA, 1482 bp, Bacillus anthracis; identical to SEQ ID NO: 1995
  CDS (1)..(1482)

SEQ ID NO: 46951 - protein, 493 aa, Bacillus anthracis; identical to SEQ ID NO: 1996

SEQ ID NO: 46952 - DNA, 1383 bp, Bacillus cereus; identical to SEQ ID NO: 1997
  CDS (1)..(1383)

SEQ ID NO: 46953 - protein, 460 aa, Bacillus cereus; identical to SEQ ID NO: 1998

SEQ ID NO: 46954 - DNA, 20 bp, Artificial sequence
  (1)..(20): primer
atggggcagggttttccacc

SEQ ID NO: 46955 - DNA, 25 bp, Artificial sequence
  (1)..(25): primer
ttacttcaacacataaccgtacaac

SEQ ID NO: 46956 - protein, 642 aa, Artificial sequence; identical to SEQ ID NO: 2902
  Variant (2)..(5): xaa in position 2 to 5 is any amino acid
  Variant (7)..(58): xaa in position 7 to 58 is any amino acid
  Variant (60)..(61): xaa in position 60 to 61 is any amino acid
  Variant (63)..(66): xaa in position 63 to 66 is any amino acid
  Variant (68)..(71): xaa in position 68 to 71 is any amino acid
  Variant (73)..(76): xaa in position 73 to 76 is any amino acid
  Variant (78)..(90): xaa in position 78 to 90 is any amino acid
  Variant (92)..(92): xaa in position 92 is any amino acid
  Variant (94)..(113): xaa in position 94 to 113 is any amino acid
  Variant (116)..(116): xaa in position 116 is any amino acid
  Variant (120)..(131): xaa in position 120 to 131 is any amino acid
  Variant (133)..(188): xaa in position 133 to 188 is any amino acid
  Variant (191)..(191): xaa in position 191 is any amino acid
  Variant (193)..(215): xaa in position 193 to 215 is any amino acid
  Variant (217)..(217): xaa in position 217 is any amino acid
  Variant (219)..(224): xaa in position 219 to 224 is any amino acid
  Variant (226)..(290): xaa in position 226 to 290 is any amino acid
  Variant (292)..(292): xaa in position 292 is any amino acid
  Variant (295)..(300): xaa in position 295 to 300 is any amino acid
  Variant (302)..(302): xaa in position 302 is any amino acid
  Variant (304)..(305): xaa in position 304 to 305 is any amino acid
  Variant (307)..(333): xaa in position 307 to 333 is any amino acid
  Variant (337)..(337): xaa in position 337 is any amino acid
  Variant (339)..(341): xaa in position 339 to 341 is any amino acid
  Variant (343)..(355): xaa in position 343 to 355 is any amino acid
  Variant (357)..(370): xaa in position 357 to 370 is any amino acid
  Variant (372)..(457): xaa in position 372 to 457 is any amino acid
  Variant (460)..(460): xaa in position 460 is any amino acid
  Variant (462)..(494): xaa in position 462 to 494 is any amino acid
  Variant (496)..(497): xaa in position 496 to 497 is any amino acid
  Variant (499)..(505): xaa in position 499 to 505 is any amino acid
  Variant (507)..(520): xaa in position 507 to 520 is any amino acid
  Variant (522)..(524): xaa in position 522 to 524 is any amino acid
  Variant (526)..(620): xaa in position 526 to 620 is any amino acid
  Variant (622)..(624): xaa in position 622 to 624 is any amino acid
  Variant (626)..(630): xaa in position 626 to 630 is any amino acid
  Variant (635)..(640): xaa in position 635 to 640 is any amino acid

SEQ ID NO: 46957 - protein, 101 aa, Artificial sequence; identical to SEQ ID NO: 1322
  Variant (2)..(23): xaa in position 2 to 23 is any amino acid
  Variant (24)..(30): xaa in position 24 to 30 is any or no amino acid
  Variant (32)..(32): xaa in position 32 is any amino acid
  Variant (37)..(39): xaa in position 37 to 39 is any amino acid
  Variant (41)..(55): xaa in position 41 to 55 is any amino acid
  Variant (56)..(57): xaa in position 56 to 57 is any or no amino acid
  Variant (59)..(62): xaa in position 59 to 62 is any amino acid
  Variant (64)..(64): xaa in position 64 is any amino acid
  Variant (67)..(70): xaa in position 67 to 70 is any amino acid
  Variant (72)..(72): xaa in position 72 is any amino acid
  Variant (75)..(77): xaa in position 75 to 77 is any amino acid
  Variant (79)..(85): xaa in position 79 to 85 is any amino acid
  Variant (87)..(90): xaa in position 87 to 90 is any amino acid
  Variant (92)..(93): xaa in position 92 to 93 is any amino acid
  Variant (97)..(97): xaa in position 97 is any amino acid
  Variant (100)..(100): xaa in position 100 is any amino acid

SEQ ID NO: 46958 - protein, 76 aa, Artificial sequence; identical to SEQ ID NO: 2897
  Variant (1)..(1): xaa in position 1 is Leu, Met or Val
  Variant (2)..(2): xaa in position 2 is Gly or Asp
  Variant (3)..(3): xaa in position 3 is Asp, Ser, Asn, Gln or Gly
  Variant (4)..(4): xaa in position 4 is Leu or Arg
  Variant (5)..(6): xaa in position 5 to 6 is any amino acid
  Variant (7)..(7): xaa in position 7 is His or Pro
  Variant (8)..(8): xaa in position 8 is any amino acid
  Variant (9)..(9): xaa in position 9 is Gly, Ser, Glu or Asp
  Variant (10)..(13): xaa in position 10 to 13 is any amino acid
  Variant (14)..(14): xaa in position 14 is Ala or Ser
  Variant (15)..(15): xaa in position 15 is Gln, Glu or Met
  Variant (16)..(18): xaa in position 16 to 18 is any amino acid
  Variant (19)..(19): xaa in position 19 is Ala or Ser
  Variant (20)..(21): xaa in position 20 to 21 is any amino acid
  Variant (22)..(22): xaa in position 22 is Phe, Tyr, Trp or Val
  Variant (23)..(23): xaa in position 23 is any amino acid
  Variant (24)..(24): xaa in position 24 is Ala, Ser or Val
  Variant (25)..(27): xaa in position 25 to 27 is any amino acid
  Variant (28)..(28): xaa in position 28 is Tyr, Phe or Trp
  Variant (29)..(30): xaa in position 29 to 30 is any amino acid
  Variant (31)..(31): xaa in position 31 is Val, Thr, Leu or Ile
  Variant (32)..(32): xaa in position 32 is any amino acid
  Variant (34)..(34): xaa in position 34 is Thr or Ser
  Variant (35)..(35): xaa in position 35 is Ser or Thr
  Variant (36)..(36): xaa in position 36 is any amino acid
  Variant (37)..(37): xaa in position 37 is Ser, Ala or Gly
  Variant (38)..(38): xaa in position 38 is Asn, Ile, Val or Ser
  Variant (39)..(51): xaa in position 39 to 51 is any amino acid
  Variant (52)..(52): xaa in position 52 is Val, Ile, Leu or Ala
  Variant (53)..(53): xaa in position 53 is Leu, Ile, Val or Met
  Variant (54)..(55): xaa in position 54 to 55 is any amino acid
  Variant (57)..(57): xaa in position 57 is Asn or Asp
  Variant (58)..(58): xaa in position 58 is any amino acid
  Variant (60)..(60): xaa in position 60 is Lys, Gln or Arg
  Variant (61)..(61): xaa in position 61 is Ser or Ala
  Variant (62)..(65): xaa in position 62 to 65 is any amino acid
  Variant (66)..(66): xaa in position 66 is any or no amino acid
  Variant (67)..(67): xaa in position 67 is Leu, Ile, Met or Val
  Variant (68)..(73): xaa in position 68 to 73 is any amino acid
  Variant (74)..(74): xaa in position 74 is Pro or Ala
  Variant (75)..(75): xaa in position 75 is any amino acid
  Variant (76)..(76): xaa in position 76 is Tyr, Phe or Trp

SEQ ID NO: 46959 - protein, 39 aa, Artificial sequence; identical to SEQ ID NO: 2898
  Variant (1)..(1): xaa in position 1 is Val, Ile, Leu, Phe or Thr
  Variant (2)..(2): xaa in position 2 is Ile, Val, Leu, Phe or Ala
  Variant (3)..(5): xaa in position 3 to 5 is any amino acid
  Variant (6)..(6): xaa in position 6 is Thr, Asn or Ser
  Variant (7)..(7): xaa in position 7 is Tyr, Phe or Pro
  Variant (8)..(8): xaa in position 8 is Asp, Tyr, Phe or His
  Variant (10)..(12): xaa in position 10 to 12 is any amino acid
  Variant (13)..(13): xaa in position 13 is Asn, Asp or Ser
  Variant (14)..(25): xaa in position 14 to 25 is any amino acid
  Variant (26)..(29): xaa in position 26 to 29 is any or no amino acid
  Variant (30)..(30): xaa in position 30 is Ile, Val, Leu or Phe
  Variant (31)..(31): xaa in position 31 is any amino acid
  Variant (32)..(32): xaa in position 32 is Phe, Val, Trp or Ile
  Variant (34)..(34): xaa in position 34 is Glu, Ser or Cys
  Variant (36)..(36): xaa in position 36 is Trp or His
  Variant (37)..(37): xaa in position 37 is any amino acid
  Variant (38)..(38): xaa in position 38 is Ala, Gly, Pro or Val
  Variant (39)..(39): xaa in position 39 is Tyr, His or Phe

SEQ ID NO: 46960 - protein, 84 aa, Artificial sequence; identical to SEQ ID NO: 2899
  Variant (1)..(1): xaa in position 1 is Ser or Leu
  Variant (2)..(2): xaa in position 2 is any amino acid
  Variant (5)..(7): xaa in position 5 to 7 is any amino acid
  Variant (8)..(8): xaa in position 8 is Ala, Gly or Ser
  Variant (9)..(9): xaa in position 9 is Leu, Phe, Met or Ile
  Variant (10)..(10): xaa in position 10 is Ser, Thr, Arg or Glu
  Variant (11)..(11): xaa in position 11 is Gln or Met
  Variant (12)..(12): xaa in position 12 is any amino acid
  Variant (13)..(13): xaa in position 13 is Ser or Ala
  Variant (14)..(14): xaa in position 14 is any amino acid
  Variant (15)..(15): xaa in position 15 is Ile, Leu, Met, Val or Phe
  Variant (16)..(16): xaa in position 16 is His, Asn, Leu or Ile
  Variant (17)..(25): xaa in position 17 to 25 is any amino acid
  Variant (26)..(33): xaa in position 26 to 33 is any or no amino acid
  Variant (34)..(34): xaa in position 34 is Phe, Val, Leu, Met or Ile
  Variant (35)..(42): xaa in position 35 to 42 is any amino acid
  Variant (43)..(43): xaa in position 43 is Ser or Thr
  Variant (44)..(44): xaa in position 44 is Thr or Ser
  Variant (46)..(47): xaa in position 46 to 47 is any amino acid
  Variant (48)..(48): xaa in position 48 is Tyr, Gln or Val
  Variant (49)..(49): xaa in position 49 is any amino acid
  Variant (50)..(50): xaa in position 50 is Leu, Ile, Phe or Met
  Variant (51)..(51): xaa in position 51 is any amino acid
  Variant (52)..(52): xaa in position 52 is Ala or Ser
  Variant (53)..(53): xaa in position 53 is Ser, Ala or Thr
  Variant (54)..(54): xaa in position 54 is any amino acid
  Variant (55)..(55): xaa in position 55 is Asp or Glu
  Variant (56)..(63): xaa in position 56 to 63 is any amino acid
  Variant (64)..(65): xaa in position 64 to 65 is any or no amino acid
  Variant (66)..(66): xaa in position 66 is Gly, Ala, Lys or Asn
  Variant (67)..(73): xaa in position 67 to 73 is any amino acid
  Variant (74)..(74): xaa in position 74 is Ile, Val, Leu, Tyr or Phe
  Variant (75)..(80): xaa in position 75 to 80 is any amino acid
  Variant (81)..(81): xaa in position 81 is Arg or Lys
  Variant (82)..(83): xaa in position 82 to 83 is any amino acid
  Variant (84)..(84): xaa in position 84 is Ile, Leu, Val, Met, Phe, Ala or Thr

SEQ ID NO: 46961 - protein, 31 aa, Artificial sequence; identical to SEQ ID NO: 2900
  Variant (1)..(1): xaa in position 1 is Val, Ile, Leu, Cys or Arg
  Variant (2)..(5): xaa in position 2 to 5 is any amino acid
  Variant (6)..(9): xaa in position 6 to 9 is any or no amino acid
  Variant (10)..(10): xaa in position 10 is Gly, Thr, Asp or Asn
  Variant (11)..(11): xaa in position 11 is any amino acid
  Variant (12)..(12): xaa in position 12 is Ile, Val or Thr
  Variant (13)..(13): xaa in position 13 is any amino acid
  Variant (14)..(14): xaa in position 14 is Ala, Gly, Thr or Leu
  Variant (15)..(16): xaa in position 15 to 16 is any amino acid
  Variant (17)..(17): xaa in position 17 is Val, Ile, Ala, Leu or Phe
  Variant (18)..(19): xaa in position 18 to 19 is any amino acid
  Variant (24)..(24): xaa in position 24 is Ile, Val or Phe
  Variant (25)..(26): xaa in position 25 to 26 is any amino acid
  Variant (27)..(27): xaa in position 27 is Val, Leu, Ile, Phe or Met
  Variant (28)..(29): xaa in position 28 to 29 is any amino acid
  Variant (31)..(31): xaa in position 31 is Glu or Gln

SEQ ID NO: 46962 - DNA, 1113 bp, Saccharomyces cerevisiae; identical to SEQ ID NO: 1363
  CDS (1)..(1113)

SEQ ID NO: 46963 - protein, 370 aa, Saccharomyces cerevisiae; identical to SEQ ID NO: 1364

SEQ ID NO: 46964 - DNA, 1086 bp, Deinococcus radiodurans; identical to SEQ ID NO: 1327
  CDS (1)..(1086)

SEQ ID NO: 46965 - protein, 361 aa, Deinococcus radiodurans; identical to SEQ ID NO: 1328

SEQ ID NO: 46966 - DNA, 1071 bp, Salmonella enterica subsp. enterica serovar Typhi; identical to SEQ ID NO: 2245
  CDS (1)..(1071)

SEQ ID NO: 46967 - protein, 356 aa, Salmonella enterica subsp. enterica serovar Typhi; identical to SEQ ID NO: 2246

SEQ ID NO: 46968 - DNA, 1071 bp, Yersinia pestis; identical to SEQ ID NO: 2247
  CDS (1)..(1071)

SEQ ID NO: 46969 - protein, 356 aa, Yersinia pestis; identical to SEQ ID NO: 2248

SEQ ID NO: 46970 - DNA, 1047 bp, Yersinia pestis; identical to SEQ ID NO: 1331
  CDS (1)..(1047)

SEQ ID NO: 46971 - protein, 348 aa, Yersinia pestis; identical to SEQ ID NO: 1332

SEQ ID NO: 46972 - DNA, 1053 bp, Escherichia coli; identical to SEQ ID NO: 2251
  CDS (1)..(1053)

SEQ ID NO: 46973 - protein, 350 aa, Escherichia coli; identical to SEQ ID NO: 1580

SEQ ID NO: 46974 - DNA, 1071 bp, Escherichia coli; identical to SEQ ID NO: 1333
  CDS (1)..(1071)

SEQ ID NO: 46975 - protein, 356 aa, Escherichia coli; identical to SEQ ID NO: 1334

SEQ ID NO: 46976 - DNA, 1131 bp, Nostoc sp. PCC 7120; identical to SEQ ID NO: 1335
  CDS (1)..(1131)

SEQ ID NO: 46977 - protein, 376 aa, Nostoc sp. PCC 7120; identical to SEQ ID NO: 1336

SEQ ID NO: 46978 - DNA, 1053 bp, Salmonella enterica subsp. enterica serovar Typhi; identical to SEQ ID NO: 1337
  CDS (1)..(1053)

SEQ ID NO: 46979 - protein, 350 aa, Salmonella enterica subsp. enterica serovar Typhi; identical to SEQ ID NO: 1338

SEQ ID NO: 46980 - DNA, 1077 bp, Pseudomonas aeruginosa; identical to SEQ ID NO: 1339
  CDS (1)..(1077)

SEQ ID NO: 46981 - protein, 358 aa, Pseudomonas aeruginosa; identical to SEQ ID NO: 1340

SEQ ID NO: 46982 - DNA, 1074 bp, Vibrio cholerae; identical to SEQ ID NO: 1343
  CDS (1)..(1074)

SEQ ID NO: 46983 - protein, 357 aa, Vibrio cholerae; identical to SEQ ID NO: 1344

SEQ ID NO: 46984 - DNA, 1038 bp, Lactococcus lactis subsp. lactis; identical to SEQ ID NO: 1345
  CDS (1)..(1038)

SEQ ID NO: 46985 - protein, 345 aa, Lactococcus lactis subsp. lactis; identical to SEQ ID NO: 1346

SEQ ID NO: 46986 - DNA, 1023 bp, Lactococcus lactis subsp. lactis; identical to SEQ ID NO: 1347
  CDS (1)..(1023)

SEQ ID NO: 46987 - protein, 340 aa, Lactococcus lactis subsp. lactis; identical to SEQ ID NO: 1348

SEQ ID NO: 46988 - DNA, 1032 bp, Streptococcus pneumoniae; identical to SEQ ID NO: 1349
  CDS (1)..(1032)

SEQ ID NO: 46989 - protein, 343 aa, Streptococcus pneumoniae; identical to SEQ ID NO: 1350

SEQ ID NO: 46990 - DNA, 1056 bp, Neisseria meningitidis; identical to SEQ ID NO: 2269
  CDS (1)..(1056)

SEQ ID NO: 46991 - protein, 351 aa, Neisseria meningitidis; identical to SEQ ID NO: 2270

SEQ ID NO: 46992 - DNA, 1095 bp, Pseudomonas aeruginosa; identical to SEQ ID NO: 1351
  CDS (1)..(1095)

SEQ ID NO: 46993 - protein, 364 aa, Pseudomonas aeruginosa; identical to SEQ ID NO: 1352

SEQ ID NO: 46994 - DNA, 1032 bp, Streptococcus pneumoniae; identical to SEQ ID NO: 1355
  CDS (1)..(1032)

SEQ ID NO: 46995 - protein, 343 aa, Streptococcus pneumoniae; identical to SEQ ID NO: 1356

SEQ ID NO: 46996 - DNA, 1143 bp, Xylella fastidiosa; identical to SEQ ID NO: 1603
  CDS (1)..(1143)

SEQ ID NO: 46997 - protein, 380 aa, Xylella fastidiosa; identical to SEQ ID NO: 1604

SEQ ID NO: 46998 - DNA, 1047 bp, Buchnera aphidicola; identical to SEQ ID NO: 1357
  CDS (1)..(1047)

SEQ ID NO: 46999 - protein, 348 aa, Buchnera aphidicola; identical to SEQ ID NO: 1358

SEQ ID NO: 47000 - DNA, 1104 bp, Corynebacterium glutamicum; identical to SEQ ID NO: 2279
  CDS (1)..(1104)

SEQ ID NO: 47001 - protein, 367 aa, Corynebacterium glutamicum; identical to SEQ ID NO: 2280

SEQ ID NO: 47002 - DNA, 1089 bp, Haemophilus influenzae; identical to SEQ ID NO: 1359
  CDS (1)..(1089)

SEQ ID NO: 47003 - protein, 362 aa, Haemophilus influenzae; identical to SEQ ID NO: 1360

SEQ ID NO: 47004 - DNA, 1502 bp, Candida albicans; identical to SEQ ID NO: 1361
  CDS (336)..(1442)

SEQ ID NO: 47005 - protein, 368 aa, Candida albicans; identical to SEQ ID NO: 1362

SEQ ID NO: 47006 - DNA, 2048 bp, Saccharomyces cerevisiae; identical to SEQ ID NO: 1365
  CDS (619)..(1731)

SEQ ID NO: 47007 - protein, 370 aa, Saccharomyces cerevisiae; identical to SEQ ID NO: 1366

SEQ ID NO: 47008 - DNA, 1107 bp, Schizosaccharomyces pombe; identical to SEQ ID NO: 1367
  CDS (1)..(1107)

SEQ ID NO: 47009 - protein, 368 aa, Schizosaccharomyces pombe; identical to SEQ ID NO: 1368

SEQ ID NO: 47010 - DNA, 1089 bp, Amycolatopsis orientalis; identical to SEQ ID NO: 1369
  CDS (1)..(1089)

SEQ ID NO: 47011 - protein, 362 aa, Amycolatopsis orientalis; identical to SEQ ID NO: 1370

SEQ ID NO: 47012 - DNA, 1119 bp, Schizosaccharomyces pombe; identical to SEQ ID NO: 1371
  CDS (1)..(1119)

SEQ ID NO: 47013 - protein, 372 aa, Schizosaccharomyces pombe; identical to SEQ ID NO: 1372

SEQ ID NO: 47014 - DNA, 1083 bp, Methylophilus methylotrophus; identical to SEQ ID NO: 1375
  CDS (1)..(1083)

SEQ ID NO: 47015 - protein, 360 aa, Methylophilus methylotrophus; identical to SEQ ID NO: 1376

SEQ ID NO: 47016 - DNA, 1770 bp, Debaryomyces hansenii; identical to SEQ ID NO: 2295
  CDS (1)..(1770)

SEQ ID NO: 47017 - protein, 589 aa, Debaryomyces hansenii; identical to SEQ ID NO: 2296

SEQ ID NO: 47018 - DNA, 1107 bp, Debaryomyces hansenii; identical to SEQ ID NO: 1377
  CDS (1)..(1107)

SEQ ID NO: 47019 - protein, 368 aa, Debaryomyces hansenii; identical to SEQ ID NO: 1378

SEQ ID NO: 47020 - DNA, 1074 bp, Yarrowia lipolytica; identical to SEQ ID NO: 1379
  CDS (1)..(1074)

SEQ ID NO: 47021 - protein, 357 aa, Yarrowia lipolytica; identical to SEQ ID NO: 1380

SEQ ID NO: 47022 - DNA, 1089 bp, Yarrowia lipolytica; identical to SEQ ID NO: 1381
  CDS (1)..(1089)

SEQ ID NO: 47023 - protein, 362 aa, Yarrowia lipolytica; identical to SEQ ID NO: 1382

SEQ ID NO: 47024 - DNA, 1119 bp, Kluyveromyces lactis; identical to SEQ ID NO: 1383
  CDS (1)..(1119)

SEQ ID NO: 47025 - protein, 372 aa, Kluyveromyces lactis; identical to SEQ ID NO: 1384

SEQ ID NO: 47026 - DNA, 1095 bp, Kluyveromyces lactis; identical to SEQ ID NO: 1385
  CDS (1)..(1095)

SEQ ID NO: 47027 - protein, 364 aa, Kluyveromyces lactis; identical to SEQ ID NO: 1386

SEQ ID NO: 47028 - DNA, 1074 bp, Erwinia carotovora subsp; identical to SEQ ID NO: 1387
  CDS (1)..(1074)

SEQ ID NO: 47029 - protein, 357 aa, Erwinia carotovora subsp; identical to SEQ ID NO: 1388

SEQ ID NO: 47030 - DNA, 1047 bp, Erwinia carotovora subsp; identical to SEQ ID NO: 1389
  CDS (1)..(1047)

SEQ ID NO: 47031 - protein, 348 aa, Erwinia carotovora subsp; identical to SEQ ID NO: 1390

SEQ ID NO: 47032 - DNA, 1056 bp, Erwinia carotovora subsp; identical to SEQ ID NO: 1391
  CDS (1)..(1056)

SEQ ID NO: 47033 - protein, 351 aa, Erwinia carotovora subsp; identical to SEQ ID NO: 1392

SEQ ID NO: 47034 - DNA, 1113 bp, Acinetobacter sp; identical to SEQ ID NO: 1393
  CDS (1)..(1113)

SEQ ID NO: 47035 - protein, 370 aa, Acinetobacter sp; identical to SEQ ID NO: 1394

SEQ ID NO: 47036 - DNA, 1056 bp, Acinetobacter sp; identical to SEQ ID NO: 1395
  CDS (1)..(1056)

SEQ ID NO: 47037 - protein, 351 aa, Acinetobacter sp; identical to SEQ ID NO: 1396

SEQ ID NO: 47038 - DNA, 1119 bp, Candida glabrata; identical to SEQ ID NO: 1397
  CDS (1)..(1119)

SEQ ID NO: 47039 - protein, 372 aa, Candida glabrata; identical to SEQ ID NO: 1398

SEQ ID NO: 47040 - DNA, 1071 bp, Candida glabrata; identical to SEQ ID NO: 1399
  CDS (1)..(1071)

SEQ ID NO: 47041 - protein, 356 aa, Candida glabrata; identical to SEQ ID NO: 1400

SEQ ID NO: 47042 - DNA, 1083 bp, Photobacterium profundum; identical to SEQ ID NO: 1401
  CDS (1)..(1083)

SEQ ID NO: 47043 - protein, 360 aa, Photobacterium profundum; identical to SEQ ID NO: 1402

SEQ ID NO: 47044 - DNA, 1053 bp, Photobacterium profundum; identical to SEQ ID NO: 1403
  CDS (1)..(1053)

SEQ ID NO: 47045 - protein, 350 aa, Photobacterium profundum; identical to SEQ ID NO: 1404

SEQ ID NO: 47046 - DNA, 1113 bp, Photobacterium profundum; identical to SEQ ID NO: 1405
  CDS (1)..(1113)

SEQ ID NO: 47047 - protein, 370 aa, Photobacterium profundum; identical to SEQ ID NO: 1406

SEQ ID NO: 47048 - DNA, 1056 bp, Photobacterium profundum; identical to SEQ ID NO: 1407
  CDS (1)..(1056)

SEQ ID NO: 47049 - protein, 351 aa, Photobacterium profundum; identical to SEQ ID NO: 1408

SEQ ID NO: 47050 - DNA, 1092 bp, Parachlamydia sp; identical to SEQ ID NO: 1409
  CDS (1)..(1092)

SEQ ID NO: 47051 - protein, 363 aa, Parachlamydia sp; identical to SEQ ID NO: 1410

SEQ ID NO: 47052 - DNA, 1095 bp, Rhodopseudomonas palustris; identical to SEQ ID NO: 1411
  CDS (1)..(1095)

SEQ ID NO: 47053 - protein, 364 aa, Rhodopseudomonas palustris; identical to SEQ ID NO: 1412

SEQ ID NO: 47054 - DNA, 1100 bp, Amycolatopsis methanolica; identical to SEQ ID NO: 1413
  CDS (1)..(1086)

SEQ ID NO: 47055 - protein, 361 aa, Amycolatopsis methanolica; identical to SEQ ID NO: 1414

SEQ ID NO: 47056 - DNA, 1071 bp, Treponema denticola; identical to SEQ ID NO: 1415
  CDS (1)..(1071)

SEQ ID NO: 47057 - protein, 356 aa, Treponema denticola; identical to SEQ ID NO: 1416

SEQ ID NO: 47058 - DNA, 1068 bp, Geobacter sulfurreducens; identical to SEQ ID NO: 1417
  CDS (1)..(1068)

SEQ ID NO: 47059 - protein, 355 aa, Geobacter sulfurreducens; identical to SEQ ID NO: 1418

SEQ ID NO: 47060 - DNA, 1095 bp, Ashbya gossypii; identical to SEQ ID NO: 1419
  CDS (1)..(1095)

SEQ ID NO: 47061 - protein, 364 aa, Ashbya gossypii; identical to SEQ ID NO: 1420

SEQ ID NO: 47062 - DNA, 1122 bp, Ashbya gossypii; identical to SEQ ID NO: 1421
  CDS (1)..(1122)

SEQ ID NO: 47063 - protein, 373 aa, Ashbya gossypii; identical to SEQ ID NO: 1422

SEQ ID NO: 47064 - DNA, 1098 bp, Amycolatopsis balhimycina; identical to SEQ ID NO: 1423
  CDS (1)..(1098)

SEQ ID NO: 47065 - protein, 365 aa, Amycolatopsis balhimycina; identical to SEQ ID NO: 1424

SEQ ID NO: 47066 - DNA, 1053 bp, Vibrio vulnificus; identical to SEQ ID NO: 2345
  CDS (1)..(1053)

SEQ ID NO: 47067 - protein, 350 aa, Vibrio vulnificus; identical to SEQ ID NO: 2346

SEQ ID NO: 47068 - DNA, 1047 bp, Photorhabdus luminescens; identical to SEQ ID NO: 1427
  CDS (1)..(1047)

SEQ ID NO: 47069 - protein, 348 aa, Photorhabdus luminescens; identical to SEQ ID NO: 1428

SEQ ID NO: 47070 - DNA, 1053 bp, Photorhabdus luminescens; identical to SEQ ID NO: 1429
  CDS (1)..(1053)

SEQ ID NO: 47071 - protein, 350 aa, Photorhabdus luminescens; identical to SEQ ID NO: 1430

SEQ ID NO: 47072 - DNA, 1095 bp, Photorhabdus luminescens; identical to SEQ ID NO: 1431
  CDS (1)..(1095)

SEQ ID NO: 47073 - protein, 364 aa, Photorhabdus luminescens; identical to SEQ ID NO: 1432

SEQ ID NO: 47074 - DNA, 1119 bp, Gloeobacter violaceus; identical to SEQ ID NO: 1433
  CDS (1)..(1119)

SEQ ID NO: 47075 - protein, 372 aa, Gloeobacter violaceus; identical to SEQ ID NO: 1434

SEQ ID NO: 47076 - DNA, 1107 bp, Chromobacterium violaceum; identical to SEQ ID NO: 1435
  CDS (1)..(1107)

SEQ ID NO: 47077 - protein, 368 aa, Chromobacterium violaceum; identical to SEQ ID NO: 1436

SEQ ID NO: 47078 - DNA, 1059 bp, Chromobacterium violaceum; identical to SEQ ID NO: 1437
  CDS (1)..(1059)

SEQ ID NO: 47079 - protein, 352 aa, Chromobacterium violaceum; identical to SEQ ID NO: 1438

SEQ ID NO: 47080 - DNA, 1140 bp, Neurospora crassa; identical to SEQ ID NO: 1439
  CDS (1)..(1140)

SEQ ID NO: 47081 - protein, 379 aa, Neurospora crassa; identical to SEQ ID NO: 1440

SEQ ID NO: 47082 - DNA, 1092 bp, Neurospora crassa; identical to SEQ ID NO: 1441
  CDS (1)..(1092)

SEQ ID NO: 47083 - protein, 363 aa, Neurospora crassa; identical to SEQ ID NO: 1442

SEQ ID NO: 47084 - DNA, 1068 bp, Synechococcus sp; identical to SEQ ID NO: 1443
  CDS (1)..(1068)

SEQ ID NO: 47085 - protein, 355 aa, Synechococcus sp; identical to SEQ ID NO: 1444

SEQ ID NO: 47086 - DNA, 1053 bp, Rhodopirellula baltica; identical to SEQ ID NO: 1445
  CDS (1)..(1053)

SEQ ID NO: 47087 - protein, 350 aa, Rhodopirellula baltica; identical to SEQ ID NO: 1446

SEQ ID NO: 47088 - DNA, 1068 bp, Prochlorococcus marinus subsp; identical to SEQ ID NO: 1447
  CDS (1)..(1068)

SEQ ID NO: 47089 - protein, 355 aa, Prochlorococcus marinus subsp; identical to SEQ ID NO: 1448

SEQ ID NO: 47090 - DNA, 1083 bp, Prochlorococcus marinus; identical to SEQ ID NO: 1449
  CDS (1)..(1083)

SEQ ID NO: 47091 - protein, 360 aa, Prochlorococcus marinus; identical to SEQ ID NO: 1450

SEQ ID NO: 47092 - DNA, 1074 bp, Prochlorococcus marinus; identical to SEQ ID NO: 1451
  CDS (1)..(1074)

SEQ ID NO: 47093 - protein, 357 aa, Prochlorococcus marinus; identical to SEQ ID NO: 1452

SEQ ID NO: 47094 - DNA, 1113 bp, Haemophilus ducreyi; identical to SEQ ID NO: 1453
  CDS (1)..(1113)

SEQ ID NO: 47095 - protein, 370 aa, Haemophilus ducreyi; identical to SEQ ID NO: 1454

SEQ ID NO: 47096 - DNA, 1080 bp, Haemophilus ducreyi; identical to SEQ ID NO: 1455
  CDS (1)..(1080)

SEQ ID NO: 47097 - protein, 359 aa, Haemophilus ducreyi; identical to SEQ ID NO: 1456

SEQ ID NO: 47098 - DNA, 1086 bp, Candidatus Blochmannia floridanus; identical to SEQ ID NO: 1457
  CDS (1)..(1086)

SEQ ID NO: 47099 - protein, 361 aa, Candidatus Blochmannia floridanus; identical to SEQ ID NO: 1458

SEQ ID NO: 47100 - DNA, 1074 bp, Bordetella pertussis; identical to SEQ ID NO: 2379
  CDS (1)..(1074)

SEQ ID NO: 47101 - protein, 357 aa, Bordetella pertussis; identical to SEQ ID NO: 1460

SEQ ID NO: 47102 - DNA, 1119 bp, Bordetella bronchiseptica; identical to SEQ ID NO: 1461
  CDS (1)..(1119)

SEQ ID NO: 47103 - protein, 372 aa, Bordetella bronchiseptica; identical to SEQ ID NO: 1462

SEQ ID NO: 47104 - DNA, 1179 bp, Nitrosomonas europaea; identical to SEQ ID NO: 1463
  CDS (1)..(1179)

SEQ ID NO: 47105 - protein, 392 aa, Nitrosomonas europaea; identical to SEQ ID NO: 1464

SEQ ID NO: 47106 - DNA, 1083 bp, Coxiella burnetii; identical to SEQ ID NO: 1465
  CDS (1)..(1083)

SEQ ID NO: 47107 - protein, 360 aa, Coxiella burnetii; identical to SEQ ID NO: 1466

SEQ ID NO: 47108 - DNA, 1053 bp, Vibrio parahaemolyticus; identical to SEQ ID NO: 1471
  CDS (1)..(1053)

SEQ ID NO: 47109 - protein, 350 aa, Vibrio parahaemolyticus; identical to SEQ ID NO: 1472

SEQ ID NO: 47110 - DNA, 1053 bp, Vibrio parahaemolyticus; identical to SEQ ID NO: 1473
  CDS (1)..(1053)

SEQ ID NO: 47111 - protein, 350 aa, Vibrio parahaemolyticus; identical to SEQ ID NO: 1474

SEQ ID NO: 47112 - DNA, 1074 bp, Vibrio parahaemolyticus; identical to SEQ ID NO: 1475
  CDS (1)..(1074)

SEQ ID NO: 47113 - protein, 357 aa, Vibrio parahaemolyticus; identical to SEQ ID NO: 1476

SEQ ID NO: 47114 - DNA, 1083 bp, Pseudomonas syringae; identical to SEQ ID NO: 1477
  CDS (1)..(1083)

SEQ ID NO: 47115 - protein, 360 aa, Pseudomonas syringae; identical to SEQ ID NO: 1478

SEQ ID NO: 47116 - DNA, 1077 bp, Pseudomonas syringae; identical to SEQ ID NO: 1479
  CDS (1)..(1077)

SEQ ID NO: 47117 - protein, 358 aa, Pseudomonas syringae; identical to SEQ ID NO: 1480

SEQ ID NO: 47118 - DNA, 1062 bp, Pseudomonas putida; identical to SEQ ID NO: 1481
  CDS (1)..(1062)

SEQ ID NO: 47119 - protein, 353 aa, Pseudomonas putida; identical to SEQ ID NO: 1482

SEQ ID NO: 47120 - DNA, 1113 bp, Pseudomonas putida; identical to SEQ ID NO: 1483
  CDS (1)..(1113)

SEQ ID NO: 47121 - protein, 370 aa, Pseudomonas putida; identical to SEQ ID NO: 1484

SEQ ID NO: 47122 - DNA, 1086 bp, Bradyrhizobium japonicum; identical to SEQ ID NO: 1485
  CDS (1)..(1086)

SEQ ID NO: 47123 - protein, 361 aa, Bradyrhizobium japonicum; identical to SEQ ID NO: 1486

SEQ ID NO: 47124 - DNA, 1053 bp, Yersinia pestis; identical to SEQ ID NO: 1487
  CDS (1)..(1053)

SEQ ID NO: 47125 - protein, 350 aa, Yersinia pestis; identical to SEQ ID NO: 1488

SEQ ID NO: 47126 - DNA, 1038 bp, Wigglesworthia glossinidia brevipalpis; identical to SEQ ID NO: 1491
  CDS (1)..(1038)

SEQ ID NO: 47127 - protein, 345 aa, Wigglesworthia glossinidia brevipalpis; identical to SEQ ID NO: 1492

SEQ ID NO: 47128 - DNA, 1071 bp, Vibrio vulnificus; identical to SEQ ID NO: 1739
  CDS (1)..(1071)

SEQ ID NO: 47129 - protein, 356 aa, Vibrio vulnificus; identical to SEQ ID NO: 1740

SEQ ID NO: 47130 - DNA, 1053 bp, Vibrio vulnificus; identical to SEQ ID NO: 1493
  CDS (1)..(1053)

SEQ ID NO: 47131 - protein, 350 aa, Vibrio vulnificus; identical to SEQ ID NO: 1494

SEQ ID NO: 47132 - DNA, 1071 bp, Vibrio vulnificus; identical to SEQ ID NO: 1497
  CDS (1)..(1071)

SEQ ID NO: 47133 - protein, 356 aa, Vibrio vulnificus; identical to SEQ ID NO: 1498

SEQ ID NO: 47134 - DNA, 1062 bp, Synechococcus elongatus; identical to SEQ ID NO: 1499
  CDS (1)..(1062)

SEQ ID NO: 47135 - protein, 353 aa, Synechococcus elongatus; identical to SEQ ID NO: 1500

SEQ ID NO: 47136 - DNA, 1032 bp, Streptococcus mutans; identical to SEQ ID NO: 1501
  CDS (1)..(1032)

SEQ ID NO: 47137 - protein, 343 aa, Streptococcus mutans; identical to SEQ ID NO: 1502

SEQ ID NO: 47138 - DNA, 1035 bp, Streptococcus mutans; identical to SEQ ID NO: 1503
  CDS (1)..(1035)

SEQ ID NO: 47139 - protein, 344 aa, Streptococcus mutans; identical to SEQ ID NO: 1504

SEQ ID NO: 47140 - DNA, 1008 bp, Streptococcus agalactiae; identical to SEQ ID NO: 1505
  CDS (1)..(1008)

SEQ ID NO: 47141 - protein, 335 aa, Streptococcus agalactiae; identical to SEQ ID NO: 1506

SEQ ID NO: 47142 - DNA, 1065 bp, Shewanella oneidensis; identical to SEQ ID NO: 1507
  CDS (1)..(1065)

SEQ ID NO: 47143 - protein, 354 aa, Shewanella oneidensis; identical to SEQ ID NO: 1508

SEQ ID NO: 47144 - DNA, 1092 bp, Shewanella oneidensis; identical to SEQ ID NO: 1509
  CDS (1)..(1092)

SEQ ID NO: 47145 - protein, 363 aa, Shewanella oneidensis; identical to SEQ ID NO: 1510

SEQ ID NO: 47146 - DNA, 1059 bp, Shewanella oneidensis; identical to SEQ ID NO: 1511
  CDS (1)..(1059)

SEQ ID NO: 47147 - protein, 352 aa, Shewanella oneidensis; identical to SEQ ID NO: 1512

SEQ ID NO: 47148 - DNA, 1170 bp, Corynebacterium efficiens; identical to SEQ ID NO: 1515
  CDS (1)..(1170)

SEQ ID NO: 47149 - protein, 389 aa, Corynebacterium efficiens; identical to SEQ ID NO: 1516

SEQ ID NO: 47150 - DNA, 1134 bp, Bifidobacterium longum; identical to SEQ ID NO: 1517
  CDS (1)..(1134)

SEQ ID NO: 47151 - protein, 377 aa, Bifidobacterium longum; identical to SEQ ID NO: 1518

SEQ ID NO: 47152 - DNA, 1233 bp, Bifidobacterium longum; identical to SEQ ID NO: 1519
  CDS (1)..(1233)

SEQ ID NO: 47153 - protein, 410 aa, Bifidobacterium longum; identical to SEQ ID NO: 1520

SEQ ID NO: 47154 - DNA, 1221 bp, Phytophthora infestans; identical to SEQ ID NO: 1521
  CDS (20)..(1153)

SEQ ID NO: 47155 - protein, 377 aa, Phytophthora infestans; identical to SEQ ID NO: 1522

SEQ ID NO: 47156 - DNA, 1062 bp, Chlorobium tepidum; identical to SEQ ID NO: 1523
  CDS (1)..(1062)

SEQ ID NO: 47157 - protein, 353 aa, Chlorobium tepidum; identical to SEQ ID NO: 1524

SEQ ID NO: 47158 - DNA, 1074 bp, Xanthomonas campestris; identical to SEQ ID NO: 1525
  CDS (1)..(1074)

SEQ ID NO: 47159 - protein, 357 aa, Xanthomonas campestris; identical to SEQ ID NO: 1526

SEQ ID NO: 47160 - DNA, 1074 bp, Xanthomonas axonopodis; identical to SEQ ID NO: 1527
  CDS (1)..(1074)

SEQ ID NO: 47161 - protein, 357 aa, Xanthomonas axonopodis; identical to SEQ ID NO: 1528

SEQ ID NO: 47162 - DNA, 1080 bp, Ralstonia solanacearum; identical to SEQ ID NO: 1529
  CDS (1)..(1080)

SEQ ID NO: 47163 - protein, 359 aa, Ralstonia solanacearum; identical to SEQ ID NO: 1530

SEQ ID NO: 47164 - DNA, 1179 bp, Ralstonia solanacearum; identical to SEQ ID NO: 1531
  CDS (1)..(1179)

SEQ ID NO: 47165 - protein, 392 aa, Ralstonia solanacearum; identical to SEQ ID NO: 1532

SEQ ID NO: 47166 - DNA, 1065 bp, Synechococcus sp; identical to SEQ ID NO: 1533
  CDS (1)..(1065)

SEQ ID NO: 47167 - protein, 354 aa, Synechococcus sp; identical to SEQ ID NO: 1534

SEQ ID NO: 47168 - DNA, 1035 bp, Escherichia coli; identical to SEQ ID NO: 1535
  CDS (1)..(1035)

SEQ ID NO: 47169 - protein, 344 aa, Escherichia coli; identical to SEQ ID NO: 1536

SEQ ID NO: 47170 - DNA, 1200 bp, Stigmatella aurantiaca; identical to SEQ ID NO: 1537
  CDS (62)..(1147)

SEQ ID NO: 47171 - protein, 361 aa, Stigmatella aurantiaca; identical to SEQ ID NO: 1538

SEQ ID NO: 47172 - DNA, 1083 bp, Amycolatopsis mediterranei; identical to SEQ ID NO: 1541
  CDS (1)..(1083)

SEQ ID NO: 47173 - protein, 360 aa, Amycolatopsis mediterranei; identical to SEQ ID NO: 1542

SEQ ID NO: 47174 - DNA, 1053 bp, Pasteurella multocida; identical to SEQ ID NO: 1543
  CDS (1)..(1053)

SEQ ID NO: 47175 - protein, 350 aa, Pasteurella multocida; identical to SEQ ID NO: 1544

SEQ ID NO: 47176 - DNA, 1086 bp, Pasteurella multocida; identical to SEQ ID NO: 1545
  CDS (1)..(1086)

SEQ ID NO: 47177 - protein, 361 aa, Pasteurella multocida; identical to SEQ ID NO: 1546

SEQ ID NO: 47178 - DNA, 1125 bp, Emericella nidulans; identical to SEQ ID NO: 1547
  CDS (1)..(1125)

SEQ ID NO: 47179 - protein, 374 aa, Emericella nidulans; identical to SEQ ID NO: 1548

SEQ ID NO: 47180 - DNA, 1089 bp, Emericella nidulans; identical to SEQ ID NO: 1549
  CDS (1)..(1089)

SEQ ID NO: 47181 - protein, 362 aa, Emericella nidulans; identical to SEQ ID NO: 1550

SEQ ID NO: 47182 - DNA, 1239 bp, Vibrio cholerae; identical to SEQ ID NO: 1551
  CDS (114)..(1175)

SEQ ID NO: 47183 - protein, 353 aa, Vibrio cholerae; identical to SEQ ID NO: 1552

SEQ ID NO: 47184 - DNA, 2184 bp, Candida albicans; identical to SEQ ID NO: 1553
  CDS (461)..(1573)

SEQ ID NO: 47185 - protein, 370 aa, Candida albicans; identical to SEQ ID NO: 1554

SEQ ID NO: 47186 - DNA, 1047 bp, Buchnera aphidicola; identical to SEQ ID NO: 1555
  CDS (1)..(1047)

SEQ ID NO: 47187 - protein, 348 aa, Buchnera aphidicola; identical to SEQ ID NO: 1556

SEQ ID NO: 47188 - DNA, 1047 bp, Buchnera aphidicola; identical to SEQ ID NO: 1557
  CDS (1)..(1047)

SEQ ID NO: 47189 - protein, 348 aa, Buchnera aphidicola; identical to SEQ ID NO: 1558

SEQ ID NO: 47190 - DNA, 1047 bp, Erwinia herbicola; identical to SEQ ID NO: 1559
  CDS (1)..(1047)

SEQ ID NO: 47191 - protein, 348 aa, Erwinia herbicola; identical to SEQ ID NO: 1560

SEQ ID NO: 47192 - DNA, 1047 bp, Salmonella typhimurium; identical to SEQ ID NO: 1561
  CDS (1)..(1047)

SEQ ID NO: 47193 - protein, 348 aa, Salmonella typhimurium; identical to SEQ ID NO: 1562

SEQ ID NO: 47194 - DNA, 1047 bp, Shigella flexneri; identical to SEQ ID NO: 2473
  CDS (1)..(1047)

SEQ ID NO: 47195 - protein, 348 aa, Shigella flexneri; identical to SEQ ID NO: 2474

SEQ ID NO: 47196 - DNA, 25 bp, Artificial sequence
  (1)..(25): primer
atgttcattaaaaacgatcacgccg

SEQ ID NO: 47197 - DNA, 25 bp, Artificial sequence
  (1)..(25): primer
ctattttttcaaggcctttcttctg

SEQ ID NO: 47198 - protein, 353 aa, Artificial sequence; identical to SEQ ID NO: 24922
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(37): xaa in position 37 is any amino acid
  Variant (39)..(46): xaa in position 39 to 46 is any amino acid
  Variant (51)..(51): xaa in position 51 is any amino acid
  Variant (54)..(56): xaa in position 54 to 56 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(130): xaa in position 121 to 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(152): xaa in position 148 to 152 is any amino acid
  Variant (163)..(163): xaa in position 163 is any amino acid
  Variant (166)..(168): xaa in position 166 to 168 is any amino acid
  Variant (171)..(171): xaa in position 171 is any amino acid
  Variant (174)..(174): xaa in position 174 is any amino acid
  Variant (176)..(176): xaa in position 176 is any amino acid
  Variant (181)..(181): xaa in position 181 is any amino acid
  Variant (183)..(183): xaa in position 183 is any amino acid
  Variant (185)..(188): xaa in position 185 to 188 is any amino acid
  Variant (190)..(191): xaa in position 190 to 191 is any amino acid
  Variant (193)..(195): xaa in position 193 to 195 is any amino acid
  Variant (197)..(199): xaa in position 197 to 199 is any amino acid
  Variant (201)..(201): xaa in position 201 is any amino acid
  Variant (203)..(208): xaa in position 203 to 208 is any amino acid
  Variant (210)..(215): xaa in position 210 to 215 is any amino acid
  Variant (217)..(217): xaa in position 217 is any amino acid
  Variant (220)..(222): xaa in position 220 to 222 is any amino acid
  Variant (224)..(225): xaa in position 224 to 225 is any amino acid
  Variant (230)..(238): xaa in position 230 to 238 is any amino acid
  Variant (241)..(269): xaa in position 241 to 269 is any amino acid
  Variant (271)..(271): xaa in position 271 is any amino acid
  Variant (274)..(274): xaa in position 274 is any amino acid
  Variant (277)..(277): xaa in position 277 is any amino acid
  Variant (279)..(282): xaa in position 279 to 282 is any amino acid
  Variant (284)..(285): xaa in position 284 to 285 is any amino acid
  Variant (287)..(292): xaa in position 287 to 292 is any amino acid
  Variant (294)..(296): xaa in position 294 to 296 is any amino acid
  Variant (298)..(305): xaa in position 298 to 305 is any amino acid
  Variant (307)..(307): xaa in position 307 is any amino acid
  Variant (309)..(309): xaa in position 309 is any amino acid
  Variant (312)..(315): xaa in position 312 to 315 is any amino acid
  Variant (317)..(317): xaa in position 317 is any amino acid
  Variant (319)..(334): xaa in position 319 to 334 is any amino acid
  Variant (337)..(337): xaa in position 337 is any amino acid
  Variant (339)..(339): xaa in position 339 is any amino acid
  Variant (342)..(342): xaa in position 342 is any amino acid
  Variant (344)..(345): xaa in position 344 to 345 is any amino acid
  Variant (347)..(348): xaa in position 347 to 348 is any amino acid
  Variant (350)..(352): xaa in position 350 to 352 is any amino acid

SEQ ID NO: 47199 - protein, 72 aa, Artificial sequence; identical to SEQ ID NO: 2906
  Variant (5)..(5): xaa in position 5 is Ile, Val, Ser or Leu
  Variant (6)..(6): xaa in position 6 is His or Asp
  Variant (7)..(7): xaa in position 7 is Asp or Asn
  Variant (8)..(10): xaa in position 8 to 10 is any amino acid
  Variant (11)..(11): xaa in position 11 is Ala, Val or Gly
  Variant (12)..(12): xaa in position 12 is any amino acid
  Variant (13)..(13): xaa in position 13 is Glu, Asp, Ala or Gln
  Variant (15)..(15): xaa in position 15 is Ala, Gly or Cys
  Variant (16)..(17): xaa in position 16 to 17 is any amino acid
  Variant (18)..(18): xaa in position 18 is Leu, Ile or Phe
  Variant (19)..(28): xaa in position 19 to 28 is any amino acid
  Variant (29)..(30): xaa in position 29 to 30 is any or no amino acid
  Variant (31)..(31): xaa in position 31 is Leu, Ile, Phe or Met
  Variant (32)..(32): xaa in position 32 is any amino acid
  Variant (33)..(33): xaa in position 33 is Ile, Val, Leu or Met
  Variant (34)..(34): xaa in position 34 is Val, Ile or Leu
  Variant (37)..(37): xaa in position 37 is Val, Ala or Thr
  Variant (39)..(39): xaa in position 39 is Phe, Leu, Thr or Val
  Variant (40)..(40): xaa in position 40 is Glu or Ala
  Variant (45)..(46): xaa in position 45 to 46 is any amino acid
  Variant (47)..(47): xaa in position 47 is any or no amino acid
  Variant (49)..(49): xaa in position 49 is Trp or Tyr
  Variant (50)..(50): xaa in position 50 is Lys or Arg
  Variant (52)..(52): xaa in position 52 is Leu, Phe, Met or Tyr
  Variant (53)..(53): xaa in position 53 is Ile, Val, Ala or Leu
  Variant (54)..(54): xaa in position 54 is any amino acid
  Variant (55)..(55): xaa in position 55 is Asp, Glu or Gln
  Variant (57)..(57): xaa in position 57 is any amino acid
  Variant (58)..(58): xaa in position 58 is Leu, Met, Ile, Val, Ala or Thr
  Variant (59)..(59): xaa in position 59 is Asp, Asn or Ser
  Variant (60)..(63): xaa in position 60 to 63 is any amino acid
  Variant (64)..(64): xaa in position 64 is Ile, Val, Leu or Met
  Variant (65)..(66): xaa in position 65 to 66 is any amino acid
  Variant (68)..(68): xaa in position 68 is Leu, Ile, Met or Val
  Variant (69)..(70): xaa in position 69 to 70 is any amino acid
  Variant (71)..(71): xaa in position 71 is Ala, Ser, Gly, Val or Thr

SEQ ID NO: 47200 - protein, 76 aa, Artificial sequence; identical to SEQ ID NO: 2907
  Variant (1)..(1): xaa in position 1 is Ala or Ser
  Variant (2)..(2): xaa in position 2 is Ile or Val
  Variant (6)..(6): xaa in position 6 is Thr, Ser or Asn
  Variant (7)..(7): xaa in position 7 is Thr, Val, Ala, Ser or Ile
  Variant (8)..(8): xaa in position 8 is Glu or Ala
  Variant (9)..(9): xaa in position 9 is Ser, Asp or Asn
  Variant (11)..(11): xaa in position 11 is any amino acid
  Variant (14)..(14): xaa in position 14 is Glu, Gln, Phe or Met
  Variant (15)..(15): xaa in position 15 is Leu, Met, Val, Phe or Ile
  Variant (16)..(16): xaa in position 16 is Ala, Ser, Thr, Cys or Val
  Variant (18)..(18): xaa in position 18 is Gly, Ala or Asn
  Variant (19)..(21): xaa in position 19 to 21 is any amino acid
  Variant (22)..(22): xaa in position 22 is Pro or Ala
  Variant (23)..(23): xaa in position 23 is Val, Ile, Thr or Leu
  Variant (25)..(25): xaa in position 25 is Phe, Met, Tyr or Ile
  Variant (28)..(28): xaa in position 28 is any amino acid
  Variant (29)..(29): xaa in position 29 is Thr, Ser or Arg
  Variant (30)..(30): xaa in position 30 is any amino acid
  Variant (32)..(35): xaa in position 32 to 35 is any amino acid
  Variant (36)..(36): xaa in position 36 is Ala or Met
  Variant (37)..(37): xaa in position 37 is any amino acid
  Variant (38)..(38): xaa in position 38 is Asp, Asn or Glu
  Variant (39)..(39): xaa in position 39 is Ala or Gly
  Variant (40)..(41): xaa in position 40 to 41 is any amino acid
  Variant (42)..(42): xaa in position 42 is Ala or Ser
  Variant (43)..(43): xaa in position 43 is Ala, Ser, Val or Thr
  Variant (44)..(46): xaa in position 44 to 46 is any amino acid
  Variant (47)..(47): xaa in position 47 is His or Gln
  Variant (48)..(48): xaa in position 48 is any amino acid
  Variant (49)..(49): xaa in position 49 is Phe, Tyr, His or Val
  Variant (50)..(51): xaa in position 50 to 51 is any amino acid
  Variant (52)..(55): xaa in position 52 to 55 is any or no amino acid
  Variant (57)..(60): xaa in position 57 to 60 is any amino acid
  Variant (61)..(62): xaa in position 61 to 62 is any or no amino acid
  Variant (63)..(63): xaa in position 63 is Thr or Ser
  Variant (64)..(64): xaa in position 64 is any amino acid
  Variant (67)..(69): xaa in position 67 to 69 is any amino acid
  Variant (70)..(70): xaa in position 70 is His or Phe
  Variant (71)..(71): xaa in position 71 is Val, Ile, Leu or Ala
  Variant (72)..(72): xaa in position 72 is Ile or Val
  Variant (73)..(73): xaa in position 73 is Leu or Met
  Variant (76)..(76): xaa in position 76 is Gly, Ala or Ser

SEQ ID NO: 47201 - protein, 83 aa, Artificial sequence; identical to SEQ ID NO: 2908
  Variant (1)..(1): xaa in position 1 is Leu, Ile or Val
  Variant (2)..(2): xaa in position 2 is Met, Val, Ile or Leu
  Variant (3)..(3): xaa in position 3 is Ile or Val
  Variant (5)..(5): xaa in position 5 is Cys, Phe, Ala, Thr or Tyr
  Variant (6)..(6): xaa in position 6 is Ser, Asn or Ala
  Variant (8)..(8): xaa in position 8 is Gly, Ala or Asp
  Variant (10)..(10): xaa in position 10 is Ser or Cys
  Variant (11)..(11): xaa in position 11 is any amino acid
  Variant (13)..(15): xaa in position 13 to 15 is any amino acid
  Variant (16)..(16): xaa in position 16 is Arg, Asn, Lys, Leu or Glu
  Variant (18)..(19): xaa in position 18 to 19 is any amino acid
  Variant (20)..(20): xaa in position 20 is Val or Ile
  Variant (21)..(26): xaa in position 21 to 26 is any amino acid
  Variant (27)..(27): xaa in position 27 is Gln, Asn or Arg
  Variant (28)..(28): xaa in position 28 is Ile, Leu, Val, Arg or Met
  Variant (29)..(30): xaa in position 29 to 30 is any amino acid
  Variant (31)..(31): xaa in position 31 is Gly, Asn or Asp
  Variant (32)..(32): xaa in position 32 is any amino acid
  Variant (33)..(37): xaa in position 33 to 37 is any or no amino acid
  Variant (38)..(38): xaa in position 38 is Ile, Val or Leu
  Variant (39)..(39): xaa in position 39 is any amino acid
  Variant (41)..(41): xaa in position 41 is any amino acid
  Variant (43)..(43): xaa in position 43 is Ile, Leu, Val, Ala or Met
  Variant (46)..(46): xaa in position 46 is His, Phe, Asn or Tyr
  Variant (47)..(47): xaa in position 47 is Leu or Ile
  Variant (48)..(49): xaa in position 48 to 49 is any amino acid
  Variant (51)..(51): xaa in position 51 is any amino acid
  Variant (53)..(57): xaa in position 53 to 57 is any amino acid
  Variant (58)..(69): xaa in position 58 to 69 is any or no amino acid
  Variant (71)..(71): xaa in position 71 is any amino acid
  Variant (73)..(73): xaa in position 73 is Ile or Val
  Variant (76)..(76): xaa in position 76 is any amino acid
  Variant (78)..(78): xaa in position 78 is Ile, Leu or Val
  Variant (79)..(79): xaa in position 79 is any amino acid
  Variant (80)..(80): xaa in position 80 is Trp, Ile, Leu or Phe
  Variant (81)..(82): xaa in position 81 to 82 is any amino acid
  Variant (83)..(83): xaa in position 83 is Thr or Ser

SEQ ID NO: 47202 - DNA, 1992 bp, Saccharomyces cerevisiae; identical to SEQ ID NO: 46090
  CDS (1)..(1992)

SEQ ID NO: 47203 - protein, 663 aa, Saccharomyces cerevisiae; identical to SEQ ID NO: 46091

SEQ ID NO: 47204 - DNA, 28 bp, Artificial sequence
  (1)..(28): primer
atgaagttactttttaaaagatattcgt

SEQ ID NO: 47205 - DNA, 27 bp, Artificial sequence
  (1)..(27): primer
ttatttttgttgcatttgcttagatct

SEQ ID NO: 47206 - DNA, 1163 bp, Escherichia coli; identical to SEQ ID NO: 17374
  CDS (215)..(1009)

SEQ ID NO: 47207 - protein, 264 aa, Escherichia coli; identical to SEQ ID NO: 17375

SEQ ID NO: 47208 - DNA, 927 bp, Xenopus tropicalis; identical to SEQ ID NO: 17376
  CDS (1)..(927)

SEQ ID NO: 47209 - protein, 308 aa, Xenopus tropicalis; identical to SEQ ID NO: 17377

SEQ ID NO: 47210 - DNA, 780 bp, Saccharomyces cerevisiae; identical to SEQ ID NO: 17378
  CDS (1)..(780)

SEQ ID NO: 47211 - protein, 259 aa, Saccharomyces cerevisiae; identical to SEQ ID NO: 17379

SEQ ID NO: 47212 - DNA, 873 bp, Ateline herpesvirus 3; identical to SEQ ID NO: 17380
  CDS (1)..(873)

SEQ ID NO: 47213 - protein, 290 aa, Ateline herpesvirus 3; identical to SEQ ID NO: 17381

SEQ ID NO: 47214 - DNA, 879 bp, Melanoplus sanguinipes entomopoxvirus; identical to SEQ ID NO: 17382
  CDS (1)..(879)

SEQ ID NO: 47215 - protein, 292 aa, Melanoplus sanguinipes entomopoxvirus; identical to SEQ ID NO: 17383

SEQ ID NO: 47216 - DNA, 888 bp, Cercopithecine herpesvirus 9; identical to SEQ ID NO: 17384
  CDS (1)..(888)

SEQ ID NO: 47217 - protein, 295 aa, Cercopithecine herpesvirus 9; identical to SEQ ID NO: 17385

SEQ ID NO: 47218 - DNA, 987 bp, Mycoplasma pneumoniae M129; identical to SEQ ID NO: 17386
  CDS (1)..(987): transl_table=4

SEQ ID NO: 47219 - protein, 328 aa, Mycoplasma pneumoniae M129; identical to SEQ ID NO: 17387

SEQ ID NO: 47220 - DNA, 888 bp, Invertebrate iridescent virus 6; identical to SEQ ID NO: 17388
  CDS (1)..(888)

SEQ ID NO: 47221 - protein, 295 aa, Invertebrate iridescent virus 6; identical to SEQ ID NO: 17389

SEQ ID NO: 47222 - DNA, 1479 bp, Arabidopsis thaliana; identical to SEQ ID NO: 17390
  CDS (1)..(1479)

SEQ ID NO: 47223 - protein, 492 aa, Arabidopsis thaliana; identical to SEQ ID NO: 17391

SEQ ID NO: 47224 - DNA, 1698 bp, Arabidopsis thaliana; identical to SEQ ID NO: 17392
  CDS (1)..(1698)

SEQ ID NO: 47225 - protein, 565 aa, Arabidopsis thaliana; identical to SEQ ID NO: 17393

SEQ ID NO: 47226 - DNA, 1164 bp, Deinococcus radiodurans R1; identical to SEQ ID NO: 17394
  CDS (1)..(1164): transl_table=11

SEQ ID NO: 47227 - protein, 387 aa, Deinococcus radiodurans R1; identical to SEQ ID NO: 17395

SEQ ID NO: 47228 - DNA, 801 bp, Mycobacterium tuberculosis CDC1551; identical to SEQ ID NO: 17396
  CDS (1)..(801): transl_table=11

SEQ ID NO: 47229 - protein, 266 aa, Mycobacterium tuberculosis CDC1551; identical to SEQ ID NO: 17397

SEQ ID NO: 47230 - DNA, 840 bp, Agrobacterium tumefaciens str. C58; identical to SEQ ID NO: 17398
  CDS (1)..(840): transl_table=11

SEQ ID NO: 47231 - protein, 279 aa, Agrobacterium tumefaciens str. C58; identical to SEQ ID NO: 17399

SEQ ID NO: 47232 - DNA, 870 bp, Shrimp white spot syndrome virus; identical to SEQ ID NO: 17400
  CDS (1)..(870)

SEQ ID NO: 47233 - protein, 289 aa, Shrimp white spot syndrome virus; identical to SEQ ID NO: 17401

SEQ ID NO: 47234 - DNA, 1116 bp, Salmonella enterica subsp. enterica serovar Typhi str. CT18; identical to SEQ ID NO: 17402
  CDS (1)..(1116): transl_table=11

SEQ ID NO: 47235 - protein, 371 aa, Salmonella enterica subsp. enterica serovar Typhi str. CT18; identical to SEQ ID NO: 17403

SEQ ID NO: 47236 - DNA, 1002 bp, Cercopithecine herpesvirus 17; identical to SEQ ID NO: 17404
  CDS (1)..(1002)

SEQ ID NO: 47237 - protein, 333 aa, Cercopithecine herpesvirus 17; identical to SEQ ID NO: 17405

SEQ ID NO: 47238 - DNA, 960 bp, Danio rerio; identical to SEQ ID NO: 17406
  CDS (1)..(960)

SEQ ID NO: 47239 - protein, 319 aa, Danio rerio; identical to SEQ ID NO: 17407

SEQ ID NO: 47240 - DNA, 1878 bp, Schizosaccharomyces pombe 972h-; identical to SEQ ID NO: 17408
  CDS (1)..(1878)

SEQ ID NO: 47241 - protein, 625 aa, Schizosaccharomyces pombe 972h-; identical to SEQ ID NO: 17409

SEQ ID NO: 47242 - DNA, 864 bp, Streptococcus pyogenes MGAS315; identical to SEQ ID NO: 17410
  CDS (1)..(864): transl_table=11

SEQ ID NO: 47243 - protein, 287 aa, Streptococcus pyogenes MGAS315; identical to SEQ ID NO: 17411

SEQ ID NO: 47244 - DNA, 876 bp, Heliothis zea virus 1; identical to SEQ ID NO: 17412
  CDS (1)..(876)

SEQ ID NO: 47245 - protein, 291 aa, Heliothis zea virus 1; identical to SEQ ID NO: 17413

SEQ ID NO: 47246 - DNA, 1827 bp, Plasmodium falciparum 3D7; identical to SEQ ID NO: 17414
  CDS (1)..(1827)

SEQ ID NO: 47247 - protein, 608 aa, Plasmodium falciparum 3D7; identical to SEQ ID NO: 17415

SEQ ID NO: 47248 - DNA, 861 bp, Enterobacteria phage RB69; identical to SEQ ID NO: 17416
  CDS (1)..(861): transl_table=11

SEQ ID NO: 47249 - protein, 286 aa, Enterobacteria phage RB69; identical to SEQ ID NO: 17417

SEQ ID NO: 47250 - DNA, 804 bp, Porphyromonas gingivalis W83; identical to SEQ ID NO: 17418
  CDS (1)..(804): transl_table=11

SEQ ID NO: 47251 - protein, 267 aa, Porphyromonas gingivalis W83; identical to SEQ ID NO: 17419

SEQ ID NO: 47252 - DNA, 840 bp, Bacteriophage 44RR2.8t; identical to SEQ ID NO: 17420
  CDS (1)..(840): transl_table=11

SEQ ID NO: 47253 - protein, 279 aa, Bacteriophage 44RR2.8t; identical to SEQ ID NO: 17421

SEQ ID NO: 47254 - DNA, 834 bp, Bacteriophage Aeh1; identical to SEQ ID NO: 17422
  CDS (1)..(834): transl_table=11

SEQ ID NO: 47255 - protein, 277 aa, Bacteriophage Aeh1; identical to SEQ ID NO: 17423

SEQ ID NO: 47256 - DNA, 900 bp, Bacteriophage Felix 01; identical to SEQ ID NO: 17424
  CDS (1)..(900): transl_table=11

SEQ ID NO: 47257 - protein, 299 aa, Bacteriophage Felix 01; identical to SEQ ID NO: 17425

SEQ ID NO: 47258 - DNA, 1023 bp, Eremothecium gossypii; identical to SEQ ID NO: 17426
  CDS (1)..(1023)

SEQ ID NO: 47259 - protein, 340 aa, Eremothecium gossypii; identical to SEQ ID NO: 17427

SEQ ID NO: 47260 - DNA, 870 bp, Anopheles gambiae str. PEST; identical to SEQ ID NO: 17428
  CDS (1)..(870)

SEQ ID NO: 47261 - protein, 289 aa, Anopheles gambiae str. PEST; identical to SEQ ID NO: 17429

SEQ ID NO: 47262 - DNA, 1107 bp, Neurospora crassa; identical to SEQ ID NO: 17430
  CDS (1)..(1107)

SEQ ID NO: 47263 - protein, 368 aa, Neurospora crassa; identical to SEQ ID NO: 17431

SEQ ID NO: 47264 - DNA, 1020 bp, Magnaporthe grisea 70-15; identical to SEQ ID NO: 17432
  CDS (1)..(1020)

SEQ ID NO: 47265 - protein, 339 aa, Magnaporthe grisea 70-15; identical to SEQ ID NO: 17433

SEQ ID NO: 47266 - DNA, 978 bp, Gibberella zeae PH-1; identical to SEQ ID NO: 17434
  CDS (1)..(978)

SEQ ID NO: 47267 - protein, 325 aa, Gibberella zeae PH-1; identical to SEQ ID NO: 17435

SEQ ID NO: 47268 - DNA, 1665 bp, Ustilago maydis 521; identical to SEQ ID NO: 17436
  CDS (1)..(1665)

SEQ ID NO: 47269 - protein, 554 aa, Ustilago maydis 521; identical to SEQ ID NO: 17437

SEQ ID NO: 47270 - DNA, 3207 bp, Gallus gallus; identical to SEQ ID NO: 17438
  CDS (1)..(3207)

SEQ ID NO: 47271 - protein, 1068 aa, Gallus gallus; identical to SEQ ID NO: 17439

SEQ ID NO: 47272 - DNA, 897 bp, Candida glabrata CBS138; identical to SEQ ID NO: 17440
  CDS (1)..(897)

SEQ ID NO: 47273 - protein, 298 aa, Candida glabrata CBS138; identical to SEQ ID NO: 17441

SEQ ID NO: 47274 - DNA, 939 bp, Kluyveromyces lactis NRRL Y-1140; identical to SEQ ID NO: 17442
  CDS (1)..(939)

SEQ ID NO: 47275 - protein, 312 aa, Kluyveromyces lactis NRRL Y-1140; identical to SEQ ID NO: 17443

SEQ ID NO: 47276 - DNA, 951 bp, Debaryomyces hansenii CBS767; identical to SEQ ID NO: 17444
  CDS (1)..(951)

SEQ ID NO: 47277 - protein, 316 aa, Debaryomyces hansenii CBS767; identical to SEQ ID NO: 17445

SEQ ID NO: 47278 - DNA, 891 bp, Yarrowia lipolytica CLIB99; identical to SEQ ID NO: 17446
  CDS (1)..(891)

SEQ ID NO: 47279 - protein, 296 aa, Yarrowia lipolytica CLIB99; identical to SEQ ID NO: 17447

SEQ ID NO: 47280 - DNA, 978 bp, Canis familiaris; identical to SEQ ID NO: 17448
  CDS (1)..(978)

SEQ ID NO: 47281 - protein, 325 aa, Canis familiaris; identical to SEQ ID NO: 17449

SEQ ID NO: 47282 - DNA, 1257 bp, Canis familiaris; identical to SEQ ID NO: 17450
  CDS (1)..(1257)

SEQ ID NO: 47283 - protein, 418 aa, Canis familiaris; identical to SEQ ID NO: 17451

SEQ ID NO: 47284 - DNA, 918 bp, Apis mellifera; identical to SEQ ID NO: 17452
  CDS (1)..(918)

SEQ ID NO: 47285 - protein, 305 aa, Apis mellifera; identical to SEQ ID NO: 17453

SEQ ID NO: 47286 - DNA, 1965 bp, Aspergillus nidulans FGSC A4; identical to SEQ ID NO: 17454
  CDS (1)..(1965)

SEQ ID NO: 47287 - protein, 654 aa, Aspergillus nidulans FGSC A4; identical to SEQ ID NO: 17455

SEQ ID NO: 47288 - DNA, 1566 bp, Cryptosporidium hominis; identical to SEQ ID NO: 17456
  CDS (1)..(1566)

SEQ ID NO: 47289 - protein, 521 aa, Cryptosporidium hominis; identical to SEQ ID NO: 17457

SEQ ID NO: 47290 - DNA, 1758 bp, Plasmodium berghei; identical to SEQ ID NO: 17458
  CDS (1)..(1758)

SEQ ID NO: 47291 - protein, 585 aa, Plasmodium berghei; identical to SEQ ID NO: 17459

SEQ ID NO: 47292 - DNA, 840 bp, Enterobacteria phage T5; identical to SEQ ID NO: 17460
  CDS (1)..(840): transl_table=11

SEQ ID NO: 47293 - protein, 279 aa, Enterobacteria phage T5; identical to SEQ ID NO: 17461

SEQ ID NO: 47294 - DNA, 864 bp, Streptococcus pyogenes MGAS10394; identical to SEQ ID NO: 17462
  CDS (1)..(864): transl_table=11

SEQ ID NO: 47295 - protein, 287 aa, Streptococcus pyogenes MGAS10394; identical to SEQ ID NO: 17463

SEQ ID NO: 47296 - DNA, 861 bp, Lymphocystis disease virus - isolate China; identical to SEQ ID NO: 17464
  CDS (1)..(861)

SEQ ID NO: 47297 - protein, 286 aa, Lymphocystis disease virus - isolate China; identical to SEQ ID NO: 17465

SEQ ID NO: 47298 - DNA, 972 bp, Burkholderia mallei ATCC 23344; identical to SEQ ID NO: 17466
  CDS (1)..(972): transl_table=11

SEQ ID NO: 47299 - protein, 323 aa, Burkholderia mallei ATCC 23344; identical to SEQ ID NO: 17467

SEQ ID NO: 47300 - DNA, 990 bp, Burkholderia pseudomallei K96243; identical to SEQ ID NO: 17468
  CDS (1)..(990): transl_table=11

SEQ ID NO: 47301 - protein, 329 aa, Burkholderia pseudomallei K96243; identical to SEQ ID NO: 17469

SEQ ID NO: 47302 - DNA, 1692 bp, Acanthamoeba polyphaga mimivirus; identical to SEQ ID NO: 17470
  CDS (1)..(1692)

SEQ ID NO: 47303 - protein, 563 aa, Acanthamoeba polyphaga mimivirus; identical to SEQ ID NO: 17471

SEQ ID NO: 47304 - DNA, 858 bp, Vibrio fischeri ES114; identical to SEQ ID NO: 17472
  CDS (1)..(858): transl_table=11

SEQ ID NO: 47305 - protein, 285 aa, Vibrio fischeri ES114; identical to SEQ ID NO: 17473

SEQ ID NO: 47306 - DNA, 795 bp, Neisseria gonorrhoeae FA 1090; identical to SEQ ID NO: 17474
  CDS (1)..(795): transl_table=11

SEQ ID NO: 47307 - protein, 264 aa, Neisseria gonorrhoeae FA 1090; identical to SEQ ID NO: 17475

SEQ ID NO: 47308 - DNA, 795 bp, Bacteroides fragilis NCTC 9343; identical to SEQ ID NO: 17476
  CDS (1)..(795): transl_table=11

SEQ ID NO: 47309 - protein, 264 aa, Bacteroides fragilis NCTC 9343; identical to SEQ ID NO: 17477

SEQ ID NO: 47310 - DNA, 972 bp, Pseudomonas syringae pv. syringae B728a; identical to SEQ ID NO: 17478
  CDS (1)..(972)

SEQ ID NO: 47311 - protein, 323 aa, Pseudomonas syringae pv. syringae B728a; identical to SEQ ID NO: 17479

SEQ ID NO: 47312 - DNA, 1002 bp, Macaca fuscata rhadinovirus; identical to SEQ ID NO: 17480
  CDS (1)..(1002)

SEQ ID NO: 47313 - protein, 333 aa, Macaca fuscata rhadinovirus; identical to SEQ ID NO: 17481

SEQ ID NO: 47314 - DNA, 858 bp, Enterobacteria phage RB43; identical to SEQ ID NO: 17482
  CDS (1)..(858): transl_table=11

SEQ ID NO: 47315 - protein, 285 aa, Enterobacteria phage RB43; identical to SEQ ID NO: 17483

SEQ ID NO: 47316 - DNA, 852 bp, Haemophilus influenzae 86-028NP; identical to SEQ ID NO: 17484
  CDS (1)..(852): transl_table=11

SEQ ID NO: 47317 - protein, 283 aa, Haemophilus influenzae 86-028NP; identical to SEQ ID NO: 17485

SEQ ID NO: 47318 - DNA, 822 bp, Corynebacterium jeikeium K411; identical to SEQ ID NO: 17486
  CDS (1)..(822): transl_table=11

SEQ ID NO: 47319 - protein, 273 aa, Corynebacterium jeikeium K411; identical to SEQ ID NO: 17487

SEQ ID NO: 47320 - DNA, 897 bp, Rhodobacter sphaeroides 2.4.1; identical to SEQ ID NO: 17488
  CDS (1)..(897)

SEQ ID NO: 47321 - protein, 298 aa, Rhodobacter sphaeroides 2.4.1; identical to SEQ ID NO: 17489

SEQ ID NO: 47322 - DNA, 957 bp, Lactobacillus gasseri; identical to SEQ ID NO: 17490
  CDS (1)..(957)

SEQ ID NO: 47323 - protein, 318 aa, Lactobacillus gasseri; identical to SEQ ID NO: 17491

SEQ ID NO: 47324 - DNA, 795 bp, Magnetospirillum magnetotacticum MS-1; identical to SEQ ID NO: 17492
  CDS (1)..(795)

SEQ ID NO: 47325 - protein, 264 aa, Magnetospirillum magnetotacticum MS-1; identical to SEQ ID NO: 17493

SEQ ID NO: 47326 - DNA, 969 bp, Leuconostoc mesenteroides subsp. mesenteroides ATCC 8293; identical to SEQ ID NO: 17494
  CDS (1)..(969)

SEQ ID NO: 47327 - protein, 322 aa, Leuconostoc mesenteroides subsp. mesenteroides ATCC 8293; identical to SEQ ID NO: 17495

SEQ ID NO: 47328 - DNA, 852 bp, Haemophilus somnus 129PT; identical to SEQ ID NO: 17496
  CDS (1)..(852)

SEQ ID NO: 47329 - protein, 283 aa, Haemophilus somnus 129PT; identical to SEQ ID NO: 17497

SEQ ID NO: 47330 - DNA, 828 bp, Fusobacterium nucleatum subsp. vincentii ATCC 49256; identical to SEQ ID NO: 17498
  CDS (1)..(828): transl_table=11

SEQ ID NO: 47331 - protein, 275 aa, Fusobacterium nucleatum subsp. vincentii ATCC 49256; identical to SEQ ID NO: 17499

SEQ ID NO: 47332 - DNA, 795 bp, Dechloromonas aromatica RCB; identical to SEQ ID NO: 17500
  CDS (1)..(795)

SEQ ID NO: 47333 - protein, 264 aa, Dechloromonas aromatica RCB; identical to SEQ ID NO: 17501

SEQ ID NO: 47334 - DNA, 795 bp, Ralstonia eutropha JMP134; identical to SEQ ID NO: 17502
  CDS (1)..(795)

SEQ ID NO: 47335 - protein, 264 aa, Ralstonia eutropha JMP134; identical to SEQ ID NO: 17503

SEQ ID NO: 47336 - DNA, 852 bp, Haemophilus influenzae R2846; identical to SEQ ID NO: 17504
  CDS (1)..(852)

SEQ ID NO: 47337 - protein, 283 aa, Haemophilus influenzae R2846; identical to SEQ ID NO: 17505

SEQ ID NO: 47338 - DNA, 873 bp, Bifidobacterium longum DJO10A; identical to SEQ ID NO: 17506
  CDS (1)..(873)

SEQ ID NO: 47339 - protein, 290 aa, Bifidobacterium longum DJO10A; identical to SEQ ID NO: 17507

SEQ ID NO: 47340 - DNA, 972 bp, Burkholderia cepacia R18194; identical to SEQ ID NO: 17508
  CDS (1)..(972)

SEQ ID NO: 47341 - protein, 323 aa, Burkholderia cepacia R18194; identical to SEQ ID NO: 17509

SEQ ID NO: 47342 - DNA, 945 bp, Listeria monocytogenes str. 1/2a F6854; identical to SEQ ID NO: 17510
  CDS (1)..(945): transl_table=11

SEQ ID NO: 47343 - protein, 314 aa, Listeria monocytogenes str. 1/2a F6854; identical to SEQ ID NO: 17511

SEQ ID NO: 47344 - DNA, 957 bp, Bacillus cereus G9241; identical to SEQ ID NO: 17512
  CDS (1)..(957): transl_table=11

SEQ ID NO: 47345 - protein, 318 aa, Bacillus cereus G9241; identical to SEQ ID NO: 17513

SEQ ID NO: 47346 - DNA, 951 bp, Rubrivivax gelatinosus PM1; identical to SEQ ID NO: 17514
  CDS (1)..(951)

SEQ ID NO: 47347 - protein, 316 aa, Rubrivivax gelatinosus PM1; identical to SEQ ID NO: 17515

SEQ ID NO: 47348 - DNA, 786 bp, Rubrivivax gelatinosus PM1; identical to SEQ ID NO: 17516
  CDS (1)..(786)

SEQ ID NO: 47349 - protein, 261 aa, Rubrivivax gelatinosus PM1; identical to SEQ ID NO: 17517

SEQ ID NO: 47350 - DNA, 972 bp, Pseudomonas fluorescens PfO-1; identical to SEQ ID NO: 17518
  CDS (1)..(972)

SEQ ID NO: 47351 - protein, 323 aa, Pseudomonas fluorescens PfO-1; identical to SEQ ID NO: 17519

SEQ ID NO: 47352 - DNA, 972 bp, Burkholderia fungorum LB400; identical to SEQ ID NO: 17520
  CDS (1)..(972)

SEQ ID NO: 47353 - protein, 323 aa, Burkholderia fungorum LB400; identical to SEQ ID NO: 17521

SEQ ID NO: 47354 - DNA, 945 bp, Novosphingobium aromaticivorans DSM 12444; identical to SEQ ID NO: 17522
  CDS (1)..(945)

SEQ ID NO: 47355 - protein, 314 aa, Novosphingobium aromaticivorans DSM 12444; identical to SEQ ID NO: 17523

SEQ ID NO: 47356 - DNA, 795 bp, Cytophaga hutchinsonii; identical to SEQ ID NO: 17524
  CDS (1)..(795)

SEQ ID NO: 47357 - protein, 264 aa, Cytophaga hutchinsonii; identical to SEQ ID NO: 17525

SEQ ID NO: 47358 - DNA, 834 bp, Microbulbifer degradans 2-40; identical to SEQ ID NO: 17526
  CDS (1)..(834)

SEQ ID NO: 47359 - protein, 277 aa, Microbulbifer degradans 2-40; identical to SEQ ID NO: 17527

SEQ ID NO: 47360 - DNA, 960 bp, Oenococcus oeni PSU-1; identical to SEQ ID NO: 17528
  CDS (1)..(960)

SEQ ID NO: 47361 - protein, 319 aa, Oenococcus oeni PSU-1; identical to SEQ ID NO: 17529

SEQ ID NO: 47362 - DNA, 951 bp, Pediococcus pentosaceus ATCC 25745; identical to SEQ ID NO: 17530
  CDS (1)..(951)

SEQ ID NO: 47363 - protein, 316 aa, Pediococcus pentosaceus ATCC 25745; identical to SEQ ID NO: 17531

SEQ ID NO: 47364 - DNA, 840 bp, Streptococcus suis 89/1591; identical to SEQ ID NO: 17532
  CDS (1)..(840)

SEQ ID NO: 47365 - protein, 279 aa, Streptococcus suis 89/1591; identical to SEQ ID NO: 17533

SEQ ID NO: 47366 - DNA, 795 bp, Thiobacillus denitrificans ATCC 25259; identical to SEQ ID NO: 17534
  CDS (1)..(795)

SEQ ID NO: 47367 - protein, 264 aa, Thiobacillus denitrificans ATCC 25259; identical to SEQ ID NO: 17535

SEQ ID NO: 47368 - DNA, 984 bp, Erythrobacter litoralis HTCC2594; identical to SEQ ID NO: 17536
  CDS (1)..(984): transl_table=11

SEQ ID NO: 47369 - protein, 327 aa, Erythrobacter litoralis HTCC2594; identical to SEQ ID NO: 17537

SEQ ID NO: 47370 - DNA, 840 bp, Lactococcus lactis subsp. cremoris SK11; identical to SEQ ID NO: 17538
  CDS (1)..(840)

SEQ ID NO: 47371 - protein, 279 aa, Lactococcus lactis subsp. cremoris SK11; identical to SEQ ID NO: 17539

SEQ ID NO: 47372 - DNA, 912 bp, Lactobacillus delbrueckii subsp. bulgaricus ATCC BAA-365; identical to SEQ ID NO: 17540
  CDS (1)..(912)

SEQ ID NO: 47373 - protein, 303 aa, Lactobacillus delbrueckii subsp. bulgaricus ATCC BAA-365; identical to SEQ ID NO: 17541

SEQ ID NO: 47374 - DNA, 861 bp, Streptococcus thermophilus LMD-9; identical to SEQ ID NO: 17542
  CDS (1)..(861)

SEQ ID NO: 47375 - protein, 286 aa, Streptococcus thermophilus LMD-9; identical to SEQ ID NO: 17543

SEQ ID NO: 47376 - DNA, 804 bp, Arthrobacter sp. FB24; identical to SEQ ID NO: 17544
  CDS (1)..(804): transl_table=11

SEQ ID NO: 47377 - protein, 267 aa, Arthrobacter sp. FB24; identical to SEQ ID NO: 17545

SEQ ID NO: 47378 - DNA, 795 bp, Azotobacter vinelandii AvOP; identical to SEQ ID NO: 17546
  CDS (1)..(795): transl_table=11

SEQ ID NO: 47379 - protein, 264 aa, Azotobacter vinelandii AvOP; identical to SEQ ID NO: 17547

SEQ ID NO: 47380 - DNA, 972 bp, Burkholderia vietnamiensis G4; identical to SEQ ID NO: 17548
  CDS (1)..(972): transl_table=11

SEQ ID NO: 47381 - protein, 323 aa, Burkholderia vietnamiensis G4; identical to SEQ ID NO: 17549

SEQ ID NO: 47382 - DNA, 972 bp, Burkholderia cenocepacia AU 1054; identical to SEQ ID NO: 17550
  CDS (1)..(972): transl_table=11

SEQ ID NO: 47383 - protein, 323 aa, Burkholderia cenocepacia AU 1054; identical to SEQ ID NO: 17551

SEQ ID NO: 47384 - DNA, 795 bp, Chromohalobacter salexigens DSM 3043; identical to SEQ ID NO: 17552
  CDS (1)..(795): transl_table=11

SEQ ID NO: 47385 - protein, 264 aa, Chromohalobacter salexigens DSM 3043; identical to SEQ ID NO: 17553

SEQ ID NO: 47386 - DNA, 972 bp, Burkholderia pseudomallei 668; identical to SEQ ID NO: 17554
  CDS (1)..(972)

SEQ ID NO: 47387 - protein, 323 aa, Burkholderia pseudomallei 668; identical to SEQ ID NO: 17555

SEQ ID NO: 47388 - DNA, 990 bp, Burkholderia pseudomallei S13; identical to SEQ ID NO: 17556
  CDS (1)..(990)

SEQ ID NO: 47389 - protein, 329 aa, Burkholderia pseudomallei S13; identical to SEQ ID NO: 17557

SEQ ID NO: 47390 - DNA, 831 bp, Clostridium thermocellum ATCC 27405; identical to SEQ ID NO: 17558
  CDS (1)..(831): transl_table=11

SEQ ID NO: 47391 - protein, 276 aa, Clostridium thermocellum ATCC 27405; identical to SEQ ID NO: 17559

SEQ ID NO: 47392 - DNA, 855 bp, Polaromonas sp. JS666; identical to SEQ ID NO: 17560
  CDS (1)..(855): transl_table=11

SEQ ID NO: 47393 - protein, 284 aa, Polaromonas sp. JS666; identical to SEQ ID NO: 17561

SEQ ID NO: 47394 - DNA, 795 bp, Exiguobacterium sp. 255-15; identical to SEQ ID NO: 17562
  CDS (1)..(795): transl_table=11

SEQ ID NO: 47395 - protein, 264 aa, Exiguobacterium sp. 255-15; identical to SEQ ID NO: 17563

SEQ ID NO: 47396 - DNA, 795 bp, Methylobacillus flagellatus KT; identical to SEQ ID NO: 17564
  CDS (1)..(795): transl_table=11

SEQ ID NO: 47397 - protein, 264 aa, Methylobacillus flagellatus KT; identical to SEQ ID NO: 17565

SEQ ID NO: 47398 - DNA, 963 bp, Sphingopyxis alaskensis RB2256; identical to SEQ ID NO: 17566
  CDS (1)..(963): transl_table=11

SEQ ID NO: 47399 - protein, 320 aa, Sphingopyxis alaskensis RB2256; identical to SEQ ID NO: 17567

SEQ ID NO: 47400 - DNA, 795 bp, Shewanella amazonensis SB2B; identical to SEQ ID NO: 17568
  CDS (1)..(795): transl_table=11

SEQ ID NO: 47401 - protein, 264 aa, Shewanella amazonensis SB2B; identical to SEQ ID NO: 17569

SEQ ID NO: 47402 - DNA, 795 bp, Ralstonia metallidurans CH34; identical to SEQ ID NO: 17570
  CDS (1)..(795): transl_table=11

SEQ ID NO: 47403 - protein, 264 aa, Ralstonia metallidurans CH34; identical to SEQ ID NO: 17571

SEQ ID NO: 47404 - DNA, 975 bp, Enterococcus faecium DO; identical to SEQ ID NO: 17572
  CDS (1)..(975): transl_table=11

SEQ ID NO: 47405 - protein, 324 aa, Enterococcus faecium DO; identical to SEQ ID NO: 17573

SEQ ID NO: 47406 - DNA, 795 bp, Mesorhizobium sp. BNC1; identical to SEQ ID NO: 17574
  CDS (1)..(795): transl_table=11

SEQ ID NO: 47407 - protein, 264 aa, Mesorhizobium sp. BNC1; identical to SEQ ID NO: 17575

SEQ ID NO: 47408 - DNA, 807 bp, Kineococcus radiotolerans SRS30216; identical to SEQ ID NO: 17576
  CDS (1)..(807): transl_table=11

SEQ ID NO: 47409 - protein, 268 aa, Kineococcus radiotolerans SRS30216; identical to SEQ ID NO: 17577

SEQ ID NO: 47410 - DNA, 834 bp, Silicibacter sp. TM1040; identical to SEQ ID NO: 17578
  CDS (1)..(834): transl_table=11

SEQ ID NO: 47411 - protein, 277 aa, Silicibacter sp. TM1040; identical to SEQ ID NO: 17579

SEQ ID NO: 47412 - DNA, 795 bp, Nitrobacter hamburgensis X14; identical to SEQ ID NO: 17580
  CDS (1)..(795): transl_table=11

SEQ ID NO: 47413 - protein, 264 aa, Nitrobacter hamburgensis X14; identical to SEQ ID NO: 17581

SEQ ID NO: 47414 - DNA, 795 bp, Shewanella denitrificans OS-217; identical to SEQ ID NO: 17582
  CDS (1)..(795): transl_table=11

SEQ ID NO: 47415 - protein, 264 aa, Shewanella denitrificans OS-217; identical to SEQ ID NO: 17583

SEQ ID NO: 47416 - DNA, 852 bp, Shewanella frigidimarina NCIMB 400; identical to SEQ ID NO: 17584
  CDS (1)..(852): transl_table=11

SEQ ID NO: 47417 - protein, 283 aa, Shewanella frigidimarina NCIMB 400; identical to SEQ ID NO: 17585

SEQ ID NO: 47418 - DNA, 1500 bp, Cryptosporidium parvum; identical to SEQ ID NO: 17586
  CDS (1)..(1500)

SEQ ID NO: 47419 - protein, 499 aa, Cryptosporidium parvum; identical to SEQ ID NO: 17587

SEQ ID NO: 47420 - DNA, 879 bp, Bacteriophage beta; identical to SEQ ID NO: 17588
  CDS (1)..(879): transl_table=11

SEQ ID NO: 47421 - protein, 292 aa, Bacteriophage beta; identical to SEQ ID NO: 17589

SEQ ID NO: 47422 - DNA, 1734 bp, Daucus carota; identical to SEQ ID NO: 17590
  CDS (1)..(1734)

SEQ ID NO: 47423 - protein, 577 aa, Daucus carota; identical to SEQ ID NO: 17591

SEQ ID NO: 47424 - DNA, 972 bp, Pseudomonas fluorescens; identical to SEQ ID NO: 17592
  CDS (1)..(972): transl_table=11

SEQ ID NO: 47425 - protein, 323 aa, Pseudomonas fluorescens; identical to SEQ ID NO: 17593

SEQ ID NO: 47426 - DNA, 1569 bp, Theileria parva; identical to SEQ ID NO: 17594
  CDS (1)..(1569)

SEQ ID NO: 47427 - protein, 522 aa, Theileria parva; identical to SEQ ID NO: 17595

SEQ ID NO: 47428 - DNA, 1572 bp, Theileria annulata; identical to SEQ ID NO: 17596
  CDS (1)..(1572)

SEQ ID NO: 47429 - protein, 523 aa, Theileria annulata; identical to SEQ ID NO: 17597

SEQ ID NO: 47430 - DNA, 1500 bp, Plasmodium chabaudi; identical to SEQ ID NO: 17598
  CDS (1)..(1500)

SEQ ID NO: 47431 - protein, 499 aa, Plasmodium chabaudi; identical to SEQ ID NO: 17599

SEQ ID NO: 47432 - DNA, 942 bp, Homo sapiens; identical to SEQ ID NO: 17600
  CDS (1)..(942)

SEQ ID NO: 47433 - protein, 313 aa, Homo sapiens; identical to SEQ ID NO: 17601

SEQ ID NO: 47434 - DNA, 1584 bp, Trypanosoma brucei; identical to SEQ ID NO: 17602
  CDS (1)..(1584)

SEQ ID NO: 47435 - protein, 527 aa, Trypanosoma brucei; identical to SEQ ID NO: 17603

SEQ ID NO: 47436 - DNA, 852 bp, Haemophilus parasuis; identical to SEQ ID NO: 17604
  CDS (1)..(852): transl_table=11

SEQ ID NO: 47437 - protein, 283 aa, Haemophilus parasuis; identical to SEQ ID NO: 17605

SEQ ID NO: 47438 - DNA, 948 bp, Caenorhabditis briggsae; identical to SEQ ID NO: 17606
  CDS (1)..(948)

SEQ ID NO: 47439 - protein, 315 aa, Caenorhabditis briggsae; identical to SEQ ID NO: 17607

SEQ ID NO: 47440 - DNA, 957 bp, Brachydanio rerio; identical to SEQ ID NO: 17608
  CDS (1)..(957)

SEQ ID NO: 47441 - protein, 318 aa, Brachydanio rerio; identical to SEQ ID NO: 17609

SEQ ID NO: 47442 - DNA, 861 bp, Bacteriophage T6; identical to SEQ ID NO: 17610
  CDS (1)..(861): transl_table=11

SEQ ID NO: 47443 - protein, 286 aa, Bacteriophage T6; identical to SEQ ID NO: 17611

SEQ ID NO: 47444 - DNA, 861 bp, Bacteriophage U5; identical to SEQ ID NO: 17612
  CDS (1)..(861): transl_table=11

SEQ ID NO: 47445 - protein, 286 aa, Bacteriophage U5; identical to SEQ ID NO: 17613

SEQ ID NO: 47446 - DNA, 861 bp, Bacteriophage RB3; identical to SEQ ID NO: 17614
  CDS (1)..(861): transl_table=11

SEQ ID NO: 47447 - protein, 286 aa, Bacteriophage RB3; identical to SEQ ID NO: 17615

SEQ ID NO: 47448 - DNA, 861 bp, Bacteriophage RB27; identical to SEQ ID NO: 17616
  CDS (1)..(861): transl_table=11

SEQ ID NO: 47449 - protein, 286 aa, Bacteriophage RB27; identical to SEQ ID NO: 17617

SEQ ID NO: 47450 - DNA, 861 bp, Bacteriophage RB23; identical to SEQ ID NO: 17618
  CDS (1)..(861): transl_table=11

SEQ ID NO: 47451 - protein, 286 aa, Bacteriophage RB23; identical to SEQ ID NO: 17619

SEQ ID NO: 47452 - DNA, 861 bp, Bacteriophage RB61; identical to SEQ ID NO: 17620
  CDS (1)..(861): transl_table=11

SEQ ID NO: 47453 - protein, 286 aa, Bacteriophage RB61; identical to SEQ ID NO: 17621

SEQ ID NO: 47454 - DNA, 861 bp, Bacteriophage LZ2; identical to SEQ ID NO: 17622
  CDS (1)..(861): transl_table=11

SEQ ID NO: 47455 - protein, 286 aa, Bacteriophage LZ2; identical to SEQ ID NO: 17623

SEQ ID NO: 47456 - DNA, 861 bp, Bacteriophage RB14; identical to SEQ ID NO: 17624
  CDS (1)..(861): transl_table=11

SEQ ID NO: 47457 - protein, 286 aa, Bacteriophage RB14; identical to SEQ ID NO: 17625

SEQ ID NO: 47458 - DNA, 861 bp, Bacteriophage RB32; identical to SEQ ID NO: 17626
  CDS (1)..(861): transl_table=11

SEQ ID NO: 47459 - protein, 286 aa, Bacteriophage RB32; identical to SEQ ID NO: 17627

SEQ ID NO: 47460 - DNA, 840 bp, Lactococcus lactis; identical to SEQ ID NO: 17628
  CDS (1)..(840): transl_table=11

SEQ ID NO: 47461 - protein, 279 aa, Lactococcus lactis; identical to SEQ ID NO: 17629

SEQ ID NO: 47462 - DNA, 1767 bp, Plasmodium yoelii yoelii; identical to SEQ ID NO: 17630
  CDS (1)..(1767)

SEQ ID NO: 47463 - protein, 588 aa, Plasmodium yoelii yoelii; identical to SEQ ID NO: 17631

SEQ ID NO: 47464 - DNA, 861 bp, Bacteriophage T2; identical to SEQ ID NO: 17632
  CDS (1)..(861): transl_table=11

SEQ ID NO: 47465 - protein, 286 aa, Bacteriophage T2; identical to SEQ ID NO: 17633

SEQ ID NO: 47466 - DNA, 1536 bp, Babesia bovis; identical to SEQ ID NO: 17634
  CDS (1)..(1536)

SEQ ID NO: 47467 - protein, 511 aa, Babesia bovis; identical to SEQ ID NO: 17635

SEQ ID NO: 47468 - DNA, 960 bp, Brachydanio rerio; identical to SEQ ID NO: 17636
  CDS (1)..(960)

SEQ ID NO: 47469 - protein, 319 aa, Brachydanio rerio; identical to SEQ ID NO: 17637

SEQ ID NO: 47470 - DNA, 1593 bp, Pisum sativum; identical to SEQ ID NO: 17638
  CDS (1)..(1593)

SEQ ID NO: 47471 - protein, 530 aa, Pisum sativum; identical to SEQ ID NO: 17639

SEQ ID NO: 47472 - DNA, 1563 bp, Leishmania chagasi; identical to SEQ ID NO: 17640
  CDS (1)..(1563)

SEQ ID NO: 47473 - protein, 520 aa, Leishmania chagasi; identical to SEQ ID NO: 17641

SEQ ID NO: 47474 - DNA, 1563 bp, Leishmania infantum; identical to SEQ ID NO: 17642
  CDS (1)..(1563)

SEQ ID NO: 47475 - protein, 520 aa, Leishmania infantum; identical to SEQ ID NO: 17643

SEQ ID NO: 47476 - DNA, 1563 bp, Leishmania tropica; identical to SEQ ID NO: 17644
  CDS (1)..(1563): n means a or g or c or t/u, s means g or c

SEQ ID NO: 47477 - protein, 520 aa, Leishmania tropica; identical to SEQ ID NO: 17645
  Xaa in position 304 is unknown

SEQ ID NO: 47478 - DNA, 870 bp, White spot syndrome virus; identical to SEQ ID NO: 17646
  CDS (1)..(870)

SEQ ID NO: 47479 - protein, 289 aa, White spot syndrome virus; identical to SEQ ID NO: 17647

SEQ ID NO: 47480 - DNA, 924 bp, Mus musculus; identical to SEQ ID NO: 17648
  CDS (1)..(924)

SEQ ID NO: 47481 - protein, 307 aa, Mus musculus; identical to SEQ ID NO: 17649

SEQ ID NO: 47482 - DNA, 840 bp, Homo sapiens; identical to SEQ ID NO: 17650
  CDS (1)..(840)

SEQ ID NO: 47483 - protein, 279 aa, Homo sapiens; identical to SEQ ID NO: 17651

SEQ ID NO: 47484 - DNA, 951 bp, Macropodid herpesvirus 1; identical to SEQ ID NO: 17652
  CDS (1)..(951)

SEQ ID NO: 47485 - protein, 316 aa, Macropodid herpesvirus 1; identical to SEQ ID NO: 17653

SEQ ID NO: 47486 - DNA, 1770 bp, Plasmodium gallinaceum; identical to SEQ ID NO: 17654
  CDS (1)..(1770)

SEQ ID NO: 47487 - protein, 589 aa, Plasmodium gallinaceum; identical to SEQ ID NO: 17655

SEQ ID NO: 47488 - DNA, 1002 bp, Rhesus monkey rhadinovirus H26; identical to SEQ ID NO: 17656
  CDS (1)..(1002)

SEQ ID NO: 47489 - protein, 333 aa, Rhesus monkey rhadinovirus H26; identical to SEQ ID NO: 17657

SEQ ID NO: 47490 - DNA, 939 bp, Caenorhabditis elegans; identical to SEQ ID NO: 17658
  CDS (1)..(939)

SEQ ID NO: 47491 - protein, 312 aa, Caenorhabditis elegans; identical to SEQ ID NO: 17659

SEQ ID NO: 47492 - DNA, 924 bp, Trichinella spiralis; identical to SEQ ID NO: 17660
  CDS (1)..(924)

SEQ ID NO: 47493 - protein, 307 aa, Trichinella spiralis; identical to SEQ ID NO: 17661

SEQ ID NO: 47494 - DNA, 1029 bp, Halobacterium volcanii; identical to SEQ ID NO: 17662
  CDS (1)..(1029): transl_table=11

SEQ ID NO: 47495 - protein, 342 aa, Halobacterium volcanii; identical to SEQ ID NO: 17663

SEQ ID NO: 47496 - DNA, 969 bp, Oryza sativa; identical to SEQ ID NO: 17664
  CDS (1)..(969)

SEQ ID NO: 47497 - protein, 322 aa, Oryza sativa; identical to SEQ ID NO: 17665

SEQ ID NO: 47498 - DNA, 741 bp, Bacteriophage T4; identical to SEQ ID NO: 17666
  CDS (1)..(741): transl_table=11

SEQ ID NO: 47499 - protein, 246 aa, Bacteriophage T4; identical to SEQ ID NO: 17667

SEQ ID NO: 47500 - DNA, 1560 bp, Arabidopsis thaliana; identical to SEQ ID NO: 17668
  CDS (1)..(1560)

SEQ ID NO: 47501 - protein, 519 aa, Arabidopsis thaliana; identical to SEQ ID NO: 17669

SEQ ID NO: 47502 - DNA, 1557 bp, Arabidopsis thaliana; identical to SEQ ID NO: 17670
  CDS (1)..(1557)

SEQ ID NO: 47503 - protein, 518 aa, Arabidopsis thaliana; identical to SEQ ID NO: 17671

SEQ ID NO: 47504 - DNA, 1548 bp, Crithidia fasciculata; identical to SEQ ID NO: 17672
  CDS (1)..(1548)

SEQ ID NO: 47505 - protein, 515 aa, Crithidia fasciculata; identical to SEQ ID NO: 17673

SEQ ID NO: 47506 - DNA, 1587 bp, Daucus carota; identical to SEQ ID NO: 17674
  CDS (1)..(1587)

SEQ ID NO: 47507 - protein, 528 aa, Daucus carota; identical to SEQ ID NO: 17675

SEQ ID NO: 47508 - DNA, 1563 bp, Leishmania amazonensis; identical to SEQ ID NO: 17676
  CDS (1)..(1563)

SEQ ID NO: 47509 - protein, 520 aa, Leishmania amazonensis; identical to SEQ ID NO: 17677

SEQ ID NO: 47510 - DNA, 1563 bp, Leishmania major; identical to SEQ ID NO: 17678
  CDS (1)..(1563)

SEQ ID NO: 47511 - protein, 520 aa, Leishmania major; identical to SEQ ID NO: 17679

SEQ ID NO: 47512 - DNA, 1566 bp, Zea mays; identical to SEQ ID NO: 17680
  CDS (1)..(1566)

SEQ ID NO: 47513 - protein, 521 aa, Zea mays; identical to SEQ ID NO: 17681

SEQ ID NO: 47514 - DNA, 1389 bp, Paramecium tetraurelia; identical to SEQ ID NO: 17682
  CDS (1)..(1389): transl_table=6

SEQ ID NO: 47515 - protein, 462 aa, Paramecium tetraurelia; identical to SEQ ID NO: 17683

SEQ ID NO: 47516 - DNA, 1752 bp, Plasmodium chabaudi; identical to SEQ ID NO: 17684
  CDS (1)..(1752)

SEQ ID NO: 47517 - protein, 583 aa, Plasmodium chabaudi; identical to SEQ ID NO: 17685

SEQ ID NO: 47518 - DNA, 1827 bp, Plasmodium falciparum; identical to SEQ ID NO: 17686
  CDS (1)..(1827)

SEQ ID NO: 47519 - protein, 608 aa, Plasmodium falciparum; identical to SEQ ID NO: 17687

SEQ ID NO: 47520 - DNA, 1872 bp, Plasmodium vivax; identical to SEQ ID NO: 17688
  CDS (1)..(1872)

SEQ ID NO: 47521 - protein, 623 aa, Plasmodium vivax; identical to SEQ ID NO: 17689

SEQ ID NO: 47522 - DNA, 1593 bp, Glycine max; identical to SEQ ID NO: 17690
  CDS (1)..(1593)

SEQ ID NO: 47523 - protein, 530 aa, Glycine max; identical to SEQ ID NO: 17691

SEQ ID NO: 47524 - DNA, 1833 bp, Toxoplasma gondii; identical to SEQ ID NO: 17692
  CDS (1)..(1833)

SEQ ID NO: 47525 - protein, 610 aa, Toxoplasma gondii; identical to SEQ ID NO: 17693

SEQ ID NO: 47526 - DNA, 1566 bp, Trypanosoma cruzi; identical to SEQ ID NO: 17694
  CDS (1)..(1566)

SEQ ID NO: 47527 - protein, 521 aa, Trypanosoma cruzi; identical to SEQ ID NO: 17695

SEQ ID NO: 47528 - DNA, 885 bp, Encephalitozoon cuniculi; identical to SEQ ID NO: 17696
  CDS (1)..(885)

SEQ ID NO: 47529 - protein, 294 aa, Encephalitozoon cuniculi; identical to SEQ ID NO: 17697

SEQ ID NO: 47530 - DNA, 840 bp, Bacillus licheniformis; identical to SEQ ID NO: 17698
  CDS (1)..(840): transl_table=11

SEQ ID NO: 47531 - protein, 279 aa, Bacillus licheniformis; identical to SEQ ID NO: 17699

SEQ ID NO: 47532 - DNA, 840 bp, Bacillus subtilis; identical to SEQ ID NO: 17700
  CDS (1)..(840): transl_table=11

SEQ ID NO: 47533 - protein, 279 aa, Bacillus subtilis; identical to SEQ ID NO: 17701

SEQ ID NO: 47534 - DNA, 1243 bp, Bacillus amyloliquefaciens; identical to SEQ ID NO: 17702
  CDS (157)..(951)

SEQ ID NO: 47535 - protein, 264 aa, Bacillus amyloliquefaciens; identical to SEQ ID NO: 17703

SEQ ID NO: 47536 - DNA, 795 bp, Bacillus subtilis; identical to SEQ ID NO: 17704
  CDS (1)..(795): transl_table=11

SEQ ID NO: 47537 - protein, 264 aa, Bacillus subtilis; identical to SEQ ID NO: 17705

SEQ ID NO: 47538 - DNA, 843 bp, Acinetobacter sp; identical to SEQ ID NO: 17706
  CDS (1)..(843): transl_table=11

SEQ ID NO: 47539 - protein, 280 aa, Acinetobacter sp; identical to SEQ ID NO: 17707

SEQ ID NO: 47540 - DNA, 891 bp, Agaricus bisporus; identical to SEQ ID NO: 17708
  CDS (1)..(891)

SEQ ID NO: 47541 - protein, 296 aa, Agaricus bisporus; identical to SEQ ID NO: 17709

SEQ ID NO: 47542 - DNA, 795 bp, Agrobacterium tumefaciens; identical to SEQ ID NO: 17710
  CDS (1)..(795): transl_table=11

SEQ ID NO: 47543 - protein, 264 aa, Agrobacterium tumefaciens; identical to SEQ ID NO: 17711

SEQ ID NO: 47544 - DNA, 885 bp, Ascaris suum; identical to SEQ ID NO: 17712
  CDS (1)..(885)

SEQ ID NO: 47545 - protein, 294 aa, Ascaris suum; identical to SEQ ID NO: 17713

SEQ ID NO: 47546 - DNA, 795 bp, Azoarcus sp; identical to SEQ ID NO: 17714
  CDS (1)..(795): transl_table=11

SEQ ID NO: 47547 - protein, 264 aa, Azoarcus sp; identical to SEQ ID NO: 17715

SEQ ID NO: 47548 - DNA, 957 bp, Bacillus cereus; identical to SEQ ID NO: 17716
  CDS (1)..(957): transl_table=11

SEQ ID NO: 47549 - protein, 318 aa, Bacillus cereus; identical to SEQ ID NO: 17717

SEQ ID NO: 47550 - DNA, 795 bp, Bacteroides fragilis; identical to SEQ ID NO: 17718
  CDS (1)..(795): transl_table=11

SEQ ID NO: 47551 - protein, 264 aa, Bacteroides fragilis; identical to SEQ ID NO: 17719

SEQ ID NO: 47552 - DNA, 795 bp, Bacillus halodurans; identical to SEQ ID NO: 17720
  CDS (1)..(795): transl_table=11

SEQ ID NO: 47553 - protein, 264 aa, Bacillus halodurans; identical to SEQ ID NO: 17721

SEQ ID NO: 47554 - DNA, 840 bp, Bacillus mojavensis; identical to SEQ ID NO: 17722
  CDS (1)..(840): transl_table=11

SEQ ID NO: 47555 - protein, 279 aa, Bacillus mojavensis; identical to SEQ ID NO: 17723

SEQ ID NO: 47556 - DNA, 840 bp, Bacillus subtilis var; identical to SEQ ID NO: 17724
  CDS (1)..(840): transl_table=11

SEQ ID NO: 47557 - protein, 279 aa, Bacillus subtilis var; identical to SEQ ID NO: 17725

SEQ ID NO: 47558 - DNA, 795 bp, Bacillus clausii; identical to SEQ ID NO: 17726
  CDS (1)..(795): transl_table=11

SEQ ID NO: 47559 - protein, 264 aa, Bacillus clausii; identical to SEQ ID NO: 17727

SEQ ID NO: 47560 - DNA, 795 bp, Bacteroides thetaiotaomicron; identical to SEQ ID NO: 17728
  CDS (1)..(795): transl_table=11

SEQ ID NO: 47561 - protein, 264 aa, Bacteroides thetaiotaomicron; identical to SEQ ID NO: 17729

SEQ ID NO: 47562 - DNA, 795 bp, Bartonella henselae; identical to SEQ ID NO: 17730
  CDS (1)..(795): transl_table=11

SEQ ID NO: 47563 - protein, 264 aa, Bartonella henselae; identical to SEQ ID NO: 17731

SEQ ID NO: 47564 - DNA, 795 bp, Bartonella quintana; identical to SEQ ID NO: 17732
  CDS (1)..(795): transl_table=11

SEQ ID NO: 47565 - protein, 264 aa, Bartonella quintana; identical to SEQ ID NO: 17733

SEQ ID NO: 47566 - DNA, 795 bp, Bdellovibrio bacteriovorus; identical to SEQ ID NO: 17734
  CDS (1)..(795): transl_table=11

SEQ ID NO: 47567 - protein, 264 aa, Bdellovibrio bacteriovorus; identical to SEQ ID NO: 17735

SEQ ID NO: 47568 - DNA, 801 bp, Bifidobacterium longum; identical to SEQ ID NO: 17736
  CDS (1)..(801): transl_table=11

SEQ ID NO: 47569 - protein, 266 aa, Bifidobacterium longum; identical to SEQ ID NO: 17737

SEQ ID NO: 47570 - DNA, 972 bp, Bordetella pertussis; identical to SEQ ID NO: 17738
  CDS (1)..(972): transl_table=11

SEQ ID NO: 47571 - protein, 323 aa, Bordetella pertussis; identical to SEQ ID NO: 17739

SEQ ID NO: 47572 - DNA, 840 bp, Bacteriophage phi; identical to SEQ ID NO: 17740
  CDS (1)..(840): transl_table=11

SEQ ID NO: 47573 - protein, 279 aa, Bacteriophage phi; identical to SEQ ID NO: 17741

SEQ ID NO: 47574 - DNA, 861 bp, Bacteriophage T4; identical to SEQ ID NO: 17742
  CDS (1)..(861): transl_table=11

SEQ ID NO: 47575 - protein, 286 aa, Bacteriophage T4; identical to SEQ ID NO: 17743

SEQ ID NO: 47576 - DNA, 795 bp, Bradyrhizobium japonicum; identical to SEQ ID NO: 17744
  CDS (1)..(795): transl_table=11

SEQ ID NO: 47577 - protein, 264 aa, Bradyrhizobium japonicum; identical to SEQ ID NO: 17745

SEQ ID NO: 47578 - DNA, 795 bp, Brucella melitensis; identical to SEQ ID NO: 17746
  CDS (1)..(795): transl_table=11

SEQ ID NO: 47579 - protein, 264 aa, Brucella melitensis; identical to SEQ ID NO: 17747

SEQ ID NO: 47580 - DNA, 795 bp, Buchnera aphidicola; identical to SEQ ID NO: 17748
  CDS (1)..(795): transl_table=11

SEQ ID NO: 47581 - protein, 264 aa, Buchnera aphidicola; identical to SEQ ID NO: 17749

SEQ ID NO: 47582 - DNA, 795 bp, Buchnera aphidicola; identical to SEQ ID NO: 17750
  CDS (1)..(795): transl_table=11

SEQ ID NO: 47583 - protein, 264 aa, Buchnera aphidicola; identical to SEQ ID NO: 17751

SEQ ID NO: 47584 - DNA, 795 bp, Buchnera aphidicola; identical to SEQ ID NO: 17752
  CDS (1)..(795): transl_table=11

SEQ ID NO: 47585 - protein, 264 aa, Buchnera aphidicola; identical to SEQ ID NO: 17753

SEQ ID NO: 47586 - DNA, 840 bp, Caulobacter crescentus; identical to SEQ ID NO: 17754
  CDS (1)..(840): transl_table=11

SEQ ID NO: 47587 - protein, 279 aa, Caulobacter crescentus; identical to SEQ ID NO: 17755

SEQ ID NO: 47588 - DNA, 795 bp, Chromobacterium violaceum; identical to SEQ ID NO: 17756
  CDS (1)..(795): transl_table=11

SEQ ID NO: 47589 - protein, 264 aa, Chromobacterium violaceum; identical to SEQ ID NO: 17757

SEQ ID NO: 47590 - DNA, 792 bp, Clostridium acetobutylicum; identical to SEQ ID NO: 17758
  CDS (1)..(792): transl_table=11

SEQ ID NO: 47591 - protein, 263 aa, Clostridium acetobutylicum; identical to SEQ ID NO: 17759

SEQ ID NO: 47592 - DNA, 813 bp, Corynebacterium diphtheriae; identical to SEQ ID NO: 17760
  CDS (1)..(813): transl_table=11

SEQ ID NO: 47593 - protein, 270 aa, Corynebacterium diphtheriae; identical to SEQ ID NO: 17761

SEQ ID NO: 47594 - DNA, 804 bp, Corynebacterium efficiens; identical to SEQ ID NO: 17762
  CDS (1)..(804): transl_table=11

SEQ ID NO: 47595 - protein, 267 aa, Corynebacterium efficiens; identical to SEQ ID NO: 17763

SEQ ID NO: 47596 - DNA, 801 bp, Corynebacterium glutamicum; identical to SEQ ID NO: 17764
  CDS (1)..(801): transl_table=11

SEQ ID NO: 47597 - protein, 266 aa, Corynebacterium glutamicum; identical to SEQ ID NO: 17765

SEQ ID NO: 47598 - DNA, 795 bp, Coxiella burnetii; identical to SEQ ID NO: 17766
  CDS (1)..(795)

SEQ ID NO: 47599 - protein, 264 aa, Coxiella burnetii; identical to SEQ ID NO: 17767

SEQ ID NO: 47600 - DNA, 954 bp, Cryptococcus neoformans; identical to SEQ ID NO: 17768
  CDS (1)..(954)

SEQ ID NO: 47601 - protein, 317 aa, Cryptococcus neoformans; identical to SEQ ID NO: 17769

SEQ ID NO: 47602 - DNA, 966 bp, Drosophila melanogaster; identical to SEQ ID NO: 17770
  CDS (1)..(966)

SEQ ID NO: 47603 - protein, 321 aa, Drosophila melanogaster; identical to SEQ ID NO: 17771

SEQ ID NO: 47604 - DNA, 870 bp, Equine herpesvirus 2; identical to SEQ ID NO: 17772
  CDS (1)..(870)

SEQ ID NO: 47605 - protein, 289 aa, Equine herpesvirus 2; identical to SEQ ID NO: 17773

SEQ ID NO: 47606 - DNA, 948 bp, Enterococcus faecalis; identical to SEQ ID NO: 17774
  CDS (1)..(948): transl_table=11

SEQ ID NO: 47607 - protein, 315 aa, Enterococcus faecalis; identical to SEQ ID NO: 17775

SEQ ID NO: 47608 - DNA, 795 bp, Erwinia carotovora; identical to SEQ ID NO: 17776
  CDS (1)..(795): transl_table=11

SEQ ID NO: 47609 - protein, 264 aa, Erwinia carotovora; identical to SEQ ID NO: 17777

SEQ ID NO: 47610 - DNA, 825 bp, Francisella tularensis; identical to SEQ ID NO: 17778
  CDS (1)..(825): transl_table=11

SEQ ID NO: 47611 - protein, 274 aa, Francisella tularensis; identical to SEQ ID NO: 17779

SEQ ID NO: 47612 - DNA, 828 bp, Fusobacterium nucleatum; identical to SEQ ID NO: 17780
  CDS (1)..(828): transl_table=11

SEQ ID NO: 47613 - protein, 275 aa, Fusobacterium nucleatum; identical to SEQ ID NO: 17781

SEQ ID NO: 47614 - DNA, 795 bp, Geobacillus kaustophilus; identical to SEQ ID NO: 17782
  CDS (1)..(795): transl_table=11

SEQ ID NO: 47615 - protein, 264 aa, Geobacillus kaustophilus; identical to SEQ ID NO: 17783

SEQ ID NO: 47616 - DNA, 852 bp, Haemophilus ducreyi; identical to SEQ ID NO: 17784
  CDS (1)..(852): transl_table=11

SEQ ID NO: 47617 - protein, 283 aa, Haemophilus ducreyi; identical to SEQ ID NO: 17785

SEQ ID NO: 47618 - DNA, 852 bp, Haemophilus influenzae; identical to SEQ ID NO: 17786
  CDS (1)..(852): transl_table=11

SEQ ID NO: 47619 - protein, 283 aa, Haemophilus influenzae; identical to SEQ ID NO: 17787

SEQ ID NO: 47620 - DNA, 1014 bp, Human herpesvirus 8; identical to SEQ ID NO: 17788
  CDS (1)..(1014)

SEQ ID NO: 47621 - protein, 337 aa, Human herpesvirus 8; identical to SEQ ID NO: 17789

SEQ ID NO: 47622 - DNA, 852 bp, Idiomarina loihiensis; identical to SEQ ID NO: 17790
  CDS (1)..(852): transl_table=11

SEQ ID NO: 47623 - protein, 283 aa, Idiomarina loihiensis; identical to SEQ ID NO: 17791

SEQ ID NO: 47624 - DNA, 957 bp, Lactobacillus acidophilus; identical to SEQ ID NO: 17792
  CDS (1)..(957): transl_table=11

SEQ ID NO: 47625 - protein, 318 aa, Lactobacillus acidophilus; identical to SEQ ID NO: 17793

SEQ ID NO: 47626 - DNA, 971 bp, Lactobacillus casei; identical to SEQ ID NO: 17794
  CDS (20)..(970)

SEQ ID NO: 47627 - protein, 316 aa, Lactobacillus casei; identical to SEQ ID NO: 17795

SEQ ID NO: 47628 - DNA, 957 bp, Lactobacillus johnsonii; identical to SEQ ID NO: 17796
  CDS (1)..(957): transl_table=11

SEQ ID NO: 47629 - protein, 318 aa, Lactobacillus johnsonii; identical to SEQ ID NO: 17797

SEQ ID NO: 47630 - DNA, 840 bp, Lactococcus lactis; identical to SEQ ID NO: 17798
  CDS (1)..(840): transl_table=11

SEQ ID NO: 47631 - protein, 279 aa, Lactococcus lactis; identical to SEQ ID NO: 17799

SEQ ID NO: 47632 - DNA, 951 bp, Lactobacillus plantarum; identical to SEQ ID NO: 17800
  CDS (1)..(951): transl_table=11

SEQ ID NO: 47633 - protein, 316 aa, Lactobacillus plantarum; identical to SEQ ID NO: 17801

SEQ ID NO: 47634 - DNA, 795 bp, Legionella pneumophila; identical to SEQ ID NO: 17802
  CDS (1)..(795): transl_table=11

SEQ ID NO: 47635 - protein, 264 aa, Legionella pneumophila; identical to SEQ ID NO: 17803

SEQ ID NO: 47636 - DNA, 795 bp, Legionella pneumophila subsp; identical to SEQ ID NO: 17804
  CDS (1)..(795): transl_table=11

SEQ ID NO: 47637 - protein, 264 aa, Legionella pneumophila subsp; identical to SEQ ID NO: 17805

SEQ ID NO: 47638 - DNA, 810 bp, Leifsonia xyli; identical to SEQ ID NO: 17806
  CDS (1)..(810): transl_table=11

SEQ ID NO: 47639 - protein, 269 aa, Leifsonia xyli; identical to SEQ ID NO: 17807

SEQ ID NO: 47640 - DNA, 945 bp, Listeria monocytogenes; identical to SEQ ID NO: 17808
  CDS (1)..(945): transl_table=11

SEQ ID NO: 47641 - protein, 314 aa, Listeria monocytogenes; identical to SEQ ID NO: 17809

SEQ ID NO: 47642 - DNA, 852 bp, Mannheimia succiniciproducens; identical to SEQ ID NO: 17810
  CDS (1)..(852): transl_table=11

SEQ ID NO: 47643 - protein, 283 aa, Mannheimia succiniciproducens; identical to SEQ ID NO: 17811

SEQ ID NO: 47644 - DNA, 867 bp, Mesoplasma florum; identical to SEQ ID NO: 17812
  CDS (1)..(867): transl_table=4

SEQ ID NO: 47645 - protein, 288 aa, Mesoplasma florum; identical to SEQ ID NO: 17813

SEQ ID NO: 47646 - DNA, 783 bp, Methylococcus capsulatus; identical to SEQ ID NO: 17814
  CDS (1)..(783): transl_table=11

SEQ ID NO: 47647 - protein, 260 aa, Methylococcus capsulatus; identical to SEQ ID NO: 17815

SEQ ID NO: 47648 - DNA, 795 bp, Methylobacillus flagellatum; identical to SEQ ID NO: 17816
  CDS (1)..(795): transl_table=11

SEQ ID NO: 47649 - protein, 264 aa, Methylobacillus flagellatum; identical to SEQ ID NO: 17817

SEQ ID NO: 47650 - DNA, 924 bp, Mus musculus; identical to SEQ ID NO: 17818
  CDS (1)..(924)

SEQ ID NO: 47651 - protein, 307 aa, Mus musculus; identical to SEQ ID NO: 17819

SEQ ID NO: 47652 - DNA, 792 bp, Mycobacterium bovis; identical to SEQ ID NO: 17820
  CDS (1)..(792): transl_table=11

SEQ ID NO: 47653 - protein, 263 aa, Mycobacterium bovis; identical to SEQ ID NO: 17821

SEQ ID NO: 47654 - DNA, 870 bp, Mycoplasma gallisepticum; identical to SEQ ID NO: 17822
  CDS (1)..(870): transl_table=4

SEQ ID NO: 47655 - protein, 289 aa, Mycoplasma gallisepticum; identical to SEQ ID NO: 17823

SEQ ID NO: 47656 - DNA, 864 bp, Mycoplasma genitalium; identical to SEQ ID NO: 17824
  CDS (1)..(864): transl_table=4

SEQ ID NO: 47657 - protein, 287 aa, Mycoplasma genitalium; identical to SEQ ID NO: 17825

SEQ ID NO: 47658 - DNA, 801 bp, Mycobacterium leprae; identical to SEQ ID NO: 17826
  CDS (1)..(801): transl_table=11

SEQ ID NO: 47659 - protein, 266 aa, Mycobacterium leprae; identical to SEQ ID NO: 17827

SEQ ID NO: 47660 - DNA, 867 bp, Mycoplasma mobile; identical to SEQ ID NO: 17828
  CDS (1)..(867): transl_table=4

SEQ ID NO: 47661 - protein, 288 aa, Mycoplasma mobile; identical to SEQ ID NO: 17829

SEQ ID NO: 47662 - DNA, 801 bp, Mycobacterium paratuberculosis; identical to SEQ ID NO: 17830
  CDS (1)..(801): transl_table=11

SEQ ID NO: 47663 - protein, 266 aa, Mycobacterium paratuberculosis; identical to SEQ ID NO: 17831

SEQ ID NO: 47664 - DNA, 870 bp, Mycoplasma penetrans; identical to SEQ ID NO: 17832
  CDS (1)..(870): transl_table=4

SEQ ID NO: 47665 - protein, 289 aa, Mycoplasma penetrans; identical to SEQ ID NO: 17833

SEQ ID NO: 47666 - DNA, 861 bp, Mycoplasma pulmonis; identical to SEQ ID NO: 17836
  CDS (1)..(861): transl_table=4

SEQ ID NO: 47667 - protein, 286 aa, Mycoplasma pulmonis; identical to SEQ ID NO: 17837

SEQ ID NO: 47668 - DNA, 1422 bp, Neisseria gonorrhoeae; identical to SEQ ID NO: 17838
  CDS (446)..(1243)

SEQ ID NO: 47669 - protein, 265 aa, Neisseria gonorrhoeae; identical to SEQ ID NO: 17839

SEQ ID NO: 47670 - DNA, 795 bp, Neisseria meningitidis; identical to SEQ ID NO: 17840
  CDS (1)..(795): transl_table=11

SEQ ID NO: 47671 - protein, 264 aa, Neisseria meningitidis; identical to SEQ ID NO: 17841

SEQ ID NO: 47672 - DNA, 795 bp, Nitrosomonas europaea; identical to SEQ ID NO: 17842
  CDS (1)..(795): transl_table=11

SEQ ID NO: 47673 - protein, 264 aa, Nitrosomonas europaea; identical to SEQ ID NO: 17843

SEQ ID NO: 47674 - DNA, 801 bp, Nocardia farcinica; identical to SEQ ID NO: 17844
  CDS (1)..(801): transl_table=11

SEQ ID NO: 47675 - protein, 266 aa, Nocardia farcinica; identical to SEQ ID NO: 17845

SEQ ID NO: 47676 - DNA, 954 bp, Oceanobacillus iheyensis; identical to SEQ ID NO: 17846
  CDS (1)..(954): transl_table=11

SEQ ID NO: 47677 - protein, 317 aa, Oceanobacillus iheyensis; identical to SEQ ID NO: 17847

SEQ ID NO: 47678 - DNA, 867 bp, Onion yellows phytoplasma; identical to SEQ ID NO: 17848
  CDS (1)..(867): transl_table=11

SEQ ID NO: 47679 - protein, 288 aa, Onion yellows phytoplasma; identical to SEQ ID NO: 17849

SEQ ID NO: 47680 - DNA, 852 bp, Pasteurella multocida; identical to SEQ ID NO: 17850
  CDS (1)..(852): transl_table=11

SEQ ID NO: 47681 - protein, 283 aa, Pasteurella multocida; identical to SEQ ID NO: 17851

SEQ ID NO: 47682 - DNA, 795 bp, Photorhabdus luminescens; identical to SEQ ID NO: 17852
  CDS (1)..(795): transl_table=11

SEQ ID NO: 47683 - protein, 264 aa, Photorhabdus luminescens; identical to SEQ ID NO: 17853

SEQ ID NO: 47684 - DNA, 852 bp, Photobacterium profundum; identical to SEQ ID NO: 17854
  CDS (1)..(852): transl_table=11

SEQ ID NO: 47685 - protein, 283 aa, Photobacterium profundum; identical to SEQ ID NO: 17855

SEQ ID NO: 47686 - DNA, 795 bp, Porphyromonas gingivalis; identical to SEQ ID NO: 17856
  CDS (1)..(795)

SEQ ID NO: 47687 - protein, 264 aa, Porphyromonas gingivalis; identical to SEQ ID NO: 17857

SEQ ID NO: 47688 - DNA, 810 bp, Propionibacterium acnes; identical to SEQ ID NO: 17858
  CDS (1)..(810): transl_table=11

SEQ ID NO: 47689 - protein, 269 aa, Propionibacterium acnes; identical to SEQ ID NO: 17859

SEQ ID NO: 47690 - DNA, 795 bp, Pseudomonas aeruginosa; identical to SEQ ID NO: 17860
  CDS (1)..(795): transl_table=11

SEQ ID NO: 47691 - protein, 264 aa, Pseudomonas aeruginosa; identical to SEQ ID NO: 17861

SEQ ID NO: 47692 - DNA, 972 bp, Pseudomonas syringae; identical to SEQ ID NO: 17862
  CDS (1)..(972): transl_table=11

SEQ ID NO: 47693 - protein, 323 aa, Pseudomonas syringae; identical to SEQ ID NO: 17863

SEQ ID NO: 47694 - DNA, 795 bp, Ralstonia solanacearum; identical to SEQ ID NO: 17864
  CDS (1)..(795): transl_table=11

SEQ ID NO: 47695 - protein, 264 aa, Ralstonia solanacearum; identical to SEQ ID NO: 17865

SEQ ID NO: 47696 - DNA, 924 bp, Rattus norvegicus; identical to SEQ ID NO: 17866
  CDS (1)..(924)

SEQ ID NO: 47697 - protein, 307 aa, Rattus norvegicus; identical to SEQ ID NO: 17867

SEQ ID NO: 47698 - DNA, 795 bp, Rhizobium loti; identical to SEQ ID NO: 17868
  CDS (1)..(795): transl_table=11

SEQ ID NO: 47699 - protein, 264 aa, Rhizobium loti; identical to SEQ ID NO: 17869

SEQ ID NO: 47700 - DNA, 795 bp, Rhizobium meliloti; identical to SEQ ID NO: 17870
  CDS (1)..(795): transl_table=11

SEQ ID NO: 47701 - protein, 264 aa, Rhizobium meliloti; identical to SEQ ID NO: 17871

SEQ ID NO: 47702 - DNA, 795 bp, Rhodopirellula baltica; identical to SEQ ID NO: 17872
  CDS (1)..(795): transl_table=11

SEQ ID NO: 47703 - protein, 264 aa, Rhodopirellula baltica; identical to SEQ ID NO: 17873

SEQ ID NO: 47704 - DNA, 795 bp, Rhodopseudomonas palustris; identical to SEQ ID NO: 17874
  CDS (1)..(795): transl_table=11

SEQ ID NO: 47705 - protein, 264 aa, Rhodopseudomonas palustris; identical to SEQ ID NO: 17875

SEQ ID NO: 47706 - DNA, 795 bp, Salmonella paratyphi; identical to SEQ ID NO: 17876
  CDS (1)..(795): transl_table=11

SEQ ID NO: 47707 - protein, 264 aa, Salmonella paratyphi; identical to SEQ ID NO: 17877

SEQ ID NO: 47708 - DNA, 795 bp, Salmonella typhi; identical to SEQ ID NO: 17878
  CDS (1)..(795): transl_table=11

SEQ ID NO: 47709 - protein, 264 aa, Salmonella typhi; identical to SEQ ID NO: 17879

SEQ ID NO: 47710 - DNA, 795 bp, Shewanella oneidensis; identical to SEQ ID NO: 17880
  CDS (1)..(795): transl_table=11

SEQ ID NO: 47711 - protein, 264 aa, Shewanella oneidensis; identical to SEQ ID NO: 17881

SEQ ID NO: 47712 - DNA, 885 bp, Saimiriine herpesvirus 2; identical to SEQ ID NO: 17882
  CDS (1)..(885)

SEQ ID NO: 47713 - protein, 294 aa, Saimiriine herpesvirus 2; identical to SEQ ID NO: 17883

SEQ ID NO: 47714 - DNA, 957 bp, Staphylococcus aureus; identical to SEQ ID NO: 17884
  CDS (1)..(957): transl_table=11

SEQ ID NO: 47715 - protein, 318 aa, Staphylococcus aureus; identical to SEQ ID NO: 17885

SEQ ID NO: 47716 - DNA, 840 bp, Streptococcus agalactiae; identical to SEQ ID NO: 17886
  CDS (1)..(840): transl_table=11

SEQ ID NO: 47717 - protein, 279 aa, Streptococcus agalactiae; identical to SEQ ID NO: 17887

SEQ ID NO: 47718 - DNA, 840 bp, Streptococcus agalactiae; identical to SEQ ID NO: 17888
  CDS (1)..(840): transl_table=11

SEQ ID NO: 47719 - protein, 279 aa, Streptococcus agalactiae; identical to SEQ ID NO: 17889

SEQ ID NO: 47720 - DNA, 840 bp, Streptococcus mutans; identical to SEQ ID NO: 17890
  CDS (1)..(840): transl_table=11

SEQ ID NO: 47721 - protein, 279 aa, Streptococcus mutans; identical to SEQ ID NO: 17891

SEQ ID NO: 47722 - DNA, 840 bp, Streptococcus pyogenes; identical to SEQ ID NO: 17892
  CDS (1)..(840): transl_table=11

SEQ ID NO: 47723 - protein, 279 aa, Streptococcus pyogenes; identical to SEQ ID NO: 17893

SEQ ID NO: 47724 - DNA, 840 bp, Streptococcus pyogenes; identical to SEQ ID NO: 17894
  CDS (1)..(840)

SEQ ID NO: 47725 - protein, 279 aa, Streptococcus pyogenes; identical to SEQ ID NO: 17895

SEQ ID NO: 47726 - DNA, 840 bp, Streptococcus pneumoniae; identical to SEQ ID NO: 17896
  CDS (1)..(840): transl_table=11

SEQ ID NO: 47727 - protein, 279 aa, Streptococcus pneumoniae; identical to SEQ ID NO: 17897

SEQ ID NO: 47728 - DNA, 861 bp, Streptococcus thermophilus; identical to SEQ ID NO: 17898
  CDS (1)..(861): transl_table=11

SEQ ID NO: 47729 - protein, 286 aa, Streptococcus thermophilus; identical to SEQ ID NO: 17899

SEQ ID NO: 47730 - DNA, 861 bp, Streptococcus thermophilus; identical to SEQ ID NO: 17900
  CDS (1)..(861): transl_table=11

SEQ ID NO: 47731 - protein, 286 aa, Streptococcus thermophilus; identical to SEQ ID NO: 17901

SEQ ID NO: 47732 - DNA, 852 bp, Symbiobacterium thermophilum; identical to SEQ ID NO: 17902
  CDS (1)..(852): transl_table=11

SEQ ID NO: 47733 - protein, 283 aa, Symbiobacterium thermophilum; identical to SEQ ID NO: 17903

SEQ ID NO: 47734 - DNA, 852 bp, Vibrio cholerae; identical to SEQ ID NO: 17904
  CDS (1)..(852): transl_table=11

SEQ ID NO: 47735 - protein, 283 aa, Vibrio cholerae; identical to SEQ ID NO: 17905

SEQ ID NO: 47736 - DNA, 852 bp, Vibrio fischeri; identical to SEQ ID NO: 17906
  CDS (1)..(852)

SEQ ID NO: 47737 - protein, 283 aa, Vibrio fischeri; identical to SEQ ID NO: 17907

SEQ ID NO: 47738 - DNA, 852 bp, Vibrio parahaemolyticus; identical to SEQ ID NO: 17908
  CDS (1)..(852): transl_table=11

SEQ ID NO: 47739 - protein, 283 aa, Vibrio parahaemolyticus; identical to SEQ ID NO: 17909

SEQ ID NO: 47740 - DNA, 852 bp, Vibrio vulnificus; identical to SEQ ID NO: 17910
  CDS (1)..(852): transl_table=11

SEQ ID NO: 47741 - protein, 283 aa, Vibrio vulnificus; identical to SEQ ID NO: 17911

SEQ ID NO: 47742 - DNA, 852 bp, Vibrio vulnificus; identical to SEQ ID NO: 17912
  CDS (1)..(852): transl_table=11

SEQ ID NO: 47743 - protein, 283 aa, Vibrio vulnificus; identical to SEQ ID NO: 17913

SEQ ID NO: 47744 - DNA, 906 bp, Varicella; identical to SEQ ID NO: 17914
  CDS (1)..(906)

SEQ ID NO: 47745 - protein, 301 aa, Varicella; identical to SEQ ID NO: 17915

SEQ ID NO: 47746 - DNA, 795 bp, Wigglesworthia glossinidia brevipalpis; identical to SEQ ID NO: 17916
  CDS (1)..(795): transl_table=11

SEQ ID NO: 47747 - protein, 264 aa, Wigglesworthia glossinidia brevipalpis; identical to SEQ ID NO: 17917

SEQ ID NO: 47748 - DNA, 795 bp, Xanthomonas axonopodis; identical to SEQ ID NO: 17918
  CDS (1)..(795): transl_table=11

SEQ ID NO: 47749 - protein, 264 aa, Xanthomonas axonopodis; identical to SEQ ID NO: 17919

SEQ ID NO: 47750 - DNA, 795 bp, Xanthomonas campestris; identical to SEQ ID NO: 17920
  CDS (1)..(795): transl_table=11

SEQ ID NO: 47751 - protein, 264 aa, Xanthomonas campestris; identical to SEQ ID NO: 17921

SEQ ID NO: 47752 - DNA, 795 bp, Xanthomonas oryzae; identical to SEQ ID NO: 17922
  CDS (1)..(795): transl_table=11

SEQ ID NO: 47753 - protein, 264 aa, Xanthomonas oryzae; identical to SEQ ID NO: 17923

SEQ ID NO: 47754 - DNA, 795 bp, Xenorhabdus nematophilus; identical to SEQ ID NO: 17924
  CDS (1)..(795): transl_table=11

SEQ ID NO: 47755 - protein, 264 aa, Xenorhabdus nematophilus; identical to SEQ ID NO: 17925

SEQ ID NO: 47756 - DNA, 795 bp, Xylella fastidiosa; identical to SEQ ID NO: 17926
  CDS (1)..(795): transl_table=11

SEQ ID NO: 47757 - protein, 264 aa, Xylella fastidiosa; identical to SEQ ID NO: 17927

SEQ ID NO: 47758 - DNA, 795 bp, Xylella fastidiosa; identical to SEQ ID NO: 17928
  CDS (1)..(795): transl_table=11

SEQ ID NO: 47759 - protein, 264 aa, Xylella fastidiosa; identical to SEQ ID NO: 17929

SEQ ID NO: 47760 - DNA, 915 bp, Saccharomyces cerevisiae; identical to SEQ ID NO: 17930
  CDS (1)..(915)

SEQ ID NO: 47761 - protein, 304 aa, Saccharomyces cerevisiae; identical to SEQ ID NO: 17931

SEQ ID NO: 47762 - DNA, 795 bp, Yersinia pestis; identical to SEQ ID NO: 17932
  CDS (1)..(795): transl_table=11

SEQ ID NO: 47763 - protein, 264 aa, Yersinia pestis; identical to SEQ ID NO: 17933

SEQ ID NO: 47764 - DNA, 795 bp, Yersinia pseudotuberculosis; identical to SEQ ID NO: 17934
  CDS (1)..(795): transl_table=11

SEQ ID NO: 47765 - protein, 264 aa, Yersinia pseudotuberculosis; identical to SEQ ID NO: 17935

SEQ ID NO: 47766 - DNA, 24 bp, Artificial sequence
  (1)..(24): primer
atgaaacagtatttagaactgatg

SEQ ID NO: 47767 - DNA, 23 bp, Artificial sequence
  (1)..(23): primer
ttagatagccaccggcgctttaa

SEQ ID NO: 47768 - protein, 579 aa, Artificial sequence; identical to SEQ ID NO: 17938
  Variant (2)..(4): xaa in position 2 to 4 is any amino acid
  Variant (6)..(7): xaa in position 6 to 7 is any amino acid
  Variant (10)..(11): xaa in position 10 to 11 is any amino acid
  Variant (13)..(17): xaa in position 13 to 17 is any amino acid
  Variant (19)..(26): xaa in position 19 to 26 is any or no amino acid
  Variant (29)..(29): xaa in position 29 is any or no amino acid
  Variant (31)..(32): xaa in position 31 to 32 is any amino acid
  Variant (34)..(34): xaa in position 34 is any amino acid
  Variant (37)..(37): xaa in position 37 is any amino acid
  Variant (38)..(41): xaa in position 38 to 41 is any or no amino acid
  Variant (44)..(44): xaa in position 44 is any or no amino acid
  Variant (46)..(141): xaa in position 46 to 141 is any or no amino acid
  Variant (151)..(151): xaa in position 151 is any amino acid
  Variant (152)..(155): xaa in position 152 to 155 is any or no amino acid
  Variant (157)..(158): xaa in position 157 to 158 is any or no amino acid
  Variant (160)..(160): xaa in position 160 is any or no amino acid
  Variant (167)..(167): xaa in position 167 is any amino acid
  Variant (169)..(169): xaa in position 169 is any amino acid
  Variant (171)..(171): xaa in position 171 is any amino acid
  Variant (172)..(175): xaa in position 172 to 175 is any or no amino acid
  Variant (177)..(182): xaa in position 177 to 182 is any amino acid
  Variant (185)..(188): xaa in position 185 to 188 is any amino acid
  Variant (189)..(243): xaa in position 189 to 243 is any or no amino acid
  Variant (246)..(246): xaa in position 246 is any amino acid
  Variant (250)..(250): xaa in position 250 is any amino acid
  Variant (254)..(254): xaa in position 254 is any amino acid
  Variant (256)..(257): xaa in position 256 to 257 is any amino acid
  Variant (258)..(296): xaa in position 258 to 296 is any or no amino acid
  Variant (301)..(302): xaa in position 301 to 302 is any or no amino acid
  Variant (305)..(306): xaa in position 305 to 306 is any amino acid
  Variant (308)..(318): xaa in position 308 to 318 is any or no amino acid
  Variant (320)..(321): xaa in position 320 to 321 is any or no amino acid
  Variant (324)..(324): xaa in position 324 is any or no amino acid
  Variant (327)..(328): xaa in position 327 to 328 is any or no amino acid
  Variant (331)..(331): xaa in position 331 is any amino acid
  Variant (332)..(333): xaa in position 332 to 333 is any or no amino acid
  Variant (335)..(335): xaa in position 335 is any amino acid
  Variant (336)..(349): xaa in position 336 to 349 is any or no amino acid
  Variant (351)..(351): xaa in position 351 is any amino acid
  Variant (353)..(353): xaa in position 353 is any amino acid
  Variant (357)..(359): xaa in position 357 to 359 is any amino acid
  Variant (362)..(362): xaa in position 362 is any amino acid
  Variant (364)..(367): xaa in position 364 to 367 is any amino acid
  Variant (368)..(418): xaa in position 368 to 418 is any or no amino acid
  Variant (420)..(422): xaa in position 420 to 422 is any amino acid
  Variant (428)..(428): xaa in position 428 is any amino acid
  Variant (431)..(431): xaa in position 431 is any amino acid
  Variant (439)..(440): xaa in position 439 to 440 is any amino acid
  Variant (445)..(446): xaa in position 445 to 446 is any amino acid
  Variant (450)..(456): xaa in position 450 to 456 is any amino acid
  Variant (457)..(463): xaa in position 457 to 463 is any or no amino acid
  Variant (465)..(470): xaa in position 465 to 470 is any amino acid
  Variant (472)..(473): xaa in position 472 to 473 is any amino acid
  Variant (477)..(478): xaa in position 477 to 478 is any amino acid
  Variant (480)..(485): xaa in position 480 to 485 is any amino acid
  Variant (486)..(521): xaa in position 486 to 521 is any or no amino acid
  Variant (524)..(524): xaa in position 524 is any amino acid
  Variant (526)..(526): xaa in position 526 is any amino acid
  Variant (528)..(530): xaa in position 528 to 530 is any amino acid
  Variant (532)..(532): xaa in position 532 is any amino acid
  Variant (534)..(534): xaa in position 534 is any amino acid
  Variant (536)..(539): xaa in position 536 to 539 is any amino acid
  Variant (540)..(553): xaa in position 540 to 553 is any or no amino acid
  Variant (555)..(560): xaa in position 555 to 560 is any amino acid
  Variant (562)..(563): xaa in position 562 to 563 is any amino acid
  Variant (565)..(566): xaa in position 565 to 566 is any amino acid
  Variant (568)..(572): xaa in position 568 to 572 is any amino acid
  Variant (574)..(576): xaa in position 574 to 576 is any amino acid

SEQ ID NO: 47769 - protein, 27 aa, Artificial sequence
  Variant (2)..(8): xaa in position 2 to 8 is any amino acid
  Variant (9)..(10): xaa in position 9 to 10 is any or no amino acid
  Variant (12)..(15): xaa in position 12 to 15 is any amino acid
  Variant (16)..(16): xaa in position 16 is Asp or Asn
  Variant (19)..(21): xaa in position 19 to 21 is any amino acid
  Variant (22)..(22): xaa in position 22 is Ala, Cys, Gly, Thr or Val
  Variant (23)..(26): xaa in position 23 to 26 is any amino acid
  Variant (27)..(27): xaa in position 27 is Ala, Asp, Glu, Gly or Ser
LXXXXXXXXXGXXXXXRTXXXXXXXXX

SEQ ID NO: 47770 - protein, 21 aa, Artificial sequence
  Variant (2)..(2): xaa in position 2 is any amino acid
  Variant (3)..(3): xaa in position 3 is Ile, Leu, Met or Val
  Variant (7)..(15): xaa in position 7 to 15 is any amino acid
  Variant (17)..(17): xaa in position 17 is any or no amino acid
  Variant (19)..(20): xaa in position 19 to 20 is any amino acid
  Variant (21)..(21): xaa in position 21 is Phe, Ile, Leu, Met or Val
PXXTTKXXXXXXXXXEXLXXX

SEQ ID NO: 47771 - protein, 37 aa, Artificial sequence; identical to SEQ ID NO: 17941
  Variant (2)..(2): xaa in position 2 is Ile, Leu, Met or Val
  Variant (3)..(5): xaa in position 3 to 5 is any amino acid
  Variant (6)..(6): xaa in position 6 is Ile, Leu or Val
  Variant (7)..(8): xaa in position 7 to 8 is any amino acid
  Variant (9)..(9): xaa in position 9 is Ile, Leu or Val
  Variant (10)..(12): xaa in position 10 to 12 is any amino acid
  Variant (14)..(14): xaa in position 14 is any amino acid
  Variant (15)..(15): xaa in position 15 is Cys, Asp, Gly, Asn or Ser
  Variant (18)..(18): xaa in position 18 is any amino acid
  Variant (19)..(19): xaa in position 19 is Ile, Leu, Met or Val
  Variant (20)..(22): xaa in position 20 to 22 is any amino acid
  Variant (23)..(23): xaa in position 23 is Phe, Trp or Tyr
  Variant (25)..(32): xaa in position 25 to 32 is any amino acid
  Variant (34)..(34): xaa in position 34 is any or no amino acid
  Variant (36)..(36): xaa in position 36 is any or no amino acid

SEQ ID NO: 47772 - protein, 32 aa, Artificial sequence; identical to SEQ ID NO: 17942
  Variant (2)..(3): xaa in position 2 to 3 is any amino acid
  Variant (4)..(6): xaa in position 4 to 6 is any or no amino acid
  Variant (8)..(8): xaa in position 8 is any or no amino acid
  Variant (11)..(11): xaa in position 11 is Ala, Cys, Gly or Val
  Variant (13)..(14): xaa in position 13 to 14 is any amino acid
  Variant (17)..(17): xaa in position 17 is Ile, Leu or Val
  Variant (18)..(18): xaa in position 18 is Asn or Pro
  Variant (21)..(21): xaa in position 21 is any amino acid
  Variant (22)..(22): xaa in position 22 is Ala, Gly, Ile or Val
  Variant (23)..(23): xaa in position 23 is Ala, Gly, Gln or Ser
  Variant (24)..(26): xaa in position 24 to 26 is any amino acid
  Variant (27)..(27): xaa in position 27 is Phe or Leu
  Variant (28)..(29): xaa in position 28 to 29 is any amino acid
  Variant (30)..(30): xaa in position 30 is Ile, Leu, Met or Val
  Variant (31)..(31): xaa in position 31 is any amino acid

SEQ ID NO: 47773 - DNA, 192 bp, Escherichia coli
  CDS (1)..(192)
atggtagtgccagcgatgactggagttaacaccatcatgcgtgaatatccaaatggcgaaaaaacacaccttactgtaatggccgcagggtttccatctctgaccggagatcataaagtcatttatgtagccgcggatcgacatgttacttcagaagaaattctggaagcagcaataaggctcttgagttga

SEQ ID NO: 47774 - protein, 63 aa, Escherichia coli
MVVPAMTGVNTIMREYPNGEKTHLTVMAAGFPSLTGDHKVIYVAADRHVTSEEILEAAIRLLS

SEQ ID NO: 47775 - DNA, 156 bp, Escherichia coli
  CDS (1)..(156)
atgcgtgaatatccaaatggcgaaaaaacacaccttactgtaatggccgcagggtttccatctctgaccggagatcataaagtcatttatgtagccgcggatcgacatgttacttcagaagaaattctggaagcagcaataaggctcttgagttga

SEQ ID NO: 47776 - protein, 51 aa, Escherichia coli
MREYPNGEKTHLTVMAAGFPSLTGDHKVIYVAADRHVTSEEILEAAIRLLS

SEQ ID NO: 47777 - DNA, 23 bp, Artificial sequence
  (1)..(23): primer
atggtagtgccagcgatgactgg

SEQ ID NO: 47778 - DNA, 26 bp, Artificial sequence
  (1)..(26): primer
ttaactcaagagccttattgctgctt

SEQ ID NO: 47779 - protein, 51 aa, Artificial sequence; identical to SEQ ID NO: 47776
  (1)..(51): protein

SEQ ID NO: 47780 - protein, 51 aa, Artificial sequence; identical to SEQ ID NO: 47776
  (1)..(51): protein

SEQ ID NO: 47781 - DNA, 291 bp, Escherichia coli K12; identical to SEQ ID NO: 18608
  CDS (1)..(291): transl_table=11

SEQ ID NO: 47782 - protein, 96 aa, Escherichia coli K12; identical to SEQ ID NO: 18609

SEQ ID NO: 47783 - DNA, 216 bp, Bacteriophage 933W; identical to SEQ ID NO: 18610
  CDS (1)..(216): transl_table=11

SEQ ID NO: 47784 - protein, 71 aa, Bacteriophage 933W; identical to SEQ ID NO: 18611

SEQ ID NO: 47785 - DNA, 291 bp, Bacteriophage VT2-Sa; identical to SEQ ID NO: 18612
  CDS (1)..(291): transl_table=11

SEQ ID NO: 47786 - protein, 96 aa, Bacteriophage VT2-Sa; identical to SEQ ID NO: 18613

SEQ ID NO: 47787 - DNA, 315 bp, Escherichia coli O157:H7 EDL933; identical to SEQ ID NO: 18614
  CDS (1)..(315): transl_table=11

SEQ ID NO: 47788 - protein, 104 aa, Escherichia coli O157:H7 EDL933; identical to SEQ ID NO: 18615

SEQ ID NO: 47789 - DNA, 315 bp, Escherichia coli O157:H7 EDL933; identical to SEQ ID NO: 18616
  CDS (1)..(315): transl_table=11

SEQ ID NO: 47790 - protein, 104 aa, Escherichia coli O157:H7 EDL933; identical to SEQ ID NO: 18617

SEQ ID NO: 47791 - DNA, 273 bp, Escherichia coli O157:H7 EDL933; identical to SEQ ID NO: 18618
  CDS (1)..(273): transl_table=11

SEQ ID NO: 47792 - protein, 90 aa, Escherichia coli O157:H7 EDL933; identical to SEQ ID NO: 18619

SEQ ID NO: 47793 - DNA, 216 bp, Escherichia coli O157:H7; identical to SEQ ID NO: 18620
  CDS (1)..(216): transl_table=11

SEQ ID NO: 47794 - protein, 71 aa, Escherichia coli O157:H7; identical to SEQ ID NO: 18621

SEQ ID NO: 47795 - DNA, 207 bp, Escherichia coli O157:H7; identical to SEQ ID NO: 18622
  CDS (1)..(207): transl_table=11

SEQ ID NO: 47796 - protein, 68 aa, Escherichia coli O157:H7; identical to SEQ ID NO: 18623

SEQ ID NO: 47797 - DNA, 216 bp, Escherichia coli O157:H7; identical to SEQ ID NO: 18624
  CDS (1)..(216): transl_table=11

SEQ ID NO: 47798 - protein, 71 aa, Escherichia coli O157:H7; identical to SEQ ID NO: 18625

SEQ ID NO: 47799 - DNA, 216 bp, Escherichia coli O157:H7; identical to SEQ ID NO: 18626
  CDS (1)..(216): transl_table=11

SEQ ID NO: 47800 - protein, 71 aa, Escherichia coli O157:H7; identical to SEQ ID NO: 18627

SEQ ID NO: 47801 - DNA, 216 bp, Escherichia coli O157:H7; identical to SEQ ID NO: 18628
  CDS (1)..(216): transl_table=11

SEQ ID NO: 47802 - protein, 71 aa, Escherichia coli O157:H7; identical to SEQ ID NO: 18629

SEQ ID NO: 47803 - DNA, 207 bp, Escherichia coli O157:H7; identical to SEQ ID NO: 18630
  CDS (1)..(207): transl_table=11

SEQ ID NO: 47804 - protein, 68 aa, Escherichia coli O157:H7; identical to SEQ ID NO: 18631

SEQ ID NO: 47805 - DNA, 207 bp, Escherichia coli O157:H7; identical to SEQ ID NO: 18632
  CDS (1)..(207): transl_table=11

SEQ ID NO: 47806 - protein, 68 aa, Escherichia coli O157:H7; identical to SEQ ID NO: 18633

SEQ ID NO: 47807 - DNA, 216 bp, Shigella flexneri 2a str. 301; identical to SEQ ID NO: 18634
  CDS (1)..(216): transl_table=11

SEQ ID NO: 47808 - protein, 71 aa, Shigella flexneri 2a str. 301; identical to SEQ ID NO: 18635

SEQ ID NO: 47809 - DNA, 216 bp, Shigella flexneri 2a str. 301; identical to SEQ ID NO: 18636
  CDS (1)..(216): transl_table=11

SEQ ID NO: 47810 - protein, 71 aa, Shigella flexneri 2a str. 301; identical to SEQ ID NO: 18637

SEQ ID NO: 47811 - DNA, 321 bp, Escherichia coli CFT073; identical to SEQ ID NO: 18638
  CDS (1)..(321): transl_table=11

SEQ ID NO: 47812 - protein, 106 aa, Escherichia coli CFT073; identical to SEQ ID NO: 18639

SEQ ID NO: 47813 - DNA, 216 bp, Escherichia coli CFT073; identical to SEQ ID NO: 18640
  CDS (1)..(216): transl_table=11

SEQ ID NO: 47814 - protein, 71 aa, Escherichia coli CFT073; identical to SEQ ID NO: 18641

SEQ ID NO: 47815 - DNA, 216 bp, Shigella flexneri 2a str. 2457T; identical to SEQ ID NO: 18642
  CDS (1)..(216): transl_table=11

SEQ ID NO: 47816 - protein, 71 aa, Shigella flexneri 2a str. 2457T; identical to SEQ ID NO: 18643

SEQ ID NO: 47817 - DNA, 180 bp, Shigella flexneri 2a str. 2457T; identical to SEQ ID NO: 18644
  CDS (1)..(180): transl_table=11

SEQ ID NO: 47818 - protein, 59 aa, Shigella flexneri 2a str. 2457T; identical to SEQ ID NO: 18645

SEQ ID NO: 47819 - DNA, 213 bp, Yersinia pseudotuberculosis IP 32953; identical to SEQ ID NO: 18646
  CDS (1)..(213): transl_table=11

SEQ ID NO: 47820 - protein, 70 aa, Yersinia pseudotuberculosis IP 32953; identical to SEQ ID NO: 18647

SEQ ID NO: 47821 - DNA, 216 bp, Shigella sonnei Ss046; identical to SEQ ID NO: 18648
  CDS (1)..(216): transl_table=11

SEQ ID NO: 47822 - protein, 71 aa, Shigella sonnei Ss046; identical to SEQ ID NO: 18649

SEQ ID NO: 47823 - DNA, 216 bp, Shigella sonnei Ss046; identical to SEQ ID NO: 18650
  CDS (1)..(216): transl_table=11

SEQ ID NO: 47824 - protein, 71 aa, Shigella sonnei Ss046; identical to SEQ ID NO: 18651

SEQ ID NO: 47825 - DNA, 207 bp, Bacteriophage H19B; identical to SEQ ID NO: 18652
  CDS (1)..(207): transl_table=11

SEQ ID NO: 47826 - protein, 68 aa, Bacteriophage H19B; identical to SEQ ID NO: 18653

SEQ ID NO: 47827 - DNA, 291 bp, Stx1; identical to SEQ ID NO: 18654
  CDS (1)..(291): transl_table=11

SEQ ID NO: 47828 - protein, 96 aa, Stx1; identical to SEQ ID NO: 18655

SEQ ID NO: 47829 - DNA, 150 bp, Escherichia coli; identical to SEQ ID NO: 18656
  CDS (1)..(150): transl_table=11

SEQ ID NO: 47830 - protein, 49 aa, Escherichia coli; identical to SEQ ID NO: 18657

SEQ ID NO: 47831 - DNA, 216 bp, Escherichia coli; identical to SEQ ID NO: 18658
  CDS (1)..(216): transl_table=11

SEQ ID NO: 47832 - protein, 71 aa, Escherichia coli; identical to SEQ ID NO: 18659

SEQ ID NO: 47833 - DNA, 216 bp, Shigella dysenteriae; identical to SEQ ID NO: 18660
  CDS (1)..(216): transl_table=11

SEQ ID NO: 47834 - protein, 71 aa, Shigella dysenteriae; identical to SEQ ID NO: 18661

SEQ ID NO: 47835 - DNA, 216 bp, Escherichia coli O6; identical to SEQ ID NO: 18662
  CDS (1)..(216): transl_table=11

SEQ ID NO: 47836 - protein, 71 aa, Escherichia coli O6; identical to SEQ ID NO: 18663

SEQ ID NO: 47837 - DNA, 216 bp, Bacteriophage P21; identical to SEQ ID NO: 18664
  CDS (1)..(216): transl_table=11

SEQ ID NO: 47838 - protein, 71 aa, Bacteriophage P21; identical to SEQ ID NO: 18665

SEQ ID NO: 47839 - DNA, 24 bp, Artificial sequence
  (1)..(24): primer
atgctgtcaaaactaccccgtaga

SEQ ID NO: 47840 - DNA, 23 bp, Artificial sequence
  (1)..(23): primer
ttactctcctctcgcagccttac

SEQ ID NO: 47841 - protein, 71 aa, Artificial sequence; identical to SEQ ID NO: 18668
  Variant (2)..(3): xaa in position 2 to 3 is any amino acid
  Variant (14)..(14): xaa in position 14 is any amino acid
  Variant (18)..(20): xaa in position 18 to 20 is any amino acid
  Variant (24)..(24): xaa in position 24 is any amino acid
  Variant (27)..(27): xaa in position 27 is any amino acid
  Variant (30)..(30): xaa in position 30 is any amino acid
  Variant (37)..(37): xaa in position 37 is any amino acid
  Variant (47)..(47): xaa in position 47 is any amino acid
  Variant (49)..(49): xaa in position 49 is any amino acid
  Variant (67)..(67): xaa in position 67 is any amino acid

SEQ ID NO: 47842 - protein, 10 aa, Artificial sequence
  Variant (2)..(2): xaa in position 2 is Asp or Glu
  Variant (5)..(5): xaa in position 5 is Ser or Thr
  Variant (7)..(7): xaa in position 7 is Gly or Ser
  Variant (8)..(8): xaa in position 8 is Ile or Val
  Variant (9)..(9): xaa in position 9 is Ala or Ser
MXKIXTXXXY

SEQ ID NO: 47843 - protein, 6 aa, Artificial sequence
  Variant (2)..(2): xaa in position 2 is Phe or Leu
  Variant (5)..(5): xaa in position 5 is any amino acid
WXLQXL

SEQ ID NO: 47844 - protein, 14 aa, Artificial sequence
  Variant (5)..(5): xaa in position 5 is any or no amino acid
  Variant (7)..(7): xaa in position 7 is any or no amino acid
PSQWXAXIGVLGSL

SEQ ID NO: 47845 - DNA, 1047 bp, Escherichia coli K12; identical to SEQ ID NO: 1323
  CDS (1)..(1047)

SEQ ID NO: 47846 - protein, 348 aa, Escherichia coli K12; identical to SEQ ID NO: 1324

SEQ ID NO: 47847 - DNA, 1235 bp, Salmonella typhimurium; identical to SEQ ID NO: 1325
  CDS (165)..(1235)

SEQ ID NO: 47848 - protein, 356 aa, Salmonella typhimurium; identical to SEQ ID NO: 1326

SEQ ID NO: 47849 - DNA, 1086 bp, Deinococcus radiodurans; identical to SEQ ID NO: 1327
  CDS (1)..(1086)

SEQ ID NO: 47850 - protein, 361 aa, Deinococcus radiodurans; identical to SEQ ID NO: 1328

SEQ ID NO: 47851 - DNA, 1056 bp, Neisseria meningitidis; identical to SEQ ID NO: 1329
  CDS (1)..(1056)

SEQ ID NO: 47852 - protein, 351 aa, Neisseria meningitidis; identical to SEQ ID NO: 1330

SEQ ID NO: 47853 - DNA, 1047 bp, Yersinia pestis; identical to SEQ ID NO: 1331
  CDS (1)..(1047)

SEQ ID NO: 47854 - protein, 348 aa, Yersinia pestis; identical to SEQ ID NO: 1332

SEQ ID NO: 47855 - DNA, 1071 bp, Escherichia coli; identical to SEQ ID NO: 1333
  CDS (1)..(1071)

SEQ ID NO: 47856 - protein, 356 aa, Escherichia coli; identical to SEQ ID NO: 1334

SEQ ID NO: 47857 - DNA, 1131 bp, Nostoc sp. PCC 7120; identical to SEQ ID NO: 1335
  CDS (1)..(1131)

SEQ ID NO: 47858 - protein, 376 aa, Nostoc sp. PCC 7120; identical to SEQ ID NO: 1336

SEQ ID NO: 47859 - DNA, 1053 bp, Salmonella enterica subsp. enterica serovar Typhi; identical to SEQ ID NO: 1337
  CDS (1)..(1053)

SEQ ID NO: 47860 - protein, 350 aa, Salmonella enterica subsp. enterica serovar Typhi; identical to SEQ ID NO: 1338

SEQ ID NO: 47861 - DNA, 1077 bp, Pseudomonas aeruginosa; identical to SEQ ID NO: 1339
  CDS (1)..(1077)

SEQ ID NO: 47862 - protein, 358 aa, Pseudomonas aeruginosa; identical to SEQ ID NO: 1340

SEQ ID NO: 47863 - DNA, 1047 bp, Buchnera sp; identical to SEQ ID NO: 1341
  CDS (1)..(1047)

SEQ ID NO: 47864 - protein, 348 aa, Buchnera sp; identical to SEQ ID NO: 1342

SEQ ID NO: 47865 - DNA, 1074 bp, Vibrio cholerae; identical to SEQ ID NO: 1343
  CDS (1)..(1074)

SEQ ID NO: 47866 - protein, 357 aa, Vibrio cholerae; identical to SEQ ID NO: 1344

SEQ ID NO: 47867 - DNA, 1038 bp, Lactococcus lactis subsp. lactis; identical to SEQ ID NO: 1345
  CDS (1)..(1038)

SEQ ID NO: 47868 - protein, 345 aa, Lactococcus lactis subsp. lactis; identical to SEQ ID NO: 1346

SEQ ID NO: 47869 - DNA, 1023 bp, Lactococcus lactis subsp. lactis; identical to SEQ ID NO: 1347
  CDS (1)..(1023)

SEQ ID NO: 47870 - protein, 340 aa, Lactococcus lactis subsp. lactis; identical to SEQ ID NO: 1348

SEQ ID NO: 47871 - DNA, 1032 bp, Streptococcus pneumoniae; identical to SEQ ID NO: 1349
  CDS (1)..(1032)

SEQ ID NO: 47872 - protein, 343 aa, Streptococcus pneumoniae; identical to SEQ ID NO: 1350

SEQ ID NO: 47873 - DNA, 1095 bp, Pseudomonas aeruginosa; identical to SEQ ID NO: 1351
  CDS (1)..(1095)

SEQ ID NO: 47874 - protein, 364 aa, Pseudomonas aeruginosa; identical to SEQ ID NO: 1352

SEQ ID NO: 47875 - DNA, 1110 bp, Caulobacter crescentus; identical to SEQ ID NO: 1353
  CDS (1)..(1110)

SEQ ID NO: 47876 - protein, 369 aa, Caulobacter crescentus; identical to SEQ ID NO: 1354

SEQ ID NO: 47877 - DNA, 1032 bp, Streptococcus pneumoniae; identical to SEQ ID NO: 1355
  CDS (1)..(1032)

SEQ ID NO: 47878 - protein, 343 aa, Streptococcus pneumoniae; identical to SEQ ID NO: 1356

SEQ ID NO: 47879 - DNA, 1047 bp, Buchnera aphidicola; identical to SEQ ID NO: 1357
  CDS (1)..(1047)

SEQ ID NO: 47880 - protein, 348 aa, Buchnera aphidicola; identical to SEQ ID NO: 1358

SEQ ID NO: 47881 - DNA, 1089 bp, Haemophilus influenzae; identical to SEQ ID NO: 1359
  CDS (1)..(1089)

SEQ ID NO: 47882 - protein, 362 aa, Haemophilus influenzae; identical to SEQ ID NO: 1360

SEQ ID NO: 47883 - DNA, 1502 bp, Candida albicans; identical to SEQ ID NO: 1361
  CDS (336)..(1442)

SEQ ID NO: 47884 - protein, 368 aa, Candida albicans; identical to SEQ ID NO: 1362

SEQ ID NO: 47885 - DNA, 1113 bp, Saccharomyces cerevisiae; identical to SEQ ID NO: 1363
  CDS (1)..(1113)

SEQ ID NO: 47886 - protein, 370 aa, Saccharomyces cerevisiae; identical to SEQ ID NO: 1364

SEQ ID NO: 47887 - DNA, 2048 bp, Saccharomyces cerevisiae; identical to SEQ ID NO: 1365
  CDS (619)..(1731)

SEQ ID NO: 47888 - protein, 370 aa, Saccharomyces cerevisiae; identical to SEQ ID NO: 1366

SEQ ID NO: 47889 - DNA, 1107 bp, Schizosaccharomyces pombe; identical to SEQ ID NO: 1367
  CDS (1)..(1107)

SEQ ID NO: 47890 - protein, 368 aa, Schizosaccharomyces pombe; identical to SEQ ID NO: 1368

SEQ ID NO: 47891 - DNA, 1089 bp, Amycolatopsis orientalis; identical to SEQ ID NO: 1369
  CDS (1)..(1089)

SEQ ID NO: 47892 - protein, 362 aa, Amycolatopsis orientalis; identical to SEQ ID NO: 1370

SEQ ID NO: 47893 - DNA, 1119 bp, Schizosaccharomyces pombe; identical to SEQ ID NO: 1371
  CDS (1)..(1119)

SEQ ID NO: 47894 - protein, 372 aa, Schizosaccharomyces pombe; identical to SEQ ID NO: 1372

SEQ ID NO: 47895 - DNA, 1248 bp, Corynebacterium glutamicum; identical to SEQ ID NO: 1373
  CDS (101)..(1228)

SEQ ID NO: 47896 - protein, 375 aa, Corynebacterium glutamicum; identical to SEQ ID NO: 1374

SEQ ID NO: 47897 - DNA, 1083 bp, Methylophilus methylotrophus; identical to SEQ ID NO: 1375
  CDS (1)..(1083)

SEQ ID NO: 47898 - protein, 360 aa, Methylophilus methylotrophus; identical to SEQ ID NO: 1376

SEQ ID NO: 47899 - DNA, 1107 bp, Debaryomyces hansenii; identical to SEQ ID NO: 1377
  CDS (1)..(1107)

SEQ ID NO: 47900 - protein, 368 aa, Debaryomyces hansenii; identical to SEQ ID NO: 1378

SEQ ID NO: 47901 - DNA, 1074 bp, Yarrowia lipolytica; identical to SEQ ID NO: 1379
  CDS (1)..(1074)

SEQ ID NO: 47902 - protein, 357 aa, Yarrowia lipolytica; identical to SEQ ID NO: 1380

SEQ ID NO: 47903 - DNA, 1089 bp, Yarrowia lipolytica; identical to SEQ ID NO: 1381
  CDS (1)..(1089)

SEQ ID NO: 47904 - protein, 362 aa, Yarrowia lipolytica; identical to SEQ ID NO: 1382

SEQ ID NO: 47905 - DNA, 1119 bp, Kluyveromyces lactis; identical to SEQ ID NO: 1383
  CDS (1)..(1119)

SEQ ID NO: 47906 - protein, 372 aa, Kluyveromyces lactis; identical to SEQ ID NO: 1384

SEQ ID NO: 47907 - DNA, 1095 bp, Kluyveromyces lactis; identical to SEQ ID NO: 1385
  CDS (1)..(1095)

SEQ ID NO: 47908 - protein, 364 aa, Kluyveromyces lactis; identical to SEQ ID NO: 1386

SEQ ID NO: 47909 - DNA, 1074 bp, Erwinia carotovora subsp; identical to SEQ ID NO: 1387
  CDS (1)..(1074)

SEQ ID NO: 47910 - protein, 357 aa, Erwinia carotovora subsp; identical to SEQ ID NO: 1388

SEQ ID NO: 47911 - DNA, 1047 bp, Erwinia carotovora subsp; identical to SEQ ID NO: 1389
  CDS (1)..(1047)

SEQ ID NO: 47912 - protein, 348 aa, Erwinia carotovora subsp; identical to SEQ ID NO: 1390

SEQ ID NO: 47913 - DNA, 1056 bp, Erwinia carotovora subsp; identical to SEQ ID NO: 1391
  CDS (1)..(1056)

SEQ ID NO: 47914 - protein, 351 aa, Erwinia carotovora subsp; identical to SEQ ID NO: 1392

SEQ ID NO: 47915 - DNA, 1113 bp, Acinetobacter sp; identical to SEQ ID NO: 1393
  CDS (1)..(1113)

SEQ ID NO: 47916 - protein, 370 aa, Acinetobacter sp; identical to SEQ ID NO: 1394

SEQ ID NO: 47917 - DNA, 1056 bp, Acinetobacter sp; identical to SEQ ID NO: 1395
  CDS (1)..(1056)

SEQ ID NO: 47918 - protein, 351 aa, Acinetobacter sp; identical to SEQ ID NO: 1396

SEQ ID NO: 47919 - DNA, 1119 bp, Candida glabrata; identical to SEQ ID NO: 1397
  CDS (1)..(1119)

SEQ ID NO: 47920 - protein, 372 aa, Candida glabrata; identical to SEQ ID NO: 1398

SEQ ID NO: 47921 - DNA, 1071 bp, Candida glabrata; identical to SEQ ID NO: 1399
  CDS (1)..(1071)

SEQ ID NO: 47922 - protein, 356 aa, Candida glabrata; identical to SEQ ID NO: 1400

SEQ ID NO: 47923 - DNA, 1083 bp, Photobacterium profundum; identical to SEQ ID NO: 1401
  CDS (1)..(1083)

SEQ ID NO: 47924 - protein, 360 aa, Photobacterium profundum; identical to SEQ ID NO: 1402

SEQ ID NO: 47925 - DNA, 1053 bp, Photobacterium profundum; identical to SEQ ID NO: 1403
  CDS (1)..(1053)

SEQ ID NO: 47926 - protein, 350 aa, Photobacterium profundum; identical to SEQ ID NO: 1404

SEQ ID NO: 47927 - DNA, 1113 bp, Photobacterium profundum; identical to SEQ ID NO: 1405
  CDS (1)..(1113)

SEQ ID NO: 47928 - protein, 370 aa, Photobacterium profundum; identical to SEQ ID NO: 1406

SEQ ID NO: 47929 - DNA, 1056 bp, Photobacterium profundum; identical to SEQ ID NO: 1407
  CDS (1)..(1056)

SEQ ID NO: 47930 - protein, 351 aa, Photobacterium profundum; identical to SEQ ID NO: 1408

SEQ ID NO: 47931 - DNA, 1092 bp, Parachlamydia sp; identical to SEQ ID NO: 1409
  CDS (1)..(1092)

SEQ ID NO: 47932 - protein, 363 aa, Parachlamydia sp; identical to SEQ ID NO: 1410

SEQ ID NO: 47933 - DNA, 1095 bp, Rhodopseudomonas palustris; identical to SEQ ID NO: 1411
  CDS (1)..(1095)

SEQ ID NO: 47934 - protein, 364 aa, Rhodopseudomonas palustris; identical to SEQ ID NO: 1412

SEQ ID NO: 47935 - DNA, 1100 bp, Amycolatopsis methanolica; identical to SEQ ID NO: 1413
  CDS (1)..(1086)

SEQ ID NO: 47936 - protein, 361 aa, Amycolatopsis methanolica; identical to SEQ ID NO: 1414

SEQ ID NO: 47937 - DNA, 1071 bp, Treponema denticola; identical to SEQ ID NO: 1415
  CDS (1)..(1071)

SEQ ID NO: 47938 - protein, 356 aa, Treponema denticola; identical to SEQ ID NO: 1416

SEQ ID NO: 47939 - DNA, 1068 bp, Geobacter sulfurreducens; identical to SEQ ID NO: 1417
  CDS (1)..(1068)

SEQ ID NO: 47940 - protein, 355 aa, Geobacter sulfurreducens; identical to SEQ ID NO: 1418

SEQ ID NO: 47941 - DNA, 1095 bp, Ashbya gossypii; identical to SEQ ID NO: 1419
  CDS (1)..(1095)

SEQ ID NO: 47942 - protein, 364 aa, Ashbya gossypii; identical to SEQ ID NO: 1420

SEQ ID NO: 47943 - DNA, 1122 bp, Ashbya gossypii; identical to SEQ ID NO: 1421
  CDS (1)..(1122)

SEQ ID NO: 47944 - protein, 373 aa, Ashbya gossypii; identical to SEQ ID NO: 1422

SEQ ID NO: 47945 - DNA, 1098 bp, Amycolatopsis balhimycina; identical to SEQ ID NO: 1423
  CDS (1)..(1098)

SEQ ID NO: 47946 - protein, 365 aa, Amycolatopsis balhimycina; identical to SEQ ID NO: 1424

SEQ ID NO: 47947 - DNA, 1071 bp, Vibrio vulnificus; identical to SEQ ID NO: 1425
  CDS (1)..(1071)

SEQ ID NO: 47948 - protein, 356 aa, Vibrio vulnificus; identical to SEQ ID NO: 1426

SEQ ID NO: 47949 - DNA, 1047 bp, Photorhabdus luminescens; identical to SEQ ID NO: 1427
  CDS (1)..(1047)

SEQ ID NO: 47950 - protein, 348 aa, Photorhabdus luminescens; identical to SEQ ID NO: 1428

SEQ ID NO: 47951 - DNA, 1053 bp, Photorhabdus luminescens; identical to SEQ ID NO: 1429
  CDS (1)..(1053)

SEQ ID NO: 47952 - protein, 350 aa, Photorhabdus luminescens; identical to SEQ ID NO: 1430

SEQ ID NO: 47953 - DNA, 1095 bp, Photorhabdus luminescens; identical to SEQ ID NO: 1431
  CDS (1)..(1095)

SEQ ID NO: 47954 - protein, 364 aa, Photorhabdus luminescens; identical to SEQ ID NO: 1432

SEQ ID NO: 47955 - DNA, 1119 bp, Gloeobacter violaceus; identical to SEQ ID NO: 1433
  CDS (1)..(1119)

SEQ ID NO: 47956 - protein, 372 aa, Gloeobacter violaceus; identical to SEQ ID NO: 1434

SEQ ID NO: 47957 - DNA, 1107 bp, Chromobacterium violaceum; identical to SEQ ID NO: 1435
  CDS (1)..(1107)

SEQ ID NO: 47958 - protein, 368 aa, Chromobacterium violaceum; identical to SEQ ID NO: 1436

SEQ ID NO: 47959 - DNA, 1059 bp, Chromobacterium violaceum; identical to SEQ ID NO: 1437
  CDS (1)..(1059)

SEQ ID NO: 47960 - protein, 352 aa, Chromobacterium violaceum; identical to SEQ ID NO: 1438

SEQ ID NO: 47961 - DNA, 1140 bp, Neurospora crassa; identical to SEQ ID NO: 1439
  CDS (1)..(1140)

SEQ ID NO: 47962 - protein, 379 aa, Neurospora crassa; identical to SEQ ID NO: 1440

SEQ ID NO: 47963 - DNA, 1092 bp, Neurospora crassa; identical to SEQ ID NO: 1441
  CDS (1)..(1092)

SEQ ID NO: 47964 - protein, 363 aa, Neurospora crassa; identical to SEQ ID NO: 1442

SEQ ID NO: 47965 - DNA, 1068 bp, Synechococcus sp; identical to SEQ ID NO: 1443
  CDS (1)..(1068)

SEQ ID NO: 47966 - protein, 355 aa, Synechococcus sp; identical to SEQ ID NO: 1444

SEQ ID NO: 47967 - DNA, 1053 bp, Rhodopirellula baltica; identical to SEQ ID NO: 1445
  CDS (1)..(1053)

SEQ ID NO: 47968 - protein, 350 aa, Rhodopirellula baltica; identical to SEQ ID NO: 1446

SEQ ID NO: 47969 - DNA, 1068 bp, Prochlorococcus marinus subsp; identical to SEQ ID NO: 1447
  CDS (1)..(1068)

SEQ ID NO: 47970 - protein, 355 aa, Prochlorococcus marinus subsp; identical to SEQ ID NO: 1448

SEQ ID NO: 47971 - DNA, 1083 bp, Prochlorococcus marinus; identical to SEQ ID NO: 1449
  CDS (1)..(1083)

SEQ ID NO: 47972 - protein, 360 aa, Prochlorococcus marinus; identical to SEQ ID NO: 1450

SEQ ID NO: 47973 - DNA, 1074 bp, Prochlorococcus marinus; identical to SEQ ID NO: 1451
  CDS (1)..(1074)

SEQ ID NO: 47974 - protein, 357 aa, Prochlorococcus marinus; identical to SEQ ID NO: 1452

SEQ ID NO: 47975 - DNA, 1113 bp, Haemophilus ducreyi; identical to SEQ ID NO: 1453
  CDS (1)..(1113)

SEQ ID NO: 47976 - protein, 370 aa, Haemophilus ducreyi; identical to SEQ ID NO: 1454

SEQ ID NO: 47977 - DNA, 1080 bp, Haemophilus ducreyi; identical to SEQ ID NO: 1455
  CDS (1)..(1080)

SEQ ID NO: 47978 - protein, 359 aa, Haemophilus ducreyi; identical to SEQ ID NO: 1456

SEQ ID NO: 47979 - DNA, 1086 bp, Candidatus Blochmannia floridanus; identical to SEQ ID NO: 1457
  CDS (1)..(1086)

SEQ ID NO: 47980 - protein, 361 aa, Candidatus Blochmannia floridanus; identical to SEQ ID NO: 1458

SEQ ID NO: 47981 - DNA, 1074 bp, Bordetella pertussis; identical to SEQ ID NO: 1459
  CDS (1)..(1074)

SEQ ID NO: 47982 - protein, 357 aa, Bordetella pertussis; identical to SEQ ID NO: 1460

SEQ ID NO: 47983 - DNA, 1119 bp, Bordetella bronchiseptica; identical to SEQ ID NO: 1461
  CDS (1)..(1119)

SEQ ID NO: 47984 - protein, 372 aa, Bordetella bronchiseptica; identical to SEQ ID NO: 1462

SEQ ID NO: 47985 - DNA, 1179 bp, Nitrosomonas europaea; identical to SEQ ID NO: 1463
  CDS (1)..(1179)

SEQ ID NO: 47986 - protein, 392 aa, Nitrosomonas europaea; identical to SEQ ID NO: 1464

SEQ ID NO: 47987 - DNA, 1083 bp, Coxiella burnetii; identical to SEQ ID NO: 1465
  CDS (1)..(1083)

SEQ ID NO: 47988 - protein, 360 aa, Coxiella burnetii; identical to SEQ ID NO: 1466

SEQ ID NO: 47989 - DNA, 834 bp, Vibrio anguillarum; identical to SEQ ID NO: 1467
  CDS (1)..(834)

SEQ ID NO: 47990 - protein, 277 aa, Vibrio anguillarum; identical to SEQ ID NO: 1468

SEQ ID NO: 47991 - DNA, 1143 bp, Xylella fastidiosa; identical to SEQ ID NO: 1469
  CDS (1)..(1143)

SEQ ID NO: 47992 - protein, 380 aa, Xylella fastidiosa; identical to SEQ ID NO: 1470

SEQ ID NO: 47993 - DNA, 1053 bp, Vibrio parahaemolyticus; identical to SEQ ID NO: 1471
  CDS (1)..(1053)

SEQ ID NO: 47994 - protein, 350 aa, Vibrio parahaemolyticus; identical to SEQ ID NO: 1472

SEQ ID NO: 47995 - DNA, 1053 bp, Vibrio parahaemolyticus; identical to SEQ ID NO: 1473
  CDS (1)..(1053)

SEQ ID NO: 47996 - protein, 350 aa, Vibrio parahaemolyticus; identical to SEQ ID NO: 1474

SEQ ID NO: 47997 - DNA, 1074 bp, Vibrio parahaemolyticus; identical to SEQ ID NO: 1475
  CDS (1)..(1074)

SEQ ID NO: 47998 - protein, 357 aa, Vibrio parahaemolyticus; identical to SEQ ID NO: 1476

SEQ ID NO: 47999 - DNA, 1083 bp, Pseudomonas syringae; identical to SEQ ID NO: 1477
  CDS (1)..(1083)

SEQ ID NO: 48000 - protein, 360 aa, Pseudomonas syringae; identical to SEQ ID NO: 1478

SEQ ID NO: 48001 - DNA, 1077 bp, Pseudomonas syringae; identical to SEQ ID NO: 1479
  CDS (1)..(1077)

SEQ ID NO: 48002 - protein, 358 aa, Pseudomonas syringae; identical to SEQ ID NO: 1480

SEQ ID NO: 48003 - DNA, 1062 bp, Pseudomonas putida; identical to SEQ ID NO: 1481
  CDS (1)..(1062)

SEQ ID NO: 48004 - protein, 353 aa, Pseudomonas putida; identical to SEQ ID NO: 1482

SEQ ID NO: 48005 - DNA, 1113 bp, Pseudomonas putida; identical to SEQ ID NO: 1483
  CDS (1)..(1113)

SEQ ID NO: 48006 - protein, 370 aa, Pseudomonas putida; identical to SEQ ID NO: 1484

SEQ ID NO: 48007 - DNA, 1086 bp, Bradyrhizobium japonicum; identical to SEQ ID NO: 1485
  CDS (1)..(1086)

SEQ ID NO: 48008 - protein, 361 aa, Bradyrhizobium japonicum; identical to SEQ ID NO: 1486

SEQ ID NO: 48009 - DNA, 1053 bp, Yersinia pestis; identical to SEQ ID NO: 1487
  CDS (1)..(1053)

SEQ ID NO: 48010 - protein, 350 aa, Yersinia pestis; identical to SEQ ID NO: 1488

SEQ ID NO: 48011 - DNA, 1077 bp, Yersinia pestis; identical to SEQ ID NO: 1489
  CDS (1)..(1077)

SEQ ID NO: 48012 - protein, 358 aa, Yersinia pestis; identical to SEQ ID NO: 1490

SEQ ID NO: 48013 - DNA, 1038 bp, Wigglesworthia glossinidia brevipalpis; identical to SEQ ID NO: 1491
  CDS (1)..(1038)

SEQ ID NO: 48014 - protein, 345 aa, Wigglesworthia glossinidia brevipalpis; identical to SEQ ID NO: 1492

SEQ ID NO: 48015 - DNA, 1053 bp, Vibrio vulnificus; identical to SEQ ID NO: 1493
  CDS (1)..(1053)

SEQ ID NO: 48016 - protein, 350 aa, Vibrio vulnificus; identical to SEQ ID NO: 1494

SEQ ID NO: 48017 - DNA, 1053 bp, Vibrio vulnificus; identical to SEQ ID NO: 1495
  CDS (1)..(1053)

SEQ ID NO: 48018 - protein, 350 aa, Vibrio vulnificus; identical to SEQ ID NO: 1496

SEQ ID NO: 48019 - DNA, 1071 bp, Vibrio vulnificus; identical to SEQ ID NO: 1497
  CDS (1)..(1071)

SEQ ID NO: 48020 - protein, 356 aa, Vibrio vulnificus; identical to SEQ ID NO: 1498

SEQ ID NO: 48021 - DNA, 1062 bp, Synechococcus elongatus; identical to SEQ ID NO: 1499
  CDS (1)..(1062)

SEQ ID NO: 48022 - protein, 353 aa, Synechococcus elongatus; identical to SEQ ID NO: 1500

SEQ ID NO: 48023 - DNA, 1032 bp, Streptococcus mutans; identical to SEQ ID NO: 1501
  CDS (1)..(1032)

SEQ ID NO: 48024 - protein, 343 aa, Streptococcus mutans; identical to SEQ ID NO: 1502

SEQ ID NO: 48025 - DNA, 1035 bp, Streptococcus mutans; identical to SEQ ID NO: 1503
  CDS (1)..(1035)

SEQ ID NO: 48026 - protein, 344 aa, Streptococcus mutans; identical to SEQ ID NO: 1504

SEQ ID NO: 48027 - DNA, 1008 bp, Streptococcus agalactiae; identical to SEQ ID NO: 1505
  CDS (1)..(1008)

SEQ ID NO: 48028 - protein, 335 aa, Streptococcus agalactiae; identical to SEQ ID NO: 1506

SEQ ID NO: 48029 - DNA, 1065 bp, Shewanella oneidensis; identical to SEQ ID NO: 1507
  CDS (1)..(1065)

SEQ ID NO: 48030 - protein, 354 aa, Shewanella oneidensis; identical to SEQ ID NO: 1508

SEQ ID NO: 48031 - DNA, 1092 bp, Shewanella oneidensis; identical to SEQ ID NO: 1509
  CDS (1)..(1092)

SEQ ID NO: 48032 - protein, 363 aa, Shewanella oneidensis; identical to SEQ ID NO: 1510

SEQ ID NO: 48033 - DNA, 1059 bp, Shewanella oneidensis; identical to SEQ ID NO: 1511
  CDS (1)..(1059)

SEQ ID NO: 48034 - protein, 352 aa, Shewanella oneidensis; identical to SEQ ID NO: 1512

SEQ ID NO: 48035 - DNA, 1053 bp, Escherichia coli O6; identical to SEQ ID NO: 1513
  CDS (1)..(1053)

SEQ ID NO: 48036 - protein, 350 aa, Escherichia coli O6; identical to SEQ ID NO: 1514

SEQ ID NO: 48037 - DNA, 1170 bp, Corynebacterium efficiens; identical to SEQ ID NO: 1515
  CDS (1)..(1170)

SEQ ID NO: 48038 - protein, 389 aa, Corynebacterium efficiens; identical to SEQ ID NO: 1516

SEQ ID NO: 48039 - DNA, 1134 bp, Bifidobacterium longum; identical to SEQ ID NO: 1517
  CDS (1)..(1134)

SEQ ID NO: 48040 - protein, 377 aa, Bifidobacterium longum; identical to SEQ ID NO: 1518

SEQ ID NO: 48041 - DNA, 1233 bp, Bifidobacterium longum; identical to SEQ ID NO: 1519
  CDS (1)..(1233)

SEQ ID NO: 48042 - protein, 410 aa, Bifidobacterium longum; identical to SEQ ID NO: 1520

SEQ ID NO: 48043 - DNA, 1221 bp, Phytophthora infestans; identical to SEQ ID NO: 1521
  CDS (20)..(1153)

SEQ ID NO: 48044 - protein, 377 aa, Phytophthora infestans; identical to SEQ ID NO: 1522

SEQ ID NO: 48045 - DNA, 1062 bp, Chlorobium tepidum; identical to SEQ ID NO: 1523
  CDS (1)..(1062)

SEQ ID NO: 48046 - protein, 353 aa, Chlorobium tepidum; identical to SEQ ID NO: 1524

SEQ ID NO: 48047 - DNA, 1074 bp, Xanthomonas campestris; identical to SEQ ID NO: 1525
  CDS (1)..(1074)

SEQ ID NO: 48048 - protein, 357 aa, Xanthomonas campestris; identical to SEQ ID NO: 1526

SEQ ID NO: 48049 - DNA, 1074 bp, Xanthomonas axonopodis; identical to SEQ ID NO: 1527
  CDS (1)..(1074)

SEQ ID NO: 48050 - protein, 357 aa, Xanthomonas axonopodis; identical to SEQ ID NO: 1528

SEQ ID NO: 48051 - DNA, 1080 bp, Ralstonia solanacearum; identical to SEQ ID NO: 1529
  CDS (1)..(1080)

SEQ ID NO: 48052 - protein, 359 aa, Ralstonia solanacearum; identical to SEQ ID NO: 1530

SEQ ID NO: 48053 - DNA, 1179 bp, Ralstonia solanacearum; identical to SEQ ID NO: 1531
  CDS (1)..(1179)

SEQ ID NO: 48054 - protein, 392 aa, Ralstonia solanacearum; identical to SEQ ID NO: 1532

SEQ ID NO: 48055 - DNA, 1065 bp, Synechococcus sp; identical to SEQ ID NO: 1533
  CDS (1)..(1065)

SEQ ID NO: 48056 - protein, 354 aa, Synechococcus sp; identical to SEQ ID NO: 1534

SEQ ID NO: 48057 - DNA, 1035 bp, Escherichia coli; identical to SEQ ID NO: 1535
  CDS (1)..(1035)

SEQ ID NO: 48058 - protein, 344 aa, Escherichia coli; identical to SEQ ID NO: 1536

SEQ ID NO: 48059 - DNA, 1200 bp, Stigmatella aurantiaca; identical to SEQ ID NO: 1537
  CDS (62)..(1147)

SEQ ID NO: 48060 - protein, 361 aa, Stigmatella aurantiaca; identical to SEQ ID NO: 1538

SEQ ID NO: 48061 - DNA, 1092 bp, Rhizobium loti; identical to SEQ ID NO: 1539
  CDS (1)..(1092)

SEQ ID NO: 48062 - protein, 363 aa, Rhizobium loti; identical to SEQ ID NO: 1540

SEQ ID NO: 48063 - DNA, 1083 bp, Amycolatopsis mediterranei; identical to SEQ ID NO: 1541
  CDS (1)..(1083)

SEQ ID NO: 48064 - protein, 360 aa, Amycolatopsis mediterranei; identical to SEQ ID NO: 1542

SEQ ID NO: 48065 - DNA, 1053 bp, Pasteurella multocida; identical to SEQ ID NO: 1543
  CDS (1)..(1053)

SEQ ID NO: 48066 - protein, 350 aa, Pasteurella multocida; identical to SEQ ID NO: 1544

SEQ ID NO: 48067 - DNA, 1086 bp, Pasteurella multocida; identical to SEQ ID NO: 1545
  CDS (1)..(1086)

SEQ ID NO: 48068 - protein, 361 aa, Pasteurella multocida; identical to SEQ ID NO: 1546

SEQ ID NO: 48069 - DNA, 1125 bp, Emericella nidulans; identical to SEQ ID NO: 1547
  CDS (1)..(1125)

SEQ ID NO: 48070 - protein, 374 aa, Emericella nidulans; identical to SEQ ID NO: 1548

SEQ ID NO: 48071 - DNA, 1089 bp, Emericella nidulans; identical to SEQ ID NO: 1549
  CDS (1)..(1089)

SEQ ID NO: 48072 - protein, 362 aa, Emericella nidulans; identical to SEQ ID NO: 1550

SEQ ID NO: 48073 - DNA, 1239 bp, Vibrio cholerae; identical to SEQ ID NO: 1551
  CDS (114)..(1175)

SEQ ID NO: 48074 - protein, 353 aa, Vibrio cholerae; identical to SEQ ID NO: 1552

SEQ ID NO: 48075 - DNA, 2184 bp, Candida albicans; identical to SEQ ID NO: 1553
  CDS (461)..(1573)

SEQ ID NO: 48076 - protein, 370 aa, Candida albicans; identical to SEQ ID NO: 1554

SEQ ID NO: 48077 - DNA, 1047 bp, Buchnera aphidicola; identical to SEQ ID NO: 1555
  CDS (1)..(1047)

SEQ ID NO: 48078 - protein, 348 aa, Buchnera aphidicola; identical to SEQ ID NO: 1556

SEQ ID NO: 48079 - DNA, 1047 bp, Buchnera aphidicola; identical to SEQ ID NO: 1557
  CDS (1)..(1047)

SEQ ID NO: 48080 - protein, 348 aa, Buchnera aphidicola; identical to SEQ ID NO: 1558

SEQ ID NO: 48081 - DNA, 1047 bp, Erwinia herbicola; identical to SEQ ID NO: 1559
  CDS (1)..(1047)

SEQ ID NO: 48082 - protein, 348 aa, Erwinia herbicola; identical to SEQ ID NO: 1560

SEQ ID NO: 48083 - DNA, 1047 bp, Salmonella typhimurium; identical to SEQ ID NO: 1561
  CDS (1)..(1047)

SEQ ID NO: 48084 - protein, 348 aa, Salmonella typhimurium; identical to SEQ ID NO: 1562

SEQ ID NO: 48085 - DNA, 23 bp, Artificial sequence
  (1)..(23): primer
atgaacagaactgacgaactccg

SEQ ID NO: 48086 - DNA, 24 bp, Artificial sequence
  (1)..(24): primer
ttagaagcgggtatctaccgcaga

SEQ ID NO: 48087 - protein, 352 aa, Artificial sequence; identical to SEQ ID NO: 19007
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(40): xaa in position 37 to 40 is any amino acid
  Variant (42)..(43): xaa in position 42 to 43 is any amino acid
  Variant (45)..(46): xaa in position 45 to 46 is any amino acid
  Variant (51)..(51): xaa in position 51 is any amino acid
  Variant (54)..(55): xaa in position 54 to 55 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(128): xaa in position 121 to 128 is any amino acid
  Variant (130)..(130): xaa in position 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(152): xaa in position 148 to 152 is any amino acid
  Variant (163)..(163): xaa in position 163 is any amino acid
  Variant (166)..(167): xaa in position 166 to 167 is any amino acid
  Variant (170)..(170): xaa in position 170 is any amino acid
  Variant (173)..(173): xaa in position 173 is any amino acid
  Variant (175)..(175): xaa in position 175 is any amino acid
  Variant (180)..(180): xaa in position 180 is any amino acid
  Variant (182)..(182): xaa in position 182 is any amino acid
  Variant (184)..(187): xaa in position 184 to 187 is any amino acid
  Variant (189)..(190): xaa in position 189 to 190 is any amino acid
  Variant (192)..(194): xaa in position 192 to 194 is any amino acid
  Variant (196)..(198): xaa in position 196 to 198 is any amino acid
  Variant (200)..(200): xaa in position 200 is any amino acid
  Variant (202)..(207): xaa in position 202 to 207 is any amino acid
  Variant (209)..(214): xaa in position 209 to 214 is any amino acid
  Variant (216)..(216): xaa in position 216 is any amino acid
  Variant (219)..(221): xaa in position 219 to 221 is any amino acid
  Variant (223)..(224): xaa in position 223 to 224 is any amino acid
  Variant (229)..(237): xaa in position 229 to 237 is any amino acid
  Variant (240)..(268): xaa in position 240 to 268 is any amino acid
  Variant (270)..(270): xaa in position 270 is any amino acid
  Variant (273)..(273): xaa in position 273 is any amino acid
  Variant (276)..(276): xaa in position 276 is any amino acid
  Variant (278)..(281): xaa in position 278 to 281 is any amino acid
  Variant (283)..(284): xaa in position 283 to 284 is any amino acid
  Variant (286)..(291): xaa in position 286 to 291 is any amino acid
  Variant (293)..(295): xaa in position 293 to 295 is any amino acid
  Variant (297)..(304): xaa in position 297 to 304 is any amino acid
  Variant (306)..(306): xaa in position 306 is any amino acid
  Variant (308)..(308): xaa in position 308 is any amino acid
  Variant (311)..(314): xaa in position 311 to 314 is any amino acid
  Variant (316)..(316): xaa in position 316 is any amino acid
  Variant (318)..(333): xaa in position 318 to 333 is any amino acid
  Variant (336)..(336): xaa in position 336 is any amino acid
  Variant (338)..(338): xaa in position 338 is any amino acid
  Variant (341)..(341): xaa in position 341 is any amino acid
  Variant (343)..(344): xaa in position 343 to 344 is any amino acid
  Variant (346)..(347): xaa in position 346 to 347 is any amino acid
  Variant (349)..(351): xaa in position 349 to 351 is any amino acid

SEQ ID NO: 48088 - protein, 24 aa, Artificial sequence
  Variant (2)..(2): xaa in position 2 is any amino acid
  Variant (3)..(3): xaa in position 3 is Leu, Val, Phe, Ile, Ala or Met
  Variant (4)..(4): xaa in position 4 is Val, Ile, Leu or Ala
  Variant (5)..(5): xaa in position 5 is Val or Ile
  Variant (6)..(6): xaa in position 6 is Val, Ile, Cys or Thr
  Variant (11)..(11): xaa in position 11 is Ile, Val, Ser or Leu
  Variant (12)..(12): xaa in position 12 is His or Asp
  Variant (13)..(13): xaa in position 13 is Asp or Asn
  Variant (14)..(15): xaa in position 14 to 15 is any amino acid
  Variant (16)..(16): xaa in position 16 is Ala, Ser, Gln or Thr
  Variant (17)..(17): xaa in position 17 is Ala, Val or Gly
  Variant (18)..(18): xaa in position 18 is any amino acid
  Variant (19)..(19): xaa in position 19 is Glu, Asp, Ala or Gln
  Variant (21)..(21): xaa in position 21 is Ala, Gly, Cys or Ser
  Variant (22)..(22): xaa in position 22 is any amino acid
  Variant (23)..(23): xaa in position 23 is Arg, Lys, Gln, His or Leu
  Variant (24)..(24): xaa in position 24 is Leu, Ile or Phe
RXXXXXGPCSXXXXXXXXXYXXXX

SEQ ID NO: 48089 - protein, 42 aa, Artificial sequence; identical to SEQ ID NO: 2884
  Variant (1)..(1): xaa in position 1 is Leu, Ile, Phe or Met
  Variant (2)..(2): xaa in position 2 is any amino acid
  Variant (3)..(3): xaa in position 3 is Ile, Val, Leu or Met
  Variant (4)..(4): xaa in position 4 is Val, Ile or Leu
  Variant (7)..(7): xaa in position 7 is Val, Ala or Thr
  Variant (9)..(9): xaa in position 9 is Phe, Leu, Thr or Val
  Variant (10)..(10): xaa in position 10 is Glu or Ala
  Variant (15)..(16): xaa in position 15 to 16 is any amino acid
  Variant (17)..(17): xaa in position 17 is any or no amino acid
  Variant (19)..(19): xaa in position 19 is Trp or Tyr
  Variant (20)..(20): xaa in position 20 is Lys or Arg
  Variant (22)..(22): xaa in position 22 is Leu, Phe, Met or Tyr
  Variant (23)..(23): xaa in position 23 is Ile, Val, Ala or Leu
  Variant (24)..(24): xaa in position 24 is any amino acid
  Variant (25)..(25): xaa in position 25 is Asp, Glu or Gln
  Variant (27)..(27): xaa in position 27 is any amino acid
  Variant (28)..(28): xaa in position 28 is Leu, Met, Ile, Val, Ala or Thr
  Variant (29)..(29): xaa in position 29 is Asp, Asn or Ser
  Variant (30)..(33): xaa in position 30 to 33 is any amino acid
  Variant (34)..(34): xaa in position 34 is Ile, Val, Leu or Met
  Variant (35)..(36): xaa in position 35 to 36 is any amino acid
  Variant (38)..(38): xaa in position 38 is Leu, Ile, Met or Val
  Variant (39)..(40): xaa in position 39 to 40 is any amino acid
  Variant (41)..(41): xaa in position 41 is Ala, Ser, Gly, Val or Thr

SEQ ID NO: 48090 - protein, 65 aa, Artificial sequence; identical to SEQ ID NO: 2885
  Variant (2)..(2): xaa in position 2 is any amino acid
  Variant (4)..(4): xaa in position 4 is Asp, Tyr, Gln, Asn or Glu
  Variant (5)..(9): xaa in position 5 to 9 is any amino acid
  Variant (10)..(10): xaa in position 10 is Tyr, Phe or Leu
  Variant (11)..(12): xaa in position 11 to 12 is any amino acid
  Variant (13)..(13): xaa in position 13 is Asp or Glu
  Variant (14)..(15): xaa in position 14 to 15 is any amino acid
  Variant (16)..(16): xaa in position 16 is Ser, Ala, Thr or Cys
  Variant (17)..(17): xaa in position 17 is Trp, Phe, Tyr, Leu or Val
  Variant (18)..(18): xaa in position 18 is any amino acid
  Variant (19)..(19): xaa in position 19 is Ala or Ser
  Variant (20)..(20): xaa in position 20 is Ile or Val
  Variant (24)..(24): xaa in position 24 is Thr, Ser or Asn
  Variant (25)..(25): xaa in position 25 is Thr, Val, Ala, Ser or Ile
  Variant (26)..(26): xaa in position 26 is Glu or Ala
  Variant (27)..(27): xaa in position 27 is Ser, Asp or Asn
  Variant (29)..(29): xaa in position 29 is any amino acid
  Variant (32)..(32): xaa in position 32 is Glu, Gln, Phe or Met
  Variant (33)..(33): xaa in position 33 is Leu, Met, Val, Ile or Phe
  Variant (34)..(34): xaa in position 34 is Ala, Ser, Thr, Cys or Val
  Variant (36)..(36): xaa in position 36 is Gly, Ala or Asn
  Variant (37)..(39): xaa in position 37 to 39 is any amino acid
  Variant (40)..(40): xaa in position 40 is Pro or Ala
  Variant (41)..(41): xaa in position 41 is Val, Ile, Thr or Leu
  Variant (43)..(43): xaa in position 43 is Phe, Met, Tyr or Ile
  Variant (46)..(46): xaa in position 46 is any amino acid
  Variant (47)..(47): xaa in position 47 is Thr, Ser or Arg
  Variant (48)..(48): xaa in position 48 is any amino acid
  Variant (50)..(53): xaa in position 50 to 53 is any amino acid
  Variant (54)..(54): xaa in position 54 is Ala or Met
  Variant (55)..(55): xaa in position 55 is any amino acid
  Variant (56)..(56): xaa in position 56 is Asp, Asn or Glu
  Variant (57)..(57): xaa in position 57 is Ala or Gly
  Variant (58)..(59): xaa in position 58 to 59 is any amino acid
  Variant (60)..(60): xaa in position 60 is Ala or Ser
  Variant (61)..(61): xaa in position 61 is Ala, Ser, Val or Thr
  Variant (62)..(64): xaa in position 62 to 64 is any amino acid
  Variant (65)..(65): xaa in position 65 is His or Gln

SEQ ID NO: 48091 - protein, 71 aa, Artificial sequence; identical to SEQ ID NO: 2886
  Variant (1)..(1): xaa in position 1 is Thr or Ser
  Variant (2)..(2): xaa in position 2 is any amino acid
  Variant (5)..(7): xaa in position 5 to 7 is any amino acid
  Variant (8)..(8): xaa in position 8 is His or Phe
  Variant (9)..(9): xaa in position 9 is Val, Ile, Leu or Ala
  Variant (10)..(10): xaa in position 10 is Ile or Val
  Variant (11)..(11): xaa in position 11 is Leu or Met
  Variant (14)..(14): xaa in position 14 is Gly, Ser or Ala
  Variant (15)..(16): xaa in position 15 to 16 is any amino acid
  Variant (17)..(22): xaa in position 17 to 22 is any or no amino acid
  Variant (23)..(23): xaa in position 23 is Pro, Thr or Ser
  Variant (25)..(25): xaa in position 25 is Tyr, Phe or His
  Variant (26)..(29): xaa in position 26 to 29 is any amino acid
  Variant (30)..(30): xaa in position 30 is Val, Ile or Leu
  Variant (31)..(36): xaa in position 31 to 36 is any amino acid
  Variant (37)..(37): xaa in position 37 is Leu, Met, Ile, Tyr or His
  Variant (38)..(40): xaa in position 38 to 40 is any amino acid
  Variant (41)..(51): xaa in position 41 to 51 is any or no amino acid
  Variant (52)..(52): xaa in position 52 is Leu, Ile or Val
  Variant (53)..(53): xaa in position 53 is Met, Val, Ile or Leu
  Variant (54)..(54): xaa in position 54 is Ile or Val
  Variant (56)..(56): xaa in position 56 is Cys, Phe, Ala, Thr, Tyr or Val
  Variant (57)..(57): xaa in position 57 is Ser, Asn or Ala
  Variant (59)..(59): xaa in position 59 is Gly, Ala or Asp
  Variant (61)..(61): xaa in position 61 is Ser or Cys
  Variant (62)..(62): xaa in position 62 is any amino acid
  Variant (64)..(66): xaa in position 64 to 66 is any amino acid
  Variant (67)..(67): xaa in position 67 is Arg, Asn, Lys, Leu or Glu
  Variant (69)..(70): xaa in position 69 to 70 is any amino acid
  Variant (71)..(71): xaa in position 71 is Val or Ile

SEQ ID NO: 48092 - protein, 41 aa, Artificial sequence; identical to SEQ ID NO: 2887
  Variant (2)..(2): xaa in position 2 is any amino acid
  Variant (4)..(4): xaa in position 4 is Ile, Leu, Val, Ala or Met
  Variant (7)..(7): xaa in position 7 is His, Asn, Phe or Tyr
  Variant (8)..(8): xaa in position 8 is Leu or Ile
  Variant (9)..(10): xaa in position 9 to 10 is any amino acid
  Variant (12)..(12): xaa in position 12 is any amino acid
  Variant (14)..(19): xaa in position 14 to 19 is any amino acid
  Variant (20)..(30): xaa in position 20 to 30 is any or no amino acid
  Variant (32)..(32): xaa in position 32 is any amino acid
  Variant (34)..(34): xaa in position 34 is Ile or Val
  Variant (37)..(37): xaa in position 37 is Ala, Pro, Gly, Lys, Ser or Glu
  Variant (39)..(39): xaa in position 39 is Ile, Leu or Val
  Variant (40)..(40): xaa in position 40 is any amino acid
  Variant (41)..(41): xaa in position 41 is Trp, Ile, Leu or Phe

SEQ ID NO: 48093 - DNA, 1122 bp, Escherichia coli K12; identical to SEQ ID NO: 21814
  CDS (1)..(1122)

SEQ ID NO: 48094 - protein, 373 aa, Escherichia coli K12; identical to SEQ ID NO: 21815

SEQ ID NO: 48095 - DNA, 1122 bp, Yersinia pestis; identical to SEQ ID NO: 21816
  CDS (1)..(1122)

SEQ ID NO: 48096 - protein, 373 aa, Yersinia pestis; identical to SEQ ID NO: 21817

SEQ ID NO: 48097 - DNA, 1122 bp, Salmonella enterica subsp. enterica serovar Typhi; identical to SEQ ID NO: 21818
  CDS (1)..(1122)

SEQ ID NO: 48098 - protein, 373 aa, Salmonella enterica subsp. enterica serovar Typhi; identical to SEQ ID NO: 21819

SEQ ID NO: 48099 - DNA, 1128 bp, Vibrio cholerae; identical to SEQ ID NO: 21820
  CDS (1)..(1128)

SEQ ID NO: 48100 - protein, 375 aa, Vibrio cholerae; identical to SEQ ID NO: 21821

SEQ ID NO: 48101 - DNA, 1134 bp, Haemophilus influenzae; identical to SEQ ID NO: 21822
  CDS (1)..(1134)

SEQ ID NO: 48102 - protein, 377 aa, Haemophilus influenzae; identical to SEQ ID NO: 21823

SEQ ID NO: 48103 - DNA, 1122 bp, Erwinia herbicola; identical to SEQ ID NO: 21824
  CDS (1)..(1122)

SEQ ID NO: 48104 - protein, 373 aa, Erwinia herbicola; identical to SEQ ID NO: 21825

SEQ ID NO: 48105 - DNA, 1131 bp, Mannheimia succiniciproducens MBEL55E; identical to SEQ ID NO: 21826
  CDS (1)..(1131)

SEQ ID NO: 48106 - protein, 376 aa, Mannheimia succiniciproducens MBEL55E; identical to SEQ ID NO: 21827

SEQ ID NO: 48107 - DNA, 1122 bp, Erwinia carotovora; identical to SEQ ID NO: 21828
  CDS (1)..(1122)

SEQ ID NO: 48108 - protein, 373 aa, Erwinia carotovora; identical to SEQ ID NO: 21829

SEQ ID NO: 48109 - DNA, 1128 bp, Photobacterium profundum; identical to SEQ ID NO: 21830
  CDS (1)..(1128)

SEQ ID NO: 48110 - protein, 375 aa, Photobacterium profundum; identical to SEQ ID NO: 21831

SEQ ID NO: 48111 - DNA, 1128 bp, Vibrio vulnificus; identical to SEQ ID NO: 21832
  CDS (1)..(1128)

SEQ ID NO: 48112 - protein, 375 aa, Vibrio vulnificus; identical to SEQ ID NO: 21833

SEQ ID NO: 48113 - DNA, 1122 bp, Photorhabdus luminescens; identical to SEQ ID NO: 21834
  CDS (1)..(1122)

SEQ ID NO: 48114 - protein, 373 aa, Photorhabdus luminescens; identical to SEQ ID NO: 21835

SEQ ID NO: 48115 - DNA, 1134 bp, Candidatus Blochmannia floridanus; identical to SEQ ID NO: 21836
  CDS (1)..(1134)

SEQ ID NO: 48116 - protein, 377 aa, Candidatus Blochmannia floridanus; identical to SEQ ID NO: 21837

SEQ ID NO: 48117 - DNA, 1128 bp, Vibrio parahaemolyticus; identical to SEQ ID NO: 21838
  CDS (1)..(1128)

SEQ ID NO: 48118 - protein, 375 aa, Vibrio parahaemolyticus; identical to SEQ ID NO: 21839

SEQ ID NO: 48119 - DNA, 1140 bp, Shewanella oneidensis; identical to SEQ ID NO: 21840
  CDS (1)..(1140)

SEQ ID NO: 48120 - protein, 379 aa, Shewanella oneidensis; identical to SEQ ID NO: 21841

SEQ ID NO: 48121 - DNA, 1125 bp, Pasteurella multocida; identical to SEQ ID NO: 21842
  CDS (1)..(1125)

SEQ ID NO: 48122 - protein, 374 aa, Pasteurella multocida; identical to SEQ ID NO: 21843

SEQ ID NO: 48123 - DNA, 24 bp, Artificial sequence
  (1)..(24): primer
atggttgctgaattgaccgcatta

SEQ ID NO: 48124 - DNA, 23 bp, Artificial sequence
  (1)..(23): primer
ttactggcgattgtcattcgcct

SEQ ID NO: 48125 - protein, 370 aa, Artificial sequence; identical to SEQ ID NO: 21846
  Variant (2)..(4): xaa in position 2 to 4 is any amino acid
  Variant (6)..(7): xaa in position 6 to 7 is any amino acid
  Variant (10)..(11): xaa in position 10 to 11 is any amino acid
  Variant (13)..(21): xaa in position 13 to 21 is any amino acid
  Variant (24)..(24): xaa in position 24 is any amino acid
  Variant (27)..(29): xaa in position 27 to 29 is any amino acid
  Variant (31)..(32): xaa in position 31 to 32 is any amino acid
  Variant (34)..(36): xaa in position 34 to 36 is any amino acid
  Variant (39)..(39): xaa in position 39 is any amino acid
  Variant (42)..(42): xaa in position 42 is any amino acid
  Variant (44)..(44): xaa in position 44 is any amino acid
  Variant (47)..(49): xaa in position 47 to 49 is any amino acid
  Variant (51)..(52): xaa in position 51 to 52 is any amino acid
  Variant (54)..(55): xaa in position 54 to 55 is any amino acid
  Variant (58)..(60): xaa in position 58 to 60 is any amino acid
  Variant (62)..(65): xaa in position 62 to 65 is any amino acid
  Variant (67)..(68): xaa in position 67 to 68 is any amino acid
  Variant (70)..(70): xaa in position 70 is any amino acid
  Variant (74)..(74): xaa in position 74 is any amino acid
  Variant (80)..(81): xaa in position 80 to 81 is any amino acid
  Variant (83)..(85): xaa in position 83 to 85 is any amino acid
  Variant (89)..(97): xaa in position 89 to 97 is any amino acid
  Variant (99)..(100): xaa in position 99 to 100 is any amino acid
  Variant (103)..(103): xaa in position 103 is any amino acid
  Variant (105)..(106): xaa in position 105 to 106 is any amino acid
  Variant (108)..(109): xaa in position 108 to 109 is any amino acid
  Variant (111)..(116): xaa in position 111 to 116 is any amino acid
  Variant (120)..(123): xaa in position 120 to 123 is any amino acid
  Variant (125)..(127): xaa in position 125 to 127 is any amino acid
  Variant (130)..(131): xaa in position 130 to 131 is any amino acid
  Variant (133)..(145): xaa in position 133 to 145 is any amino acid
  Variant (149)..(154): xaa in position 149 to 154 is any amino acid
  Variant (156)..(161): xaa in position 156 to 161 is any amino acid
  Variant (163)..(169): xaa in position 163 to 169 is any amino acid
  Variant (172)..(172): xaa in position 172 is any amino acid
  Variant (174)..(174): xaa in position 174 is any amino acid
  Variant (176)..(182): xaa in position 176 to 182 is any amino acid
  Variant (184)..(185): xaa in position 184 to 185 is any amino acid
  Variant (187)..(187): xaa in position 187 is any amino acid
  Variant (189)..(189): xaa in position 189 is any amino acid
  Variant (191)..(191): xaa in position 191 is any amino acid
  Variant (193)..(193): xaa in position 193 is any amino acid
  Variant (198)..(199): xaa in position 198 to 199 is any amino acid
  Variant (201)..(205): xaa in position 201 to 205 is any amino acid
  Variant (207)..(208): xaa in position 207 to 208 is any amino acid
  Variant (210)..(210): xaa in position 210 is any amino acid
  Variant (212)..(214): xaa in position 212 to 214 is any amino acid
  Variant (216)..(216): xaa in position 216 is any amino acid
  Variant (219)..(222): xaa in position 219 to 222 is any amino acid
  Variant (224)..(224): xaa in position 224 is any amino acid
  Variant (226)..(228): xaa in position 226 to 228 is any amino acid
  Variant (230)..(232): xaa in position 230 to 232 is any amino acid
  Variant (236)..(244): xaa in position 236 to 244 is any amino acid
  Variant (247)..(248): xaa in position 247 to 248 is any amino acid
  Variant (250)..(252): xaa in position 250 to 252 is any amino acid
  Variant (254)..(256): xaa in position 254 to 256 is any amino acid
  Variant (259)..(260): xaa in position 259 to 260 is any amino acid
  Variant (262)..(263): xaa in position 262 to 263 is any amino acid
  Variant (265)..(266): xaa in position 265 to 266 is any amino acid
  Variant (268)..(280): xaa in position 268 to 280 is any amino acid
  Variant (284)..(286): xaa in position 284 to 286 is any amino acid
  Variant (290)..(292): xaa in position 290 to 292 is any amino acid
  Variant (297)..(297): xaa in position 297 is any amino acid
  Variant (299)..(301): xaa in position 299 to 301 is any amino acid
  Variant (304)..(304): xaa in position 304 is any amino acid
  Variant (308)..(316): xaa in position 308 to 316 is any amino acid
  Variant (318)..(338): xaa in position 318 to 338 is any amino acid
  Variant (340)..(342): xaa in position 340 to 342 is any amino acid
  Variant (344)..(348): xaa in position 344 to 348 is any amino acid
  Variant (350)..(356): xaa in position 350 to 356 is any amino acid
  Variant (358)..(360): xaa in position 358 to 360 is any amino acid
  Variant (362)..(364): xaa in position 362 to 364 is any amino acid
  Variant (366)..(369): xaa in position 366 to 369 is any amino acid

SEQ ID NO: 48126 - protein, 370 aa, Artificial sequence; identical to SEQ ID NO: 21847
  Variant (2)..(3): xaa in position 2 to 3 is any amino acid
  Variant (6)..(7): xaa in position 6 to 7 is any amino acid
  Variant (10)..(10): xaa in position 10 is any amino acid
  Variant (13)..(17): xaa in position 13 to 17 is any amino acid
  Variant (21)..(21): xaa in position 21 is any amino acid
  Variant (24)..(24): xaa in position 24 is any amino acid
  Variant (27)..(28): xaa in position 27 to 28 is any amino acid
  Variant (31)..(31): xaa in position 31 is any amino acid
  Variant (34)..(36): xaa in position 34 to 36 is any amino acid
  Variant (42)..(42): xaa in position 42 is any amino acid
  Variant (44)..(44): xaa in position 44 is any amino acid
  Variant (48)..(48): xaa in position 48 is any amino acid
  Variant (51)..(52): xaa in position 51 to 52 is any amino acid
  Variant (55)..(55): xaa in position 55 is any amino acid
  Variant (58)..(60): xaa in position 58 to 60 is any amino acid
  Variant (62)..(63): xaa in position 62 to 63 is any amino acid
  Variant (65)..(65): xaa in position 65 is any amino acid
  Variant (70)..(70): xaa in position 70 is any amino acid
  Variant (74)..(74): xaa in position 74 is any amino acid
  Variant (80)..(81): xaa in position 80 to 81 is any amino acid
  Variant (83)..(85): xaa in position 83 to 85 is any amino acid
  Variant (89)..(91): xaa in position 89 to 91 is any amino acid
  Variant (93)..(97): xaa in position 93 to 97 is any amino acid
  Variant (100)..(100): xaa in position 100 is any amino acid
  Variant (103)..(103): xaa in position 103 is any amino acid
  Variant (105)..(106): xaa in position 105 to 106 is any amino acid
  Variant (108)..(108): xaa in position 108 is any amino acid
  Variant (111)..(115): xaa in position 111 to 115 is any amino acid
  Variant (120)..(120): xaa in position 120 is any amino acid
  Variant (122)..(123): xaa in position 122 to 123 is any amino acid
  Variant (125)..(127): xaa in position 125 to 127 is any amino acid
  Variant (130)..(131): xaa in position 130 to 131 is any amino acid
  Variant (133)..(135): xaa in position 133 to 135 is any amino acid
  Variant (137)..(138): xaa in position 137 to 138 is any amino acid
  Variant (141)..(141): xaa in position 141 is any amino acid
  Variant (143)..(143): xaa in position 143 is any amino acid
  Variant (145)..(145): xaa in position 145 is any amino acid
  Variant (149)..(150): xaa in position 149 to 150 is any amino acid
  Variant (152)..(154): xaa in position 152 to 154 is any amino acid
  Variant (156)..(157): xaa in position 156 to 157 is any amino acid
  Variant (159)..(161): xaa in position 159 to 161 is any amino acid
  Variant (163)..(164): xaa in position 163 to 164 is any amino acid
  Variant (169)..(169): xaa in position 169 is any amino acid
  Variant (172)..(172): xaa in position 172 is any amino acid
  Variant (174)..(174): xaa in position 174 is any amino acid
  Variant (176)..(177): xaa in position 176 to 177 is any amino acid
  Variant (180)..(180): xaa in position 180 is any amino acid
  Variant (184)..(185): xaa in position 184 to 185 is any amino acid
  Variant (187)..(187): xaa in position 187 is any amino acid
  Variant (191)..(191): xaa in position 191 is any amino acid
  Variant (201)..(205): xaa in position 201 to 205 is any amino acid
  Variant (207)..(207): xaa in position 207 is any amino acid
  Variant (212)..(212): xaa in position 212 is any amino acid
  Variant (214)..(214): xaa in position 214 is any amino acid
  Variant (219)..(222): xaa in position 219 to 222 is any amino acid
  Variant (226)..(226): xaa in position 226 is any amino acid
  Variant (228)..(228): xaa in position 228 is any amino acid
  Variant (230)..(232): xaa in position 230 to 232 is any amino acid
  Variant (236)..(241): xaa in position 236 to 241 is any amino acid
  Variant (243)..(243): xaa in position 243 is any amino acid
  Variant (247)..(248): xaa in position 247 to 248 is any amino acid
  Variant (250)..(251): xaa in position 250 to 251 is any amino acid
  Variant (259)..(260): xaa in position 259 to 260 is any amino acid
  Variant (263)..(263): xaa in position 263 is any amino acid
  Variant (265)..(265): xaa in position 265 is any amino acid
  Variant (268)..(269): xaa in position 268 to 269 is any amino acid
  Variant (271)..(273): xaa in position 271 to 273 is any amino acid
  Variant (275)..(276): xaa in position 275 to 276 is any amino acid
  Variant (279)..(279): xaa in position 279 is any amino acid
  Variant (292)..(292): xaa in position 292 is any amino acid
  Variant (300)..(301): xaa in position 300 to 301 is any amino acid
  Variant (308)..(312): xaa in position 308 to 312 is any amino acid
  Variant (314)..(316): xaa in position 314 to 316 is any amino acid
  Variant (318)..(326): xaa in position 318 to 326 is any amino acid
  Variant (328)..(334): xaa in position 328 to 334 is any amino acid
  Variant (337)..(338): xaa in position 337 to 338 is any amino acid
  Variant (340)..(342): xaa in position 340 to 342 is any amino acid
  Variant (344)..(345): xaa in position 344 to 345 is any amino acid
  Variant (347)..(348): xaa in position 347 to 348 is any amino acid
  Variant (352)..(352): xaa in position 352 is any amino acid
  Variant (354)..(356): xaa in position 354 to 356 is any amino acid
  Variant (358)..(359): xaa in position 358 to 359 is any amino acid
  Variant (362)..(363): xaa in position 362 to 363 is any amino acid
  Variant (366)..(366): xaa in position 366 is any amino acid

SEQ ID NO: 48127 - protein, 62 aa, Artificial sequence; identical to SEQ ID NO: 21848
  Variant (2)..(3): xaa in position 2 to 3 is any amino acid
  Variant (4)..(4): xaa in position 4 is Leu or Ile
  Variant (6)..(7): xaa in position 6 to 7 is any amino acid
  Variant (10)..(10): xaa in position 10 is any amino acid
  Variant (11)..(11): xaa in position 11 is Val, Leu or Ile
  Variant (13)..(13): xaa in position 13 is Lys, Gln or Arg
  Variant (14)..(14): xaa in position 14 is any amino acid
  Variant (15)..(15): xaa in position 15 is Leu or Met
  Variant (16)..(16): xaa in position 16 is Leu, Val or Ile
  Variant (17)..(17): xaa in position 17 is any amino acid
  Variant (18)..(18): xaa in position 18 is Leu or Val
  Variant (19)..(19): xaa in position 19 is Leu or Phe
  Variant (20)..(20): xaa in position 20 is Ala, Ser or Arg
  Variant (21)..(21): xaa in position 21 is Lys, Gln or Arg
  Variant (24)..(24): xaa in position 24 is any amino acid
  Variant (27)..(27): xaa in position 27 is any amino acid
  Variant (28)..(28): xaa in position 28 is Gln, Glu or Lys
  Variant (29)..(29): xaa in position 29 is Val or Ile
  Variant (31)..(31): xaa in position 31 is any amino acid
  Variant (32)..(32): xaa in position 32 is Val or Ile
  Variant (34)..(34): xaa in position 34 is Ser or His
  Variant (35)..(36): xaa in position 35 to 36 is any amino acid
  Variant (39)..(39): xaa in position 39 is any amino acid
  Variant (42)..(42): xaa in position 42 is Ala, Val or Asp
  Variant (44)..(44): xaa in position 44 is Asp, Glu or Gln
  Variant (47)..(48): xaa in position 47 to 48 is any amino acid
  Variant (49)..(49): xaa in position 49 is Met or Ile
  Variant (51)..(52): xaa in position 51 to 52 is any amino acid
  Variant (54)..(54): xaa in position 54 is Arg or Lys
  Variant (55)..(55): xaa in position 55 is any amino acid
  Variant (58)..(60): xaa in position 58 to 60 is any amino acid
  Variant (62)..(62): xaa in position 62 is Val or Ile

SEQ ID NO: 48128 - protein, 23 aa, Artificial sequence
  Variant (2)..(2): xaa in position 2 is Ile, Val or Leu
  Variant (3)..(3): xaa in position 3 is Glu or Arg
  Variant (5)..(5): xaa in position 5 is Ile, Val or Leu
  Variant (9)..(9): xaa in position 9 is any amino acid
  Variant (15)..(16): xaa in position 15 to 16 is any amino acid
  Variant (18)..(18): xaa in position 18 is Asn, Lys or His
  Variant (19)..(20): xaa in position 19 to 20 is any amino acid
LXXDXLRRXMRESYXXEXXXGFK

SEQ ID NO: 48129 - protein, 52 aa, Artificial sequence; identical to SEQ ID NO: 21850
  Variant (1)..(1): xaa in position 1 is Val, Ile or Leu
  Variant (3)..(3): xaa in position 3 is Ile, Val or Leu
  Variant (4)..(4): xaa in position 4 is Val, Ile or Leu
  Variant (7)..(7): xaa in position 7 is any amino acid
  Variant (9)..(9): xaa in position 9 is Gln, Lys or Arg
  Variant (10)..(10): xaa in position 10 is Leu or Met
  Variant (12)..(12): xaa in position 12 is any amino acid
  Variant (13)..(13): xaa in position 13 is Leu or Phe
  Variant (15)..(15): xaa in position 15 is any amino acid
  Variant (16)..(16): xaa in position 16 is Arg, Lys or Gln
  Variant (17)..(17): xaa in position 17 is any amino acid
  Variant (18)..(18): xaa in position 18 is Leu or Phe
  Variant (19)..(19): xaa in position 19 is any amino acid
  Variant (20)..(20): xaa in position 20 is Leu or Ala
  Variant (24)..(24): xaa in position 24 is any amino acid
  Variant (25)..(25): xaa in position 25 is Val or Ile
  Variant (26)..(27): xaa in position 26 to 27 is any amino acid
  Variant (29)..(29): xaa in position 29 is Glu, Gly or Asp
  Variant (30)..(31): xaa in position 30 to 31 is any amino acid
  Variant (34)..(35): xaa in position 34 to 35 is any amino acid
  Variant (37)..(38): xaa in position 37 to 38 is any amino acid
  Variant (39)..(39): xaa in position 39 is Ile or Leu
  Variant (40)..(40): xaa in position 40 is Leu, Val or Phe
  Variant (41)..(42): xaa in position 41 to 42 is any amino acid
  Variant (43)..(43): xaa in position 43 is Ala, Val or Thr
  Variant (44)..(44): xaa in position 44 is Gly, Asp or Asn
  Variant (45)..(45): xaa in position 45 is Met, Leu, Val or Ala
  Variant (46)..(46): xaa in position 46 is Val, Ile or Leu
  Variant (47)..(47): xaa in position 47 is Ile, Leu, Val or Phe
  Variant (48)..(48): xaa in position 48 is Val, Ile or Leu
  Variant (49)..(49): xaa in position 49 is Ser, Thr or Cys

SEQ ID NO: 48130 - protein, 34 aa, Artificial sequence; identical to SEQ ID NO: 21851
  Variant (1)..(1): xaa in position 1 is Ile, Leu or Val
  Variant (2)..(2): xaa in position 2 is Leu, Ile or Val
  Variant (3)..(3): xaa in position 3 is any amino acid
  Variant (6)..(6): xaa in position 6 is Thr, Ala or Ser
  Variant (8)..(8): xaa in position 8 is Val, Ile or Leu
  Variant (10)..(11): xaa in position 10 to 11 is any amino acid
  Variant (12)..(12): xaa in position 12 is Pro or Ser
  Variant (13)..(13): xaa in position 13 is Leu or Met
  Variant (14)..(15): xaa in position 14 to 15 is any amino acid
  Variant (16)..(16): xaa in position 16 is Met or Ile
  Variant (18)..(18): xaa in position 18 is any amino acid
  Variant (19)..(19): xaa in position 19 is Val, Ala or Ile
  Variant (21)..(21): xaa in position 21 is any amino acid
  Variant (23)..(23): xaa in position 23 is Pro or Ala
  Variant (25)..(25): xaa in position 25 is Leu, Val or Ile
  Variant (27)..(27): xaa in position 27 is Leu or Phe
  Variant (32)..(32): xaa in position 32 is Gly or Ser
  Variant (33)..(33): xaa in position 33 is Pro or Ala

SEQ ID NO: 48131 - protein, 30 aa, Artificial sequence; identical to SEQ ID NO: 21852
  Variant (2)..(2): xaa in position 2 is Leu or Met
  Variant (3)..(3): xaa in position 3 is Ala, Ile or Val
  Variant (5)..(5): xaa in position 5 is Gln or Lys
  Variant (7)..(8): xaa in position 7 to 8 is Val, Ile or Leu
  Variant (9)..(9): xaa in position 9 is any amino acid
  Variant (11)..(11): xaa in position 11 is Asp or His
  Variant (14)..(17): xaa in position 14 to 17 is any amino acid
  Variant (19)..(19): xaa in position 19 is Gln or Glu
  Variant (21)..(21): xaa in position 21 is Leu or Phe
  Variant (22)..(22): xaa in position 22 is Leu, Ile or Val
  Variant (23)..(23): xaa in position 23 is Glu, Gln or Thr
  Variant (25)..(25): xaa in position 25 is Ile, Phe or Leu
  Variant (26)..(26): xaa in position 26 is any amino acid
  Variant (27)..(27): xaa in position 27 is Ile, Val, Leu or Met

SEQ ID NO: 48132 - protein, 23 aa, Artificial sequence
  Variant (3)..(4): xaa in position 3 to 4 is any amino acid
  Variant (6)..(6): xaa in position 6 is any amino acid
  Variant (7)..(7): xaa in position 7 is Phe, Leu or Tyr
  Variant (8)..(8): xaa in position 8 is Ile or Val
  Variant (10)..(10): xaa in position 10 is Ala or Ser
  Variant (11)..(11): xaa in position 11 is Leu or Met
  Variant (12)..(12): xaa in position 12 is Arg or Cys
  Variant (15)..(15): xaa in position 15 is Ala, Thr or Ser
  Variant (16)..(16): xaa in position 16 is Thr, Ser or Ile
  Variant (18)..(18): xaa in position 18 is Ala or Val
  Variant (19)..(19): xaa in position 19 is any amino acid
  Variant (21)..(21): xaa in position 21 is any amino acid
  Variant (22)..(22): xaa in position 22 is His or Asn
HDXXMXXXQXXXHFXXFXXGXXL

SEQ ID NO: 48133 - protein, 37 aa, Artificial sequence; identical to SEQ ID NO: 21854
  Variant (4)..(4): xaa in position 4 is Ile, Met, Leu or Phe
  Variant (5)..(5): xaa in position 5 is Tyr or Phe
  Variant (6)..(6): xaa in position 6 is Arg, Gln or Cys
  Variant (10)..(10): xaa in position 10 is Ala or Ile
  Variant (11)..(11): xaa in position 11 is Met, Leu, Val or Ile
  Variant (12)..(12): xaa in position 12 is Val, Ile or Leu
  Variant (17)..(17): xaa in position 17 is Ala, Gly or Thr
  Variant (19)..(21): xaa in position 19 to 21 is any amino acid
  Variant (24)..(24): xaa in position 24 is Ala or Gly
  Variant (28)..(28): xaa in position 28 is Met, Leu or Phe
  Variant (29)..(29): xaa in position 29 is Ser, Asp or Ala
  Variant (30)..(32): xaa in position 30 to 32 is any amino acid
  Variant (33)..(33): xaa in position 33 is Asn or Ser
  Variant (34)..(34): xaa in position 34 is Leu, Ile, Val or Gln
  Variant (35)..(35): xaa in position 35 is any amino acid
  Variant (36)..(36): xaa in position 36 is Leu, Met, Val or Ala

SEQ ID NO: 48134 - DNA, 2374 bp, Escherichia coli K12; identical to SEQ ID NO: 1805
  CDS (86)..(2281)

SEQ ID NO: 48135 - protein, 731 aa, Escherichia coli K12; identical to SEQ ID NO: 1806

SEQ ID NO: 48136 - DNA, 2961 bp, Hafnia alvei; identical to SEQ ID NO: 1807
  CDS (185)..(2404)

SEQ ID NO: 48137 - protein, 739 aa, Hafnia alvei; identical to SEQ ID NO: 1808

SEQ ID NO: 48138 - DNA, 4341 bp, Escherichia coli; identical to SEQ ID NO: 1809
  CDS (660)..(2858)

SEQ ID NO: 48139 - protein, 732 aa, Escherichia coli; identical to SEQ ID NO: 1810

SEQ ID NO: 48140 - DNA, 1850 bp, Bacillus subtilis; identical to SEQ ID NO: 1811
  CDS (312)..(1784)

SEQ ID NO: 48141 - protein, 490 aa, Bacillus subtilis; identical to SEQ ID NO: 1812

SEQ ID NO: 48142 - DNA, 3091 bp, Lactobacillus sp; identical to SEQ ID NO: 1813
  CDS (572)..(2767)

SEQ ID NO: 48143 - protein, 731 aa, Lactobacillus sp; identical to SEQ ID NO: 1814

SEQ ID NO: 48144 - DNA, 1449 bp, Bacillus halodurans; identical to SEQ ID NO: 1815
  CDS (1)..(1449)

SEQ ID NO: 48145 - protein, 482 aa, Bacillus halodurans; identical to SEQ ID NO: 1816

SEQ ID NO: 48146 - DNA, 2196 bp, Sinorhizobium meliloti; identical to SEQ ID NO: 1817
  CDS (1)..(2196)

SEQ ID NO: 48147 - protein, 731 aa, Sinorhizobium meliloti; identical to SEQ ID NO: 1818

SEQ ID NO: 48148 - DNA, 1380 bp, Listeria innocua; identical to SEQ ID NO: 1819
  CDS (1)..(1380)

SEQ ID NO: 48149 - protein, 459 aa, Listeria innocua; identical to SEQ ID NO: 1820

SEQ ID NO: 48150 - DNA, 2307 bp, Yersinia pestis; identical to SEQ ID NO: 1821
  CDS (1)..(2307)

SEQ ID NO: 48151 - protein, 768 aa, Yersinia pestis; identical to SEQ ID NO: 1822

SEQ ID NO: 48152 - DNA, 2145 bp, Salmonella enterica subsp. enterica serovar Typhi; identical to SEQ ID NO: 1823
  CDS (1)..(2145)

SEQ ID NO: 48153 - protein, 714 aa, Salmonella enterica subsp. enterica serovar Typhi; identical to SEQ ID NO: 1824

SEQ ID NO: 48154 - DNA, 1467 bp, Nostoc sp. PCC 7120; identical to SEQ ID NO: 1825
  CDS (1)..(1467)

SEQ ID NO: 48155 - protein, 488 aa, Nostoc sp. PCC 7120; identical to SEQ ID NO: 1826

SEQ ID NO: 48156 - DNA, 2163 bp, Yersinia pestis; identical to SEQ ID NO: 1827
  CDS (1)..(2163)

SEQ ID NO: 48157 - protein, 720 aa, Yersinia pestis; identical to SEQ ID NO: 1828

SEQ ID NO: 48158 - DNA, 2271 bp, Salmonella enterica subsp. enterica serovar Typhi; identical to SEQ ID NO: 1829
  CDS (1)..(2271)

SEQ ID NO: 48159 - protein, 756 aa, Salmonella enterica subsp. enterica serovar Typhi; identical to SEQ ID NO: 1830

SEQ ID NO: 48160 - DNA, 2148 bp, Escherichia coli; identical to SEQ ID NO: 1831
  CDS (1)..(2148)

SEQ ID NO: 48161 - protein, 715 aa, Escherichia coli; identical to SEQ ID NO: 1832

SEQ ID NO: 48162 - DNA, 2835 bp, Escherichia coli; identical to SEQ ID NO: 1833
  CDS (571)..(2712)

SEQ ID NO: 48163 - protein, 713 aa, Escherichia coli; identical to SEQ ID NO: 1834

SEQ ID NO: 48164 - DNA, 1446 bp, Clostridium acetobutylicum; identical to SEQ ID NO: 1835
  CDS (1)..(1446)

SEQ ID NO: 48165 - protein, 481 aa, Clostridium acetobutylicum; identical to SEQ ID NO: 1836

SEQ ID NO: 48166 - DNA, 1464 bp, Clostridium acetobutylicum; identical to SEQ ID NO: 1837
  CDS (1)..(1464)

SEQ ID NO: 48167 - protein, 487 aa, Clostridium acetobutylicum; identical to SEQ ID NO: 1838

SEQ ID NO: 48168 - DNA, 2256 bp, Pseudomonas aeruginosa; identical to SEQ ID NO: 1839
  CDS (1)..(2256)

SEQ ID NO: 48169 - protein, 751 aa, Pseudomonas aeruginosa; identical to SEQ ID NO: 1840

SEQ ID NO: 48170 - DNA, 2853 bp, Mycobacterium leprae; identical to SEQ ID NO: 1841
  CDS (1)..(2853)

SEQ ID NO: 48171 - protein, 950 aa, Mycobacterium leprae; identical to SEQ ID NO: 1842

SEQ ID NO: 48172 - DNA, 2202 bp, Vibrio cholerae; identical to SEQ ID NO: 1843
  CDS (1)..(2202)

SEQ ID NO: 48173 - protein, 733 aa, Vibrio cholerae; identical to SEQ ID NO: 1844

SEQ ID NO: 48174 - DNA, 2163 bp, Vibrio cholerae; identical to SEQ ID NO: 1845
  CDS (1)..(2163)

SEQ ID NO: 48175 - protein, 720 aa, Vibrio cholerae; identical to SEQ ID NO: 1846

SEQ ID NO: 48176 - DNA, 2163 bp, Haemophilus influenzae; identical to SEQ ID NO: 1847
  CDS (1)..(2163)

SEQ ID NO: 48177 - protein, 720 aa, Haemophilus influenzae; identical to SEQ ID NO: 1848

SEQ ID NO: 48178 - DNA, 2844 bp, Mycobacterium tuberculosis; identical to SEQ ID NO: 1849
  CDS (1)..(2844)

SEQ ID NO: 48179 - protein, 947 aa, Mycobacterium tuberculosis; identical to SEQ ID NO: 1850

SEQ ID NO: 48180 - DNA, 1476 bp, Streptococcus pneumoniae; identical to SEQ ID NO: 1851
  CDS (1)..(1476)

SEQ ID NO: 48181 - protein, 491 aa, Streptococcus pneumoniae; identical to SEQ ID NO: 1852

SEQ ID NO: 48182 - DNA, 1476 bp, Bacillus halodurans; identical to SEQ ID NO: 1853
  CDS (1)..(1476)

SEQ ID NO: 48183 - protein, 491 aa, Bacillus halodurans; identical to SEQ ID NO: 1854

SEQ ID NO: 48184 - DNA, 2349 bp, Sinorhizobium meliloti; identical to SEQ ID NO: 1855
  CDS (1)..(2349)

SEQ ID NO: 48185 - protein, 782 aa, Sinorhizobium meliloti; identical to SEQ ID NO: 1856

SEQ ID NO: 48186 - DNA, 1476 bp, Streptococcus pneumoniae; identical to SEQ ID NO: 1857
  CDS (1)..(1476)

SEQ ID NO: 48187 - protein, 491 aa, Streptococcus pneumoniae; identical to SEQ ID NO: 1858

SEQ ID NO: 48188 - DNA, 2271 bp, Escherichia coli; identical to SEQ ID NO: 1859
  CDS (1)..(2271)

SEQ ID NO: 48189 - protein, 756 aa, Escherichia coli; identical to SEQ ID NO: 1860

SEQ ID NO: 48190 - DNA, 1443 bp, Bacillus subtilis; identical to SEQ ID NO: 1861
  CDS (1)..(1443)

SEQ ID NO: 48191 - protein, 480 aa, Bacillus subtilis; identical to SEQ ID NO: 1862

SEQ ID NO: 48192 - DNA, 1452 bp, Synechocystis sp; identical to SEQ ID NO: 1863
  CDS (1)..(1452)

SEQ ID NO: 48193 - protein, 483 aa, Synechocystis sp; identical to SEQ ID NO: 1864

SEQ ID NO: 48194 - DNA, 2307 bp, Yersinia pseudotuberculosis IP 32953; identical to SEQ ID NO: 1865
  CDS (1)..(2307)

SEQ ID NO: 48195 - protein, 768 aa, Yersinia pseudotuberculosis IP 32953; identical to SEQ ID NO: 1866

SEQ ID NO: 48196 - DNA, 1467 bp, Symbiobacterium thermophilum; identical to SEQ ID NO: 1867
  CDS (1)..(1467)

SEQ ID NO: 48197 - protein, 488 aa, Symbiobacterium thermophilum; identical to SEQ ID NO: 1868

SEQ ID NO: 48198 - DNA, 1410 bp, Symbiobacterium thermophilum; identical to SEQ ID NO: 1869
  CDS (1)..(1410)

SEQ ID NO: 48199 - protein, 469 aa, Symbiobacterium thermophilum; identical to SEQ ID NO: 1870

SEQ ID NO: 48200 - DNA, 2154 bp, Erwinia carotovora; identical to SEQ ID NO: 1871
  CDS (1)..(2154)

SEQ ID NO: 48201 - protein, 717 aa, Erwinia carotovora; identical to SEQ ID NO: 1872

SEQ ID NO: 48202 - DNA, 2790 bp, Acinetobacter sp; identical to SEQ ID NO: 1873
  CDS (1)..(2790)

SEQ ID NO: 48203 - protein, 929 aa, Acinetobacter sp; identical to SEQ ID NO: 1874

SEQ ID NO: 48204 - DNA, 1482 bp, Bacillus thuringiensis; identical to SEQ ID NO: 1875
  CDS (1)..(1482)

SEQ ID NO: 48205 - protein, 493 aa, Bacillus thuringiensis; identical to SEQ ID NO: 1876

SEQ ID NO: 48206 - DNA, 1422 bp, Bacillus thuringiensis; identical to SEQ ID NO: 1877
  CDS (1)..(1422)

SEQ ID NO: 48207 - protein, 473 aa, Bacillus thuringiensis; identical to SEQ ID NO: 1878

SEQ ID NO: 48208 - DNA, 2358 bp, Rhodopseudomonas palustris; identical to SEQ ID NO: 1879
  CDS (1)..(2358)

SEQ ID NO: 48209 - protein, 785 aa, Rhodopseudomonas palustris; identical to SEQ ID NO: 1880

SEQ ID NO: 48210 - DNA, 2837 bp, Shigella boydii; identical to SEQ ID NO: 1881
  CDS (165)..(2435)

SEQ ID NO: 48211 - protein, 756 aa, Shigella boydii; identical to SEQ ID NO: 1882

SEQ ID NO: 48212 - DNA, 1380 bp, Listeria monocytogenes; identical to SEQ ID NO: 1883
  CDS (1)..(1380)

SEQ ID NO: 48213 - protein, 459 aa, Listeria monocytogenes; identical to SEQ ID NO: 1884

SEQ ID NO: 48214 - DNA, 1482 bp, Bacillus cereus; identical to SEQ ID NO: 1885
  CDS (1)..(1482)

SEQ ID NO: 48215 - protein, 493 aa, Bacillus cereus; identical to SEQ ID NO: 1886

SEQ ID NO: 48216 - DNA, 1422 bp, Bacillus cereus; identical to SEQ ID NO: 1887
  CDS (1)..(1422)

SEQ ID NO: 48217 - protein, 473 aa, Bacillus cereus; identical to SEQ ID NO: 1888

SEQ ID NO: 48218 - DNA, 1458 bp, Mycobacterium paratuberculosis; identical to SEQ ID NO: 1889
  CDS (1)..(1458)

SEQ ID NO: 48219 - protein, 485 aa, Mycobacterium paratuberculosis; identical to SEQ ID NO: 1890

SEQ ID NO: 48220 - DNA, 2853 bp, Mycobacterium paratuberculosis; identical to SEQ ID NO: 1891
  CDS (1)..(2853)

SEQ ID NO: 48221 - protein, 950 aa, Mycobacterium paratuberculosis; identical to SEQ ID NO: 1892

SEQ ID NO: 48222 - DNA, 2100 bp, Lactobacillus johnsonii; identical to SEQ ID NO: 1893
  CDS (1)..(2100)

SEQ ID NO: 48223 - protein, 699 aa, Lactobacillus johnsonii; identical to SEQ ID NO: 1894

SEQ ID NO: 48224 - DNA, 3625 bp, Vibrio parahaemolyticus; identical to SEQ ID NO: 1895
  CDS (1451)..(3625)

SEQ ID NO: 48225 - protein, 724 aa, Vibrio parahaemolyticus; identical to SEQ ID NO: 1896

SEQ ID NO: 48226 - DNA, 2142 bp, Shigella flexneri; identical to SEQ ID NO: 1897
  CDS (1)..(2142)

SEQ ID NO: 48227 - protein, 713 aa, Shigella flexneri; identical to SEQ ID NO: 1898

SEQ ID NO: 48228 - DNA, 2181 bp, Vibrio vulnificus; identical to SEQ ID NO: 1899
  CDS (1)..(2181)

SEQ ID NO: 48229 - protein, 726 aa, Vibrio vulnificus; identical to SEQ ID NO: 1900

SEQ ID NO: 48230 - DNA, 2307 bp, Photorhabdus luminescens; identical to SEQ ID NO: 1901
  CDS (1)..(2307)

SEQ ID NO: 48231 - protein, 768 aa, Photorhabdus luminescens; identical to SEQ ID NO: 1902

SEQ ID NO: 48232 - DNA, 1404 bp, Gloeobacter violaceus; identical to SEQ ID NO: 1903
  CDS (1)..(1404)

SEQ ID NO: 48233 - protein, 467 aa, Gloeobacter violaceus; identical to SEQ ID NO: 1904

SEQ ID NO: 48234 - DNA, 2259 bp, Chromobacterium violaceum; identical to SEQ ID NO: 1905
  CDS (1)..(2259)

SEQ ID NO: 48235 - protein, 752 aa, Chromobacterium violaceum; identical to SEQ ID NO: 1906

SEQ ID NO: 48236 - DNA, 1251 bp, Chromobacterium violaceum; identical to SEQ ID NO: 1907
  CDS (1)..(1251)

SEQ ID NO: 48237 - protein, 416 aa, Chromobacterium violaceum; identical to SEQ ID NO: 1908

SEQ ID NO: 48238 - DNA, 2352 bp, Fusobacterium nucleatum subsp; identical to SEQ ID NO: 1909
  CDS (1)..(2352)

SEQ ID NO: 48239 - protein, 783 aa, Fusobacterium nucleatum subsp; identical to SEQ ID NO: 1910

SEQ ID NO: 48240 - DNA, 2196 bp, Shigella flexneri; identical to SEQ ID NO: 1911
  CDS (1)..(2196)

SEQ ID NO: 48241 - protein, 731 aa, Shigella flexneri; identical to SEQ ID NO: 1912

SEQ ID NO: 48242 - DNA, 2271 bp, Bordetella pertussis; identical to SEQ ID NO: 1913
  CDS (1)..(2271)

SEQ ID NO: 48243 - protein, 756 aa, Bordetella pertussis; identical to SEQ ID NO: 1914

SEQ ID NO: 48244 - DNA, 2271 bp, Bordetella parapertussis; identical to SEQ ID NO: 1915
  CDS (1)..(2271)

SEQ ID NO: 48245 - protein, 756 aa, Bordetella parapertussis; identical to SEQ ID NO: 1916

SEQ ID NO: 48246 - DNA, 1422 bp, Bacillus cereus; identical to SEQ ID NO: 1917
  CDS (1)..(1422)

SEQ ID NO: 48247 - protein, 473 aa, Bacillus cereus; identical to SEQ ID NO: 1918

SEQ ID NO: 48248 - DNA, 1422 bp, Bacillus anthracis; identical to SEQ ID NO: 1919
  CDS (1)..(1422)

SEQ ID NO: 48249 - protein, 473 aa, Bacillus anthracis; identical to SEQ ID NO: 1920

SEQ ID NO: 48250 - DNA, 2271 bp, Shigella flexneri; identical to SEQ ID NO: 1921
  CDS (1)..(2271)

SEQ ID NO: 48251 - protein, 756 aa, Shigella flexneri; identical to SEQ ID NO: 1922

SEQ ID NO: 48252 - DNA, 2136 bp, Shigella flexneri; identical to SEQ ID NO: 1923
  CDS (1)..(2136)

SEQ ID NO: 48253 - protein, 711 aa, Shigella flexneri; identical to SEQ ID NO: 1924

SEQ ID NO: 48254 - DNA, 2127 bp, Escherichia coli; identical to SEQ ID NO: 1925
  CDS (1)..(2127)

SEQ ID NO: 48255 - protein, 708 aa, Escherichia coli; identical to SEQ ID NO: 1926

SEQ ID NO: 48256 - DNA, 1563 bp, Oryza sativa; identical to SEQ ID NO: 1927
  CDS (1)..(1563)

SEQ ID NO: 48257 - protein, 520 aa, Oryza sativa; identical to SEQ ID NO: 1928

SEQ ID NO: 48258 - DNA, 2181 bp, Vibrio parahaemolyticus; identical to SEQ ID NO: 1929
  CDS (1)..(2181)

SEQ ID NO: 48259 - protein, 726 aa, Vibrio parahaemolyticus; identical to SEQ ID NO: 1930

SEQ ID NO: 48260 - DNA, 4026 bp, Vibrio parahaemolyticus; identical to SEQ ID NO: 1931
  CDS (1779)..(3914)

SEQ ID NO: 48261 - protein, 711 aa, Vibrio parahaemolyticus; identical to SEQ ID NO: 1932

SEQ ID NO: 48262 - DNA, 1461 bp, Clostridium tetani; identical to SEQ ID NO: 1933
  CDS (1)..(1461)

SEQ ID NO: 48263 - protein, 486 aa, Clostridium tetani; identical to SEQ ID NO: 1934

SEQ ID NO: 48264 - DNA, 1416 bp, Clostridium tetani; identical to SEQ ID NO: 1935
  CDS (1)..(1416)

SEQ ID NO: 48265 - protein, 471 aa, Clostridium tetani; identical to SEQ ID NO: 1936

SEQ ID NO: 48266 - DNA, 2766 bp, Bradyrhizobium japonicum; identical to SEQ ID NO: 1937
  CDS (1)..(2766)

SEQ ID NO: 48267 - protein, 921 aa, Bradyrhizobium japonicum; identical to SEQ ID NO: 1938

SEQ ID NO: 48268 - DNA, 2517 bp, Bradyrhizobium japonicum; identical to SEQ ID NO: 1939
  CDS (1)..(2517)

SEQ ID NO: 48269 - protein, 838 aa, Bradyrhizobium japonicum; identical to SEQ ID NO: 1940

SEQ ID NO: 48270 - DNA, 2181 bp, Vibrio vulnificus; identical to SEQ ID NO: 1941
  CDS (1)..(2181)

SEQ ID NO: 48271 - protein, 726 aa, Vibrio vulnificus; identical to SEQ ID NO: 1942

SEQ ID NO: 48272 - DNA, 2109 bp, Vibrio vulnificus; identical to SEQ ID NO: 1943
  CDS (1)..(2109)

SEQ ID NO: 48273 - protein, 702 aa, Vibrio vulnificus; identical to SEQ ID NO: 1944

SEQ ID NO: 48274 - DNA, 2163 bp, Shewanella oneidensis; identical to SEQ ID NO: 1945
  CDS (1)..(2163)

SEQ ID NO: 48275 - protein, 720 aa, Shewanella oneidensis; identical to SEQ ID NO: 1946

SEQ ID NO: 48276 - DNA, 1419 bp, Oceanobacillus iheyensis; identical to SEQ ID NO: 1947
  CDS (1)..(1419)

SEQ ID NO: 48277 - protein, 472 aa, Oceanobacillus iheyensis; identical to SEQ ID NO: 1948

SEQ ID NO: 48278 - DNA, 2154 bp, Escherichia coli O6; identical to SEQ ID NO: 1949
  CDS (1)..(2154)

SEQ ID NO: 48279 - protein, 717 aa, Escherichia coli O6; identical to SEQ ID NO: 1950

SEQ ID NO: 48280 - DNA, 2271 bp, Escherichia coli O6; identical to SEQ ID NO: 1951
  CDS (1)..(2271)

SEQ ID NO: 48281 - protein, 756 aa, Escherichia coli O6; identical to SEQ ID NO: 1952

SEQ ID NO: 48282 - DNA, 2370 bp, Escherichia coli O6; identical to SEQ ID NO: 1953
  CDS (1)..(2370)

SEQ ID NO: 48283 - protein, 789 aa, Escherichia coli O6; identical to SEQ ID NO: 1954

SEQ ID NO: 48284 - DNA, 2136 bp, Escherichia coli O6; identical to SEQ ID NO: 1955
  CDS (1)..(2136)

SEQ ID NO: 48285 - protein, 711 aa, Escherichia coli O6; identical to SEQ ID NO: 1956

SEQ ID NO: 48286 - DNA, 2208 bp, Escherichia coli O6; identical to SEQ ID NO: 1957
  CDS (1)..(2208)

SEQ ID NO: 48287 - protein, 735 aa, Escherichia coli O6; identical to SEQ ID NO: 1958

SEQ ID NO: 48288 - DNA, 2142 bp, Escherichia coli O6; identical to SEQ ID NO: 1959
  CDS (1)..(2142)

SEQ ID NO: 48289 - protein, 713 aa, Escherichia coli O6; identical to SEQ ID NO: 1960

SEQ ID NO: 48290 - DNA, 1488 bp, Thermoanaerobacter tengcongensis; identical to SEQ ID NO: 1961
  CDS (1)..(1488)

SEQ ID NO: 48291 - protein, 495 aa, Thermoanaerobacter tengcongensis; identical to SEQ ID NO: 1962

SEQ ID NO: 48292 - DNA, 1419 bp, Thermoanaerobacter tengcongensis; identical to SEQ ID NO: 1963
  CDS (1)..(1419)

SEQ ID NO: 48293 - protein, 472 aa, Thermoanaerobacter tengcongensis; identical to SEQ ID NO: 1964

SEQ ID NO: 48294 - DNA, 2352 bp, Fusobacterium nucleatum; identical to SEQ ID NO: 1965
  CDS (1)..(2352)

SEQ ID NO: 48295 - protein, 783 aa, Fusobacterium nucleatum; identical to SEQ ID NO: 1966

SEQ ID NO: 48296 - DNA, 1431 bp, Clostridium perfringens; identical to SEQ ID NO: 1967
  CDS (1)..(1431)

SEQ ID NO: 48297 - protein, 476 aa, Clostridium perfringens; identical to SEQ ID NO: 1968

SEQ ID NO: 48298 - DNA, 1455 bp, Clostridium perfringens; identical to SEQ ID NO: 1969
  CDS (1)..(1455)

SEQ ID NO: 48299 - protein, 484 aa, Clostridium perfringens; identical to SEQ ID NO: 1970

SEQ ID NO: 48300 - DNA, 2280 bp, Ralstonia solanacearum; identical to SEQ ID NO: 1971
  CDS (1)..(2280)

SEQ ID NO: 48301 - protein, 759 aa, Ralstonia solanacearum; identical to SEQ ID NO: 1972

SEQ ID NO: 48302 - DNA, 2271 bp, Salmonella typhimurium; identical to SEQ ID NO: 1973
  CDS (1)..(2271)

SEQ ID NO: 48303 - protein, 756 aa, Salmonella typhimurium; identical to SEQ ID NO: 1974

SEQ ID NO: 48304 - DNA, 2136 bp, Salmonella typhimurium; identical to SEQ ID NO: 1975
  CDS (1)..(2136)

SEQ ID NO: 48305 - protein, 711 aa, Salmonella typhimurium; identical to SEQ ID NO: 1976

SEQ ID NO: 48306 - DNA, 2199 bp, Salmonella typhimurium; identical to SEQ ID NO: 1977
  CDS (1)..(2199)

SEQ ID NO: 48307 - protein, 732 aa, Salmonella typhimurium; identical to SEQ ID NO: 1978

SEQ ID NO: 48308 - DNA, 2142 bp, Salmonella typhimurium; identical to SEQ ID NO: 1979
  CDS (1)..(2142)

SEQ ID NO: 48309 - protein, 713 aa, Salmonella typhimurium; identical to SEQ ID NO: 1980

SEQ ID NO: 48310 - DNA, 2136 bp, Vibrio vulnificus; identical to SEQ ID NO: 1981
  CDS (1)..(2136)

SEQ ID NO: 48311 - protein, 711 aa, Vibrio vulnificus; identical to SEQ ID NO: 1982

SEQ ID NO: 48312 - DNA, 2163 bp, Pasteurella multocida; identical to SEQ ID NO: 1983
  CDS (1)..(2163)

SEQ ID NO: 48313 - protein, 720 aa, Pasteurella multocida; identical to SEQ ID NO: 1984

SEQ ID NO: 48314 - DNA, 2139 bp, Moritella japonica; identical to SEQ ID NO: 1985
  CDS (1)..(2139)

SEQ ID NO: 48315 - protein, 712 aa, Moritella japonica; identical to SEQ ID NO: 1986

SEQ ID NO: 48316 - DNA, 1479 bp, Streptomyces coelicolor; identical to SEQ ID NO: 1987
  CDS (1)..(1479)

SEQ ID NO: 48317 - protein, 492 aa, Streptomyces coelicolor; identical to SEQ ID NO: 1988

SEQ ID NO: 48318 - DNA, 2130 bp, Eikenella corrodens; identical to SEQ ID NO: 1989
  CDS (1)..(2130)

SEQ ID NO: 48319 - protein, 709 aa, Eikenella corrodens; identical to SEQ ID NO: 1990

SEQ ID NO: 48320 - DNA, 2271 bp, Escherichia coli; identical to SEQ ID NO: 1859
  CDS (4)..(2271)

SEQ ID NO: 48321 - protein, 755 aa, Escherichia coli; identical to SEQ ID NO: 1992

SEQ ID NO: 48322 - DNA, 2196 bp, Lactobacillus sp; identical to SEQ ID NO: 1993
  CDS (1)..(2196)

SEQ ID NO: 48323 - protein, 731 aa, Lactobacillus sp; identical to SEQ ID NO: 1814

SEQ ID NO: 48324 - DNA, 1482 bp, Bacillus anthracis; identical to SEQ ID NO: 1995
  CDS (1)..(1482)

SEQ ID NO: 48325 - protein, 493 aa, Bacillus anthracis; identical to SEQ ID NO: 1996

SEQ ID NO: 48326 - DNA, 1383 bp, Bacillus cereus; identical to SEQ ID NO: 1997
  CDS (1)..(1383)

SEQ ID NO: 48327 - protein, 460 aa, Bacillus cereus; identical to SEQ ID NO: 1998

SEQ ID NO: 48328 - DNA, 20 bp, Artificial sequence
  (1)..(20): primer
atggggcagggttttccacc

SEQ ID NO: 48329 - DNA, 25 bp, Artificial sequence
  (1)..(25): primer
ttacttcaacacataaccgtacaac

SEQ ID NO: 48330 - protein, 642 aa, Artificial sequence; identical to SEQ ID NO: 2902
  Variant (2)..(5): xaa in position 2 to 5 is any amino acid
  Variant (7)..(58): xaa in position 7 to 58 is any amino acid
  Variant (60)..(61): xaa in position 60 to 61 is any amino acid
  Variant (63)..(66): xaa in position 63 to 66 is any amino acid
  Variant (68)..(71): xaa in position 68 to 71 is any amino acid
  Variant (73)..(76): xaa in position 73 to 76 is any amino acid
  Variant (78)..(90): xaa in position 78 to 90 is any amino acid
  Variant (92)..(92): xaa in position 92 is any amino acid
  Variant (94)..(113): xaa in position 94 to 113 is any amino acid
  Variant (116)..(116): xaa in position 116 is any amino acid
  Variant (120)..(131): xaa in position 120 to 131 is any amino acid
  Variant (133)..(188): xaa in position 133 to 188 is any amino acid
  Variant (191)..(191): xaa in position 191 is any amino acid
  Variant (193)..(215): xaa in position 193 to 215 is any amino acid
  Variant (217)..(217): xaa in position 217 is any amino acid
  Variant (219)..(224): xaa in position 219 to 224 is any amino acid
  Variant (226)..(290): xaa in position 226 to 290 is any amino acid
  Variant (292)..(292): xaa in position 292 is any amino acid
  Variant (295)..(300): xaa in position 295 to 300 is any amino acid
  Variant (302)..(302): xaa in position 302 is any amino acid
  Variant (304)..(305): xaa in position 304 to 305 is any amino acid
  Variant (307)..(333): xaa in position 307 to 333 is any amino acid
  Variant (337)..(337): xaa in position 337 is any amino acid
  Variant (339)..(341): xaa in position 339 to 341 is any amino acid
  Variant (343)..(355): xaa in position 343 to 355 is any amino acid
  Variant (357)..(370): xaa in position 357 to 370 is any amino acid
  Variant (372)..(457): xaa in position 372 to 457 is any amino acid
  Variant (460)..(460): xaa in position 460 is any amino acid
  Variant (462)..(494): xaa in position 462 to 494 is any amino acid
  Variant (496)..(497): xaa in position 496 to 497 is any amino acid
  Variant (499)..(505): xaa in position 499 to 505 is any amino acid
  Variant (507)..(520): xaa in position 507 to 520 is any amino acid
  Variant (522)..(524): xaa in position 522 to 524 is any amino acid
  Variant (526)..(620): xaa in position 526 to 620 is any amino acid
  Variant (622)..(624): xaa in position 622 to 624 is any amino acid
  Variant (626)..(630): xaa in position 626 to 630 is any amino acid
  Variant (635)..(640): xaa in position 635 to 640 is any amino acid

SEQ ID NO: 48331 - protein, 101 aa, Artificial sequence; identical to SEQ ID NO: 1322
  Variant (2)..(23): xaa in position 2 to 23 is any amino acid
  Variant (24)..(30): xaa in position 24 to 30 is any or no amino acid
  Variant (32)..(32): xaa in position 32 is any amino acid
  Variant (37)..(39): xaa in position 37 to 39 is any amino acid
  Variant (41)..(55): xaa in position 41 to 55 is any amino acid
  Variant (56)..(57): xaa in position 56 to 57 is any or no amino acid
  Variant (59)..(62): xaa in position 59 to 62 is any amino acid
  Variant (64)..(64): xaa in position 64 is any amino acid
  Variant (67)..(70): xaa in position 67 to 70 is any amino acid
  Variant (72)..(72): xaa in position 72 is any amino acid
  Variant (75)..(77): xaa in position 75 to 77 is any amino acid
  Variant (79)..(85): xaa in position 79 to 85 is any amino acid
  Variant (87)..(90): xaa in position 87 to 90 is any amino acid
  Variant (92)..(93): xaa in position 92 to 93 is any amino acid
  Variant (97)..(97): xaa in position 97 is any amino acid
  Variant (100)..(100): xaa in position 100 is any amino acid

SEQ ID NO: 48332 - protein, 76 aa, Artificial sequence; identical to SEQ ID NO: 2897
  Variant (1)..(1): xaa in position 1 is Leu, Met or Val
  Variant (2)..(2): xaa in position 2 is Gly or Asp
  Variant (3)..(3): xaa in position 3 is Asp, Ser, Asn, Gln or Gly
  Variant (4)..(4): xaa in position 4 is Leu or Arg
  Variant (5)..(6): xaa in position 5 to 6 is any amino acid
  Variant (7)..(7): xaa in position 7 is His or Pro
  Variant (8)..(8): xaa in position 8 is any amino acid
  Variant (9)..(9): xaa in position 9 is Gly, Ser, Glu or Asp
  Variant (10)..(13): xaa in position 10 to 13 is any amino acid
  Variant (14)..(14): xaa in position 14 is Ala or Ser
  Variant (15)..(15): xaa in position 15 is Gln, Glu or Met
  Variant (16)..(18): xaa in position 16 to 18 is any amino acid
  Variant (19)..(19): xaa in position 19 is Ala or Ser
  Variant (20)..(21): xaa in position 20 to 21 is any amino acid
  Variant (22)..(22): xaa in position 22 is Phe, Tyr, Trp or Val
  Variant (23)..(23): xaa in position 23 is any amino acid
  Variant (24)..(24): xaa in position 24 is Ala, Ser or Val
  Variant (25)..(27): xaa in position 25 to 27 is any amino acid
  Variant (28)..(28): xaa in position 28 is Tyr, Phe or Trp
  Variant (29)..(30): xaa in position 29 to 30 is any amino acid
  Variant (31)..(31): xaa in position 31 is Val, Thr, Leu or Ile
  Variant (32)..(32): xaa in position 32 is any amino acid
  Variant (34)..(34): xaa in position 34 is Thr or Ser
  Variant (35)..(35): xaa in position 35 is Ser or Thr
  Variant (36)..(36): xaa in position 36 is any amino acid
  Variant (37)..(37): xaa in position 37 is Ser, Ala or Gly
  Variant (38)..(38): xaa in position 38 is Asn, Ile, Val or Ser
  Variant (39)..(51): xaa in position 39 to 51 is any amino acid
  Variant (52)..(52): xaa in position 52 is Val, Ile, Leu or Ala
  Variant (53)..(53): xaa in position 53 is Leu, Ile, Val or Met
  Variant (54)..(55): xaa in position 54 to 55 is any amino acid
  Variant (57)..(57): xaa in position 57 is Asn or Asp
  Variant (58)..(58): xaa in position 58 is any amino acid
  Variant (60)..(60): xaa in position 60 is Lys, Gln or Arg
  Variant (61)..(61): xaa in position 61 is Ser or Ala
  Variant (62)..(65): xaa in position 62 to 65 is any amino acid
  Variant (66)..(66): xaa in position 66 is any or no amino acid
  Variant (67)..(67): xaa in position 67 is Leu, Ile, Met or Val
  Variant (68)..(73): xaa in position 68 to 73 is any amino acid
  Variant (74)..(74): xaa in position 74 is Pro or Ala
  Variant (75)..(75): xaa in position 75 is any amino acid
  Variant (76)..(76): xaa in position 76 is Tyr, Phe or Trp

SEQ ID NO: 48333 - protein, 39 aa, Artificial sequence; identical to SEQ ID NO: 2898
  Variant (1)..(1): xaa in position 1 is Val, Ile, Leu, Phe or Thr
  Variant (2)..(2): xaa in position 2 is Ile, Val, Leu, Phe or Ala
  Variant (3)..(5): xaa in position 3 to 5 is any amino acid
  Variant (6)..(6): xaa in position 6 is Thr, Asn or Ser
  Variant (7)..(7): xaa in position 7 is Tyr, Phe or Pro
  Variant (8)..(8): xaa in position 8 is Asp, Tyr, Phe or His
  Variant (10)..(12): xaa in position 10 to 12 is any amino acid
  Variant (13)..(13): xaa in position 13 is Asn, Asp or Ser
  Variant (14)..(25): xaa in position 14 to 25 is any amino acid
  Variant (26)..(29): xaa in position 26 to 29 is any or no amino acid
  Variant (30)..(30): xaa in position 30 is Ile, Val, Leu or Phe
  Variant (31)..(31): xaa in position 31 is any amino acid
  Variant (32)..(32): xaa in position 32 is Phe, Val, Trp or Ile
  Variant (34)..(34): xaa in position 34 is Glu, Ser or Cys
  Variant (36)..(36): xaa in position 36 is Trp or His
  Variant (37)..(37): xaa in position 37 is any amino acid
  Variant (38)..(38): xaa in position 38 is Ala, Gly, Pro or Val
  Variant (39)..(39): xaa in position 39 is Tyr, His or Phe

SEQ ID NO: 48334 - protein, 84 aa, Artificial sequence; identical to SEQ ID NO: 2899
  Variant (1)..(1): xaa in position 1 is Ser or Leu
  Variant (2)..(2): xaa in position 2 is any amino acid
  Variant (5)..(7): xaa in position 5 to 7 is any amino acid
  Variant (8)..(8): xaa in position 8 is Ala, Gly or Ser
  Variant (9)..(9): xaa in position 9 is Leu, Phe, Met or Ile
  Variant (10)..(10): xaa in position 10 is Ser, Thr, Arg or Glu
  Variant (11)..(11): xaa in position 11 is Gln or Met
  Variant (12)..(12): xaa in position 12 is any amino acid
  Variant (13)..(13): xaa in position 13 is Ser or Ala
  Variant (14)..(14): xaa in position 14 is any amino acid
  Variant (15)..(15): xaa in position 15 is Ile, Leu, Met, Val or Phe
  Variant (16)..(16): xaa in position 16 is His, Asn, Leu or Ile
  Variant (17)..(25): xaa in position 17 to 25 is any amino acid
  Variant (26)..(33): xaa in position 26 to 33 is any or no amino acid
  Variant (34)..(34): xaa in position 34 is Phe, Val, Leu, Met or Ile
  Variant (35)..(42): xaa in position 35 to 42 is any amino acid
  Variant (43)..(43): xaa in position 43 is Ser or Thr
  Variant (44)..(44): xaa in position 44 is Thr or Ser
  Variant (46)..(47): xaa in position 46 to 47 is any amino acid
  Variant (48)..(48): xaa in position 48 is Tyr, Gln or Val
  Variant (49)..(49): xaa in position 49 is any amino acid
  Variant (50)..(50): xaa in position 50 is Leu, Ile, Phe or Met
  Variant (51)..(51): xaa in position 51 is any amino acid
  Variant (52)..(52): xaa in position 52 is Ala or Ser
  Variant (53)..(53): xaa in position 53 is Ser, Ala or Thr
  Variant (54)..(54): xaa in position 54 is any amino acid
  Variant (55)..(55): xaa in position 55 is Asp or Glu
  Variant (56)..(63): xaa in position 56 to 63 is any amino acid
  Variant (64)..(65): xaa in position 64 to 65 is any or no amino acid
  Variant (66)..(66): xaa in position 66 is Gly, Ala, Lys or Asn
  Variant (67)..(73): xaa in position 67 to 73 is any amino acid
  Variant (74)..(74): xaa in position 74 is Ile, Val, Leu, Tyr or Phe
  Variant (75)..(80): xaa in position 75 to 80 is any amino acid
  Variant (81)..(81): xaa in position 81 is Arg or Lys
  Variant (82)..(83): xaa in position 82 to 83 is any amino acid
  Variant (84)..(84): xaa in position 84 is Ile, Leu, Val, Met, Phe, Ala or Thr

SEQ ID NO: 48335 - protein, 31 aa, Artificial sequence; identical to SEQ ID NO: 2900
  Variant (1)..(1): xaa in position 1 is Val, Ile, Leu, Cys or Arg
  Variant (2)..(5): xaa in position 2 to 5 is any amino acid
  Variant (6)..(9): xaa in position 6 to 9 is any or no amino acid
  Variant (10)..(10): xaa in position 10 is Gly, Thr, Asp or Asn
  Variant (11)..(11): xaa in position 11 is any amino acid
  Variant (12)..(12): xaa in position 12 is Ile, Val or Thr
  Variant (13)..(13): xaa in position 13 is any amino acid
  Variant (14)..(14): xaa in position 14 is Ala, Gly, Thr or Leu
  Variant (15)..(16): xaa in position 15 to 16 is any amino acid
  Variant (17)..(17): xaa in position 17 is Val, Ile, Ala, Leu or Phe
  Variant (18)..(19): xaa in position 18 to 19 is any amino acid
  Variant (24)..(24): xaa in position 24 is Ile, Val or Phe
  Variant (25)..(26): xaa in position 25 to 26 is any amino acid
  Variant (27)..(27): xaa in position 27 is Val, Leu, Ile, Phe or Met
  Variant (28)..(29): xaa in position 28 to 29 is any amino acid
  Variant (31)..(31): xaa in position 31 is Glu or Gln

SEQ ID NO: 48336 - DNA, 609 bp, Escherichia coli
  CDS (1)..(609)
atgcgattgttgcgtttttgttgcgtattagatcacttaatttgctttacatctcccgtaaacacttttctgcgatacaatgcctttacgttatgtaacggagagttcggcatgtcacaccccgcgttaacgcaactgcgtgcgctgcgctattgtaaagagatccctgccctggatccgcaactgctcgactggctgttgctggaggattccatgacaaaacgttttgaacagcagggaaaaacggtaagcgtgacgatgatccgcgaagggtttgtcgagcagaatgaaatccccgaagaactgccgctgctgccgaaagagtctcgttactggttacgtgaaattttgttatgtgccgatggtgaaccgtggcttgccggtcgtaccgtcgttcctgtgtcaacgttaagcgggccggagctggcgttacaaaaattgggtaaaacgccgttaggacgctatctgttcacatcatcgacattaacccgggactttattgagataggccgtgatgccgggctgtgggggcgacgttcccgcctgcgattaagcggtaaaccgctgttgctaacagaactgtttttaccggcgtcaccgttgtactaa

SEQ ID NO: 48337 - protein, 202 aa, Escherichia coli
MRLLRFCCVLDHLICFTSPVNTFLRYNAFTLCNGEFGMSHPALTQLRALRYCKEIPALDPQLLDWLLLEDSMTKRFEQQGKTVSVTMIREGFVEQNEIPEELPLLPKESRYWLREILLCADGEPWLAGRTVVPVSTLSGPELALQKLGKTPLGRYLFTSSTLTRDFIEIGRDAGLWGRRSRLRLSGKPLLLTELFLPASPLY

SEQ ID NO: 48338 - DNA, 552 bp, Vibrio cholerae O1 biovar eltor str. N16961
  CDS (1)..(552): transl_table=11
ttgaataatagtatgaatcaattaacttcgctctatttagccgcactgaatcgcgtcacttggcaacagcctgatgacattgaatttccagcccctttagctcagcaatggctactcgaacaaggctctctttcgcgccgaatggcgacgcagtgtgagcatctgaccgtagatttattaagtaaccaaatcatgctggcggacaccctgagctatgatgaaactcaactgctcgcctctgaagagtatcttctacgccaagtgattatttatggcgaccaacaaccttgggtatttggccatactttgatccctcgctcatccatgcacaatcagccgtttgatttcacccaacaagggaaaattccactaggtctcaccgtatttagtgcggataatgttaagcgagatgcactgcaagttggctgggtagagacagaactcggacgactattagcccgtcgctctcgcttatggatgaacaacaaacccatgttagtgacggagctgtttctcgccacatccccgatttactctaaggagagagtgtaa

SEQ ID NO: 48339 - protein, 183 aa, Vibrio cholerae O1 biovar eltor str. N16961
MNNSMNQLTSLYLAALNRVTWQQPDDIEFPAPLAQQWLLEQGSLSRRMATQCEHLTVDLLSNQIMLADTLSYDETQLLASEEYLLRQVIIYGDQQPWVFGHTLIPRSSMHNQPFDFTQQGKIPLGLTVFSADNVKRDALQVGWVETELGRLLARRSRLWMNNKPMLVTELFLATSPIYSKERV

SEQ ID NO: 48340 - DNA, 513 bp, Pasteurella multocida subsp. multocida str. Pm70
  CDS (1)..(513): transl_table=11
atgtctaattattcccaattgttacaaaatgccacttggcagccttcaacggatatgcaattacctctgtcgatttcttcttggctagagctatccacatctttaactacacagctaaaacaagcttttggcgaagtgaatgtatgtgtcttagccgagtcatggataacgacgcttaacgagaatgaacgtcaattttttccaaaacaagcatgtccgtgttggtgtcgagaagtgatcttaaaaagccaagatataccattaatttttgcgcgtactttaattccggcttctttattgacgcagcatagtgaattacaacaattgggcaatcgtgcgttaggtgagtggctgtttatgcaatctgatcgtataaggcaaaaattagaattaacgcatgataaaaacaccgcactttatgcccgccgtgccttaatgagtattggcgctgagaatatgatggttgctgaattatttctaacaccacaaatttttacgagagtagtcaaatga

SEQ ID NO: 48341 - protein, 170 aa, Pasteurella multocida subsp. multocida str. Pm70
MSNYSQLLQNATWQPSTDMQLPLSISSWLELSTSLTTQLKQAFGEVNVCVLAESWITTLNENERQFFPKQACPCWCREVILKSQDIPLIFARTLIPASLLTQHSELQQLGNRALGEWLFMQSDRIRQKLELTHDKNTALYARRALMSIGAENMMVAELFLTPQIFTRVVK

SEQ ID NO: 48342 - DNA, 537 bp, Pseudomonas aeruginosa PAO1
  CDS (1)..(537): transl_table=11
atgcccagcaatgcgctctggcttcgcgccgaccaactgtccagcgtctcccccgccgtcctcgactggctgttcgacgaggggtcgctgacccggcgcctgaccgccctggccgacggcgcgttccgcgtcgaacccctgctggaaggctggcagaccctgcgcgacgacgaatgccaggggctcgacgtccctaccggcagtagcggctgggtccgcgaggtctacctgcatggccacgaccgtccctgggtgttcgcccgcagcgtggcggcgcgcagcgccctggaaggctcgggcttcgacctggcgctgctcggcacccgctcgctgggcgagttgctgttcagcgacagcgccttcgagcgcgggcccatcgaagtctgccgctatccggcggccggtctgcccgccgaggtccgcgccgagggtctctggggccgtcgctcacggttttcccgcggcgcgctcggggtgctggtggcggaggtgtacctaccgcgcctgtgggaccaggcgggaatcgccgacgtataa

SEQ ID NO: 48343 - protein, 178 aa, Pseudomonas aeruginosa PAO1
MPSNALWLRADQLSSVSPAVLDWLFDEGSLTRRLTALADGAFRVEPLLEGWQTLRDDECQGLDVPTGSSGWVREVYLHGHDRPWVFARSVAARSALEGSGFDLALLGTRSLGELLFSDSAFERGPIEVCRYPAAGLPAEVRAEGLWGRRSRFSRGALGVLVAEVYLPRLWDQAGIADV

SEQ ID NO: 48344 - DNA, 498 bp, Escherichia coli O157:H7
  CDS (1)..(498): transl_table=11
atgtcacaccccgcgttaacgcaactgcgtgcgctgcgctattgtaaagagatccctgccctggagccgcaactgctcgactggctgttgctggaagattccatgacaaaacgttttgaacagcagggaaaaacggtgagcgtgacgatgatccgcgaagggtttgtcgagcagaatgaaatccccgaagaactgccgctgctgccgaaagagtctcgttactggttacgtgaaattttgttatgtgccgatggtgaaccgtggcttgccggtcgtaccgtcgttcctgtgtcaacgttaagcgggccggagctggcgttacaaaaattgggtaaaacgccgttaggacgctatctgttcacatcatcgacattaacccgggactttattgagataggccgtgatgccggactgtgggggcgacgttcccgcttgcgattaagcggtaaaccgctgttgctaacagaactgtttttaccgacgtcaccgttgtactaa

SEQ ID NO: 48345 - protein, 165 aa, Escherichia coli O157:H7
MSHPALTQLRALRYCKEIPALEPQLLDWLLLEDSMTKRFEQQGKTVSVTMIREGFVEQNEIPEELPLLPKESRYWLREILLCADGEPWLAGRTVVPVSTLSGPELALQKLGKTPLGRYLFTSSTLTRDFIEIGRDAGLWGRRSRLRLSGKPLLLTELFLPTSPLY

SEQ ID NO: 48346 - DNA, 525 bp, Yersinia pestis CO92
  CDS (1)..(525): transl_table=11
atgtttatcggcgatgcatcaattttaaaacctatccaatggtgtgctaccgagcaccctgaacttcctgcagacatcgcagactggctgatggagctgggttcgatgactcgacgctttgagcagcattgccagcgtgttcatgtcgaaccgcaacgtgaatgctttattacgcgtgatgcgctaggggaagaggctgaacatttgcccgttagtcaacgctattggttacgggaaattgtcttgtttggtgacaatgtgccttggttactggggcgcacggttatcccggaggagacactgtctggtccggatagggcgctggtggatttaggtacattaccgctagggcgttacttattcagtggtgatgccctaacccgggactatattcacgtcgggcggcaggataatctatgggccaggcggtctttgctacgcctttcaggcaatccactgttattgactgaggtttttttaccggcatcgccgctttatacccattgtgactctatacccaagtga

SEQ ID NO: 48347 - protein, 174 aa, Yersinia pestis CO92
MFIGDASILKPIQWCATEHPELPADIADWLMELGSMTRRFEQHCQRVHVEPQRECFITRDALGEEAEHLPVSQRYWLREIVLFGDNVPWLLGRTVIPEETLSGPDRALVDLGTLPLGRYLFSGDALTRDYIHVGRQDNLWARRSLLRLSGNPLLLTEVFLPASPLYTHCDSIPK

SEQ ID NO: 48348 - DNA, 498 bp, Salmonella typhimurium LT2
  CDS (1)..(498): transl_table=11
atgtcacaccctgcgttaacgcaactgcgtgcgctgcgctattttgatgcgattcctgcgcttgaaccccatttgctggactggctgttgctggaagattctatgactaaacgttttgagcagcagggaaagcgggtaagcgtgacgctgattcgggaagcgtttgtcggccaaagtgaggtcgaggaagcatcaggtttactgccatccgagtcccgctactggttacgtgagatactgctttgcgctgacggcgagccctggcttgccggacgtaccgtggtaccggaatccacgctgtgcggacctgaacaggtcttacaacatctgggtaaaaccccgcttggacgttatctatttacatcatcgacactgacccgcgattttattgaaattggacgcgatgcaacgctgtgggggcgccgctctcgactgcggttgagcggaaaaccgctgttgcttaccgagctttttttacctgcatcgccgctgtactga

SEQ ID NO: 48349 - protein, 165 aa, Salmonella typhimurium LT2
MSHPALTQLRALRYFDAIPALEPHLLDWLLLEDSMTKRFEQQGKRVSVTLIREAFVGQSEVEEASGLLPSESRYWLREILLCADGEPWLAGRTVVPESTLCGPEQVLQHLGKTPLGRYLFTSSTLTRDFIEIGRDATLWGRRSRLRLSGKPLLLTELFLPASPLY

SEQ ID NO: 48350 - DNA, 531 bp, Ralstonia solanacearum GMI1000
  CDS (1)..(531): transl_table=11
atggccgtgtatggccagcattgggcgcgctgggcggtcggcgtgaattcactgacggcacggctgcgtgcggcatcgtcttcgtttcgtgtcgaactgctcggccaggggcgagccctgccgctgcgcgacgagtggcggtgcctgggcttgccccgcgccgccgagacgctggcgcgcgaggtgctgctgatctgcgacgaggcgccggtggtctacgcgcatacgatcgtgcatccgcgcagcgtggcggcggactggccgttcctgagggcgctcggcactcagccgctcgggcatgcgctgttcgccgacccgcgcgttgcccggggggccttcgaattcgccctgctggatggccggcatccgctggtcaaacgggcccacgcagcgctgggcggcacgccgccgggcgccatggcgcggctgccggcgcgccgttcagtgttccgccgcggcgttagcgcgatgctggtgacggaagtgttcttgccggcactggcggtgttcgacccgccgcccatgatgtga

SEQ ID NO: 48351 - protein, 176 aa, Ralstonia solanacearum GMI1000
MAVYGQHWARWAVGVNSLTARLRAASSSFRVELLGQGRALPLRDEWRCLGLPRAAETLAREVLLICDEAPVVYAHTIVHPRSVAADWPFLRALGTQPLGHALFADPRVARGAFEFALLDGRHPLVKRAHAALGGTPPGAMARLPARRSVFRRGVSAMLVTEVFLPALAVFDPPPMM

SEQ ID NO: 48352 - DNA, 567 bp, Yersinia pestis KIM
  CDS (1)..(567): transl_table=11
ttgcgggggtggctgttttatcctcggcagggagcgtttcgcatgtttatcggcgatgcatcaattttaaaacctatccaatggtgtgctaccgagcaccctgaacttcctgcagacatcgcagactggctgatggagctgggttcgatgactcgacgctttgagcagcattgccagcgtgttcatgtcgaaccgcaacgtgaatgctttattacgcgtgatgcgctaggggaagaggctgaacatttgcccgttagtcaacgctattggttacgggaaattgtcttgtttggtgacaatgtgccttggttactggggcgcacggttatcccggaggagacactgtctggtccggatagggcgctggtggatttaggtacattaccgctagggcgttacttattcagtggtgatgccctaacccgggactatattcacgtcgggcggcaggataatctatgggccaggcggtctttgctacgcctttcaggcaatccactgttattgactgaggtttttttaccggcatcgccgctttatacccattgtgactctatacccaagtga

SEQ ID NO: 48353 - protein, 188 aa, Yersinia pestis KIM
MRGWLFYPRQGAFRMFIGDASILKPIQWCATEHPELPADIADWLMELGSMTRRFEQHCQRVHVEPQRECFITRDALGEEAEHLPVSQRYWLREIVLFGDNVPWLLGRTVIPEETLSGPDRALVDLGTLPLGRYLFSGDALTRDYIHVGRQDNLWARRSLLRLSGNPLLLTEVFLPASPLYTHCDSIPK

SEQ ID NO: 48354 - DNA, 498 bp, Shigella flexneri 2a str. 301
  CDS (1)..(498): transl_table=11
atgtcacaccccgcgttaacgcaactgcgtgcgctgcgctattttaaagagatccctgccctggatccgcaactgctcgactggctgttgctggaggattccatgacaaaacgttttgaacagcagggaaaaacggtgagtgtgacgatgatccgcgaggggtttgtcgagcagaatgaaatccccgaagaactgccgctgctgccgaaagagtctcgttactggttacgtgaaattttgttatgtgccgatggtgaaccgtggcttgccggtcgtaccgtcgttcctgtatcaacattaagcgggccggaactagcgttacaaaaattgggtaaaacgccgttaggacgctatctgttcacatcatcgacactaacccgggattttatcgagataggccgtgatgccggactgtgggggcgacgttcccgcctgcgattaagcggtaaaccgctgttgctaacagaactgtttttaccggcgtcaccgttgtactaa

SEQ ID NO: 48355 - protein, 165 aa, Shigella flexneri 2a str. 301
MSHPALTQLRALRYFKEIPALDPQLLDWLLLEDSMTKRFEQQGKTVSVTMIREGFVEQNEIPEELPLLPKESRYWLREILLCADGEPWLAGRTVVPVSTLSGPELALQKLGKTPLGRYLFTSSTLTRDFIEIGRDAGLWGRRSRLRLSGKPLLLTELFLPASPLY

SEQ ID NO: 48356 - DNA, 570 bp, Shewanella oneidensis MR-1
  CDS (1)..(570): transl_table=11
atgaatgtgaccagcttaagctttccctatggcgaatcaattcaatggttttgtgccgacaacaccaaaaatcttcccgcttctccccttaaggaatggttactcgcccctggtagtctgacacaaaagctcaaaggctgctgtaatgagtttgaagtcagaatccttggtgaaggtcaatgcccgccgctcgacggcgaatatcccaatcaaagtgccgtttgggtgcgcgaagtcttactctgcctcgacgatgtgccttgggtatttgccagaaccttgatccctcagtctttgttatcgacacgccaagctgattttttaggcctaggaacacgaccactgggcgaattattatttagccaagatagttttgtgccgggacgcattgaaattgcccgctttgccaccaatagccgccttgcccacctagcgcaaagtttagcgcagaatgtagagcatgagctttgggggcgacgtcgatatttccaccacaacgaggaggaaatgtttgtcagtgaaatgttcctccctgccgccgaacaggcaatcgctaggctctgcccctaa

SEQ ID NO: 48357 - protein, 189 aa, Shewanella oneidensis MR-1
MNVTSLSFPYGESIQWFCADNTKNLPASPLKEWLLAPGSLTQKLKGCCNEFEVRILGEGQCPPLDGEYPNQSAVWVREVLLCLDDVPWVFARTLIPQSLLSTRQADFLGLGTRPLGELLFSQDSFVPGRIEIARFATNSRLAHLAQSLAQNVEHELWGRRRYFHHNEEEMFVSEMFLPAAEQAIARLCP

SEQ ID NO: 48358 - DNA, 558 bp, Pseudomonas putida KT2440
  CDS (1)..(558): transl_table=11
gtgtcgtacgaatccccgcaagcagccgctgtcgcgtggctgccgtattcacagctggcgaccgacatcgaccagcccacccttgactggctgttcgacgagggctcgctgacccgccgcctgacccgtctgtccattgatcacttttccgtcaccccgttgttcgagggctggcagccgctgcgcgatgacgaatgccaggcgctgggcatcgctgccggcgccgaaggctgggtgcgcgaagtgtatctgcgcggccatggccaaccttgggtattcgcccgcagcgtggccagccgcagcgccctggaacgtggtggcctggacctggaaaccttgggcagccgctcgctgggcgagctgctgttctgcgaccaggcgttcatccgtcatccactcgaagtgtgcacttatccacaggcctggctgccgtccgaagctgcacatgcggcgctttggggccgccgctcgcgcttcgagcgcaacggcctggacctgctggtggcagaagtgttcctgccggcattgtggcaagcggccaaggaggaaaaccgctga

SEQ ID NO: 48359 - protein, 185 aa, Pseudomonas putida KT2440
MSYESPQAAAVAWLPYSQLATDIDQPTLDWLFDEGSLTRRLTRLSIDHFSVTPLFEGWQPLRDDECQALGIAAGAEGWVREVYLRGHGQPWVFARSVASRSALERGGLDLETLGSRSLGELLFCDQAFIRHPLEVCTYPQAWLPSEAAHAALWGRRSRFERNGLDLLVAEVFLPALWQAAKEENR

SEQ ID NO: 48360 - DNA, 498 bp, Escherichia coli CFT073
  CDS (1)..(498): transl_table=11
atgtcacaccccgcgttaacgcaactgcgtgcgctgcgctattttacagagatccctgccctggagccgcaactgctcgactggctgttgctggaagattccatgacaaaacgttttgaacagcagggaaaaacggtgagcgtgacgatgatccgcgaagggtttgtcgagcagaatgaaatccccgaagaactgccactgctgccgaaagagtctcgttactggttacgtgaaattttgttatgtgccgatggtgaaccgtggcttgccggtcgtaccgtcgttcctgtgtcaacgttaagcgggccggagctggcgttacaaaaattaggtaaaacgccgttaggacgctatctgttcacatcatcgacattaacccgggactttattgagataggccgtgatgccggactgtgggggcgacgttcccgcctgcgattaagcggtaaaccgctgttgctaacagaactgtttttaccggcgtcaccgttgtactaa

SEQ ID NO: 48361 - protein, 165 aa, Escherichia coli CFT073
MSHPALTQLRALRYFTEIPALEPQLLDWLLLEDSMTKRFEQQGKTVSVTMIREGFVEQNEIPEELPLLPKESRYWLREILLCADGEPWLAGRTVVPVSTLSGPELALQKLGKTPLGRYLFTSSTLTRDFIEIGRDAGLWGRRSRLRLSGKPLLLTELFLPASPLY

SEQ ID NO: 48362 - DNA, 540 bp, Vibrio vulnificus CMCP6
  CDS (1)..(540): transl_table=11
atgaatcagccaaactcgctctatcttgctttgttaatagaagcaaaatggcaaaatcctgaagattttcacttttctagtgactttgctaagcactggttactggagcaaggctccttgtctcgccgtttggcgcgtcattgccaacatctgaccgttgagttgatgcgcaatgaaaaaagtggtatgggccaattaacaaggcaagagactcagggattgtcgcctgagatttgcttgatccgagaggtagtactatccggtgatcaaactccgtgggtgttggggagaacgttgatccctgaaaccaccttagctgatcagccctacgacttagccacgctgggtgatattcctttggggctcaccgtgtttagtgcagagcaagttgagcgtgacgcattgcaagtggcttggatcgaaacgccgcaagggcgtttactcgccagacgttctcgtttatggatgaaccacaaaccgatgttagtggcagaactgtttttacctgatgcaccgatttactccagggagagtgtgtaa

SEQ ID NO: 48363 - protein, 179 aa, Vibrio vulnificus CMCP6
MNQPNSLYLALLIEAKWQNPEDFHFSSDFAKHWLLEQGSLSRRLARHCQHLTVELMRNEKSGMGQLTRQETQGLSPEICLIREVVLSGDQTPWVLGRTLIPETTLADQPYDLATLGDIPLGLTVFSAEQVERDALQVAWIETPQGRLLARRSRLWMNHKPMLVAELFLPDAPIYSRESV

SEQ ID NO: 48364 - DNA, 561 bp, Pseudomonas syringae pv. tomato str. DC3000
  CDS (1)..(561): transl_table=11
gtgacccagcattcccccgcattcgttacccctgactggcttgagcgcgagcaactgactgacacgcccacacctgtatttttcggctggctattcaatcagcaatcccttacacgccgactggaccgcctgtctgacggcggcttcgatatcgttcccctgtctgaaggctggcaagcgttgcgcgacgacgaatgcgccgctttgggcttgccagcagccagcgaaggctgggtgcgcgaggtgtacttgcgcggtaacggcgaaaactgggtgttcgcccgtagcgtcgccgcacgggacgcgctgcaacacggcggtttgcacatggacgaactgggtacccgctcgctgggcgcattgctgttcagcgacccggcgttcgaccgcggcaccctccaggtgtgtcattacccgcaaagctggctgcctgatgccgatgcagtttccgggctgtgggcacgccgctcacaattcagtcgcggtgcgttgagcgtgctggttgccgaagtttttctgcccgccctgtggaatgcgattcataacaaggaccacgcctga

SEQ ID NO: 48365 - protein, 186 aa, Pseudomonas syringae pv. tomato str. DC3000
MTQHSPAFVTPDWLEREQLTDTPTPVFFGWLFNQQSLTRRLDRLSDGGFDIVPLSEGWQALRDDECAALGLPAASEGWVREVYLRGNGENWVFARSVAARDALQHGGLHMDELGTRSLGALLFSDPAFDRGTLQVCHYPQSWLPDADAVSGLWARRSQFSRGALSVLVAEVFLPALWNAIHNKDHA

SEQ ID NO: 48366 - DNA, 552 bp, Vibrio parahaemolyticus RIMD 2210633
  CDS (1)..(552): transl_table=11
ttgaatactagtatgaatcagccaacatcactctatcttgcttctttattggaagtagagtggcaaaagcccgaagaatttgaatttccaaacgaatttgccaagcattggctggaagaacaagggtctttgtcacgtcgtttaaagcagcactgtcaggaattgacagtagaactgctgcaaaatcatatcgtcacagcgaagacactgaaatcggatgaaagtcagttactgtctgagcaagattgcctcctaagagaggtcgtcctgtgtggagacgactgcccttgggttgttggtcgtactttgatcccacgtactacgttggtcgatcagcaatacgacttagcgcagcaaggcgatatcccactagggctcaccgtctttagcgccgataatgtcgagcgcgactcgctccaaatgggttgggttcacttgcctcaaggccgttttctcgcacgacgctcaaggttgtggatgaatcacaaacctatgttagtcgctgagttattcttatcgaattcacctatttacgccaaggagagagtgtaa

SEQ ID NO: 48367 - protein, 183 aa, Vibrio parahaemolyticus RIMD 2210633
MNTSMNQPTSLYLASLLEVEWQKPEEFEFPNEFAKHWLEEQGSLSRRLKQHCQELTVELLQNHIVTAKTLKSDESQLLSEQDCLLREVVLCGDDCPWVVGRTLIPRTTLVDQQYDLAQQGDIPLGLTVFSADNVERDSLQMGWVHLPQGRFLARRSRLWMNHKPMLVAELFLSNSPIYAKERV

SEQ ID NO: 48368 - DNA, 498 bp, Salmonella enterica subsp. enterica serovar Typhi Ty2
  CDS (1)..(498): transl_table=11
atgtcacaccctgcgttaacgcaactgcgtgcgctgcgctattttgatgcgattcctgcgcttgaaccccatttgctggactggctgttgctggaagattctgtgactaaacgttttgagcagcagggaaagcgggtaagcgtgacgctgattcgggaagcgtttgtcggccaaagtgaggtcgaggaagcatcaggtttactgccatccgagtcccgctactggttacgtgagatactgctttgcgctgacggcgagccctggcttgccggacgtaccgtggtaccggaatccacgctgtgcggacctgaacaggtcttacaacatctgggtaaaaccccgcttggacgttatctatttacatcatcgacactgacccgcgattttattgaaattggacgcgatgcaacgctgtgggggcgccgctctcgactgcggttgagcggaaaaccgctgttgcttaccgagctttttttacctgcatcgccgctgtactga

SEQ ID NO: 48369 - protein, 165 aa, Salmonella enterica subsp. enterica serovar Typhi Ty2
MSHPALTQLRALRYFDAIPALEPHLLDWLLLEDSVTKRFEQQGKRVSVTLIREAFVGQSEVEEASGLLPSESRYWLREILLCADGEPWLAGRTVVPESTLCGPEQVLQHLGKTPLGRYLFTSSTLTRDFIEIGRDATLWGRRSRLRLSGKPLLLTELFLPASPLY

SEQ ID NO: 48370 - DNA, 558 bp, Coxiella burnetii RSA 493
  CDS (1)..(558): transl_table=11
atgaagaagcaacttttttgggccccacaaaatgaaatcccttccactttgtggacagctaatgaacggagctggttgacgcatcccggctctctgacgcagcgtttacgcaagacaactgatgggcaaattcagcaccatctgcttcgggaagttttcgatgcaccggttgacgaagagacccaactcctgggtatatctcagccagaattagccttgatccgtgaaattgaatggcgatatttcgaaagcttgtgggtggcgggccgtgtagtaatcccaaagaaaaccctggaaagagagggctccccacttaaccatatcggggaacgctctttaggcgatatcttatttgcaaatgccaaatttactcgcggcgatttggagtttaggcaaattactgccgatcacccttattatttttatgttaaagagattgcgaatggcagttgtatatgggctcgacgttctttgttttatttcgaaagagatcccttattggtgagcgaaattttttcccccgcgctatttttagagagctctgtgtcgaatgattaa

SEQ ID NO: 48371 - protein, 185 aa, Coxiella burnetii RSA 493
MKKQLFWAPQNEIPSTLWTANERSWLTHPGSLTQRLRKTTDGQIQHHLLREVFDAPVDEETQLLGISQPELALIREIEWRYFESLWVAGRVVIPKKTLEREGSPLNHIGERSLGDILFANAKFTRGDLEFRQITADHPYYFYVKEIANGSCIWARRSLFYFERDPLLVSEIFSPALFLESSVSND

SEQ ID NO: 48372 - DNA, 537 bp, Nitrosomonas europaea ATCC 19718
  CDS (1)..(537): transl_table=11
atgaaggttaacccgcctctggcgtggcatcctgcacctgtttccgctcccgtcgaccttcactggtggctgactcaccggggttctctcacccgcctgattcaggatcgctgtgaacattttcgtgtcgaacctatttttcaggcactggcaacggcgtgtatcgatgagctggaagtcatgaacctgcgcagacagacccgggcactggtaagggaggtttatttgcgctgtaacgaaacaccggttgtatttgctcattcgatcgtcagaaaagaacatttacgaggtgcatggcgcggcctgagccgcctgggcaatcagtcactgggcaccatgctgtttaccaacccactgatacagcgcactcctcttgctttcaagaaactgaaaccgcaccacccgctgttcgaacgtgcctgcaaacgactgcagaaccgcccggccgatctctgggcaaggcgctcgttattcatcctgcaacatcagccgatactcgtcaccgaggtatttctgcccgcaatccgcagactctga

SEQ ID NO: 48373 - protein, 178 aa, Nitrosomonas europaea ATCC 19718
MKVNPPLAWHPAPVSAPVDLHWWLTHRGSLTRLIQDRCEHFRVEPIFQALATACIDELEVMNLRRQTRALVREVYLRCNETPVVFAHSIVRKEHLRGAWRGLSRLGNQSLGTMLFTNPLIQRTPLAFKKLKPHHPLFERACKRLQNRPADLWARRSLFILQHQPILVTEVFLPAIRRL

SEQ ID NO: 48374 - DNA, 573 bp, Bordetella bronchiseptica RB50
  CDS (1)..(573): transl_table=11
atgaccacccccattccccttgcgcgcggctggctgcccgccgcgccctcgacgctggatcccttgcgcaagtattggctgttccgtcccggcgcgctcaccgccggcctgcgccagctgggccacgtacgcctgcgcgtgctggcagagtacccgaccggcgcgccccgcgacgaggccgacggcatgcgcatcgccgcgcaaagcccggtctgggtgcgcgaagtgctgatgtcgatcgacggcgtggacagcgtcgtggcgcgcagcctcacgccgctgcgcgcctcgcatggcgtctggcagggcatgcggcgcctgctgacgcgcccgctggccgacatgctgtaccacgatcccggcatccatcgttcggtcttcgtatgccgccggctggccgccggcgtgcccttccatgccaccgccatcgcgcgcgcgccggccggcggcccggagccggcgctgtgggcgcgccgctccgccttctggcgcgccggccagccgctgctggtggccgagtgcttcctgcccgccttctggtcgctggcgcgcgcgcctgtcgcgccgcgctga

SEQ ID NO: 48375 - protein, 190 aa, Bordetella bronchiseptica RB50
MTTPIPLARGWLPAAPSTLDPLRKYWLFRPGALTAGLRQLGHVRLRVLAEYPTGAPRDEADGMRIAAQSPVWVREVLMSIDGVDSVVARSLTPLRASHGVWQGMRRLLTRPLADMLYHDPGIHRSVFVCRRLAAGVPFHATAIARAPAGGPEPALWARRSAFWRAGQPLLVAECFLPAFWSLARAPVAPR

SEQ ID NO: 48376 - DNA, 519 bp, Photorhabdus luminescens subsp. laumondii TTO1
  CDS (1)..(519): transl_table=11
atggaaaagcgtatgtcaactgactcaatattaacaacggtgcctattcagtggctttcggtggattcacccgttttgcctgatgaggttttagactggttgatggaattgggctcaatgacccgccgttttgagcaatactgcaacagtgttcgtatcataccattcagagaatgttttattaccgaagaacaactttctgatgaaaatgagcgtttgctaacgggtcaacgatattggctgcgtgagatcgtactgtgcggtgataatatcccttggctattggggcggacgttaatccctgaaacaacattaaccggtcctgatgaaagtttggttgatttaggaacagtcccactggggcgatatctttttagtggtaataaattgacgcgggactatattcatgtagggcagcaggggaaccgttgggcaagacgatcattgctgaggttatcaggcaagccattattattaaccgaagtctttttacctgaatcaccggtgtataaaaggtaa

SEQ ID NO: 48377 - protein, 172 aa, Photorhabdus luminescens subsp. laumondii TTO1
MEKRMSTDSILTTVPIQWLSVDSPVLPDEVLDWLMELGSMTRRFEQYCNSVRIIPFRECFITEEQLSDENERLLTGQRYWLREIVLCGDNIPWLLGRTLIPETTLTGPDESLVDLGTVPLGRYLFSGNKLTRDYIHVGQQGNRWARRSLLRLSGKPLLLTEVFLPESPVYKR

SEQ ID NO: 48378 - DNA, 552 bp, Vibrio vulnificus YJ016
  CDS (1)..(552): transl_table=11
ttgaatactagtatgaatcagccaaactcgctctatcttgctttgttaatagaagcaaaatggcaaaatcctgaagattttcacttttctagtgactttgctaagcactggttactggagcaaggctccttgtctcgccgtttggcgcgtcattgccaacatctgaccgttgagttgatgcgcaatgaaaaaagtggtgtgggccaattaacaatgcaagagactcaggggttatcccctgagatttgcttgatccgagaggtggtgctatccggtgatcaaacaccgtgggtgctgggaagaacgttgatccctgaaaccaccttagctgatcagccctacgacttagccacgctgggtgatattcctctgggtctcaccgtgtttagtgcagagcaagttgagcgtgacgcattgcaagtggcttggattgaaacaccgcaagggcgtttactcgccagacgttctcgtttatggatgaaccacaaaccgatgttagtggcagaactgtttttacctgatgcaccgatttactccagggagagtgtgtaa

SEQ ID NO: 48379 - protein, 183 aa, Vibrio vulnificus YJ016
MNTSMNQPNSLYLALLIEAKWQNPEDFHFSSDFAKHWLLEQGSLSRRLARHCQHLTVELMRNEKSGVGQLTMQETQGLSPEICLIREVVLSGDQTPWVLGRTLIPETTLADQPYDLATLGDIPLGLTVFSAEQVERDALQVAWIETPQGRLLARRSRLWMNHKPMLVAELFLPDAPIYSRESV

SEQ ID NO: 48380 - DNA, 519 bp, Bartonella quintana str. Toulouse
  CDS (1)..(519): transl_table=11
atgatatctgatcttaggagttctatcttgccacctttgaaatggctatccgatcaagatcctccagtaccagctggcgttagcgattggctaatggagttgggatccatgacacgtcgatttgaaaatcactgcacttgcatacgtattgaaccacaacgtgaatgtttcattacacgtgataacctgaaagaagaagctgcgcatttgcccaatagcacatgttactggctacgcgaagtcatactgatgggagacaaccaaccttggcttcttggacgcacagtgataccgcaagaaaccctatttgaacataatgaagcactgataaacttagggactgtaccactgggacggtatttatttagcagtggcaacctaactcgcgattacatttatattggccggcaaggtgcgctgtgggcacgccgctcccgtttgcgactagcgggcaaaccattgttattaaccgaactgtttttagcagcttcaccgctgtacacaacaaattccatataa

SEQ ID NO: 48381 - protein, 172 aa, Bartonella quintana str. Toulouse
MISDLRSSILPPLKWLSDQDPPVPAGVSDWLMELGSMTRRFENHCTCIRIEPQRECFITRDNLKEEAAHLPNSTCYWLREVILMGDNQPWLLGRTVIPQETLFEHNEALINLGTVPLGRYLFSSGNLTRDYIYIGRQGALWARRSRLRLAGKPLLLTELFLAASPLYTTNSI

SEQ ID NO: 48382 - DNA, 516 bp, Bartonella henselae str. Houston-1
  CDS (1)..(516): transl_table=11
atgtctgatcctaaagattctatcttgccacctctgaaatggctatcagatcaagatcctccagtaccaactcacatcaaagattggctcatggaattaggatctatgacacgtcgatttgaaaaccactgcacttacatacatatcaaaccacaacgtgaatgttttattacgcgtgataaacttaaagaagaagctgcgcatctgcccaagagcacacgttattggttacgcgaagtcatactaatgggagacaaccaaccttggctccttgggcgcacagtgataccgcaagaaaccctattcgaacacaatgaagcactgataaacttaggggatgtaccactgggacgctatttattcagtattgataaattgacccgcgattacatccatatcggaagaaaagatacgctgtgggcacgccgctcccgtttacgattaacaggcaagccattattattaaccgaattgtttttagcagcttcacctctttacacaacaaatcccatataa

SEQ ID NO: 48383 - protein, 171 aa, Bartonella henselae str. Houston-1
MSDPKDSILPPLKWLSDQDPPVPTHIKDWLMELGSMTRRFENHCTYIHIKPQRECFITRDKLKEEAAHLPKSTRYWLREVILMGDNQPWLLGRTVIPQETLFEHNEALINLGDVPLGRYLFSIDKLTRDYIHIGRKDTLWARRSRLRLTGKPLLLTELFLAASPLYTTNPI

SEQ ID NO: 48384 - DNA, 504 bp, Acinetobacter sp. ADP1
  CDS (1)..(504): transl_table=11
atgcagaaaattcaatcaaatcaaatacaggaacaagatttgacgcctgaattaaaaaaatggttgtatgcatctggatcattgactcagcaattgactgatttggcggatggcttatttacagttgaaccgattcaggaaaagtatcagcgtatgagttttatggatagccgctggatgcgtatgccagcgtatcatgtggcctgggtgagagaaagtttgttatatgggtgtgagcaacagccatgggtaaaagcaaagagtattttccctgttttaagtctgcaaaaaaaggcccgtatctttaaacacattggtaaaaaacccattggccgatttctgtttcagcgcacgactccgttgtgtgaacggcgtgtgatacgtttagaagaaggctggaccagacaaagttgttatacgtggcatgggtgtaaatttatcgtgcaggaaacttttctagcttcgtttgagcaatatattcaacatcattctcactctatatag

SEQ ID NO: 48385 - protein, 167 aa, Acinetobacter sp. ADP1
MQKIQSNQIQEQDLTPELKKWLYASGSLTQQLTDLADGLFTVEPIQEKYQRMSFMDSRWMRMPAYHVAWVRESLLYGCEQQPWVKAKSIFPVLSLQKKARIFKHIGKKPIGRFLFQRTTPLCERRVIRLEEGWTRQSCYTWHGCKFIVQETFLASFEQYIQHHSHSI

SEQ ID NO: 48386 - DNA, 534 bp, Erwinia carotovora subsp. atroseptica SCRI1043
  CDS (1)..(534): transl_table=11
atgtctgacgatgcgtcaacgcttctgcgcaccatatcctggtttactgaacccccttcggtattgcctgagcacattggtgactggctgatggaaaccagttccatgacgcagcggcttgaaaaatactgtgcccaactgagggtcacgctttgtcgtgagggtttcattacgccgcagatgctgggcgaagagcgggatcaactaccggctgacgaacgttactggctgcgtgaagttgtgctgtatggtgacgatcgcccctggcttttcggccgaacgattgtcccgcaacagacgctcgagggttctggcgcggctttgacgaaaataggcaatcagccgttaggtcgctatctgtttgagcaaaaatcgctgacgcgtgattatattcataccggatgctgcgaaggcttatgggcgcggcgttcccgcctgtgtctttcgggtcatccgttactgttgactgagcttttcttaccggaatcaccggtttattacacacctggtgatgaaggttggcaggtaatttga

SEQ ID NO: 48387 - protein, 177 aa, Erwinia carotovora subsp. atroseptica SCRI1043
MSDDASTLLRTISWFTEPPSVLPEHIGDWLMETSSMTQRLEKYCAQLRVTLCREGFITPQMLGEERDQLPADERYWLREVVLYGDDRPWLFGRTIVPQQTLEGSGAALTKIGNQPLGRYLFEQKSLTRDYIHTGCCEGLWARRSRLCLSGHPLLLTELFLPESPVYYTPGDEGWQVI

SEQ ID NO: 48388 - DNA, 594 bp, Burkholderia mallei ATCC 23344
  CDS (1)..(594): transl_table=11
atgcgtttcgacgccgccgatgcgcactggcgcgagacgccgcgccccggcgcgtcgagcgcgcagaaggactggctcacgcgcggcggctcgctcaccgcgcacctcgcgcggctcggccgcgtgacggtgcgcgtgacgcgcgagacggtcgcggcgccgtgggccgacgagcaccgcgcgctttcctgcgcgtcgcgcgcgccggtgtgggtgcgcgaggtcgtgctcgcggtcgacggcgcgccgttcgtcgccgcgcacagcatcgcgccgctcgccgcgagcaagggcgtgtggcaggcgatgcggcggctgcgcacgcgcccgctcgccgagctgctctatagcgatccggaagtgacgcgctcggcgctcgtgagccggcgcgtgctcgccgggcatccgttgttctcgctcgcatcgctcgcgctcgcgcgcgcgtatgcgacggagcacgcgttcgccgcccgccgctcggtgttcgagcggcgcggcacgccgctgatggtgaccgaatgcatgctgcccgcgctgtggcggcatctcgacgcacacggcgagcgccgcgcgcgcggcctcgagcagacgtga

SEQ ID NO: 48389 - protein, 197 aa, Burkholderia mallei ATCC 23344
MRFDAADAHWRETPRPGASSAQKDWLTRGGSLTAHLARLGRVTVRVTRETVAAPWADEHRALSCASRAPVWVREVVLAVDGAPFVAAHSIAPLAASKGVWQAMRRLRTRPLAELLYSDPEVTRSALVSRRVLAGHPLFSLASLALARAYATEHAFAARRSVFERRGTPLMVTECMLPALWRHLDAHGERRARGLEQT

SEQ ID NO: 48390 - DNA, 489 bp, Methylococcus capsulatus str. Bath
  CDS (1)..(489): transl_table=11
atggaatcctgggtgttcgaaaggggctcgctgacccggcgtctgaaagccgcttgcggcgccgacttcaatgtccgggtgatccgccagggtttcgcccatcccttcccggacgaggccttgctgctgaaactcagatccggccgtcgcgcgctggtgcgcgaagtcgaactccgatcccgcgaacggcgtttggtccttgcccgcagcgtccttccggcgcaaaccctgaagggtgcgggacgccggctggcgcacctgggcaatcgcccgctgggcgaaatcctgttcgcgtcacggcgtccgcggcgtcatgggttcgaggcggccctggccgaggaccgccattggcggccggcggttcgcgccggatcaggttcggccgggcccgtctggggtcgtcgctcgctctattcgatcgctggcaggcccttgctggtcgccgagttcttccttcccgccgtgctttccgtcccggagtccgcatga

SEQ ID NO: 48391 - protein, 162 aa, Methylococcus capsulatus str. Bath
MESWVFERGSLTRRLKAACGADFNVRVIRQGFAHPFPDEALLLKLRSGRRALVREVELRSRERRLVLARSVLPAQTLKGAGRRLAHLGNRPLGEILFASRRPRRHGFEAALAEDRHWRPAVRAGSGSAGPVWGRRSLYSIAGRPLLVAEFFLPAVLSVPESA

SEQ ID NO: 48392 - DNA, 543 bp, Photobacterium profundum SS9
  CDS (1)..(543): transl_table=11
atgtcgaaattcaagcagttgtataaaccattattggataatgcgcagtgggaaacacccctttcactcgcgatagaaggcacagcgtttgggcattggttgcttgaacctaattcattgtcacgccgacttcagcgtcattgcgatgaatttaccgtgtcgctaattgagcagaagaaaatcgatagtacgatgttatcggctgatgaacgtgagttgatcggtgatgttgattgtctattgcgtaaagttgttttgatgggagacggacaaccgtgggtatttgctcgtactttaattccgctatccacccttactgggcaagagagtgatcttgaacaattgggtgagatgccattaggctttcgggtatttaccgatcgtagtgcgcgtcgtgatgcattggaagttgcgaatacaggaacacaagcacagccactatgggctcgccgttcacgtttatggataaataacaaaccgctgctggtggctgaattatttttggcacaagccccggtgtattcaaaggagaaacaatgttag

SEQ ID NO: 48393 - protein, 180 aa, Photobacterium profundum SS9
MSKFKQLYKPLLDNAQWETPLSLAIEGTAFGHWLLEPNSLSRRLQRHCDEFTVSLIEQKKIDSTMLSADERELIGDVDCLLRKVVLMGDGQPWVFARTLIPLSTLTGQESDLEQLGEMPLGFRVFTDRSARRDALEVANTGTQAQPLWARRSRLWINNKPLLVAELFLAQAPVYSKEKQC

SEQ ID NO: 48394 - DNA, 582 bp, Idiomarina loihiensis L2TR
  CDS (1)..(582): transl_table=11
atgacaacagagttttatgccaccccggcttttccagttagcaaagcgctacaatggacaccgcctgaacaacttgaattaaccccaacacaagccgactggctgctatacgagggttcacttacagaacgcctgaagcagataggtcagcagttctccgttaagttactcggtcagcagttacttgcccctaacacggaagaaaagcaaaggttaaaaggtaaagaccaagccgttatccgtgaagttctactatactgtaatgaaaagccttgggtttttgcgcgcagtctattttctcccagcgccgaaaacgccaatacactgaatttacaacaactggggaatcagtcattgggcgagtctttatttgcccgtagcgatttatactgcggagacatagaagtggcaaaagttgctctggaacacccggttgctcggcttaatcagcagtggtttgggataaaccagaggctgctcagcagacgccgaatattttcaacgggcggtgagcaactgttagtcagtgaagtatttctgcagccctcgccactgtactcttcgccgaataacaggagttag

SEQ ID NO: 48395 - protein, 193 aa, Idiomarina loihiensis L2TR
MTTEFYATPAFPVSKALQWTPPEQLELTPTQADWLLYEGSLTERLKQIGQQFSVKLLGQQLLAPNTEEKQRLKGKDQAVIREVLLYCNEKPWVFARSLFSPSAENANTLNLQQLGNQSLGESLFARSDLYCGDIEVAKVALEHPVARLNQQWFGINQRLLSRRRIFSTGGEQLLVSEVFLQPSPLYSSPNNRS

SEQ ID NO: 48396 - DNA, 558 bp, Azoarcus sp. EbN1
  CDS (1)..(558): transl_table=11
atgcgcatccgacctcactccgaaacctggctcaaacgcccgccgcgcccccgggtgcccgcgcggctgcgcccctggctcaccgatccgggttcgctgacggcgcgcatccgcagtcgctgcagcctgttttcggtcaacgtgctcgcgcagcgcctcgccgtcccgcaccctgacgaagccgcgctgctcgggctgcgccgcggcgaactcgcgtggctgcgcgaagtgctgctcgtcgccgacggcgtcccggtggtgttcgcgcgcagcatcctgccgcggcacgacgtgcgtggagcatggatcctgttccagggactcggctcccgtccgctcggcgccgcgttgttcgccgacccgcgcatcggccgcaagccgttggcctgcgcctgtctcgaccgccgggacgcgcgctatcatcgcgcttcggctgccgccgcgccgcgtcgcctgccgctcgcgctgtgggcgcgccggtcgctgttcggcctgcgcggccgcacgctgctggtcagcgaagtgtttctgcccacgattctggagttgccgacatga

SEQ ID NO: 48397 - protein, 185 aa, Azoarcus sp. EbN1
MRIRPHSETWLKRPPRPRVPARLRPWLTDPGSLTARIRSRCSLFSVNVLAQRLAVPHPDEAALLGLRRGELAWLREVLLVADGVPVVFARSILPRHDVRGAWILFQGLGSRPLGAALFADPRIGRKPLACACLDRRDARYHRASAAAAPRRLPLALWARRSLFGLRGRTLLVSEVFLPTILELPT

SEQ ID NO: 48398 - DNA, 543 bp, Vibrio fischeri ES114
  CDS (1)..(543): transl_table=11
atgtcagatatcaattcttggtgtgcttctgtactaaaaagagtgcagtggcaagaggccgatacatttgagtgtagtaatgacctgcagcgttattggttgctaggattagattcactatcacgtcgtttagagcagcattgcaatgtgttatcggtatcggtattggataatacccatgtgaatccagataaattaaccgtagaagaggaagctcttcttagcggagaagtgtgtttgcgtcgaaaagtcatcttaaaaggtgatcagcaatcgtgggtttatggtagaacattaattccgttatcatcattgcaagatcagccgcatgatttaactcgtcaaggtcatacacctttaggtattactgtatttagtgctcaaagtgcacatagagataaattacaagtaggaacaataatgacagaaagaggagagttgtttgctcgtcgttctcgattatggatgaataataaacctatgctagttgcagagttatttttaccagaagcacccatttattcaaaggaagtggaatcatga

SEQ ID NO: 48399 - protein, 180 aa, Vibrio fischeri ES114
MSDINSWCASVLKRVQWQEADTFECSNDLQRYWLLGLDSLSRRLEQHCNVLSVSVLDNTHVNPDKLTVEEEALLSGEVCLRRKVILKGDQQSWVYGRTLIPLSSLQDQPHDLTRQGHTPLGITVFSAQSAHRDKLQVGTIMTERGELFARRSRLWMNNKPMLVAELFLPEAPIYSKEVES

SEQ ID NO: 48400 - DNA, 498 bp, Salmonella enterica subsp. enterica serovar Choleraesuis str
  CDS (1)..(498): transl_table=11
atgtcacaccctgcgttaacgcgactgcgtgcgctgcgctattttgatgcgattcctgcgcttgaaccccatttgctggactggctgttgctggaagattctatgactaaacgttttgagcagcagggaaagcgggtaagcgtgacgctgattcgggaagcgtttgtcggccaaagtgaggtcgaggaagcatcaggtttactgccatcagaatcccgctactggttacgtgagatactgctttgcgctgacggcgagccctggcttgccggacgtaccgtggtaccggaatccacgctgtgcggacctgaacaggtcttacaacatctgggtaaaaccccgcttggacgttatctatttacatcatcgacactgacccgcgattttattgaaattggacgcgatgcaacgctgtgggggcgccgctctcgactgcggttgagcggaaaaccgctgttgcttaccgagctttttttacctgcatcgccgctgtactga

SEQ ID NO: 48401 - protein, 165 aa, Salmonella enterica subsp. enterica serovar Choleraesuis str
MSHPALTRLRALRYFDAIPALEPHLLDWLLLEDSMTKRFEQQGKRVSVTLIREAFVGQSEVEEASGLLPSESRYWLREILLCADGEPWLAGRTVVPESTLCGPEQVLQHLGKTPLGRYLFTSSTLTRDFIEIGRDATLWGRRSRLRLSGKPLLLTELFLPASPLY

SEQ ID NO: 48402 - DNA, 561 bp, Pseudomonas syringae pv. syringae B728a
  CDS (1)..(561): transl_table=11
gtgacccagcaatcccccgcattcattggccctgcctggcttgagcgcgagcaattgatcgacgcaccggacccggtaatgctcgactggttgttcaatcaggactccctcactcgtcggttggaccgtttgtctgacggtcgtttcagcgtatttccgcagtttgaaggctggcagcccttgcgccctgacgagtgcctggcgctgggcctgccagaggctggcgaaggctgggtgcgcgaggtgtacctgcgtggtaacggcaacaactgggtgttcgcgcgcagtgtcgccgcccgcagcgccctgcaggatggtggcctggatatggacgagctgggcactcgctcgctgggtgagttgctgttcagcgacccggcgttcgtgcgcggcacgcttgaagtgtgtcattaccccgaggcctggctgccggctgccgatgcagcgcgcggactgtgggcacggcgctcgcgctttgatcgcgatgccttgagcgtgctggtcgccgaagttttcctgcctgccctgtgcactgcgattcatgacaaggaccacgtctga

SEQ ID NO: 48403 - protein, 186 aa, Pseudomonas syringae pv. syringae B728a
MTQQSPAFIGPAWLEREQLIDAPDPVMLDWLFNQDSLTRRLDRLSDGRFSVFPQFEGWQPLRPDECLALGLPEAGEGWVREVYLRGNGNNWVFARSVAARSALQDGGLDMDELGTRSLGELLFSDPAFVRGTLEVCHYPEAWLPAADAARGLWARRSRFDRDALSVLVAEVFLPALCTAIHDKDHV

SEQ ID NO: 48404 - DNA, 504 bp, Haemophilus somnus 129PT
  CDS (1)..(504)
ttgaatatttctttatttcgacaaattctctcctctacaaaatggcagaatgatatttttactttatccccgcaaaaacaagattggctattacatcaaggttcattaacccgaaaattacagcaatattgtcagcaactgaaagttgaaattgtggcggaaaaatgggtttctgacatgtcttttggatttaccggacatcatgagccaatttggttgcgtgaagtgatattaaaaggtgatgagcaagcttggatttttgcacaaactcgtttgccgcaatctacgattgagaatgttgcacctgacattatcaatgtaggttcaacgcctattggcttatggcttttccctcaacaaccaaaaagaaaaacacttgaatggatatatgataccgcaacaggattatatgctcgtcgttcagtattgcttttaaatcaatatccaatcgaaattaaagaattgtttttgcaagattttaaattttttcaatcaaaggtctaa

SEQ ID NO: 48405 - protein, 167 aa, Haemophilus somnus 129PT
MNISLFRQILSSTKWQNDIFTLSPQKQDWLLHQGSLTRKLQQYCQQLKVEIVAEKWVSDMSFGFTGHHEPIWLREVILKGDEQAWIFAQTRLPQSTIENVAPDIINVGSTPIGLWLFPQQPKRKTLEWIYDTATGLYARRSVLLLNQYPIEIKELFLQDFKFFQSKV

SEQ ID NO: 48406 - DNA, 507 bp, Pseudomonas syringae pv. syringae B728a
  CDS (1)..(507)
ttgatcgacgcaccggacccggtaatgctcgactggttgttcaatcaggactccctcactcgtcggttggaccgtttgtctgacggtcgtttcagcgtatttccgcagtttgaaggctggcagcccttgcgccctgacgagtgcctggcgctgggcctgccagaggctggcgaaggctgggtgcgcgaggtgtacctgcgtggtaacggcaacaactgggtgttcgcgcgcagtgtcgccgcccgcagcgccctgcaggatggtggcctggatatggacgagctgggcactcgctcgctgggtgagttgctgttcagcgacccggcgttcgtgcgcggcacgcttgaagtgtgtcattaccccgaggcctggctgccggctgccgatgcagcgcgcggactgtgggcacggcgctcgcgctttgatcgcgatgccttgagcgtgctggtcgccgaagttttcctgcctgccctgtgcactgcgattcatgacaaggaccacgtctga

SEQ ID NO: 48407 - protein, 168 aa, Pseudomonas syringae pv. syringae B728a
MIDAPDPVMLDWLFNQDSLTRRLDRLSDGRFSVFPQFEGWQPLRPDECLALGLPEAGEGWVREVYLRGNGNNWVFARSVAARSALQDGGLDMDELGTRSLGELLFSDPAFVRGTLEVCHYPEAWLPAADAARGLWARRSRFDRDALSVLVAEVFLPALCTAIHDKDHV

SEQ ID NO: 48408 - DNA, 483 bp, Actinobacillus pleuropneumoniae serovar 1 str. 4074
  CDS (1)..(483)
atgtttatgttacgacaatatcgccgaatcttagcgcaaaatcattggtgttcggaacaagaaccgcttagtaaagctcaacaagaatggcttctacatcaaggatcgctaacgcaaaaattattacaagttagccggcaattcaacgttgaaattacccaacaaaaatgggttacaaaggcatctgaaaactattctaagtattggttacgggaagtattattaaaagaagaagatcagccttggatttttgcccaaactttagtaccgcaagcaacgatagataatgtagcgcaggatctaccgatacttggcgatcaagctatcggcttatggcttttccctcagacaccgaaacggatttcgcttgaatggcaatgtgatgtgcatagcggaatgtatatgcgcagagcctgttatttattaaaaggctatccgttagaaatctccgaattgttcttggcggattttccttatttataa

SEQ ID NO: 48409 - protein, 160 aa, Actinobacillus pleuropneumoniae serovar 1 str. 4074
MFMLRQYRRILAQNHWCSEQEPLSKAQQEWLLHQGSLTQKLLQVSRQFNVEITQQKWVTKASENYSKYWLREVLLKEEDQPWIFAQTLVPQATIDNVAQDLPILGDQAIGLWLFPQTPKRISLEWQCDVHSGMYMRRACYLLKGYPLEISELFLADFPYL

SEQ ID NO: 48410 - DNA, 537 bp, Pseudomonas aeruginosa UCBPP-PA14
  CDS (1)..(537)
atgcccagcaatgcgctctggcttcgcgccgaccaactgtccagcgtctcccccaccgtcctcgactggctgttcgacgaagggtcgctgacccggcgcctgaccgccctggccgacggcgcgttccgcgtcgaacccctgctggaaggctggcagaccctgcgcgacgacgaatgccaggggctcgacgtccctcccggcagtagcggctgggtccgcgaggtctacctgcatggccacgaccgtccctgggtgttcgcccgcagcgtggcggcgcgcagcgccctggaaggctcgggcttcgacctggcgctgctcggcacccgctcgctgggcgagttgctgttcagcgacagcgccttcgagcgcgggcccatcgaagtctgccgctatccggcggccggtctgcccgccgaggtccgcgccgagggtctctggggccgtcgctcacggttttcccgcggcgcgctcggggtgctggtggcggaggtgttcctaccgagcctgtgggaccaggcgggaatcgccgacgtataa

SEQ ID NO: 48411 - protein, 178 aa, Pseudomonas aeruginosa UCBPP-PA14
MPSNALWLRADQLSSVSPTVLDWLFDEGSLTRRLTALADGAFRVEPLLEGWQTLRDDECQGLDVPPGSSGWVREVYLHGHDRPWVFARSVAARSALEGSGFDLALLGTRSLGELLFSDSAFERGPIEVCRYPAAGLPAEVRAEGLWGRRSRFSRGALGVLVAEVFLPSLWDQAGIADV

SEQ ID NO: 48412 - DNA, 507 bp, Psychrobacter sp. 273-4
  CDS (1)..(507)
atgacctctcatctttgctgctctaattattcatcaccgttacctgagctgctggtttgtctacatactgaaggctcgctaacggcgttgttagaggtaaaagcagggcagccgttacgtgtcgaacgcagctttgagggttatcgtttattatccttggcgcaaaaaaagcaattaggtatgcaaggcgcggcgctgagccgtccgcggctagcatgggtgcgcgaggtacaattatatggcaatgacgagctaccatgggtacaggcgcaaagcctgtttccgttatccagtctacagggcagtgccagacgtctacagcagttaaaaagtaccccaattggctacgtgttgtttaagcgcagccgcaccttgcccaatcagcgctttatcaaacatacggtagatggctggcaacggcagacgctttataattggtacggtcgtcctttactcattagtgagacctttttgccacagttctgtgaaaaacagttggacatttaa

SEQ ID NO: 48413 - protein, 168 aa, Psychrobacter sp. 273-4
MTSHLCCSNYSSPLPELLVCLHTEGSLTALLEVKAGQPLRVERSFEGYRLLSLAQKKQLGMQGAALSRPRLAWVREVQLYGNDELPWVQAQSLFPLSSLQGSARRLQQLKSTPIGYVLFKRSRTLPNQRFIKHTVDGWQRQTLYNWYGRPLLISETFLPQFCEKQLDI

SEQ ID NO: 48414 - DNA, 597 bp, Burkholderia cepacia R18194
  CDS (1)..(597)
atgcgattcgacggcggtcaggccggctggcgcgagacgccgcggcctggctgcacgctcgatcagcgcgactggctgacgcgtggcggatcgctgaccgcgcacctcgcgcggctcggccgcgtgaacgtgcgcgtgacgcgcgaggccgtcgactgcccgtggttcgacgagccggacgcggtcgccagtgcaccgcgcgcgccgatgtgggtgcgcgaggtgatcctgtcggtcgacggcacgccgtacgtcgccgcgcacagcatcgcgccgctcgcggccagcaagggcgtgtggcaggccatgcggcggctgcgcacgcggccgctggcggagctgctgtacagcgatccgcaggtcgagcgttcggcgctcgtcagccggcgcgtgatcgccggccatccgctgtatgcgctggcgacccatgcgcttggcggggcgcgagcgccgcattcgttcgccgcgcgacgctcggtgttccagcgccacggcaagccgttgatggtcactgagtgcatgctgccggcgctgtggcgccatctcgacgcgcacggcgacgggccgcgctcgggcgggccgggcggaggcgcgtga

SEQ ID NO: 48415 - protein, 198 aa, Burkholderia cepacia R18194
MRFDGGQAGWRETPRPGCTLDQRDWLTRGGSLTAHLARLGRVNVRVTREAVDCPWFDEPDAVASAPRAPMWVREVILSVDGTPYVAAHSIAPLAASKGVWQAMRRLRTRPLAELLYSDPQVERSALVSRRVIAGHPLYALATHALGGARAPHSFAARRSVFQRHGKPLMVTECMLPALWRHLDAHGDGPRSGGPGGGA

SEQ ID NO: 48416 - DNA, 552 bp, Pseudomonas fluorescens PfO-1
  CDS (1)..(552)
atgcaacacacaaacgctccgctgtggcgcccgcaaagcgaactgacacccctgcccgacacatccacgctcgactggctgttcgacgaaggctccctgacccgccggctgacgcacctgtccgatgacggcttcagcgtgacgccgctgttcgaaggctggcagaccctgcgcgacgacgaatgcgccgcgctggacctggccgaaggcagcgagggctgggtgcgcgaggtgtatctgcgtgggcatggccaggcctgggtgttcgcccgcagcgtggcgtcgcgcagtgccttgcagggcgacggcttgcacatggatgagttgggcagccgctcgctgggcgaactgctgttctgcgatcacgcgtttcagcgccgcgccattgaagtctgccattacccggaacactggttgcccgaaggttcccgggctgccggcctgtggggacggcgttcgcgtttcgaccgtggcgcattgagcgtactggtggcggagattttcctgcctacgctgtgggaagccgtccgcgcccgtccggagaactgctga

SEQ ID NO: 48417 - protein, 183 aa, Pseudomonas fluorescens PfO-1
MQHTNAPLWRPQSELTPLPDTSTLDWLFDEGSLTRRLTHLSDDGFSVTPLFEGWQTLRDDECAALDLAEGSEGWVREVYLRGHGQAWVFARSVASRSALQGDGLHMDELGSRSLGELLFCDHAFQRRAIEVCHYPEHWLPEGSRAAGLWGRRSRFDRGALSVLVAEIFLPTLWEAVRARPENC

SEQ ID NO: 48418 - DNA, 558 bp, Pseudomonas fluorescens PfO-1
  CDS (1)..(558)
atggatacaagtcattactggtcatcgcgaccgctgtcggaattgaccggctccgagcatcactggctgtttttgcccggggcactgaccccacgtctgaaagccatgggcgattattcaatcgaagtcgtcgagcagtcccatggcccgctcaatcctgaagaagcgcaagcgctgaacgtgtcgccaaacaccattggttgggtgcgcgaagtggtgatgaagctcgacggcgaggcctgcgtcaccgcgcgcagcctgaccagcgtgccggcgctgaatggcgactgggcggatctgaacggctacggccgtcgaccgctggccgagattctctacacctcggagcagaccctgcgcgaaccattccaatgtgccttgctgccgcccggtgcgccgttggccgcgctgtcctatcgctacgcgccgcaagccgaacgtctgttggcccggcgttcgcgtttcacccgcaatggttcggcgctgctggtcagcgagtgctttctgccagcgttctgggctcgggtcgagtacgctcaggcgctcaagtcggcctga

SEQ ID NO: 48419 - protein, 185 aa, Pseudomonas fluorescens PfO-1
MDTSHYWSSRPLSELTGSEHHWLFLPGALTPRLKAMGDYSIEVVEQSHGPLNPEEAQALNVSPNTIGWVREVVMKLDGEACVTARSLTSVPALNGDWADLNGYGRRPLAEILYTSEQTLREPFQCALLPPGAPLAALSYRYAPQAERLLARRSRFTRNGSALLVSECFLPAFWARVEYAQALKSA

SEQ ID NO: 48420 - DNA, 684 bp, Burkholderia fungorum LB400
  CDS (1)..(684)
atgtctatccgtttcgttgccgccgacgcccactggcgcgtcgcgcccttgcccggcctgagcgccgcgcagaaagactggctgacccgtggtggttcactgaccgcgcatctgcgcgcgctcggcgcggtcgcggttcgcgtgacgcgcgaaggcgtcgcgctgccgtggcccgacgagcatgccgcgctcggcctcgcgccgcgtgcgccggtctgggtgcgcgaagtcgtcctcgcggtcgaaggcgtgccgttcgtcgcggcgcatagcgtcgcgccgctcgccgcgagtgccggcgtgtggcaggccatgcggcgcttgcgcacgcggccgctggctgaactgctgtatagcgacagcagcgtggcgcgttcgtcgctggtgagccgcaggctgaccgctcggcatccgctctatcgcctcgcggcgtgcgcgatcgagagcctgccgccgcatgcgctggtcgcgcgccgctcggtgttcgagcgccacggcgcgcccttgatggtgaccgaatgcatgttgccggcgctatgggcgcatctggccacggtgtccggggctggcggatcaggcgactggtccgcgcatccgcgcgtgcgcgaacacggccgtccgctcgaacacaccgcctcgcgcgcgcatcccgccacgcgtgcgtccgacgagcagcgccgctga

SEQ ID NO: 48421 - protein, 227 aa, Burkholderia fungorum LB400
MSIRFVAADAHWRVAPLPGLSAAQKDWLTRGGSLTAHLRALGAVAVRVTREGVALPWPDEHAALGLAPRAPVWVREVVLAVEGVPFVAAHSVAPLAASAGVWQAMRRLRTRPLAELLYSDSSVARSSLVSRRLTARHPLYRLAACAIESLPPHALVARRSVFERHGAPLMVTECMLPALWAHLATVSGAGGSGDWSAHPRVREHGRPLEHTASRAHPATRASDEQRR

SEQ ID NO: 48422 - DNA, 564 bp, Thiobacillus denitrificans ATCC 25259
  CDS (1)..(564)
atgatcgccacgcgcgacgacgtttgccggcaggccggtctgcagtatggctggctgccccatgccttccaggcgccgcggacgctgcgcggctggctgtccgatcgcggttcgctcacccagcgcctgcggtcccgttaccgtgatttccgcgtgcttccggtgctgcgcggcgtcgcggcgccttttcccgacgaaagcggcgcgctcggcctcgcgcgcgatgcaagcgcctacgtgcgcgacgtcctgctcctcggcgatggcaaggcccgcgttttcgcgcacagcgtgctgccgcgcgcggccttgcgcggcggatggaacggcatcgcccggctcggcacgagaccgctcggcgaagcactgtttcgcaccccccgtgtccgccgtctggccatgacgatgcgccgggtcgacgcgcggcacccgctttattgcgccgcgcgccgccatgccgaggtcgccgagcgcgcactgtgggcgcggcgctcggtattttgcctggacggccacccactgctggtcagtgaagtctttttgcccgccctattaacgccatga

SEQ ID NO: 48423 - protein, 187 aa, Thiobacillus denitrificans ATCC 25259
MIATRDDVCRQAGLQYGWLPHAFQAPRTLRGWLSDRGSLTQRLRSRYRDFRVLPVLRGVAAPFPDESGALGLARDASAYVRDVLLLGDGKARVFAHSVLPRAALRGGWNGIARLGTRPLGEALFRTPRVRRLAMTMRRVDARHPLYCAARRHAEVAERALWARRSVFCLDGHPLLVSEVFLPALLTP

SEQ ID NO: 48424 - DNA, 531 bp, Dechloromonas aromatica RCB
  CDS (1)..(531)
atgaaacgcagcaaatggcggactcgcttcgccggcgcttattgcgaccccattctccgctcctggctgactgagccggattcactgacggctcgttgtcagcgggcgagttcggcttttcgcgtgcgcctgttgcgctacggcaagggtcaggcactggccgatgaagcggttgagggcaaggccggccggcattcggcctgggtgcgcgaggtggtgctcgaatgcgatggcgtgccggtgatctttgctcacacgactttgtcgacggcccggagaggccggatgacccgctggatggccggtctgggcagtcgttcgctgggttccctgctttttgcctatccagggttcaagcgagggggtatcgagtttctccggcttgatcggtgtcacccgctgtatcggcgtgccgcggccttgggggcagggcgcaagtccctgtgggcgcgccgctcactgcaccggctcggcgggcagcaggtgctggtgacggaagtctttctgccggccatcacgctgctgaagtga

SEQ ID NO: 48425 - protein, 176 aa, Dechloromonas aromatica RCB
MKRSKWRTRFAGAYCDPILRSWLTEPDSLTARCQRASSAFRVRLLRYGKGQALADEAVEGKAGRHSAWVREVVLECDGVPVIFAHTTLSTARRGRMTRWMAGLGSRSLGSLLFAYPGFKRGGIEFLRLDRCHPLYRRAAALGAGRKSLWARRSLHRLGGQQVLVTEVFLPAITLLK

SEQ ID NO: 48426 - DNA, 552 bp, Azotobacter vinelandii AvOP
  CDS (1)..(552): transl_table=11
gtgaccgctgctcccgctttccaatggctcggcgccgaccaactgcatcccgcccccccggccgtcctggccgactggctgttcgacagcggctcgctgacccgccggctgaccgccctttccgccggccgtttcgccgtgacgccgctggccgaaggctggcaggtgctgcgcgacgacgaatgcaccgccctcgacgtggtgccgggcagcaccggctgggtacgcgaggtctacctgctcggcgccgagcggccctgggtgttcgcccgcagcgtggcggcccgcgaggctctggcgggtttctccggcgtactcgccgaactcggccggcggcccctcggcgaactgctgttcagcgacccagccttcgcccgcggcccgctgcaggccacgcactatccgccggactggctgccggccgggatacgctgccccggactctggggacggcgctcccgtttccaccgggaaaccctgagcgtgctggtggcggaagtcttcctgccggagctctggcgctaccagggaatcgacccggacaccctataa

SEQ ID NO: 48427 - protein, 183 aa, Azotobacter vinelandii AvOP
MTAAPAFQWLGADQLHPAPPAVLADWLFDSGSLTRRLTALSAGRFAVTPLAEGWQVLRDDECTALDVVPGSTGWVREVYLLGAERPWVFARSVAAREALAGFSGVLAELGRRPLGELLFSDPAFARGPLQATHYPPDWLPAGIRCPGLWGRRSRFHRETLSVLVAEVFLPELWRYQGIDPDTL

SEQ ID NO: 48428 - DNA, 597 bp, Burkholderia vietnamiensis G4
  CDS (1)..(597): transl_table=11
atgcgattcgacggcgcacgctcgggctggcgcgcaacgccccggcccggctgcacgctcgagcagcgcgattggctcacgcgcggcggttcgctgaccgcgcatctcgcgcggctcggcagcgtgagcgtgcgcgtgacgcgcgaggccgtcgattgcccgtggttcgacgagcctgccgcggtcggacgcgcgccgcgcgcgccgatgtgggtgcgcgaggtgatcctgtcggtggacggcgtgccgtacgtcgccgcgcacagcatcgcgccgctcgcggccagcaagggcgtatggcaggcgatgcggcggctgcgcacgcgcccgctcgccgaattgctgtacagcgacccgcaggtcgcgcgctcggcgctcgtgagccggcgcgtgatcgccggccatccgctgtatgcgctcgcgagccatgcgctgcagcgcgagcgcgcaccgcatgcattcgccgcgcggcgctcggtattccagcggcacggcgagccgctgatggtcacggaatgcatgctgccggcgttgtggcgccatctcgccgcgcacggcgacggcccgcgctcgctcgggccgcgggcagacgcgtga

SEQ ID NO: 48429 - protein, 198 aa, Burkholderia vietnamiensis G4
MRFDGARSGWRATPRPGCTLEQRDWLTRGGSLTAHLARLGSVSVRVTREAVDCPWFDEPAAVGRAPRAPMWVREVILSVDGVPYVAAHSIAPLAASKGVWQAMRRLRTRPLAELLYSDPQVARSALVSRRVIAGHPLYALASHALQRERAPHAFAARRSVFQRHGEPLMVTECMLPALWRHLAAHGDGPRSLGPRADA

SEQ ID NO: 48430 - DNA, 603 bp, Burkholderia mallei 10229
  CDS (1)..(603)
atggcgcggatgcgtttcgacgccgccgatgcgcactggcgcgagacgccgcgccccggcgcgtcgagcgcgcagaaggactggctcacgcgcggcggctcgctcaccgcgcacctcgcgcggctcggccgcgtgacggtgcgcgtgacgcgcgagacggtcgcggcgccgtgggccgacgagcaccgcgcgctttcctgcgcgtcgcgcgcgccggtgtgggtgcgcgaggtcgtgctcgcggtcgacggcgcgccgttcgtcgccgcgcacagcatcgcgccgctcgccgcgagcaagggcgtgtggcaggcgatgcggcggctgcgcacgcgcccgctcgccgagctgctctatagcgatccggaagtgacgcgctcggcgctcgtgagccggcgcgtgctcgccgggcatccgttgttctcgctcgcatcgctcgcgctcgcgcgcgcgtatgcgacggagcacgcgttcgccgcccgccgctcggtgttcgagcggcgcggcacgccgctgatggtgaccgaatgcatgctgcccgcgctgtggcggcatctcgacgcacacggcgagcgccgcgcgcgcggcctcgagcagacgtga

SEQ ID NO: 48431 - protein, 200 aa, Burkholderia mallei 10229
MARMRFDAADAHWRETPRPGASSAQKDWLTRGGSLTAHLARLGRVTVRVTRETVAAPWADEHRALSCASRAPVWVREVVLAVDGAPFVAAHSIAPLAASKGVWQAMRRLRTRPLAELLYSDPEVTRSALVSRRVLAGHPLFSLASLALARAYATEHAFAARRSVFERRGTPLMVTECMLPALWRHLDAHGERRARGLEQT

SEQ ID NO: 48432 - DNA, 597 bp, Burkholderia cenocepacia AU 1054
  CDS (1)..(597): transl_table=11
atgcgattcgacggcgcgcaggccggctggcgcgagacgccgcggcctggctgcacgctcgaccagcgcgactggctgacgcgcggcggatcgctgaccgcgcacctcgcgcggctcggccgcgtgaacgtgcgggtgacgcgcgaggccgtcgaccgcccgtggttcgacgagccggacgcgctcgccagttcgccgcgcgcgccgatgtgggtgcgcgaggtgatcctgtcggtcgacggcatgccgtacgtcgccgcgcacagcatcgcgccgctcgcggccagcaagggcgtgtggcaggcgatgcggcggctgcgcacgcgaccgctcgcggagctgctgtacagcgatccgcaggtcgagcgctcggcgctcgtgagccggcgcgtgatcgccggccatccgctgtatgcgctcgcgagccatgcattgctgggcgcgcgggcgccgcatgcgttcgtcgcgcggcgctcggtgttccagcgtcacggcaagccgctgatggtcaccgagtgcatgctgccggcgctgtggcgccacctcgatgcgcacggcgacgggccgcggtccgtcgggtcgcacggaggcgcgtga

SEQ ID NO: 48433 - protein, 198 aa, Burkholderia cenocepacia AU 1054
MRFDGAQAGWRETPRPGCTLDQRDWLTRGGSLTAHLARLGRVNVRVTREAVDRPWFDEPDALASSPRAPMWVREVILSVDGMPYVAAHSIAPLAASKGVWQAMRRLRTRPLAELLYSDPQVERSALVSRRVIAGHPLYALASHALLGARAPHAFVARRSVFQRHGKPLMVTECMLPALWRHLDAHGDGPRSVGSHGGA

SEQ ID NO: 48434 - DNA, 603 bp, Burkholderia pseudomallei 1655
  CDS (1)..(603)
atggcgcggatgcgtttcgacgccgccgatgcgcactggcgcgagacgccgcgccccggcgcgtcgagcgcgcagaaggactggctcacgcgcggcggctcgctcaccgcgcacctcgcgcggctcggccgcgtgacggtgcgcgtgacgcgcgagacggtcgcggcgccgtgggccgacgagcatcgcgcgctttcctgcgcgtcgcgcgcgccggtgtgggtgcgcgaggtcgtgctcgcggtcgacggcgcgccgttcgtcgccgcgcacagcatcgcgccgctcgccgcgagcaagggcgtgtggcaggcgatgcggcggctgcgcacgcgcccgctcgccgagctgctctatagcgatccggaagtgacgcgctcggcgctcgtgagccggcgcgtgctcgccgggcatccgttgttctcgctcgcatcgctcgcgctcgcgcgcgcgcatgcgacggagcacgcgttcgccgcccgccgctcggtgttcgagcggcgcggcacgccgctgatggtgaccgaatgcatgctgcccgcgctgtggcggcatctcgacgcacacggcgagcgccgcgcgcgcggcctcgagcagacgtga

SEQ ID NO: 48435 - protein, 200 aa, Burkholderia pseudomallei 1655
MARMRFDAADAHWRETPRPGASSAQKDWLTRGGSLTAHLARLGRVTVRVTRETVAAPWADEHRALSCASRAPVWVREVVLAVDGAPFVAAHSIAPLAASKGVWQAMRRLRTRPLAELLYSDPEVTRSALVSRRVLAGHPLFSLASLALARAHATEHAFAARRSVFERRGTPLMVTECMLPALWRHLDAHGERRARGLEQT

SEQ ID NO: 48436 - DNA, 552 bp, Chromohalobacter salexigens DSM 3043
  CDS (1)..(552): transl_table=11
atgtctcctgaccgcttcccaggctggccgcactggctgcccatcgccgcgcagcgtcctcgaatgagccccgactggtggccctgggtggcctctcgcgattcactgaccgcgcgcttgcgcatcgccagcccccgtccattctcggtgcgtctgctcacccagggcgtgaccaggccacgcctcgacgaagcccaggcactggggctgccgcaccgcacgcacgtctggcaccgggaagtcctgttgcggctgggcaatgcctcctgggttgcggcccgttccgtggcaccgctggagggactgtccggcgcacggctatgcacgctgggagagcgttcgctgggcagttggctatttcggcaacctaacctcgagcgcggccccatcgaagcgatccgtgcgccggccatgacggggctggacgcctggcgaggcgacgccggcccctgggggcggcgctcgctcctgcgcgtgggcagaaccaggattctcgtccaggaattctttctcgccgcgatggccgctgacctctcgctgccatcgcgctaa

SEQ ID NO: 48437 - protein, 183 aa, Chromohalobacter salexigens DSM 3043
MSPDRFPGWPHWLPIAAQRPRMSPDWWPWVASRDSLTARLRIASPRPFSVRLLTQGVTRPRLDEAQALGLPHRTHVWHREVLLRLGNASWVAARSVAPLEGLSGARLCTLGERSLGSWLFRQPNLERGPIEAIRAPAMTGLDAWRGDAGPWGRRSLLRVGRTRILVQEFFLAAMAADLSLPSR

SEQ ID NO: 48438 - DNA, 537 bp, Methylobacillus flagellatus KT
  CDS (1)..(537): transl_table=11
atgcgtgaccgttggctcaagcgggccgtaggtgctcgacattaccgtccctggctcaccgagcgtggttcattgaccaggcgcttgcagcaacatagcaggcagtttgcagtgcagcccttgcatctggcgaggaaaaagccgcctcttgccgaagcgcagctattgcaggtgttacctcggcagcataccttgcagcgggatgtcatattgcgttgtgacggcgaggcggtagtgtttgcccatagcttattgccccagcaagccatgcgaggcacctggcgtggccttggccgcctggggtctcattcgctcggcagcgccttgtttgctgatccgcgcatgtgccgcggcgcattgcagtacaagaaactttcaccgcagcattttctctatcgcctggctgtggcgcatattcctgcgatgcgcggcccgatatgggcgaggcgctcggtattcaggctgggaaggaaggcagtgctggtgagcgagttgttcctgcctagcgtgttgaaacttcccttgatcaataaatag

SEQ ID NO: 48439 - protein, 178 aa, Methylobacillus flagellatus KT
MRDRWLKRAVGARHYRPWLTERGSLTRRLQQHSRQFAVQPLHLARKKPPLAEAQLLQVLPRQHTLQRDVILRCDGEAVVFAHSLLPQQAMRGTWRGLGRLGSHSLGSALFADPRMCRGALQYKKLSPQHFLYRLAVAHIPAMRGPIWARRSVFRLGRKAVLVSELFLPSVLKLPLINK

SEQ ID NO: 48440 - DNA, 564 bp, Shewanella baltica OS155
  CDS (1)..(564): transl_table=11
atgaatgtgactagcttaagcttcccctatggtgaatctattcagtggttttgtgccgaaagcgccaacaaactcccaaaatcgcccttgaaagaatggttacttgccactggcagcctaactcaaaaactcaaaacttgctgcactcaatttgaagtcaaagtccttggcgaaggactgcatgcgcccttagatggcgaatatccccagcaaggctcagtatggatccgcgaagtgttactttgcctcgactcaatcccttgggtatttgccagaaccttgatccccgaaaagttaatggccgaacgccaagccgatttccttggtctgggcacccgccccttaggtgaactgctgtttagccaagatcattttatcccaggcagaattgaagtcgccagttttgagacctgtagccgcctcgctcatttagccgaaagtttagatcagagtgtcgaacatgaactctggggacgccgccgctattttcatcacggtgaacacgaaatgatcgtcagtgaaatctttctgcctgcggccgagcaagctatccgtaagttatga

SEQ ID NO: 48441 - protein, 187 aa, Shewanella baltica OS155
MNVTSLSFPYGESIQWFCAESANKLPKSPLKEWLLATGSLTQKLKTCCTQFEVKVLGEGLHAPLDGEYPQQGSVWIREVLLCLDSIPWVFARTLIPEKLMAERQADFLGLGTRPLGELLFSQDHFIPGRIEVASFETCSRLAHLAESLDQSVEHELWGRRRYFHHGEHEMIVSEIFLPAAEQAIRKL

SEQ ID NO: 48442 - DNA, 564 bp, Shewanella amazonensis SB2B
  CDS (1)..(564): transl_table=11
atgagtgtgaccagtctcagttttccttacggtgaatccatttgttggtattcgccggatgagctggacaggttgcccgacggtgcccttgccgattggctacttgccagtggcagcctgacggccaggttaagagcccactgcagccagtttgaggtccgggtactcggtgaagccatgctgccaggcctgcccggcgaaccccaattaccccatacctgggtgcgggaagtcttgcttatcctcgacggtactccctgggtgttcgcacgcactctggtgccagaagccctgctgacccgctgcggagatgaattaaccgcactgggagacagaccccttggcgaactcctcttttccagcaacctcttcacaccgggccgaatcgaaatcgctggctttcattcctgcggcaccctggctcgcctcgccgagagcctgggacaaaatgtccatggtcgcctttggggccgtcgtcgctacttcgagcgggagggggacgagctgattgtcagcgaaatatttctccctgctgccatggattatatcctcggacctcaataa

SEQ ID NO: 48443 - protein, 187 aa, Shewanella amazonensis SB2B
MSVTSLSFPYGESICWYSPDELDRLPDGALADWLLASGSLTARLRAHCSQFEVRVLGEAMLPGLPGEPQLPHTWVREVLLILDGTPWVFARTLVPEALLTRCGDELTALGDRPLGELLFSSNLFTPGRIEIAGFHSCGTLARLAESLGQNVHGRLWGRRRYFEREGDELIVSEIFLPAAMDYILGPQ

SEQ ID NO: 48444 - DNA, 615 bp, Shewanella frigidimarina NCIMB 400
  CDS (1)..(615): transl_table=11
atgaacgtgaccagtattagctttccttatggtgaatcaattcattggttttcgccacaaaagatcgattcattgcctcatagccaacttaaagagtggctattagcaaccggaagtttgacccaacgcctcaagacacactgcaaacactttgaagtaaaagtgttaggcgagcatttacttgagcctctggcggatgaatttcctgctcaaactaaccccgtttggatccgcgaagtattattgtgtcttgacggtaccccgtgggtatttgcccgcacactgatcccacaaacgattttaggctctcaaacccctaactatcaaaatgctgatgataaacagattcgtgagcaacagaatgattttactcgccttggcactcggcctttaggtgaattactgtttagtagcccagacattactcccggcaatattgaagtcgctcagtttgaaacctgtggccgtttagctgccctagccaccagcttaaatcaacaggttaatagtagtttatggggacgtagacgttactttaacttgcacggttcacagctaattgtcagcgaaatatttctgcctgctgcggtcgagtacatcaaccaaagcatttaa

SEQ ID NO: 48445 - protein, 204 aa, Shewanella frigidimarina NCIMB 400
MNVTSISFPYGESIHWFSPQKIDSLPHSQLKEWLLATGSLTQRLKTHCKHFEVKVLGEHLLEPLADEFPAQTNPVWIREVLLCLDGTPWVFARTLIPQTILGSQTPNYQNADDKQIREQQNDFTRLGTRPLGELLFSSPDITPGNIEVAQFETCGRLAALATSLNQQVNSSLWGRRRYFNLHGSQLIVSEIFLPAAVEYINQSI

SEQ ID NO: 48446 - DNA, 564 bp, Pseudomonas fluorescens
  CDS (1)..(564): transl_table=11
gtgccgcactcaatgccccccgccccggcccccatctggctggtgcaaagccgtttgtcccccttccccggcacagccgttgccaactggctgttcgatgaagggtcgctgacccggcgcctgacccggctgtcccacaacgccttcagcgtcaccccgctggtgcaagagtggcaaaccctgcgcaacgacgaatgcgccgccctgggcctgcccgaacagagcgaaggctgggtgcgcgaggtgtacttgcgcgggcacggccaggcctgggtgttcgcccgtagcgtcgccgcccgcagcgccctgctcgaaggcggcctgaatatcgacgaactgggcagccgctccctgggcgagttgctgttctgcgaccaggcctttacccgccagcccatcgaagtctgccgctacccccggcactggctgcccgctgccgttgccgacaacggcctgtggggccgtcgctcacgctttgaccgcggccccctgagcctgctggtggcggaaatcttcctgcccagcctgtggaccgccatagacgcccgaccggaggcctgctga

SEQ ID NO: 48447 - protein, 187 aa, Pseudomonas fluorescens
MPHSMPPAPAPIWLVQSRLSPFPGTAVANWLFDEGSLTRRLTRLSHNAFSVTPLVQEWQTLRNDECAALGLPEQSEGWVREVYLRGHGQAWVFARSVAARSALLEGGLNIDELGSRSLGELLFCDQAFTRQPIEVCRYPRHWLPAAVADNGLWGRRSRFDRGPLSLLVAEIFLPSLWTAIDARPEAC

SEQ ID NO: 48448 - DNA, 609 bp, Xanthomonas albilineans
  CDS (1)..(609): transl_table=11
atgcatccgccgtcgccgttgaacacgcagcagaaagactggctgacacgcggtggttcgttgaccgcgcacctgcgcctgttggggcaggtacaggtgcaagtgcaacgggagcacaaagccatggcctggctggatgaatatcgggtgctcggactgtcgcgctgcctgcttgtatgggtgcgtgaagtggtcctggtggtggacgccaaaccctatgtctatgcgcgtagcctgacgccgctgaccgccagttacaacgcctggcaggcagtgcgtagcatcggcagtcgcccgttagctgatctgttgttccgtgatcgcagcgtgctacgttcggcgttggcgagtcggcgcatcaccgcgcagcatccgctgcaccggcgcgcatgcaacttcgtggcacagtcgcatgcgacgcaagccctgctggcgcgccgctcggtatttacgcggcaaggcgccccgttgctgatcaccgaatgcatgctgccagcgttgtgggcaacgctggaaccggtggcagctccgcgccaggcgagtctgagtgcggacggcccttgccggcattcagcgcagatcgtctcgcctgagtcgatgctggaatag

SEQ ID NO: 48449 - protein, 202 aa, Xanthomonas albilineans
MHPPSPLNTQQKDWLTRGGSLTAHLRLLGQVQVQVQREHKAMAWLDEYRVLGLSRCLLVWVREVVLVVDAKPYVYARSLTPLTASYNAWQAVRSIGSRPLADLLFRDRSVLRSALASRRITAQHPLHRRACNFVAQSHATQALLARRSVFTRQGAPLLITECMLPALWATLEPVAAPRQASLSADGPCRHSAQIVSPESMLE

SEQ ID NO: 48450 - DNA, 549 bp, Pseudomonas putida
  CDS (1)..(549): transl_table=11
atgcaagtagtttataacttttcgcaacccgggctgcagtggaaacaaagtgaccatttgcgctcactaatgacggtgaccagtagggactggctgttggatagggggtctctgacaaggcgtttgcgagtcctgtcagacgatgacctggaggtagttcctttacgtgaggaggttggagtgatcctgccacatgaagctgacgtattgggactgcagttaggggcaatcggcggggtacgtgaggtttatctagtcgggtttggtcgaccatgggtttttgcaaggtctatcatcgtaaactcaggctctattgaggaaggctcagcgttattacagctgggaaacatgccgctgggagatttattgtttggagatggctcttttcagcggagcgaaattgaagtgtgtcgctatcacgatgcgtgcaatgcgagtgcgagatctacttatccgttgtgggctaggcgttccgtgttcaaacgtgagaaaatgcatgtcttggtgcaagaaatgtttttgccagcactctgggaggagatgagctag

SEQ ID NO: 48451 - protein, 182 aa, Pseudomonas putida
MQVVYNFSQPGLQWKQSDHLRSLMTVTSRDWLLDRGSLTRRLRVLSDDDLEVVPLREEVGVILPHEADVLGLQLGAIGGVREVYLVGFGRPWVFARSIIVNSGSIEEGSALLQLGNMPLGDLLFGDGSFQRSEIEVCRYHDACNASARSTYPLWARRSVFKREKMHVLVQEMFLPALWEEMS

SEQ ID NO: 48452 - DNA, 549 bp, Pseudomonas sp
  CDS (1)..(549): transl_table=11
atggaggtggcgtaccgtttttcgcaaccgcacctggagtggaattcctacggccattggcgttcgtcgatagccgcgacccagcgggaatggctgtttgaccgcagttcactgacgcgccgcctcaggacgctatccgacaatgagttcgaggtgattcccctacgtgaagcggcggggccgatgctgccggaagaatgccgggtgcttgggttgcaacccggggtcacgggctggattcgtgaagtctacctggccggtttcggtcggccgtgggtgtatgcaaggtcggtgatcagtcattgtgatgttgaaggaagtgattcagcgttacttcaactaggcaatattccattgggaagtctgttatttggcgagaacccttataagcgcagcgaaatagaagtgtgtcgatatccggatgcctgtaacgccagcagtcgaccggcttatccgttatgggccagacgttcggtgttcagtcgtcggcaaagtcgcgtcctggttcatgaaatgttcttgccagcactgtgggaggagttgagttaa

SEQ ID NO: 48453 - protein, 182 aa, Pseudomonas sp
MEVAYRFSQPHLEWNSYGHWRSSIAATQREWLFDRSSLTRRLRTLSDNEFEVIPLREAAGPMLPEECRVLGLQPGVTGWIREVYLAGFGRPWVYARSVISHCDVEGSDSALLQLGNIPLGSLLFGENPYKRSEIEVCRYPDACNASSRPAYPLWARRSVFSRRQSRVLVHEMFLPALWEELS

SEQ ID NO: 48454 - DNA, 23 bp, Artificial sequence
  (1)..(23): primer
atgcgattgttgcgtttttgttg

SEQ ID NO: 48455 - DNA, 22 bp, Artificial sequence
  (1)..(22): primer
ttagtacaacggtgacgccggt

SEQ ID NO: 48456 - protein, 177 aa, Artificial sequence
  Variant (3)..(6): xaa in position 3 to 6 is any amino acid
  Variant (10)..(19): xaa in position 10 to 19 is any amino acid
  Variant (20)..(21): xaa in position 20 to 21 is any or no amino acid
  Variant (23)..(41): xaa in position 23 to 41 is any amino acid
  Variant (42)..(54): xaa in position 42 to 54 is any or no amino acid
  Variant (59)..(59): xaa in position 59 is any amino acid
  Variant (61)..(66): xaa in position 61 to 66 is any amino acid
  Variant (67)..(67): xaa in position 67 is any or no amino acid
  Variant (70)..(70): xaa in position 70 is any amino acid
  Variant (72)..(72): xaa in position 72 is any amino acid
  Variant (75)..(84): xaa in position 75 to 84 is any amino acid
  Variant (85)..(101): xaa in position 85 to 101 is any or no amino acid
  Variant (103)..(103): xaa in position 103 is any amino acid
  Variant (104)..(104): xaa in position 104 is any or no amino acid
  Variant (107)..(109): xaa in position 107 to 109 is any amino acid
  Variant (112)..(113): xaa in position 112 to 113 is any amino acid
  Variant (116)..(121): xaa in position 116 to 121 is any amino acid
  Variant (123)..(124): xaa in position 123 to 124 is any amino acid
  Variant (126)..(131): xaa in position 126 to 131 is any amino acid
  Variant (132)..(154): xaa in position 132 to 154 is any or no amino acid
  Variant (156)..(156): xaa in position 156 is any amino acid
  Variant (161)..(168): xaa in position 161 to 168 is any amino acid
  Variant (172)..(172): xaa in position 172 is any amino acid
  Variant (174)..(174): xaa in position 174 is any amino acid
WLXXXXSLTXXXXXXXXXXXXVXXXXXXXXXXXXXXXXXXXXXXXXXXXXXXXXVREVXLXXXXXXXWVXAXSVXXXXXXXXXXXXXXXXXXXXXXXXXXXLXXLGXXXLGXXLFXXXXXXRXXIXXXXXXXXXXXXXXXXXXXXXXXXXXXXXLXARRSXXXXXXXXLLVXEXFLP

SEQ ID NO: 48457 - protein, 9 aa, Artificial sequence
  Variant (2)..(2): xaa in position 2 is Leu or Val
  Variant (3)..(5): xaa in position 3 to 5 is any amino acid
  Variant (6)..(6): xaa in position 6 is Asp, Gly, Ser or Thr
  Variant (8)..(8): xaa in position 8 is Leu, Met or Val
WXXXXXSXT

SEQ ID NO: 48458 - protein, 17 aa, Artificial sequence
  Variant (3)..(3): xaa in position 3 is Ile or Val
  Variant (4)..(4): xaa in position 4 is any amino acid
  Variant (6)..(8): xaa in position 6 to 8 is any amino acid
  Variant (9)..(9): xaa in position 9 is Asp, Glu, Gly, Asn or Gln
  Variant (10)..(14): xaa in position 10 to 14 is any amino acid
  Variant (15)..(15): xaa in position 15 is Ala, Gly or Gln
  Variant (16)..(16): xaa in position 16 is any amino acid
  Variant (17)..(17): xaa in position 17 is Gln, Ser or Thr
REXXLXXXXXXXXXXXX

SEQ ID NO: 48459 - protein, 10 aa, Artificial sequence
  Variant (2)..(3): xaa in position 2 to 3 is any amino acid
  Variant (4)..(4): xaa in position 4 is Ala, Pro or Ser
  Variant (5)..(5): xaa in position 5 is Ile or Leu
  Variant (7)..(8): xaa in position 7 to 8 is any amino acid
  Variant (9)..(9): xaa in position 9 is Leu or Val
GXXXXGXXXF

SEQ ID NO: 48460 - protein, 23 aa, Artificial sequence
  Variant (2)..(3): xaa in position 2 to 3 is any or no amino acid
  Variant (5)..(5): xaa in position 5 is any or no amino acid
  Variant (7)..(14): xaa in position 7 to 14 is any amino acid
  Variant (15)..(15): xaa in position 15 is Ile, Leu, Met or Val
  Variant (16)..(16): xaa in position 16 is Leu or Met
  Variant (17)..(17): xaa in position 17 is Ile, Leu or Val
  Variant (18)..(18): xaa in position 18 is any amino acid
  Variant (20)..(21): xaa in position 20 to 21 is any amino acid
  Variant (23)..(23): xaa in position 23 is Ala, Pro or Ser
RXXRXSXXXXXXXXXXXXEXXLX

SEQ ID NO: 48461 - DNA, 1473 bp, Escherichia coli; identical to SEQ ID NO: 27148
  CDS (1)..(1473)

SEQ ID NO: 48462 - protein, 490 aa, Escherichia coli; identical to SEQ ID NO: 27149

SEQ ID NO: 48463 - DNA, 1620 bp, Saccharomyces cerevisiae; identical to SEQ ID NO: 27150
  CDS (1)..(1620)

SEQ ID NO: 48464 - protein, 539 aa, Saccharomyces cerevisiae; identical to SEQ ID NO: 27151

SEQ ID NO: 48465 - DNA, 1545 bp, Mesorhizobium loti MAFF303099; identical to SEQ ID NO: 27152
  CDS (1)..(1545): transl_table=11

SEQ ID NO: 48466 - protein, 514 aa, Mesorhizobium loti MAFF303099; identical to SEQ ID NO: 27153

SEQ ID NO: 48467 - DNA, 1656 bp, Mesorhizobium loti MAFF303099; identical to SEQ ID NO: 27154
  CDS (1)..(1656): transl_table=11

SEQ ID NO: 48468 - protein, 551 aa, Mesorhizobium loti MAFF303099; identical to SEQ ID NO: 27155

SEQ ID NO: 48469 - DNA, 1518 bp, Mesorhizobium loti MAFF303099; identical to SEQ ID NO: 27156
  CDS (1)..(1518): transl_table=11

SEQ ID NO: 48470 - protein, 505 aa, Mesorhizobium loti MAFF303099; identical to SEQ ID NO: 27157

SEQ ID NO: 48471 - DNA, 1563 bp, Thermotoga maritima MSB8; identical to SEQ ID NO: 27158
  CDS (1)..(1563): transl_table=11

SEQ ID NO: 48472 - protein, 520 aa, Thermotoga maritima MSB8; identical to SEQ ID NO: 27159

SEQ ID NO: 48473 - DNA, 1452 bp, Pasteurella multocida subsp. multocida str. Pm70; identical to SEQ ID NO: 27160
  CDS (1)..(1452): transl_table=11

SEQ ID NO: 48474 - protein, 483 aa, Pasteurella multocida subsp. multocida str. Pm70; identical to SEQ ID NO: 27161

SEQ ID NO: 48475 - DNA, 1518 bp, Pasteurella multocida subsp. multocida str. Pm70; identical to SEQ ID NO: 27162
  CDS (1)..(1518): transl_table=11

SEQ ID NO: 48476 - protein, 505 aa, Pasteurella multocida subsp. multocida str. Pm70; identical to SEQ ID NO: 27163

SEQ ID NO: 48477 - DNA, 2733 bp, Pasteurella multocida subsp. multocida str. Pm70; identical to SEQ ID NO: 27164
  CDS (1)..(2733): transl_table=11

SEQ ID NO: 48478 - protein, 910 aa, Pasteurella multocida subsp. multocida str. Pm70; identical to SEQ ID NO: 27165

SEQ ID NO: 48479 - DNA, 1566 bp, Pseudomonas aeruginosa PAO1; identical to SEQ ID NO: 27166
  CDS (1)..(1566): transl_table=11

SEQ ID NO: 48480 - protein, 521 aa, Pseudomonas aeruginosa PAO1; identical to SEQ ID NO: 27167

SEQ ID NO: 48481 - DNA, 2751 bp, Pseudomonas aeruginosa PAO1; identical to SEQ ID NO: 27168
  CDS (1)..(2751): transl_table=11

SEQ ID NO: 48482 - protein, 916 aa, Pseudomonas aeruginosa PAO1; identical to SEQ ID NO: 27169

SEQ ID NO: 48483 - DNA, 1698 bp, Lactococcus lactis subsp. lactis Il1403; identical to SEQ ID NO: 27170
  CDS (1)..(1698): transl_table=11

SEQ ID NO: 48484 - protein, 565 aa, Lactococcus lactis subsp. lactis Il1403; identical to SEQ ID NO: 27171

SEQ ID NO: 48485 - DNA, 1521 bp, Lactococcus lactis subsp. lactis Il1403; identical to SEQ ID NO: 27172
  CDS (1)..(1521): transl_table=11

SEQ ID NO: 48486 - protein, 506 aa, Lactococcus lactis subsp. lactis Il1403; identical to SEQ ID NO: 27173

SEQ ID NO: 48487 - DNA, 1590 bp, Escherichia coli O157:H7 EDL933; identical to SEQ ID NO: 27174
  CDS (1)..(1590): n means a or g or c or t/u, s means g or c

SEQ ID NO: 48488 - protein, 529 aa, Escherichia coli O157:H7 EDL933; identical to SEQ ID NO: 27175
  Xaa in position 383 is unknown

SEQ ID NO: 48489 - DNA, 1590 bp, Escherichia coli O157:H7; identical to SEQ ID NO: 27176
  CDS (1)..(1590): transl_table=11

SEQ ID NO: 48490 - protein, 529 aa, Escherichia coli O157:H7; identical to SEQ ID NO: 27177

SEQ ID NO: 48491 - DNA, 1512 bp, Escherichia coli O157:H7; identical to SEQ ID NO: 27178
  CDS (1)..(1512): transl_table=11

SEQ ID NO: 48492 - protein, 503 aa, Escherichia coli O157:H7; identical to SEQ ID NO: 27179

SEQ ID NO: 48493 - DNA, 2685 bp, Escherichia coli O157:H7; identical to SEQ ID NO: 27180
  CDS (1)..(2685): transl_table=11

SEQ ID NO: 48494 - protein, 894 aa, Escherichia coli O157:H7; identical to SEQ ID NO: 27181

SEQ ID NO: 48495 - DNA, 2793 bp, Agrobacterium tumefaciens str. C58; identical to SEQ ID NO: 27182
  CDS (1)..(2793): transl_table=11

SEQ ID NO: 48496 - protein, 930 aa, Agrobacterium tumefaciens str. C58; identical to SEQ ID NO: 27183

SEQ ID NO: 48497 - DNA, 1593 bp, Staphylococcus aureus subsp. aureus Mu50; identical to SEQ ID NO: 27184
  CDS (1)..(1593): transl_table=11

SEQ ID NO: 48498 - protein, 530 aa, Staphylococcus aureus subsp. aureus Mu50; identical to SEQ ID NO: 27185

SEQ ID NO: 48499 - DNA, 1704 bp, Sinorhizobium meliloti 1021; identical to SEQ ID NO: 27186
  CDS (1)..(1704): transl_table=11

SEQ ID NO: 48500 - protein, 567 aa, Sinorhizobium meliloti 1021; identical to SEQ ID NO: 27187

SEQ ID NO: 48501 - DNA, 1491 bp, Yersinia pestis CO92; identical to SEQ ID NO: 27188
  CDS (1)..(1491)

SEQ ID NO: 48502 - protein, 496 aa, Yersinia pestis CO92; identical to SEQ ID NO: 27189

SEQ ID NO: 48503 - DNA, 1593 bp, Yersinia pestis CO92; identical to SEQ ID NO: 27190
  CDS (1)..(1593)

SEQ ID NO: 48504 - protein, 530 aa, Yersinia pestis CO92; identical to SEQ ID NO: 27191

SEQ ID NO: 48505 - DNA, 1596 bp, Yersinia pestis CO92; identical to SEQ ID NO: 27192
  CDS (1)..(1596)

SEQ ID NO: 48506 - protein, 531 aa, Yersinia pestis CO92; identical to SEQ ID NO: 27193

SEQ ID NO: 48507 - DNA, 1515 bp, Yersinia pestis CO92; identical to SEQ ID NO: 27194
  CDS (1)..(1515)

SEQ ID NO: 48508 - protein, 504 aa, Yersinia pestis CO92; identical to SEQ ID NO: 27195

SEQ ID NO: 48509 - DNA, 1536 bp, Sinorhizobium meliloti 1021; identical to SEQ ID NO: 27196
  CDS (1)..(1536): transl_table=11

SEQ ID NO: 48510 - protein, 511 aa, Sinorhizobium meliloti 1021; identical to SEQ ID NO: 27197

SEQ ID NO: 48511 - DNA, 1647 bp, Sinorhizobium meliloti 1021; identical to SEQ ID NO: 27198
  CDS (1)..(1647): transl_table=11

SEQ ID NO: 48512 - protein, 548 aa, Sinorhizobium meliloti 1021; identical to SEQ ID NO: 27199

SEQ ID NO: 48513 - DNA, 1602 bp, Sinorhizobium meliloti 1021; identical to SEQ ID NO: 27200
  CDS (1)..(1602): transl_table=11

SEQ ID NO: 48514 - protein, 533 aa, Sinorhizobium meliloti 1021; identical to SEQ ID NO: 27201

SEQ ID NO: 48515 - DNA, 1476 bp, Salmonella typhimurium LT2; identical to SEQ ID NO: 27202
  CDS (1)..(1476): transl_table=11

SEQ ID NO: 48516 - protein, 491 aa, Salmonella typhimurium LT2; identical to SEQ ID NO: 27203

SEQ ID NO: 48517 - DNA, 1593 bp, Salmonella typhimurium LT2; identical to SEQ ID NO: 27204
  CDS (1)..(1593): transl_table=11

SEQ ID NO: 48518 - protein, 530 aa, Salmonella typhimurium LT2; identical to SEQ ID NO: 27205

SEQ ID NO: 48519 - DNA, 1872 bp, Salmonella typhimurium LT2; identical to SEQ ID NO: 27206
  CDS (1)..(1872): transl_table=11

SEQ ID NO: 48520 - protein, 623 aa, Salmonella typhimurium LT2; identical to SEQ ID NO: 27207

SEQ ID NO: 48521 - DNA, 1590 bp, Salmonella typhimurium LT2; identical to SEQ ID NO: 27208
  CDS (1)..(1590): transl_table=11

SEQ ID NO: 48522 - protein, 529 aa, Salmonella typhimurium LT2; identical to SEQ ID NO: 27209

SEQ ID NO: 48523 - DNA, 1536 bp, Salmonella typhimurium LT2; identical to SEQ ID NO: 27210
  CDS (1)..(1536): transl_table=11

SEQ ID NO: 48524 - protein, 511 aa, Salmonella typhimurium LT2; identical to SEQ ID NO: 27211

SEQ ID NO: 48525 - DNA, 1656 bp, Ralstonia solanacearum GMI1000; identical to SEQ ID NO: 27212
  CDS (1)..(1656): transl_table=11

SEQ ID NO: 48526 - protein, 551 aa, Ralstonia solanacearum GMI1000; identical to SEQ ID NO: 27213

SEQ ID NO: 48527 - DNA, 1524 bp, Agrobacterium tumefaciens str. C58; identical to SEQ ID NO: 27214
  CDS (1)..(1524): transl_table=11

SEQ ID NO: 48528 - protein, 507 aa, Agrobacterium tumefaciens str. C58; identical to SEQ ID NO: 27215

SEQ ID NO: 48529 - DNA, 1764 bp, Brucella melitensis 16M; identical to SEQ ID NO: 27216
  CDS (1)..(1764): transl_table=11

SEQ ID NO: 48530 - protein, 587 aa, Brucella melitensis 16M; identical to SEQ ID NO: 27217

SEQ ID NO: 48531 - DNA, 1464 bp, Schizosaccharomyces pombe 972h-; identical to SEQ ID NO: 27218
  CDS (1)..(1464)

SEQ ID NO: 48532 - protein, 487 aa, Schizosaccharomyces pombe 972h-; identical to SEQ ID NO: 27219

SEQ ID NO: 48533 - DNA, 1734 bp, Corynebacterium glutamicum ATCC 13032; identical to SEQ ID NO: 27220
  CDS (1)..(1734): transl_table=11

SEQ ID NO: 48534 - protein, 577 aa, Corynebacterium glutamicum ATCC 13032; identical to SEQ ID NO: 27221

SEQ ID NO: 48535 - DNA, 1644 bp, Corynebacterium glutamicum ATCC 13032; identical to SEQ ID NO: 27222
  CDS (1)..(1644): transl_table=11

SEQ ID NO: 48536 - protein, 547 aa, Corynebacterium glutamicum ATCC 13032; identical to SEQ ID NO: 27223

SEQ ID NO: 48537 - DNA, 1524 bp, Thermoanaerobacter tengcongensis MB4; identical to SEQ ID NO: 27224
  CDS (1)..(1524): transl_table=11

SEQ ID NO: 48538 - protein, 507 aa, Thermoanaerobacter tengcongensis MB4; identical to SEQ ID NO: 27225

SEQ ID NO: 48539 - DNA, 1593 bp, Staphylococcus aureus subsp. aureus MW2; identical to SEQ ID NO: 27226
  CDS (1)..(1593): transl_table=11

SEQ ID NO: 48540 - protein, 530 aa, Staphylococcus aureus subsp. aureus MW2; identical to SEQ ID NO: 27227

SEQ ID NO: 48541 - DNA, 1497 bp, Yersinia pestis KIM; identical to SEQ ID NO: 27228
  CDS (1)..(1497): transl_table=11

SEQ ID NO: 48542 - protein, 498 aa, Yersinia pestis KIM; identical to SEQ ID NO: 27229

SEQ ID NO: 48543 - DNA, 1515 bp, Yersinia pestis KIM; identical to SEQ ID NO: 27230
  CDS (1)..(1515): transl_table=11

SEQ ID NO: 48544 - protein, 504 aa, Yersinia pestis KIM; identical to SEQ ID NO: 27231

SEQ ID NO: 48545 - DNA, 1557 bp, Yersinia pestis KIM; identical to SEQ ID NO: 27232
  CDS (1)..(1557): transl_table=11

SEQ ID NO: 48546 - protein, 518 aa, Yersinia pestis KIM; identical to SEQ ID NO: 27233

SEQ ID NO: 48547 - DNA, 1542 bp, Bifidobacterium longum NCC2705; identical to SEQ ID NO: 27234
  CDS (1)..(1542): transl_table=11

SEQ ID NO: 48548 - protein, 513 aa, Bifidobacterium longum NCC2705; identical to SEQ ID NO: 27235

SEQ ID NO: 48549 - DNA, 2433 bp, Bifidobacterium longum NCC2705; identical to SEQ ID NO: 27236
  CDS (1)..(2433): transl_table=11

SEQ ID NO: 48550 - protein, 810 aa, Bifidobacterium longum NCC2705; identical to SEQ ID NO: 27237

SEQ ID NO: 48551 - DNA, 1593 bp, Shigella flexneri 2a str. 301; identical to SEQ ID NO: 27238
  CDS (1)..(1593): transl_table=11

SEQ ID NO: 48552 - protein, 530 aa, Shigella flexneri 2a str. 301; identical to SEQ ID NO: 27239

SEQ ID NO: 48553 - DNA, 1512 bp, Shigella flexneri 2a str. 301; identical to SEQ ID NO: 27240
  CDS (1)..(1512): transl_table=11

SEQ ID NO: 48554 - protein, 503 aa, Shigella flexneri 2a str. 301; identical to SEQ ID NO: 27241

SEQ ID NO: 48555 - DNA, 2736 bp, Shigella flexneri 2a str. 301; identical to SEQ ID NO: 27242
  CDS (1)..(2736): transl_table=11

SEQ ID NO: 48556 - protein, 911 aa, Shigella flexneri 2a str. 301; identical to SEQ ID NO: 27243

SEQ ID NO: 48557 - DNA, 1413 bp, Shewanella oneidensis MR-1; identical to SEQ ID NO: 27244
  CDS (1)..(1413): transl_table=11

SEQ ID NO: 48558 - protein, 470 aa, Shewanella oneidensis MR-1; identical to SEQ ID NO: 27245

SEQ ID NO: 48559 - DNA, 1380 bp, Streptococcus agalactiae NEM316; identical to SEQ ID NO: 27246
  CDS (1)..(1380): transl_table=11

SEQ ID NO: 48560 - protein, 459 aa, Streptococcus agalactiae NEM316; identical to SEQ ID NO: 27247

SEQ ID NO: 48561 - DNA, 1740 bp, Corynebacterium efficiens YS-314; identical to SEQ ID NO: 27248
  CDS (1)..(1740): transl_table=11

SEQ ID NO: 48562 - protein, 579 aa, Corynebacterium efficiens YS-314; identical to SEQ ID NO: 27249

SEQ ID NO: 48563 - DNA, 1476 bp, Corynebacterium efficiens YS-314; identical to SEQ ID NO: 27250
  CDS (1)..(1476): transl_table=11

SEQ ID NO: 48564 - protein, 491 aa, Corynebacterium efficiens YS-314; identical to SEQ ID NO: 27251

SEQ ID NO: 48565 - DNA, 2721 bp, Pseudomonas putida KT2440; identical to SEQ ID NO: 27252
  CDS (1)..(2721): transl_table=11

SEQ ID NO: 48566 - protein, 906 aa, Pseudomonas putida KT2440; identical to SEQ ID NO: 27253

SEQ ID NO: 48567 - DNA, 1485 bp, Escherichia coli CFT073; identical to SEQ ID NO: 27254
  CDS (1)..(1485): transl_table=11

SEQ ID NO: 48568 - protein, 494 aa, Escherichia coli CFT073; identical to SEQ ID NO: 27255

SEQ ID NO: 48569 - DNA, 1512 bp, Escherichia coli CFT073; identical to SEQ ID NO: 27256
  CDS (1)..(1512): transl_table=11

SEQ ID NO: 48570 - protein, 503 aa, Escherichia coli CFT073; identical to SEQ ID NO: 27257

SEQ ID NO: 48571 - DNA, 2736 bp, Escherichia coli CFT073; identical to SEQ ID NO: 27258
  CDS (1)..(2736): transl_table=11

SEQ ID NO: 48572 - protein, 911 aa, Escherichia coli CFT073; identical to SEQ ID NO: 27259

SEQ ID NO: 48573 - DNA, 1578 bp, Escherichia coli CFT073; identical to SEQ ID NO: 27260
  CDS (1)..(1578): transl_table=11

SEQ ID NO: 48574 - protein, 525 aa, Escherichia coli CFT073; identical to SEQ ID NO: 27261

SEQ ID NO: 48575 - DNA, 1542 bp, Vibrio vulnificus CMCP6; identical to SEQ ID NO: 27262
  CDS (1)..(1542): transl_table=11

SEQ ID NO: 48576 - protein, 513 aa, Vibrio vulnificus CMCP6; identical to SEQ ID NO: 27263

SEQ ID NO: 48577 - DNA, 1485 bp, Bradyrhizobium japonicum USDA 110; identical to SEQ ID NO: 27264
  CDS (1)..(1485)

SEQ ID NO: 48578 - protein, 494 aa, Bradyrhizobium japonicum USDA 110; identical to SEQ ID NO: 27265

SEQ ID NO: 48579 - DNA, 1518 bp, Clostridium tetani E88; identical to SEQ ID NO: 27266
  CDS (1)..(1518): transl_table=11

SEQ ID NO: 48580 - protein, 505 aa, Clostridium tetani E88; identical to SEQ ID NO: 27267

SEQ ID NO: 48581 - DNA, 1407 bp, Lactobacillus plantarum WCFS1; identical to SEQ ID NO: 27268
  CDS (1)..(1407): transl_table=11

SEQ ID NO: 48582 - protein, 468 aa, Lactobacillus plantarum WCFS1; identical to SEQ ID NO: 27269

SEQ ID NO: 48583 - DNA, 1629 bp, Tropheryma whipplei str. Twist; identical to SEQ ID NO: 27270
  CDS (1)..(1629): transl_table=11

SEQ ID NO: 48584 - protein, 542 aa, Tropheryma whipplei str. Twist; identical to SEQ ID NO: 27271

SEQ ID NO: 48585 - DNA, 1557 bp, Tropheryma whipplei str. Twist; identical to SEQ ID NO: 27272
  CDS (1)..(1557): transl_table=11

SEQ ID NO: 48586 - protein, 518 aa, Tropheryma whipplei str. Twist; identical to SEQ ID NO: 27273

SEQ ID NO: 48587 - DNA, 1629 bp, Tropheryma whipplei TW08/27; identical to SEQ ID NO: 27274
  CDS (1)..(1629): transl_table=11

SEQ ID NO: 48588 - protein, 542 aa, Tropheryma whipplei TW08/27; identical to SEQ ID NO: 27275

SEQ ID NO: 48589 - DNA, 1557 bp, Tropheryma whipplei TW08/27; identical to SEQ ID NO: 27276
  CDS (1)..(1557): transl_table=11

SEQ ID NO: 48590 - protein, 518 aa, Tropheryma whipplei TW08/27; identical to SEQ ID NO: 27277

SEQ ID NO: 48591 - DNA, 1584 bp, Pseudomonas syringae pv. tomato str. DC3000; identical to SEQ ID NO: 27278
  CDS (1)..(1584): transl_table=11

SEQ ID NO: 48592 - protein, 527 aa, Pseudomonas syringae pv. tomato str. DC3000; identical to SEQ ID NO: 27279

SEQ ID NO: 48593 - DNA, 1455 bp, Vibrio parahaemolyticus RIMD 2210633; identical to SEQ ID NO: 27280
  CDS (1)..(1455): transl_table=11

SEQ ID NO: 48594 - protein, 484 aa, Vibrio parahaemolyticus RIMD 2210633; identical to SEQ ID NO: 27281

SEQ ID NO: 48595 - DNA, 1632 bp, Vibrio parahaemolyticus RIMD 2210633; identical to SEQ ID NO: 27282
  CDS (1)..(1632): transl_table=11

SEQ ID NO: 48596 - protein, 543 aa, Vibrio parahaemolyticus RIMD 2210633; identical to SEQ ID NO: 27283

SEQ ID NO: 48597 - DNA, 1590 bp, Salmonella enterica subsp. enterica serovar Typhi Ty2; identical to SEQ ID NO: 27284
  CDS (1)..(1590): transl_table=11

SEQ ID NO: 48598 - protein, 529 aa, Salmonella enterica subsp. enterica serovar Typhi Ty2; identical to SEQ ID NO: 27285

SEQ ID NO: 48599 - DNA, 1596 bp, Salmonella enterica subsp. enterica serovar Typhi Ty2; identical to SEQ ID NO: 27286
  CDS (1)..(1596): transl_table=11

SEQ ID NO: 48600 - protein, 531 aa, Salmonella enterica subsp. enterica serovar Typhi Ty2; identical to SEQ ID NO: 27287

SEQ ID NO: 48601 - DNA, 1536 bp, Salmonella enterica subsp. enterica serovar Typhi Ty2; identical to SEQ ID NO: 27288
  CDS (1)..(1536): transl_table=11

SEQ ID NO: 48602 - protein, 511 aa, Salmonella enterica subsp. enterica serovar Typhi Ty2 [sequence omitted]

SEQ ID NO: 48603 - DNA, 2742 bp, Salmonella enterica subsp. enterica serovar Typhi Ty2; identical to SEQ ID NO: 27290
  CDS (1)..(2742): transl_table=11

SEQ ID NO: 48604 - protein, 913 aa, Salmonella enterica subsp. enterica serovar Typhi Ty2; identical to SEQ ID NO: 27291

SEQ ID NO: 48605 - DNA, 1470 bp, Bacteroides thetaiotaomicron VPI-5482; identical to SEQ ID NO: 27292
  CDS (1)..(1470): transl_table=11

SEQ ID NO: 48606 - protein, 489 aa, Bacteroides thetaiotaomicron VPI-5482; identical to SEQ ID NO: 27293

SEQ ID NO: 48607 - DNA, 1455 bp, Bacteroides thetaiotaomicron VPI-5482; identical to SEQ ID NO: 27294
  CDS (1)..(1455): transl_table=11

SEQ ID NO: 48608 - protein, 484 aa, Bacteroides thetaiotaomicron VPI-5482; identical to SEQ ID NO: 27295

SEQ ID NO: 48609 - DNA, 1425 bp, Enterococcus faecalis V583; identical to SEQ ID NO: 27296
  CDS (1)..(1425): transl_table=11

SEQ ID NO: 48610 - protein, 474 aa, Enterococcus faecalis V583; identical to SEQ ID NO: 27297

SEQ ID NO: 48611 - DNA, 1542 bp, Streptomyces avermitilis MA-4680; identical to SEQ ID NO: 27298
  CDS (1)..(1542)

SEQ ID NO: 48612 - protein, 513 aa, Streptomyces avermitilis MA-4680; identical to SEQ ID NO: 27299

SEQ ID NO: 48613 - DNA, 1533 bp, Bacillus cereus ATCC 14579; identical to SEQ ID NO: 27300
  CDS (1)..(1533): transl_table=11

SEQ ID NO: 48614 - protein, 510 aa, Bacillus cereus ATCC 14579; identical to SEQ ID NO: 27301

SEQ ID NO: 48615 - DNA, 2772 bp, Nitrosomonas europaea ATCC 19718; identical to SEQ ID NO: 27302
  CDS (1)..(2772): transl_table=11

SEQ ID NO: 48616 - protein, 923 aa, Nitrosomonas europaea ATCC 19718; identical to SEQ ID NO: 27303

SEQ ID NO: 48617 - DNA, 1533 bp, Bacillus anthracis str. Ames; identical to SEQ ID NO: 27304
  CDS (1)..(1533): transl_table=11

SEQ ID NO: 48618 - protein, 510 aa, Bacillus anthracis str. Ames; identical to SEQ ID NO: 27305

SEQ ID NO: 48619 - DNA, 1623 bp, Prochlorococcus marinus subsp. marinus str. CCMP1375; identical to SEQ ID NO: 27306
  CDS (1)..(1623): transl_table=11

SEQ ID NO: 48620 - protein, 540 aa, Prochlorococcus marinus subsp. marinus str. CCMP1375; identical to SEQ ID NO: 27307

SEQ ID NO: 48621 - DNA, 1635 bp, Bordetella pertussis Tohama I; identical to SEQ ID NO: 27308
  CDS (1)..(1635): transl_table=11

SEQ ID NO: 48622 - protein, 544 aa, Bordetella pertussis Tohama I; identical to SEQ ID NO: 27309

SEQ ID NO: 48623 - DNA, 1761 bp, Bordetella bronchiseptica RB50; identical to SEQ ID NO: 27310
  CDS (1)..(1761)

SEQ ID NO: 48624 - protein, 586 aa, Bordetella bronchiseptica RB50; identical to SEQ ID NO: 27311

SEQ ID NO: 48625 - DNA, 1476 bp, Photorhabdus luminescens subsp. laumondii TTO1; identical to SEQ ID NO: 27312
  CDS (1)..(1476): transl_table=11

SEQ ID NO: 48626 - protein, 491 aa, Photorhabdus luminescens subsp. laumondii TTO1; identical to SEQ ID NO: 27313

SEQ ID NO: 48627 - DNA, 1596 bp, Photorhabdus luminescens subsp. laumondii TTO1; identical to SEQ ID NO: 27314
  CDS (1)..(1596): transl_table=11

SEQ ID NO: 48628 - protein, 531 aa, Photorhabdus luminescens subsp. laumondii TTO1; identical to SEQ ID NO: 27315

SEQ ID NO: 48629 - DNA, 1536 bp, Photorhabdus luminescens subsp. laumondii TTO1; identical to SEQ ID NO: 27316
  CDS (1)..(1536): transl_table=11

SEQ ID NO: 48630 - protein, 511 aa, Photorhabdus luminescens subsp. laumondii TTO1; identical to SEQ ID NO: 27317

SEQ ID NO: 48631 - DNA, 1683 bp, Corynebacterium diphtheriae NCTC 13129; identical to SEQ ID NO: 27318
  CDS (1)..(1683): transl_table=11

SEQ ID NO: 48632 - protein, 560 aa, Corynebacterium diphtheriae NCTC 13129; identical to SEQ ID NO: 27319

SEQ ID NO: 48633 - DNA, 1443 bp, Corynebacterium diphtheriae NCTC 13129; identical to SEQ ID NO: 27320
  CDS (1)..(1443): transl_table=11

SEQ ID NO: 48634 - protein, 480 aa, Corynebacterium diphtheriae NCTC 13129; identical to SEQ ID NO: 27321

SEQ ID NO: 48635 - DNA, 2715 bp, Rhodopseudomonas palustris CGA009; identical to SEQ ID NO: 27322
  CDS (1)..(2715): transl_table=11

SEQ ID NO: 48636 - protein, 904 aa, Rhodopseudomonas palustris CGA009; identical to SEQ ID NO: 27323

SEQ ID NO: 48637 - DNA, 2796 bp, Rhodopseudomonas palustris CGA009; identical to SEQ ID NO: 27324
  CDS (1)..(2796): transl_table=11

SEQ ID NO: 48638 - protein, 931 aa, Rhodopseudomonas palustris CGA009; identical to SEQ ID NO: 27325

SEQ ID NO: 48639 - DNA, 2793 bp, Geobacter sulfurreducens PCA; identical to SEQ ID NO: 27326
  CDS (1)..(2793): transl_table=11

SEQ ID NO: 48640 - protein, 930 aa, Geobacter sulfurreducens PCA; identical to SEQ ID NO: 27327

SEQ ID NO: 48641 - DNA, 1347 bp, Lactobacillus johnsonii NCC 533; identical to SEQ ID NO: 27328
  CDS (1)..(1347): transl_table=11

SEQ ID NO: 48642 - protein, 448 aa, Lactobacillus johnsonii NCC 533; identical to SEQ ID NO: 27329

SEQ ID NO: 48643 - DNA, 1425 bp, Treponema denticola ATCC 35405; identical to SEQ ID NO: 27330
  CDS (1)..(1425): transl_table=11

SEQ ID NO: 48644 - protein, 474 aa, Treponema denticola ATCC 35405; identical to SEQ ID NO: 27331

SEQ ID NO: 48645 - DNA, 1509 bp, Treponema denticola ATCC 35405; identical to SEQ ID NO: 27332
  CDS (1)..(1509): transl_table=11

SEQ ID NO: 48646 - protein, 502 aa, Treponema denticola ATCC 35405; identical to SEQ ID NO: 27333

SEQ ID NO: 48647 - DNA, 1446 bp, Treponema denticola ATCC 35405; identical to SEQ ID NO: 27334
  CDS (1)..(1446): transl_table=11

SEQ ID NO: 48648 - protein, 481 aa, Treponema denticola ATCC 35405; identical to SEQ ID NO: 27335

SEQ ID NO: 48649 - DNA, 1509 bp, Treponema denticola ATCC 35405; identical to SEQ ID NO: 27336
  CDS (1)..(1509): transl_table=11

SEQ ID NO: 48650 - protein, 502 aa, Treponema denticola ATCC 35405; identical to SEQ ID NO: 27337

SEQ ID NO: 48651 - DNA, 1743 bp, Yersinia pestis biovar Medievalis str. 91001; identical to SEQ ID NO: 27338
  CDS (1)..(1743): transl_table=11

SEQ ID NO: 48652 - protein, 580 aa, Yersinia pestis biovar Medievalis str. 91001; identical to SEQ ID NO: 27339

SEQ ID NO: 48653 - DNA, 2085 bp, Neurospora crassa; identical to SEQ ID NO: 27340
  CDS (1)..(2085)

SEQ ID NO: 48654 - protein, 694 aa, Neurospora crassa; identical to SEQ ID NO: 27341

SEQ ID NO: 48655 - DNA, 2052 bp, Magnaporthe grisea 70-15; identical to SEQ ID NO: 27342
  CDS (1)..(2052)

SEQ ID NO: 48656 - protein, 683 aa, Magnaporthe grisea 70-15; identical to SEQ ID NO: 27343

SEQ ID NO: 48657 - DNA, 1965 bp, Gibberella zeae PH-1; identical to SEQ ID NO: 27344
  CDS (1)..(1965)

SEQ ID NO: 48658 - protein, 654 aa, Gibberella zeae PH-1; identical to SEQ ID NO: 27345

SEQ ID NO: 48659 - DNA, 2004 bp, Ustilago maydis 521; identical to SEQ ID NO: 27346
  CDS (1)..(2004)

SEQ ID NO: 48660 - protein, 667 aa, Ustilago maydis 521; identical to SEQ ID NO: 27347

SEQ ID NO: 48661 - DNA, 1635 bp, Candida glabrata CBS138; identical to SEQ ID NO: 27348
  CDS (1)..(1635)

SEQ ID NO: 48662 - protein, 544 aa, Candida glabrata CBS138; identical to SEQ ID NO: 27349

SEQ ID NO: 48663 - DNA, 1566 bp, Kluyveromyces lactis NRRL Y-1140; identical to SEQ ID NO: 27350
  CDS (1)..(1566)

SEQ ID NO: 48664 - protein, 521 aa, Kluyveromyces lactis NRRL Y-1140; identical to SEQ ID NO: 27351

SEQ ID NO: 48665 - DNA, 1641 bp, Debaryomyces hansenii CBS767; identical to SEQ ID NO: 27352
  CDS (1)..(1641)

SEQ ID NO: 48666 - protein, 546 aa, Debaryomyces hansenii CBS767; identical to SEQ ID NO: 27353

SEQ ID NO: 48667 - DNA, 1503 bp, Yarrowia lipolytica CLIB99; identical to SEQ ID NO: 27354
  CDS (1)..(1503)

SEQ ID NO: 48668 - protein, 500 aa, Yarrowia lipolytica CLIB99; identical to SEQ ID NO: 27355

SEQ ID NO: 48669 - DNA, 1632 bp, Cryptococcus neoformans var. neoformans JEC21; identical to SEQ ID NO: 27356
  CDS (1)..(1632)

SEQ ID NO: 48670 - protein, 543 aa, Cryptococcus neoformans var. neoformans JEC21; identical to SEQ ID NO: 27357

SEQ ID NO: 48671 - DNA, 1638 bp, Candida albicans SC5314; identical to SEQ ID NO: 27358
  CDS (1)..(1638): transl_table=12

SEQ ID NO: 48672 - protein, 545 aa, Candida albicans SC5314; identical to SEQ ID NO: 27359

SEQ ID NO: 48673 - DNA, 1899 bp, Desulfovibrio vulgaris subsp. vulgaris str. Hildenborough; identical to SEQ ID NO: 27360
  CDS (1)..(1899): transl_table=11

SEQ ID NO: 48674 - protein, 632 aa, Desulfovibrio vulgaris subsp. vulgaris str. Hildenborough; identical to SEQ ID NO: 27361

SEQ ID NO: 48675 - DNA, 1527 bp, Bacillus anthracis str. Sterne; identical to SEQ ID NO: 27362
  CDS (1)..(1527): transl_table=11

SEQ ID NO: 48676 - protein, 508 aa, Bacillus anthracis str. Sterne; identical to SEQ ID NO: 27363

SEQ ID NO: 48677 - DNA, 1593 bp, Staphylococcus aureus subsp. aureus MRSA252; identical to SEQ ID NO: 27364
  CDS (1)..(1593): transl_table=11

SEQ ID NO: 48678 - protein, 530 aa, Staphylococcus aureus subsp. aureus MRSA252; identical to SEQ ID NO: 27365

SEQ ID NO: 48679 - DNA, 1476 bp, Erwinia carotovora subsp. atroseptica SCRI1043; identical to SEQ ID NO: 27366
  CDS (1)..(1476)

SEQ ID NO: 48680 - protein, 491 aa, Erwinia carotovora subsp. atroseptica SCRI1043; identical to SEQ ID NO: 27367

SEQ ID NO: 48681 - DNA, 1617 bp, Erwinia carotovora subsp. atroseptica SCRI1043; identical to SEQ ID NO: 27368
  CDS (1)..(1617)

SEQ ID NO: 48682 - protein, 538 aa, Erwinia carotovora subsp. atroseptica SCRI1043; identical to SEQ ID NO: 27369

SEQ ID NO: 48683 - DNA, 1380 bp, Desulfotalea psychrophila LSv54; identical to SEQ ID NO: 27370
  CDS (1)..(1380): transl_table=11

SEQ ID NO: 48684 - protein, 459 aa, Desulfotalea psychrophila LSv54; identical to SEQ ID NO: 27371

SEQ ID NO: 48685 - DNA, 1491 bp, Yersinia pseudotuberculosis IP 32953; identical to SEQ ID NO: 27372
  CDS (1)..(1491): transl_table=11

SEQ ID NO: 48686 - protein, 496 aa, Yersinia pseudotuberculosis IP 32953; identical to SEQ ID NO: 27373

SEQ ID NO: 48687 - DNA, 1743 bp, Yersinia pseudotuberculosis IP 32953; identical to SEQ ID NO: 27374
  CDS (1)..(1743): transl_table=11

SEQ ID NO: 48688 - protein, 580 aa, Yersinia pseudotuberculosis IP 32953; identical to SEQ ID NO: 27375

SEQ ID NO: 48689 - DNA, 1593 bp, Yersinia pseudotuberculosis IP 32953; identical to SEQ ID NO: 27376
  CDS (1)..(1593): transl_table=11

SEQ ID NO: 48690 - protein, 530 aa, Yersinia pseudotuberculosis IP 32953; identical to SEQ ID NO: 27377

SEQ ID NO: 48691 - DNA, 1764 bp, Yersinia pseudotuberculosis IP 32953; identical to SEQ ID NO: 27378
  CDS (1)..(1764): transl_table=11

SEQ ID NO: 48692 - protein, 587 aa, Yersinia pseudotuberculosis IP 32953; identical to SEQ ID NO: 27379

SEQ ID NO: 48693 - DNA, 1689 bp, Symbiobacterium thermophilum IAM 14863; identical to SEQ ID NO: 27380
  CDS (1)..(1689): transl_table=11

SEQ ID NO: 48694 - protein, 562 aa, Symbiobacterium thermophilum IAM 14863; identical to SEQ ID NO: 27381

SEQ ID NO: 48695 - DNA, 1533 bp, Bacillus cereus E33L; identical to SEQ ID NO: 27382
  CDS (1)..(1533): transl_table=11

SEQ ID NO: 48696 - protein, 510 aa, Bacillus cereus E33L; identical to SEQ ID NO: 27383

SEQ ID NO: 48697 - DNA, 1470 bp, Mannheimia succiniciproducens MBEL55E; identical to SEQ ID NO: 27384
  CDS (1)..(1470): transl_table=11

SEQ ID NO: 48698 - protein, 489 aa, Mannheimia succiniciproducens MBEL55E; identical to SEQ ID NO: 27385

SEQ ID NO: 48699 - DNA, 2736 bp, Mannheimia succiniciproducens MBEL55E; identical to SEQ ID NO: 27386
  CDS (1)..(2736): transl_table=11

SEQ ID NO: 48700 - protein, 911 aa, Mannheimia succiniciproducens MBEL55E; identical to SEQ ID NO: 27387

SEQ ID NO: 48701 - DNA, 1461 bp, Bacteroides fragilis YCH46; identical to SEQ ID NO: 27388
  CDS (1)..(1461): transl_table=11

SEQ ID NO: 48702 - protein, 486 aa, Bacteroides fragilis YCH46; identical to SEQ ID NO: 27389

SEQ ID NO: 48703 - DNA, 1455 bp, Bacteroides fragilis YCH46; identical to SEQ ID NO: 27390
  CDS (1)..(1455): transl_table=11

SEQ ID NO: 48704 - protein, 484 aa, Bacteroides fragilis YCH46; identical to SEQ ID NO: 27391

SEQ ID NO: 48705 - DNA, 1650 bp, Burkholderia mallei ATCC 23344; identical to SEQ ID NO: 27392
  CDS (1)..(1650): transl_table=11

SEQ ID NO: 48706 - protein, 549 aa, Burkholderia mallei ATCC 23344; identical to SEQ ID NO: 27393

SEQ ID NO: 48707 - DNA, 3216 bp, Burkholderia mallei ATCC 23344; identical to SEQ ID NO: 27394
  CDS (1)..(3216): transl_table=11

SEQ ID NO: 48708 - protein, 1071 aa, Burkholderia mallei ATCC 23344; identical to SEQ ID NO: 27395

SEQ ID NO: 48709 - DNA, 3225 bp, Burkholderia pseudomallei K96243; identical to SEQ ID NO: 27396
  CDS (1)..(3225): transl_table=11

SEQ ID NO: 48710 - protein, 1074 aa, Burkholderia pseudomallei K96243; identical to SEQ ID NO: 27397

SEQ ID NO: 48711 - DNA, 1641 bp, Methylococcus capsulatus str. Bath; identical to SEQ ID NO: 27398
  CDS (1)..(1641): transl_table=11

SEQ ID NO: 48712 - protein, 546 aa, Methylococcus capsulatus str. Bath; identical to SEQ ID NO: 27399

SEQ ID NO: 48713 - DNA, 2724 bp, Methylococcus capsulatus str. Bath; identical to SEQ ID NO: 27400
  CDS (1)..(2724): transl_table=11

SEQ ID NO: 48714 - protein, 907 aa, Methylococcus capsulatus str. Bath; identical to SEQ ID NO: 27401

SEQ ID NO: 48715 - DNA, 1446 bp, Mycoplasma hyopneumoniae 232; identical to SEQ ID NO: 27402
  CDS (1)..(1446): transl_table=4

SEQ ID NO: 48716 - protein, 481 aa, Mycoplasma hyopneumoniae 232; identical to SEQ ID NO: 27403

SEQ ID NO: 48717 - DNA, 1686 bp, Nocardia farcinica IFM 10152; identical to SEQ ID NO: 27404
  CDS (1)..(1686): transl_table=11

SEQ ID NO: 48718 - protein, 561 aa, Nocardia farcinica IFM 10152; identical to SEQ ID NO: 27405

SEQ ID NO: 48719 - DNA, 783 bp, Streptococcus thermophilus LMG 18311; identical to SEQ ID NO: 27406
  CDS (1)..(783): transl_table=11

SEQ ID NO: 48720 - protein, 260 aa, Streptococcus thermophilus LMG 18311; identical to SEQ ID NO: 27407

SEQ ID NO: 48721 - DNA, 1707 bp, Streptococcus thermophilus CNRZ1066; identical to SEQ ID NO: 27408
  CDS (1)..(1707): transl_table=11

SEQ ID NO: 48722 - protein, 568 aa, Streptococcus thermophilus CNRZ1066; identical to SEQ ID NO: 27409

SEQ ID NO: 48723 - DNA, 1590 bp, Salmonella enterica subsp. enterica serovar Paratyphi A str. ATCC; identical to SEQ ID NO: 27410
  CDS (1)..(1590): transl_table=11

SEQ ID NO: 48724 - protein, 529 aa, Salmonella enterica subsp. enterica serovar Paratyphi A str. ATCC; identical to SEQ ID NO: 27411

SEQ ID NO: 48725 - DNA, 1572 bp, Salmonella enterica subsp. enterica serovar Paratyphi A str. ATCC; identical to SEQ ID NO: 27412
  CDS (1)..(1572): transl_table=11

SEQ ID NO: 48726 - protein, 523 aa, Salmonella enterica subsp. enterica serovar Paratyphi A str. ATCC; identical to SEQ ID NO: 27413

SEQ ID NO: 48727 - DNA, 1476 bp, Salmonella enterica subsp. enterica serovar Paratyphi A str. ATCC; identical to SEQ ID NO: 27414
  CDS (1)..(1476): transl_table=11

SEQ ID NO: 48728 - protein, 491 aa, Salmonella enterica subsp. enterica serovar Paratyphi A str. ATCC; identical to SEQ ID NO: 27415

SEQ ID NO: 48729 - DNA, 1536 bp, Salmonella enterica subsp. enterica serovar Paratyphi A str. ATCC; identical to SEQ ID NO: 27416
  CDS (1)..(1536): transl_table=11

SEQ ID NO: 48730 - protein, 511 aa, Salmonella enterica subsp. enterica serovar Paratyphi A str. ATCC; identical to SEQ ID NO: 27417

SEQ ID NO: 48731 - DNA, 1614 bp, Idiomarina loihiensis L2TR; identical to SEQ ID NO: 27418
  CDS (1)..(1614): transl_table=11

SEQ ID NO: 48732 - protein, 537 aa, Idiomarina loihiensis L2TR; identical to SEQ ID NO: 27419

SEQ ID NO: 48733 - DNA, 2919 bp, Azoarcus sp. EbN1; identical to SEQ ID NO: 27420
  CDS (1)..(2919): transl_table=11

SEQ ID NO: 48734 - protein, 972 aa, Azoarcus sp. EbN1; identical to SEQ ID NO: 27421

SEQ ID NO: 48735 - DNA, 2829 bp, Zymomonas mobilis subsp. mobilis ZM4; identical to SEQ ID NO: 27422
  CDS (1)..(2829): transl_table=11

SEQ ID NO: 48736 - protein, 942 aa, Zymomonas mobilis subsp. mobilis ZM4; identical to SEQ ID NO: 27423

SEQ ID NO: 48737 - DNA, 1593 bp, Zymomonas mobilis subsp. mobilis ZM4; identical to SEQ ID NO: 27424
  CDS (1)..(1593): transl_table=11

SEQ ID NO: 48738 - protein, 530 aa, Zymomonas mobilis subsp. mobilis ZM4; identical to SEQ ID NO: 27425

SEQ ID NO: 48739 - DNA, 1599 bp, Silicibacter pomeroyi DSS-3; identical to SEQ ID NO: 27426
  CDS (1)..(1599): transl_table=11

SEQ ID NO: 48740 - protein, 532 aa, Silicibacter pomeroyi DSS-3; identical to SEQ ID NO: 27427

SEQ ID NO: 48741 - DNA, 2727 bp, Silicibacter pomeroyi DSS-3; identical to SEQ ID NO: 27428
  CDS (1)..(2727): transl_table=11

SEQ ID NO: 48742 - protein, 908 aa, Silicibacter pomeroyi DSS-3; identical to SEQ ID NO: 27429

SEQ ID NO: 48743 - DNA, 1665 bp, Synechococcus elongatus PCC 6301; identical to SEQ ID NO: 27430
  CDS (1)..(1665): transl_table=11

SEQ ID NO: 48744 - protein, 554 aa, Synechococcus elongatus PCC 6301; identical to SEQ ID NO: 27431

SEQ ID NO: 48745 - DNA, 1593 bp, Staphylococcus aureus subsp. aureus COL; identical to SEQ ID NO: 27432
  CDS (1)..(1593): transl_table=11

SEQ ID NO: 48746 - protein, 530 aa, Staphylococcus aureus subsp. aureus COL; identical to SEQ ID NO: 27433

SEQ ID NO: 48747 - DNA, 1701 bp, Lactobacillus acidophilus NCFM; identical to SEQ ID NO: 27434
  CDS (1)..(1701): transl_table=11

SEQ ID NO: 48748 - protein, 566 aa, Lactobacillus acidophilus NCFM; identical to SEQ ID NO: 27435

SEQ ID NO: 48749 - DNA, 1560 bp, Salmonella enterica subsp. enterica serovar Choleraesuis str; identical to SEQ ID NO: 27436
  CDS (1)..(1560): transl_table=11

SEQ ID NO: 48750 - protein, 519 aa, Salmonella enterica subsp. enterica serovar Choleraesuis str; identical to SEQ ID NO: 27437

SEQ ID NO: 48751 - DNA, 1596 bp, Salmonella enterica subsp. enterica serovar Choleraesuis str; identical to SEQ ID NO: 27438
  CDS (1)..(1596): transl_table=11

SEQ ID NO: 48752 - protein, 531 aa, Salmonella enterica subsp. enterica serovar Choleraesuis str; identical to SEQ ID NO: 27439

SEQ ID NO: 48753 - DNA, 1590 bp, Salmonella enterica subsp. enterica serovar Choleraesuis str; identical to SEQ ID NO: 27440
  CDS (1)..(1590): transl_table=11

SEQ ID NO: 48754 - protein, 529 aa, Salmonella enterica subsp. enterica serovar Choleraesuis str; identical to SEQ ID NO: 27441

SEQ ID NO: 48755 - DNA, 2742 bp, Salmonella enterica subsp. enterica serovar Choleraesuis str; identical to SEQ ID NO: 27442
  CDS (1)..(2742): transl_table=11

SEQ ID NO: 48756 - protein, 913 aa, Salmonella enterica subsp. enterica serovar Choleraesuis str; identical to SEQ ID NO: 27443

SEQ ID NO: 48757 - DNA, 1584 bp, Pseudomonas syringae pv. syringae B728a; identical to SEQ ID NO: 27444
  CDS (1)..(1584)

SEQ ID NO: 48758 - protein, 527 aa, Pseudomonas syringae pv. syringae B728a; identical to SEQ ID NO: 27445

SEQ ID NO: 48759 - DNA, 1578 bp, Sulfolobus acidocaldarius DSM 639; identical to SEQ ID NO: 27446
  CDS (1)..(1578): transl_table=11

SEQ ID NO: 48760 - protein, 525 aa, Sulfolobus acidocaldarius DSM 639; identical to SEQ ID NO: 27447

SEQ ID NO: 48761 - DNA, 1374 bp, Leuconostoc mesenteroides subsp. mesenteroides ATCC 8293; identical to SEQ ID NO: 27448
  CDS (1)..(1374)

SEQ ID NO: 48762 - protein, 457 aa, Leuconostoc mesenteroides subsp. mesenteroides ATCC 8293; identical to SEQ ID NO: 27449

SEQ ID NO: 48763 - DNA, 1677 bp, Leuconostoc mesenteroides subsp. mesenteroides ATCC 8293; identical to SEQ ID NO: 27450
  CDS (1)..(1677)

SEQ ID NO: 48764 - protein, 558 aa, Leuconostoc mesenteroides subsp. mesenteroides ATCC 8293; identical to SEQ ID NO: 27451

SEQ ID NO: 48765 - DNA, 1674 bp, Bifidobacterium longum DJO10A; identical to SEQ ID NO: 27452
  CDS (1)..(1674)

SEQ ID NO: 48766 - protein, 557 aa, Bifidobacterium longum DJO10A; identical to SEQ ID NO: 27453

SEQ ID NO: 48767 - DNA, 1518 bp, Haemophilus somnus 129PT; identical to SEQ ID NO: 27454
  CDS (1)..(1518)

SEQ ID NO: 48768 - protein, 505 aa, Haemophilus somnus 129PT; identical to SEQ ID NO: 27455

SEQ ID NO: 48769 - DNA, 1566 bp, Pseudomonas syringae pv. syringae B728a; identical to SEQ ID NO: 27456
  CDS (1)..(1566)

SEQ ID NO: 48770 - protein, 521 aa, Pseudomonas syringae pv. syringae B728a; identical to SEQ ID NO: 27457

SEQ ID NO: 48771 - DNA, 1545 bp, Desulfovibrio desulfuricans G20; identical to SEQ ID NO: 27458
  CDS (1)..(1545)

SEQ ID NO: 48772 - protein, 514 aa, Desulfovibrio desulfuricans G20; identical to SEQ ID NO: 27459

SEQ ID NO: 48773 - DNA, 1473 bp, Actinobacillus pleuropneumoniae serovar 1 str. 4074; identical to SEQ ID NO: 27460
  CDS (1)..(1473)

SEQ ID NO: 48774 - protein, 490 aa, Actinobacillus pleuropneumoniae serovar 1 str. 4074; identical to SEQ ID NO: 27461

SEQ ID NO: 48775 - DNA, 2613 bp, Actinobacillus pleuropneumoniae serovar 1 str. 4074; identical to SEQ ID NO: 27462
  CDS (1)..(2613)

SEQ ID NO: 48776 - protein, 870 aa, Actinobacillus pleuropneumoniae serovar 1 str. 4074; identical to SEQ ID NO: 27463

SEQ ID NO: 48777 - DNA, 2763 bp, Dechloromonas aromatica RCB; identical to SEQ ID NO: 27464
  CDS (1)..(2763)

SEQ ID NO: 48778 - protein, 920 aa, Dechloromonas aromatica RCB; identical to SEQ ID NO: 27465

SEQ ID NO: 48779 - DNA, 1632 bp, Rhodobacter sphaeroides 2.4.1; identical to SEQ ID NO: 27466
  CDS (1)..(1632)

SEQ ID NO: 48780 - protein, 543 aa, Rhodobacter sphaeroides 2.4.1; identical to SEQ ID NO: 27467

SEQ ID NO: 48781 - DNA, 1557 bp, Burkholderia cepacia R18194; identical to SEQ ID NO: 27468
  CDS (1)..(1557)

SEQ ID NO: 48782 - protein, 518 aa, Burkholderia cepacia R18194; identical to SEQ ID NO: 27469

SEQ ID NO: 48783 - DNA, 1614 bp, Pseudomonas fluorescens PfO-1; identical to SEQ ID NO: 27470
  CDS (1)..(1614)

SEQ ID NO: 48784 - protein, 537 aa, Pseudomonas fluorescens PfO-1; identical to SEQ ID NO: 27471

SEQ ID NO: 48785 - DNA, 2721 bp, Pseudomonas fluorescens PfO-1; identical to SEQ ID NO: 27472
  CDS (1)..(2721)

SEQ ID NO: 48786 - protein, 906 aa, Pseudomonas fluorescens PfO-1; identical to SEQ ID NO: 27473

SEQ ID NO: 48787 - DNA, 1911 bp, Pseudomonas fluorescens PfO-1; identical to SEQ ID NO: 27474
  CDS (1)..(1911)

SEQ ID NO: 48788 - protein, 636 aa, Pseudomonas fluorescens PfO-1; identical to SEQ ID NO: 27475

SEQ ID NO: 48789 - DNA, 1563 bp, Pseudomonas fluorescens PfO-1; identical to SEQ ID NO: 27476
  CDS (1)..(1563)

SEQ ID NO: 48790 - protein, 520 aa, Pseudomonas fluorescens PfO-1; identical to SEQ ID NO: 27477

SEQ ID NO: 48791 - DNA, 1662 bp, Rhodospirillum rubrum; identical to SEQ ID NO: 27478
  CDS (1)..(1662)

SEQ ID NO: 48792 - protein, 553 aa, Rhodospirillum rubrum; identical to SEQ ID NO: 27479

SEQ ID NO: 48793 - DNA, 1569 bp, Burkholderia fungorum LB400; identical to SEQ ID NO: 27480
  CDS (1)..(1569)

SEQ ID NO: 48794 - protein, 522 aa, Burkholderia fungorum LB400; identical to SEQ ID NO: 27481

SEQ ID NO: 48795 - DNA, 786 bp, Thermobifida fusca; identical to SEQ ID NO: 27482
  CDS (1)..(786)

SEQ ID NO: 48796 - protein, 261 aa, Thermobifida fusca; identical to SEQ ID NO: 27483

SEQ ID NO: 48797 - DNA, 1506 bp, Cytophaga hutchinsonii; identical to SEQ ID NO: 27484
  CDS (1)..(1506)

SEQ ID NO: 48798 - protein, 501 aa, Cytophaga hutchinsonii; identical to SEQ ID NO: 27485

SEQ ID NO: 48799 - DNA, 1377 bp, Oenococcus oeni PSU-1; identical to SEQ ID NO: 27486
  CDS (1)..(1377)

SEQ ID NO: 48800 - protein, 458 aa, Oenococcus oeni PSU-1; identical to SEQ ID NO: 27487

SEQ ID NO: 48801 - DNA, 1689 bp, Oenococcus oeni PSU-1; identical to SEQ ID NO: 27488
  CDS (1)..(1689)

SEQ ID NO: 48802 - protein, 562 aa, Oenococcus oeni PSU-1; identical to SEQ ID NO: 27489

SEQ ID NO: 48803 - DNA, 1587 bp, Oenococcus oeni PSU-1; identical to SEQ ID NO: 27490
  CDS (1)..(1587)

SEQ ID NO: 48804 - protein, 528 aa, Oenococcus oeni PSU-1; identical to SEQ ID NO: 27491

SEQ ID NO: 48805 - DNA, 1653 bp, Streptococcus suis 89/1591; identical to SEQ ID NO: 27492
  CDS (1)..(1653)

SEQ ID NO: 48806 - protein, 550 aa, Streptococcus suis 89/1591; identical to SEQ ID NO: 27493

SEQ ID NO: 48807 - DNA, 2751 bp, Pseudomonas aeruginosa UCBPP-PA14; identical to SEQ ID NO: 27494
  CDS (1)..(2751)

SEQ ID NO: 48808 - protein, 916 aa, Pseudomonas aeruginosa UCBPP-PA14; identical to SEQ ID NO: 27495

SEQ ID NO: 48809 - DNA, 1671 bp, Ralstonia eutropha JMP134; identical to SEQ ID NO: 27496
  CDS (1)..(1671)

SEQ ID NO: 48810 - protein, 556 aa, Ralstonia eutropha JMP134; identical to SEQ ID NO: 27497

SEQ ID NO: 48811 - DNA, 1524 bp, Chloroflexus aurantiacus; identical to SEQ ID NO: 27498
  CDS (1)..(1524)

SEQ ID NO: 48812 - protein, 507 aa, Chloroflexus aurantiacus; identical to SEQ ID NO: 27499

SEQ ID NO: 48813 - DNA, 1845 bp, Chloroflexus aurantiacus; identical to SEQ ID NO: 27500
  CDS (1)..(1845)

SEQ ID NO: 48814 - protein, 614 aa, Chloroflexus aurantiacus; identical to SEQ ID NO: 27501

SEQ ID NO: 48815 - DNA, 1356 bp, Lactobacillus delbrueckii subsp. bulgaricus ATCC BAA-365; identical to SEQ ID NO: 27502
  CDS (1)..(1356)

SEQ ID NO: 48816 - protein, 451 aa, Lactobacillus delbrueckii subsp. bulgaricus ATCC BAA-365; identical to SEQ ID NO: 27503

SEQ ID NO: 48817 - DNA, 1677 bp, Streptococcus thermophilus LMD-9; identical to SEQ ID NO: 27504
  CDS (1)..(1677)

SEQ ID NO: 48818 - protein, 558 aa, Streptococcus thermophilus LMD-9; identical to SEQ ID NO: 27505

SEQ ID NO: 48819 - DNA, 1452 bp, Deinococcus geothermalis DSM 11300 [sequence omitted]

SEQ ID NO: 48820 - protein, 483 aa, Deinococcus geothermalis DSM 11300; identical to SEQ ID NO: 27507

SEQ ID NO: 48821 - DNA, 1437 bp, Anaeromyxobacter dehalogenans 2CP-C; identical to SEQ ID NO: 27508
  CDS (1)..(1437): transl_table=11

SEQ ID NO: 48822 - protein, 478 aa, Anaeromyxobacter dehalogenans 2CP-C; identical to SEQ ID NO: 27509

SEQ ID NO: 48823 - DNA, 2736 bp, Azotobacter vinelandii AvOP; identical to SEQ ID NO: 27510
  CDS (1)..(2736): transl_table=11

SEQ ID NO: 48824 - protein, 911 aa, Azotobacter vinelandii AvOP; identical to SEQ ID NO: 27511

SEQ ID NO: 48825 - DNA, 1590 bp, Azotobacter vinelandii AvOP; identical to SEQ ID NO: 27512
  CDS (1)..(1590): transl_table=11

SEQ ID NO: 48826 - protein, 529 aa, Azotobacter vinelandii AvOP; identical to SEQ ID NO: 27513

SEQ ID NO: 48827 - DNA, 1638 bp, Azotobacter vinelandii AvOP; identical to SEQ ID NO: 27514
  CDS (1)..(1638): transl_table=11

SEQ ID NO: 48828 - protein, 545 aa, Azotobacter vinelandii AvOP; identical to SEQ ID NO: 27515

SEQ ID NO: 48829 - DNA, 1623 bp, Burkholderia vietnamiensis G4; identical to SEQ ID NO: 27516
  CDS (1)..(1623): transl_table=11

SEQ ID NO: 48830 - protein, 540 aa, Burkholderia vietnamiensis G4; identical to SEQ ID NO: 27517

SEQ ID NO: 48831 - DNA, 2832 bp, Burkholderia vietnamiensis G4; identical to SEQ ID NO: 27518
  CDS (1)..(2832): transl_table=11

SEQ ID NO: 48832 - protein, 943 aa, Burkholderia vietnamiensis G4; identical to SEQ ID NO: 27519

SEQ ID NO: 48833 - DNA, 2829 bp, Burkholderia vietnamiensis G4; identical to SEQ ID NO: 27520
  CDS (1)..(2829): transl_table=11

SEQ ID NO: 48834 - protein, 942 aa, Burkholderia vietnamiensis G4; identical to SEQ ID NO: 27521

SEQ ID NO: 48835 - DNA, 3240 bp, Burkholderia mallei NCTC 10247; identical to SEQ ID NO: 27522
  CDS (1)..(3240)

SEQ ID NO: 48836 - protein, 1079 aa, Burkholderia mallei NCTC 10247; identical to SEQ ID NO: 27523

SEQ ID NO: 48837 - DNA, 1635 bp, Burkholderia cenocepacia AU 1054; identical to SEQ ID NO: 27524
  CDS (1)..(1635): transl_table=11

SEQ ID NO: 48838 - protein, 544 aa, Burkholderia cenocepacia AU 1054; identical to SEQ ID NO: 27525

SEQ ID NO: 48839 - DNA, 1632 bp, Burkholderia pseudomallei 1655; identical to SEQ ID NO: 27526
  CDS (1)..(1632)

SEQ ID NO: 48840 - protein, 543 aa, Burkholderia pseudomallei 1655; identical to SEQ ID NO: 27527

SEQ ID NO: 48841 - DNA, 2727 bp, Chromohalobacter salexigens DSM 3043; identical to SEQ ID NO: 27528
  CDS (1)..(2727): transl_table=11

SEQ ID NO: 48842 - protein, 908 aa, Chromohalobacter salexigens DSM 3043; identical to SEQ ID NO: 27529

SEQ ID NO: 48843 - DNA, 1680 bp, Chromohalobacter salexigens DSM 3043; identical to SEQ ID NO: 27530
  CDS (1)..(1680): transl_table=11

SEQ ID NO: 48844 - protein, 559 aa, Chromohalobacter salexigens DSM 3043; identical to SEQ ID NO: 27531

SEQ ID NO: 48845 - DNA, 1650 bp, Burkholderia pseudomallei 1710a; identical to SEQ ID NO: 27532
  CDS (1)..(1650)

SEQ ID NO: 48846 - protein, 549 aa, Burkholderia pseudomallei 1710a; identical to SEQ ID NO: 27533

SEQ ID NO: 48847 - DNA, 1650 bp, Burkholderia pseudomallei 668; identical to SEQ ID NO: 27534
  CDS (1)..(1650)

SEQ ID NO: 48848 - protein, 549 aa, Burkholderia pseudomallei 668; identical to SEQ ID NO: 27535

SEQ ID NO: 48849 - DNA, 3261 bp, Burkholderia pseudomallei Pasteur; identical to SEQ ID NO: 27536
  CDS (1)..(3261): n means a or g or c or t/u, s means g or c

SEQ ID NO: 48850 - protein, 1086 aa, Burkholderia pseudomallei Pasteur; identical to SEQ ID NO: 27537
  Xaa in position 459 and 489 is unknown

SEQ ID NO: 48851 - DNA, 1692 bp, Polaromonas sp. JS666; identical to SEQ ID NO: 27538
  CDS (1)..(1692): transl_table=11

SEQ ID NO: 48852 - protein, 563 aa, Polaromonas sp. JS666; identical to SEQ ID NO: 27539

SEQ ID NO: 48853 - DNA, 1668 bp, Polaromonas sp. JS666; identical to SEQ ID NO: 27540
  CDS (1)..(1668): transl_table=11

SEQ ID NO: 48854 - protein, 555 aa, Polaromonas sp. JS666; identical to SEQ ID NO: 27541

SEQ ID NO: 48855 - DNA, 1560 bp, Exiguobacterium sp. 255-15; identical to SEQ ID NO: 27542
  CDS (1)..(1560): transl_table=11

SEQ ID NO: 48856 - protein, 519 aa, Exiguobacterium sp. 255-15; identical to SEQ ID NO: 27543

SEQ ID NO: 48857 - DNA, 1506 bp, Methanosarcina barkeri str. fusaro; identical to SEQ ID NO: 27544
  CDS (1)..(1506): transl_table=11

SEQ ID NO: 48858 - protein, 501 aa, Methanosarcina barkeri str. fusaro; identical to SEQ ID NO: 27545

SEQ ID NO: 48859 - DNA, 1449 bp, Desulfuromonas acetoxidans DSM 684; identical to SEQ ID NO: 27546
  CDS (1)..(1449): transl_table=11

SEQ ID NO: 48860 - protein, 482 aa, Desulfuromonas acetoxidans DSM 684; identical to SEQ ID NO: 27547

SEQ ID NO: 48861 - DNA, 1584 bp, Jannaschia sp. CCS1; identical to SEQ ID NO: 27548
  CDS (1)..(1584): transl_table=11

SEQ ID NO: 48862 - protein, 527 aa, Jannaschia sp. CCS1; identical to SEQ ID NO: 27549

SEQ ID NO: 48863 - DNA, 1503 bp, Desulfitobacterium hafniense DCB-2; identical to SEQ ID NO: 27550
  CDS (1)..(1503): transl_table=11

SEQ ID NO: 48864 - protein, 500 aa, Desulfitobacterium hafniense DCB-2; identical to SEQ ID NO: 27551

SEQ ID NO: 48865 - DNA, 2766 bp, Methylobacillus flagellatus KT; identical to SEQ ID NO: 27552
  CDS (1)..(2766): transl_table=11

SEQ ID NO: 48866 - protein, 921 aa, Methylobacillus flagellatus KT; identical to SEQ ID NO: 27553

SEQ ID NO: 48867 - DNA, 1602 bp, Methylobacillus flagellatus KT; identical to SEQ ID NO: 27554
  CDS (1)..(1602): transl_table=11

SEQ ID NO: 48868 - protein, 533 aa, Methylobacillus flagellatus KT; identical to SEQ ID NO: 27555

SEQ ID NO: 48869 - DNA, 1518 bp, Frankia sp. EAN1pec; identical to SEQ ID NO: 27556
  CDS (1)..(1518): transl_table=11

SEQ ID NO: 48870 - protein, 505 aa, Frankia sp. EAN1pec; identical to SEQ ID NO: 27557

SEQ ID NO: 48871 - DNA, 1497 bp, Shewanella baltica OS155; identical to SEQ ID NO: 27558
  CDS (1)..(1497): transl_table=11

SEQ ID NO: 48872 - protein, 498 aa, Shewanella baltica OS155; identical to SEQ ID NO: 27559

SEQ ID NO: 48873 - DNA, 1596 bp, Shewanella amazonensis SB2B; identical to SEQ ID NO: 27560
  CDS (1)..(1596): transl_table=11

SEQ ID NO: 48874 - protein, 531 aa, Shewanella amazonensis SB2B; identical to SEQ ID NO: 27561

SEQ ID NO: 48875 - DNA, 2760 bp, Ralstonia metallidurans CH34; identical to SEQ ID NO: 27562
  CDS (1)..(2760): transl_table=11

SEQ ID NO: 48876 - protein, 919 aa, Ralstonia metallidurans CH34; identical to SEQ ID NO: 27563

SEQ ID NO: 48877 - DNA, 1635 bp, Mesorhizobium sp. BNC1; identical to SEQ ID NO: 27564
  CDS (1)..(1635): transl_table=11

SEQ ID NO: 48878 - protein, 544 aa, Mesorhizobium sp. BNC1; identical to SEQ ID NO: 27565

SEQ ID NO: 48879 - DNA, 1629 bp, Mesorhizobium sp. BNC1; identical to SEQ ID NO: 27566
  CDS (1)..(1629): transl_table=11

SEQ ID NO: 48880 - protein, 542 aa, Mesorhizobium sp. BNC1; identical to SEQ ID NO: 27567

SEQ ID NO: 48881 - DNA, 1656 bp, Kineococcus radiotolerans SRS30216; identical to SEQ ID NO: 27568
  CDS (1)..(1656): transl_table=11

SEQ ID NO: 48882 - protein, 551 aa, Kineococcus radiotolerans SRS30216; identical to SEQ ID NO: 27569

SEQ ID NO: 48883 - DNA, 1593 bp, Silicibacter sp. TM1040; identical to SEQ ID NO: 27570
  CDS (1)..(1593): transl_table=11

SEQ ID NO: 48884 - protein, 530 aa, Silicibacter sp. TM1040; identical to SEQ ID NO: 27571

SEQ ID NO: 48885 - DNA, 1614 bp, Paracoccus denitrificans PD1222; identical to SEQ ID NO: 27572
  CDS (1)..(1614): transl_table=11

SEQ ID NO: 48886 - protein, 537 aa, Paracoccus denitrificans PD1222; identical to SEQ ID NO: 27573

SEQ ID NO: 48887 - DNA, 2517 bp, Paracoccus denitrificans PD1222; identical to SEQ ID NO: 27574
  CDS (1)..(2517): transl_table=11

SEQ ID NO: 48888 - protein, 838 aa, Paracoccus denitrificans PD1222; identical to SEQ ID NO: 27575

SEQ ID NO: 48889 - DNA, 1383 bp, Paracoccus denitrificans PD1222; identical to SEQ ID NO: 27576
  CDS (1)..(1383): transl_table=11

SEQ ID NO: 48890 - protein, 460 aa, Paracoccus denitrificans PD1222; identical to SEQ ID NO: 27577

SEQ ID NO: 48891 - DNA, 1470 bp, Shewanella frigidimarina NCIMB 400; identical to SEQ ID NO: 27578
  CDS (1)..(1470): transl_table=11

SEQ ID NO: 48892 - protein, 489 aa, Shewanella frigidimarina NCIMB 400; identical to SEQ ID NO: 27579

SEQ ID NO: 48893 - DNA, 2757 bp, Shewanella frigidimarina NCIMB 400; identical to SEQ ID NO: 27580
  CDS (1)..(2757): transl_table=11

SEQ ID NO: 48894 - protein, 918 aa, Shewanella frigidimarina NCIMB 400; identical to SEQ ID NO: 27581

SEQ ID NO: 48895 - DNA, 1611 bp, Burkholderia mallei JHU; identical to SEQ ID NO: 27582
  CDS (1)..(1611)

SEQ ID NO: 48896 - protein, 536 aa, Burkholderia mallei JHU; identical to SEQ ID NO: 27583

SEQ ID NO: 48897 - DNA, 1587 bp, Pseudomonas fluorescens; identical to SEQ ID NO: 27584
  CDS (1)..(1587): transl_table=11

SEQ ID NO: 48898 - protein, 528 aa, Pseudomonas fluorescens; identical to SEQ ID NO: 27585

SEQ ID NO: 48899 - DNA, 1632 bp, Cryptococcus neoformans var; identical to SEQ ID NO: 27586
  CDS (1)..(1632)

SEQ ID NO: 48900 - protein, 543 aa, Cryptococcus neoformans var; identical to SEQ ID NO: 27587

SEQ ID NO: 48901 - DNA, 1518 bp, Thermoanaerobacter ethanolicus; identical to SEQ ID NO: 27588
  CDS (1)..(1518): transl_table=11

SEQ ID NO: 48902 - protein, 505 aa, Thermoanaerobacter ethanolicus; identical to SEQ ID NO: 27589

SEQ ID NO: 48903 - DNA, 1515 bp, Bifidobacterium longum bv; identical to SEQ ID NO: 27590
  CDS (1)..(1515): transl_table=11

SEQ ID NO: 48904 - protein, 504 aa, Bifidobacterium longum bv; identical to SEQ ID NO: 27591

SEQ ID NO: 48905 - DNA, 2691 bp, Salmonella typhimurium; identical to SEQ ID NO: 27592
  CDS (1)..(2691): transl_table=11

SEQ ID NO: 48906 - protein, 896 aa, Salmonella typhimurium; identical to SEQ ID NO: 27593

SEQ ID NO: 48907 - DNA, 1476 bp, Treponema denticola; identical to SEQ ID NO: 27594
  CDS (1)..(1476): transl_table=11

SEQ ID NO: 48908 - protein, 491 aa, Treponema denticola; identical to SEQ ID NO: 27595

SEQ ID NO: 48909 - DNA, 1473 bp, Bacillus subtilis; identical to SEQ ID NO: 27596
  CDS (1)..(1473): transl_table=11

SEQ ID NO: 48910 - protein, 490 aa, Bacillus subtilis; identical to SEQ ID NO: 27597

SEQ ID NO: 48911 - DNA, 1707 bp, Enterococcus faecalis; identical to SEQ ID NO: 27598
  CDS (1)..(1707): transl_table=11

SEQ ID NO: 48912 - protein, 568 aa, Enterococcus faecalis; identical to SEQ ID NO: 27599

SEQ ID NO: 48913 - DNA, 1722 bp, Lactobacillus johnsonii; identical to SEQ ID NO: 27600
  CDS (1)..(1722): transl_table=11

SEQ ID NO: 48914 - protein, 573 aa, Lactobacillus johnsonii; identical to SEQ ID NO: 27601

SEQ ID NO: 48915 - DNA, 1584 bp, Oceanobacillus iheyensis; identical to SEQ ID NO: 27602
  CDS (1)..(1584): transl_table=11

SEQ ID NO: 48916 - protein, 527 aa, Oceanobacillus iheyensis; identical to SEQ ID NO: 27603

SEQ ID NO: 48917 - DNA, 1677 bp, Streptococcus agalactiae serotype III; identical to SEQ ID NO: 27604
  CDS (1)..(1677): transl_table=11

SEQ ID NO: 48918 - protein, 558 aa, Streptococcus agalactiae serotype III; identical to SEQ ID NO: 27605

SEQ ID NO: 48919 - DNA, 1677 bp, Streptococcus agalactiae serotype V; identical to SEQ ID NO: 27606
  CDS (1)..(1677): transl_table=11

SEQ ID NO: 48920 - protein, 558 aa, Streptococcus agalactiae serotype V; identical to SEQ ID NO: 27607

SEQ ID NO: 48921 - DNA, 1677 bp, Streptococcus mutans; identical to SEQ ID NO: 27608
  CDS (1)..(1677): transl_table=11

SEQ ID NO: 48922 - protein, 558 aa, Streptococcus mutans; identical to SEQ ID NO: 27609

SEQ ID NO: 48923 - DNA, 1683 bp, Streptococcus pneumoniae; identical to SEQ ID NO: 27610
  CDS (1)..(1683)

SEQ ID NO: 48924 - protein, 560 aa, Streptococcus pneumoniae; identical to SEQ ID NO: 27611

SEQ ID NO: 48925 - DNA, 1683 bp, Streptococcus pneumoniae; identical to SEQ ID NO: 27612
  CDS (1)..(1683): transl_table=11

SEQ ID NO: 48926 - protein, 560 aa, Streptococcus pneumoniae; identical to SEQ ID NO: 27613

SEQ ID NO: 48927 - DNA, 1707 bp, Clostridium perfringens; identical to SEQ ID NO: 27614
  CDS (1)..(1707): transl_table=11

SEQ ID NO: 48928 - protein, 568 aa, Clostridium perfringens; identical to SEQ ID NO: 27615

SEQ ID NO: 48929 - DNA, 1701 bp, Lactobacillus plantarum; identical to SEQ ID NO: 27616
  CDS (1)..(1701): transl_table=11

SEQ ID NO: 48930 - protein, 566 aa, Lactobacillus plantarum; identical to SEQ ID NO: 27617

SEQ ID NO: 48931 - DNA, 1587 bp, Methanosarcina acetivorans; identical to SEQ ID NO: 27618
  CDS (1)..(1587): transl_table=11

SEQ ID NO: 48932 - protein, 528 aa, Methanosarcina acetivorans; identical to SEQ ID NO: 27619

SEQ ID NO: 48933 - DNA, 2343 bp, Bifidobacterium longum; identical to SEQ ID NO: 27620
  CDS (1)..(2343)

SEQ ID NO: 48934 - protein, 780 aa, Bifidobacterium longum; identical to SEQ ID NO: 27621

SEQ ID NO: 48935 - DNA, 1695 bp, Photobacterium profundum; identical to SEQ ID NO: 27622
  CDS (1)..(1695): transl_table=11

SEQ ID NO: 48936 - protein, 564 aa, Photobacterium profundum; identical to SEQ ID NO: 27623

SEQ ID NO: 48937 - DNA, 1740 bp, Vibrio parahaemolyticus; identical to SEQ ID NO: 27624
  CDS (1)..(1740): transl_table=11

SEQ ID NO: 48938 - protein, 579 aa, Vibrio parahaemolyticus; identical to SEQ ID NO: 27625

SEQ ID NO: 48939 - DNA, 1725 bp, Vibrio vulnificus; identical to SEQ ID NO: 27626
  CDS (1)..(1725): transl_table=11

SEQ ID NO: 48940 - protein, 574 aa, Vibrio vulnificus; identical to SEQ ID NO: 27627

SEQ ID NO: 48941 - DNA, 1593 bp, Escherichia coli O157; identical to SEQ ID NO: 27628
  CDS (1)..(1593): transl_table=11

SEQ ID NO: 48942 - protein, 530 aa, Escherichia coli O157; identical to SEQ ID NO: 27629

SEQ ID NO: 48943 - DNA, 1590 bp, Escherichia coli; identical to SEQ ID NO: 27630
  CDS (1)..(1590): transl_table=11

SEQ ID NO: 48944 - protein, 529 aa, Escherichia coli; identical to SEQ ID NO: 27631

SEQ ID NO: 48945 - DNA, 1512 bp, Escherichia coli; identical to SEQ ID NO: 27632
  CDS (1)..(1512): transl_table=11

SEQ ID NO: 48946 - protein, 503 aa, Escherichia coli; identical to SEQ ID NO: 27633

SEQ ID NO: 48947 - DNA, 25 bp, Artificial sequence
  (1)..(25): primer
atgtcatcgttgcaaattttgcaag

SEQ ID NO: 48948 - DNA, 28 bp, Artificial sequence
  (1)..(28): primer
ttaatatatttttgtcagcacatagcga

SEQ ID NO: 48949 - protein, 762 aa, Artificial sequence; identical to SEQ ID NO: 27636
  Variant (2)..(4): xaa in position 2 to 4 is any amino acid
  Variant (6)..(7): xaa in position 6 to 7 is any amino acid
  Variant (9)..(12): xaa in position 9 to 12 is any amino acid
  Variant (16)..(17): xaa in position 16 to 17 is any amino acid
  Variant (18)..(21): xaa in position 18 to 21 is any or no amino acid
  Variant (23)..(23): xaa in position 23 is any amino acid
  Variant (27)..(31): xaa in position 27 to 31 is any amino acid
  Variant (33)..(73): xaa in position 33 to 73 is any amino acid
  Variant (74)..(118): xaa in position 74 to 118 is any or no amino acid
  Variant (120)..(133): xaa in position 120 to 133 is any amino acid
  Variant (134)..(185): xaa in position 134 to 185 is any or no amino acid
  Variant (187)..(192): xaa in position 187 to 192 is any amino acid
  Variant (193)..(203): xaa in position 193 to 203 is any or no amino acid
  Variant (206)..(206): xaa in position 206 is any amino acid
  Variant (208)..(210): xaa in position 208 to 210 is any amino acid
  Variant (212)..(213): xaa in position 212 to 213 is any amino acid
  Variant (215)..(217): xaa in position 215 to 217 is any amino acid
  Variant (219)..(223): xaa in position 219 to 223 is any amino acid
  Variant (227)..(227): xaa in position 227 is any amino acid
  Variant (231)..(233): xaa in position 231 to 233 is any amino acid
  Variant (236)..(245): xaa in position 236 to 245 is any amino acid
  Variant (247)..(248): xaa in position 247 to 248 is any amino acid
  Variant (250)..(253): xaa in position 250 to 253 is any amino acid
  Variant (254)..(264): xaa in position 254 to 264 is any or no amino acid
  Variant (266)..(280): xaa in position 266 to 280 is any amino acid
  Variant (282)..(283): xaa in position 282 to 283 is any amino acid
  Variant (285)..(314): xaa in position 285 to 314 is any amino acid
  Variant (315)..(412): xaa in position 315 to 412 is any or no amino acid
  Variant (414)..(417): xaa in position 414 to 417 is any amino acid
  Variant (419)..(428): xaa in position 419 to 428 is any amino acid
  Variant (429)..(444): xaa in position 429 to 444 is any or no amino acid
  Variant (446)..(447): xaa in position 446 to 447 is any amino acid
  Variant (448)..(448): xaa in position 448 is any or no amino acid
  Variant (450)..(451): xaa in position 450 to 451 is any amino acid
  Variant (453)..(456): xaa in position 453 to 456 is any amino acid
  Variant (458)..(458): xaa in position 458 is any amino acid
  Variant (460)..(461): xaa in position 460 to 461 is any amino acid
  Variant (463)..(463): xaa in position 463 is any amino acid
  Variant (468)..(471): xaa in position 468 to 471 is any amino acid
  Variant (473)..(478): xaa in position 473 to 478 is any amino acid
  Variant (479)..(482): xaa in position 479 to 482 is any or no amino acid
  Variant (484)..(485): xaa in position 484 to 485 is any amino acid
  Variant (486)..(518): xaa in position 486 to 518 is any or no amino acid
  Variant (520)..(521): xaa in position 520 to 521 is any amino acid
  Variant (523)..(531): xaa in position 523 to 531 is any amino acid
  Variant (532)..(561): xaa in position 532 to 561 is any or no amino acid
  Variant (563)..(577): xaa in position 563 to 577 is any amino acid
  Variant (578)..(596): xaa in position 578 to 596 is any or no amino acid
  Variant (598)..(601): xaa in position 598 to 601 is any amino acid
  Variant (603)..(609): xaa in position 603 to 609 is any amino acid
  Variant (610)..(640): xaa in position 610 to 640 is any or no amino acid
  Variant (643)..(643): xaa in position 643 is any amino acid
  Variant (645)..(647): xaa in position 645 to 647 is any amino acid
  Variant (650)..(650): xaa in position 650 is any amino acid
  Variant (653)..(654): xaa in position 653 to 654 is any amino acid
  Variant (656)..(658): xaa in position 656 to 658 is any amino acid
  Variant (660)..(660): xaa in position 660 is any amino acid
  Variant (668)..(669): xaa in position 668 to 669 is any amino acid
  Variant (673)..(682): xaa in position 673 to 682 is any amino acid
  Variant (684)..(690): xaa in position 684 to 690 is any amino acid
  Variant (691)..(742): xaa in position 691 to 742 is any or no amino acid
  Variant (744)..(744): xaa in position 744 is any amino acid
  Variant (747)..(761): xaa in position 747 to 761 is any amino acid

SEQ ID NO: 48950 - protein, 9 aa, Artificial sequence
  Variant (2)..(2): xaa in position 2 is any amino acid
  Variant (3)..(3): xaa in position 3 is Asp, Asn or Ser
  Variant (5)..(5): xaa in position 5 is any amino acid
  Variant (8)..(8): xaa in position 8 is Ser or Thr
  Variant (9)..(9): xaa in position 9 is Ala, Ser, Thr or Val
GXXGXGKXX

SEQ ID NO: 48951 - protein, 29 aa, Artificial sequence
  Variant (2)..(4): xaa in position 2 to 4 is any amino acid
  Variant (5)..(5): xaa in position 5 is Lys or Arg
  Variant (6)..(19): xaa in position 6 to 19 is any amino acid
  Variant (20)..(20): xaa in position 20 is Phe, Ile, Leu or Val
  Variant (21)..(21): xaa in position 21 is any amino acid
  Variant (23)..(23): xaa in position 23 is Asp, Glu, Asn or Gln
  Variant (25)..(27): xaa in position 25 to 27 is any amino acid
  Variant (28)..(28): xaa in position 28 is Ile, Leu or Val
  Variant (29)..(29): xaa in position 29 is Asp or Thr
GXXXXXXXXXXXXXXXXXXXXDXPXXXXX

SEQ ID NO: 48952 - protein, 16 aa, Artificial sequence
  Variant (2)..(5): xaa in position 2 to 5 is any amino acid
  Variant (6)..(6): xaa in position 6 is Phe, Ile, Leu or Val
  Variant (7)..(7): xaa in position 7 is any amino acid
  Variant (9)..(9): xaa in position 9 is any amino acid
  Variant (10)..(10): xaa in position 10 is Asn or Ser
  Variant (12)..(12): xaa in position 12 is any amino acid
  Variant (15)..(15): xaa in position 15 is any or no amino acid
GXXXXXXGXXGXGKXT

SEQ ID NO: 48953 - protein, 29 aa, Artificial sequence
  Variant (2)..(5): xaa in position 2 to 5 is any amino acid
  Variant (6)..(6): xaa in position 6 is Ile, Leu, Met or Val
  Variant (7)..(7): xaa in position 7 is any amino acid
  Variant (8)..(8): xaa in position 8 is Phe, Ile, Leu or Val
  Variant (9)..(17): xaa in position 9 to 17 is any amino acid
  Variant (18)..(18): xaa in position 18 is Phe, Ile, Leu, Met or Val
  Variant (19)..(19): xaa in position 19 is any amino acid
  Variant (20)..(20): xaa in position 20 is Phe, Ile, Leu or Val
  Variant (21)..(21): xaa in position 21 is any amino acid
  Variant (24)..(28): xaa in position 24 to 28 is any amino acid
GXXXXXXXXXXXXXXXXXXXXDEXXXXXD

SEQ ID NO: 48954 - protein, 7 aa, Artificial sequence
  Variant (2)..(2): xaa in position 2 is any amino acid
  Variant (3)..(6): xaa in position 3 to 6 is any or no amino acid
IXXXXXH

SEQ ID NO: 48955 - DNA, 1629 bp, Escherichia coli; identical to SEQ ID NO: 27642
  CDS (467)..(1513)

SEQ ID NO: 48956 - protein, 348 aa, Escherichia coli [sequence omitted]

SEQ ID NO: 48957 - DNA, 1053 bp, Vibrio cholerae O1 biovar eltor str. N16961; identical to SEQ ID NO: 27644
  CDS (1)..(1053): transl_table=11

SEQ ID NO: 48958 - protein, 350 aa, Vibrio cholerae O1 biovar eltor str. N16961; identical to SEQ ID NO: 27645

SEQ ID NO: 48959 - DNA, 1008 bp, Campylobacter jejuni subsp. jejuni NCTC 11168; identical to SEQ ID NO: 27646
  CDS (1)..(1008): transl_table=11

SEQ ID NO: 48960 - protein, 335 aa, Campylobacter jejuni subsp. jejuni NCTC 11168; identical to SEQ ID NO: 27647

SEQ ID NO: 48961 - DNA, 1047 bp, Salmonella typhimurium LT2; identical to SEQ ID NO: 27648
  CDS (1)..(1047): transl_table=11

SEQ ID NO: 48962 - protein, 348 aa, Salmonella typhimurium LT2; identical to SEQ ID NO: 27649

SEQ ID NO: 48963 - DNA, 1182 bp, Agrobacterium tumefaciens str. C58; identical to SEQ ID NO: 27650
  CDS (1)..(1182): transl_table=11

SEQ ID NO: 48964 - protein, 393 aa, Agrobacterium tumefaciens str. C58; identical to SEQ ID NO: 27651

SEQ ID NO: 48965 - DNA, 1077 bp, Plasmodium falciparum 3D7; identical to SEQ ID NO: 27652
  CDS (1)..(1077)

SEQ ID NO: 48966 - protein, 358 aa, Plasmodium falciparum 3D7; identical to SEQ ID NO: 27653

SEQ ID NO: 48967 - DNA, 1032 bp, Shewanella oneidensis MR-1; identical to SEQ ID NO: 27654
  CDS (1)..(1032): transl_table=11

SEQ ID NO: 48968 - protein, 343 aa, Shewanella oneidensis MR-1; identical to SEQ ID NO: 27655

SEQ ID NO: 48969 - DNA, 1044 bp, Vibrio vulnificus CMCP6; identical to SEQ ID NO: 27656
  CDS (1)..(1044): transl_table=11

SEQ ID NO: 48970 - protein, 347 aa, Vibrio vulnificus CMCP6; identical to SEQ ID NO: 27657

SEQ ID NO: 48971 - DNA, 1056 bp, Coxiella burnetii RSA 493; identical to SEQ ID NO: 27658
  CDS (1)..(1056): transl_table=11

SEQ ID NO: 48972 - protein, 351 aa, Coxiella burnetii RSA 493; identical to SEQ ID NO: 27659

SEQ ID NO: 48973 - DNA, 1050 bp, Nitrosomonas europaea ATCC 19718; identical to SEQ ID NO: 27660
  CDS (1)..(1050): transl_table=11

SEQ ID NO: 48974 - protein, 349 aa, Nitrosomonas europaea ATCC 19718; identical to SEQ ID NO: 27661

SEQ ID NO: 48975 - DNA, 1032 bp, Helicobacter hepaticus ATCC 51449; identical to SEQ ID NO: 27662
  CDS (1)..(1032): transl_table=11

SEQ ID NO: 48976 - protein, 343 aa, Helicobacter hepaticus ATCC 51449; identical to SEQ ID NO: 27663

SEQ ID NO: 48977 - DNA, 1050 bp, Wigglesworthia glossinidia endosymbiont of Glossina brevipalpis; identical to SEQ ID NO: 27664
  CDS (1)..(1050): transl_table=11

SEQ ID NO: 48978 - protein, 349 aa, Wigglesworthia glossinidia endosymbiont of Glossina brevipalpis; identical to SEQ ID NO: 27665

SEQ ID NO: 48979 - DNA, 1080 bp, Prochlorococcus marinus subsp. marinus str. CCMP1375; identical to SEQ ID NO: 27666
  CDS (1)..(1080): transl_table=11

SEQ ID NO: 48980 - protein, 359 aa, Prochlorococcus marinus subsp. marinus str. CCMP1375; identical to SEQ ID NO: 27667

SEQ ID NO: 48981 - DNA, 1080 bp, Bordetella pertussis Tohama I; identical to SEQ ID NO: 27668
  CDS (1)..(1080): transl_table=11

SEQ ID NO: 48982 - protein, 359 aa, Bordetella pertussis Tohama I; identical to SEQ ID NO: 27669

SEQ ID NO: 48983 - DNA, 1080 bp, Bordetella bronchiseptica RB50; identical to SEQ ID NO: 27670
  CDS (1)..(1080)

SEQ ID NO: 48984 - protein, 359 aa, Bordetella bronchiseptica RB50; identical to SEQ ID NO: 27671

SEQ ID NO: 48985 - DNA, 1050 bp, Prochlorococcus marinus subsp. pastoris str. CCMP1986; identical to SEQ ID NO: 27672
  CDS (1)..(1050): transl_table=11

SEQ ID NO: 48986 - protein, 349 aa, Prochlorococcus marinus subsp. pastoris str. CCMP1986; identical to SEQ ID NO: 27673

SEQ ID NO: 48987 - DNA, 1065 bp, Prochlorococcus marinus str. MIT 9313; identical to SEQ ID NO: 27674
  CDS (1)..(1065): transl_table=11

SEQ ID NO: 48988 - protein, 354 aa, Prochlorococcus marinus str. MIT 9313; identical to SEQ ID NO: 27675

SEQ ID NO: 48989 - DNA, 1032 bp, Synechococcus sp. WH 8102; identical to SEQ ID NO: 27676
  CDS (1)..(1032): transl_table=11

SEQ ID NO: 48990 - protein, 343 aa, Synechococcus sp. WH 8102; identical to SEQ ID NO: 27677

SEQ ID NO: 48991 - DNA, 1086 bp, Chromobacterium violaceum ATCC 12472; identical to SEQ ID NO: 27678
  CDS (1)..(1086): transl_table=11

SEQ ID NO: 48992 - protein, 361 aa, Chromobacterium violaceum ATCC 12472; identical to SEQ ID NO: 27679

SEQ ID NO: 48993 - DNA, 1014 bp, Wolinella succinogenes DSM 1740; identical to SEQ ID NO: 27680
  CDS (1)..(1014): transl_table=11

SEQ ID NO: 48994 - protein, 337 aa, Wolinella succinogenes DSM 1740; identical to SEQ ID NO: 27681

SEQ ID NO: 48995 - DNA, 1080 bp, Oryza sativa (japonica cultivar-group); identical to SEQ ID NO: 27682
  CDS (1)..(1080)

SEQ ID NO: 48996 - protein, 359 aa, Oryza sativa (japonica cultivar-group); identical to SEQ ID NO: 27683

SEQ ID NO: 48997 - DNA, 1044 bp, Vibrio vulnificus YJ016; identical to SEQ ID NO: 27684
  CDS (1)..(1044): transl_table=11

SEQ ID NO: 48998 - protein, 347 aa, Vibrio vulnificus YJ016; identical to SEQ ID NO: 27685

SEQ ID NO: 48999 - DNA, 1086 bp, Eremothecium gossypii; identical to SEQ ID NO: 27686
  CDS (1)..(1086)

SEQ ID NO: 49000 - protein, 361 aa, Eremothecium gossypii; identical to SEQ ID NO: 27687

SEQ ID NO: 49001 - DNA, 1074 bp, Neurospora crassa; identical to SEQ ID NO: 27688
  CDS (1)..(1074)

SEQ ID NO: 49002 - protein, 357 aa, Neurospora crassa; identical to SEQ ID NO: 27689

SEQ ID NO: 49003 - DNA, 957 bp, Gibberella zeae PH-1; identical to SEQ ID NO: 27690
  CDS (1)..(957)

SEQ ID NO: 49004 - protein, 318 aa, Gibberella zeae PH-1; identical to SEQ ID NO: 27691

SEQ ID NO: 49005 - DNA, 1185 bp, Ustilago maydis 521; identical to SEQ ID NO: 27692
  CDS (1)..(1185)

SEQ ID NO: 49006 - protein, 394 aa, Ustilago maydis 521; identical to SEQ ID NO: 27693

SEQ ID NO: 49007 - DNA, 1077 bp, Candida glabrata CBS138; identical to SEQ ID NO: 27694
  CDS (1)..(1077)

SEQ ID NO: 49008 - protein, 358 aa, Candida glabrata CBS138; identical to SEQ ID NO: 27695

SEQ ID NO: 49009 - DNA, 1095 bp, Kluyveromyces lactis NRRL Y-1140; identical to SEQ ID NO: 27696
  CDS (1)..(1095)

SEQ ID NO: 49010 - protein, 364 aa, Kluyveromyces lactis NRRL Y-1140; identical to SEQ ID NO: 27697

SEQ ID NO: 49011 - DNA, 1083 bp, Debaryomyces hansenii CBS767; identical to SEQ ID NO: 27698
  CDS (1)..(1083)

SEQ ID NO: 49012 - protein, 360 aa, Debaryomyces hansenii CBS767; identical to SEQ ID NO: 27699

SEQ ID NO: 49013 - DNA, 1038 bp, Yarrowia lipolytica CLIB99; identical to SEQ ID NO: 27700
  CDS (1)..(1038)

SEQ ID NO: 49014 - protein, 345 aa, Yarrowia lipolytica CLIB99; identical to SEQ ID NO: 27701

SEQ ID NO: 49015 - DNA, 1062 bp, Cryptococcus neoformans var. neoformans JEC21; identical to SEQ ID NO: 27702
  CDS (1)..(1062)

SEQ ID NO: 49016 - protein, 353 aa, Cryptococcus neoformans var. neoformans JEC21; identical to SEQ ID NO: 27703

SEQ ID NO: 49017 - DNA, 1083 bp, Plasmodium berghei; identical to SEQ ID NO: 27704
  CDS (1)..(1083)

SEQ ID NO: 49018 - protein, 360 aa, Plasmodium berghei; identical to SEQ ID NO: 27705

SEQ ID NO: 49019 - DNA, 1077 bp, Candida albicans SC5314; identical to SEQ ID NO: 27706
  CDS (1)..(1077): transl_table=12

SEQ ID NO: 49020 - protein, 358 aa, Candida albicans SC5314; identical to SEQ ID NO: 27707

SEQ ID NO: 49021 - DNA, 1035 bp, Acinetobacter sp. ADP1; identical to SEQ ID NO: 27708
  CDS (1)..(1035): transl_table=11

SEQ ID NO: 49022 - protein, 344 aa, Acinetobacter sp. ADP1; identical to SEQ ID NO: 27709

SEQ ID NO: 49023 - DNA, 1044 bp, Erwinia carotovora subsp. atroseptica SCRI1043; identical to SEQ ID NO: 27710
  CDS (1)..(1044)

SEQ ID NO: 49024 - protein, 347 aa, Erwinia carotovora subsp. atroseptica SCRI1043; identical to SEQ ID NO: 27711

SEQ ID NO: 49025 - DNA, 1080 bp, Legionella pneumophila subsp. pneumophila str. Philadelphia 1; identical to SEQ ID NO: 27712
  CDS (1)..(1080): transl_table=11

SEQ ID NO: 49026 - protein, 359 aa, Legionella pneumophila subsp. pneumophila str. Philadelphia 1; identical to SEQ ID NO: 27713

SEQ ID NO: 49027 - DNA, 1059 bp, Burkholderia mallei ATCC 23344; identical to SEQ ID NO: 27714
  CDS (1)..(1059): transl_table=11

SEQ ID NO: 49028 - protein, 352 aa, Burkholderia mallei ATCC 23344; identical to SEQ ID NO: 27715

SEQ ID NO: 49029 - DNA, 1044 bp, Methylococcus capsulatus str. Bath; identical to SEQ ID NO: 27716
  CDS (1)..(1044): transl_table=11

SEQ ID NO: 49030 - protein, 347 aa, Methylococcus capsulatus str. Bath; identical to SEQ ID NO: 27717

SEQ ID NO: 49031 - DNA, 1038 bp, Legionella pneumophila str. Paris; identical to SEQ ID NO: 27718
  CDS (1)..(1038): transl_table=11

SEQ ID NO: 49032 - protein, 345 aa, Legionella pneumophila str. Paris; identical to SEQ ID NO: 27719

SEQ ID NO: 49033 - DNA, 1038 bp, Legionella pneumophila str. Lens; identical to SEQ ID NO: 27720
  CDS (1)..(1038): transl_table=11

SEQ ID NO: 49034 - protein, 345 aa, Legionella pneumophila str. Lens; identical to SEQ ID NO: 27721

SEQ ID NO: 49035 - DNA, 1029 bp, Photobacterium profundum SS9; identical to SEQ ID NO: 27722
  CDS (1)..(1029): transl_table=11

SEQ ID NO: 49036 - protein, 342 aa, Photobacterium profundum SS9; identical to SEQ ID NO: 27723

SEQ ID NO: 49037 - DNA, 1047 bp, Salmonella enterica subsp. enterica serovar Paratyphi A str. ATCC; identical to SEQ ID NO: 27724
  CDS (1)..(1047): transl_table=11

SEQ ID NO: 49038 - protein, 348 aa, Salmonella enterica subsp. enterica serovar Paratyphi A str. ATCC; identical to SEQ ID NO: 27725

SEQ ID NO: 49039 - DNA, 1035 bp, Idiomarina loihiensis L2TR; identical to SEQ ID NO: 27726
  CDS (1)..(1035): transl_table=11

SEQ ID NO: 49040 - protein, 344 aa, Idiomarina loihiensis L2TR; identical to SEQ ID NO: 27727

SEQ ID NO: 49041 - DNA, 1035 bp, Azoarcus sp. EbN1; identical to SEQ ID NO: 27728
  CDS (1)..(1035): transl_table=11

SEQ ID NO: 49042 - protein, 344 aa, Azoarcus sp. EbN1; identical to SEQ ID NO: 27729

SEQ ID NO: 49043 - DNA, 1041 bp, Silicibacter pomeroyi DSS-3; identical to SEQ ID NO: 27730
  CDS (1)..(1041): transl_table=11

SEQ ID NO: 49044 - protein, 346 aa, Silicibacter pomeroyi DSS-3; identical to SEQ ID NO: 27731

SEQ ID NO: 49045 - DNA, 996 bp, Campylobacter jejuni RM1221; identical to SEQ ID NO: 27732
  CDS (1)..(996): transl_table=11

SEQ ID NO: 49046 - protein, 331 aa, Campylobacter jejuni RM1221; identical to SEQ ID NO: 27733

SEQ ID NO: 49047 - DNA, 1029 bp, Vibrio fischeri ES114; identical to SEQ ID NO: 27734
  CDS (1)..(1029): transl_table=11

SEQ ID NO: 49048 - protein, 342 aa, Vibrio fischeri ES114; identical to SEQ ID NO: 27735

SEQ ID NO: 49049 - DNA, 1047 bp, Salmonella enterica subsp. enterica serovar Choleraesuis str; identical to SEQ ID NO: 27736
  CDS (1)..(1047): transl_table=11

SEQ ID NO: 49050 - protein, 348 aa, Salmonella enterica subsp. enterica serovar Choleraesuis str; identical to SEQ ID NO: 27737

SEQ ID NO: 49051 - DNA, 1044 bp, Pseudomonas syringae pv. syringae B728a; identical to SEQ ID NO: 27738
  CDS (1)..(1044)

SEQ ID NO: 49052 - protein, 347 aa, Pseudomonas syringae pv. syringae B728a; identical to SEQ ID NO: 27739

SEQ ID NO: 49053 - DNA, 1041 bp, Rhodobacter sphaeroides 2.4.1; identical to SEQ ID NO: 27740
  CDS (1)..(1041)

SEQ ID NO: 49054 - protein, 346 aa, Rhodobacter sphaeroides 2.4.1; identical to SEQ ID NO: 27741

SEQ ID NO: 49055 - DNA, 1047 bp, Pseudomonas aeruginosa UCBPP-PA14; identical to SEQ ID NO: 27742
  CDS (1)..(1047)

SEQ ID NO: 49056 - protein, 348 aa, Pseudomonas aeruginosa UCBPP-PA14; identical to SEQ ID NO: 27743

SEQ ID NO: 49057 - DNA, 1077 bp, Psychrobacter sp. 273-4; identical to SEQ ID NO: 27744
  CDS (1)..(1077)

SEQ ID NO: 49058 - protein, 358 aa, Psychrobacter sp. 273-4; identical to SEQ ID NO: 27745

SEQ ID NO: 49059 - DNA, 1032 bp, Dechloromonas aromatica RCB; identical to SEQ ID NO: 27746
  CDS (1)..(1032)

SEQ ID NO: 49060 - protein, 343 aa, Dechloromonas aromatica RCB; identical to SEQ ID NO: 27747

SEQ ID NO: 49061 - DNA, 1035 bp, Ralstonia eutropha JMP134; identical to SEQ ID NO: 27748
  CDS (1)..(1035)

SEQ ID NO: 49062 - protein, 344 aa, Ralstonia eutropha JMP134; identical to SEQ ID NO: 27749

SEQ ID NO: 49063 - DNA, 1065 bp, Burkholderia cepacia R18194; identical to SEQ ID NO: 27750
  CDS (1)..(1065)

SEQ ID NO: 49064 - protein, 354 aa, Burkholderia cepacia R18194; identical to SEQ ID NO: 27751

SEQ ID NO: 49065 - DNA, 1047 bp, Rubrivivax gelatinosus PM1; identical to SEQ ID NO: 27752
  CDS (1)..(1047)

SEQ ID NO: 49066 - protein, 348 aa, Rubrivivax gelatinosus PM1; identical to SEQ ID NO: 27753

SEQ ID NO: 49067 - DNA, 1062 bp, Burkholderia fungorum LB400; identical to SEQ ID NO: 27754
  CDS (1)..(1062)

SEQ ID NO: 49068 - protein, 353 aa, Burkholderia fungorum LB400; identical to SEQ ID NO: 27755

SEQ ID NO: 49069 - DNA, 1041 bp, Novosphingobium aromaticivorans DSM 12444; identical to SEQ ID NO: 27756
  CDS (1)..(1041)

SEQ ID NO: 49070 - protein, 346 aa, Novosphingobium aromaticivorans DSM 12444; identical to SEQ ID NO: 27757

SEQ ID NO: 49071 - DNA, 1080 bp, Microbulbifer degradans 2-40; identical to SEQ ID NO: 27758
  CDS (1)..(1080)

SEQ ID NO: 49072 - protein, 359 aa, Microbulbifer degradans 2-40; identical to SEQ ID NO: 27759

SEQ ID NO: 49073 - DNA, 1035 bp, Thiobacillus denitrificans ATCC 25259; identical to SEQ ID NO: 27760
  CDS (1)..(1035)

SEQ ID NO: 49074 - protein, 344 aa, Thiobacillus denitrificans ATCC 25259; identical to SEQ ID NO: 27761

SEQ ID NO: 49075 - DNA, 996 bp, Chloroflexus aurantiacus; identical to SEQ ID NO: 27762
  CDS (1)..(996)

SEQ ID NO: 49076 - protein, 331 aa, Chloroflexus aurantiacus; identical to SEQ ID NO: 27763

SEQ ID NO: 49077 - DNA, 1005 bp, Campylobacter coli RM2228; identical to SEQ ID NO: 27764
  CDS (1)..(1005): transl_table=11

SEQ ID NO: 49078 - protein, 334 aa, Campylobacter coli RM2228; identical to SEQ ID NO: 27765

SEQ ID NO: 49079 - DNA, 993 bp, Campylobacter lari RM2100; identical to SEQ ID NO: 27766
  CDS (1)..(993): transl_table=11

SEQ ID NO: 49080 - protein, 330 aa, Campylobacter lari RM2100; identical to SEQ ID NO: 27767

SEQ ID NO: 49081 - DNA, 1002 bp, Campylobacter upsaliensis RM3195; identical to SEQ ID NO: 27768
  CDS (1)..(1002): transl_table=11

SEQ ID NO: 49082 - protein, 333 aa, Campylobacter upsaliensis RM3195; identical to SEQ ID NO: 27769

SEQ ID NO: 49083 - DNA, 1065 bp, Erythrobacter litoralis HTCC2594; identical to SEQ ID NO: 27770
  CDS (1)..(1065): transl_table=11

SEQ ID NO: 49084 - protein, 354 aa, Erythrobacter litoralis HTCC2594; identical to SEQ ID NO: 27771

SEQ ID NO: 49085 - DNA, 1080 bp, Azotobacter vinelandii AvOP; identical to SEQ ID NO: 27772
  CDS (1)..(1080): transl_table=11

SEQ ID NO: 49086 - protein, 359 aa, Azotobacter vinelandii AvOP; identical to SEQ ID NO: 27773

SEQ ID NO: 49087 - DNA, 1095 bp, Burkholderia vietnamiensis G4; identical to SEQ ID NO: 27774
  CDS (1)..(1095): transl_table=11

SEQ ID NO: 49088 - protein, 364 aa, Burkholderia vietnamiensis G4; identical to SEQ ID NO: 27775

SEQ ID NO: 49089 - DNA, 1095 bp, Burkholderia cenocepacia AU 1054; identical to SEQ ID NO: 27776
  CDS (1)..(1095): transl_table=11

SEQ ID NO: 49090 - protein, 364 aa, Burkholderia cenocepacia AU 1054; identical to SEQ ID NO: 27777

SEQ ID NO: 49091 - DNA, 1056 bp, Chromohalobacter salexigens DSM 3043; identical to SEQ ID NO: 27778
  CDS (1)..(1056): transl_table=11

SEQ ID NO: 49092 - protein, 351 aa, Chromohalobacter salexigens DSM 3043; identical to SEQ ID NO: 27779

SEQ ID NO: 49093 - DNA, 1059 bp, Burkholderia pseudomallei 668; identical to SEQ ID NO: 27780
  CDS (1)..(1059)

SEQ ID NO: 49094 - protein, 352 aa, Burkholderia pseudomallei 668; identical to SEQ ID NO: 27781

SEQ ID NO: 49095 - DNA, 1068 bp, Polaromonas sp. JS666; identical to SEQ ID NO: 27782
  CDS (1)..(1068): transl_table=11

SEQ ID NO: 49096 - protein, 355 aa, Polaromonas sp. JS666; identical to SEQ ID NO: 27783

SEQ ID NO: 49097 - DNA, 1341 bp, Jannaschia sp. CCS1; identical to SEQ ID NO: 27784
  CDS (1)..(1341): transl_table=11

SEQ ID NO: 49098 - protein, 446 aa, Jannaschia sp. CCS1; identical to SEQ ID NO: 27785

SEQ ID NO: 49099 - DNA, 1038 bp, Methylobacillus flagellatus KT; identical to SEQ ID NO: 27786
  CDS (1)..(1038): transl_table=11

SEQ ID NO: 49100 - protein, 345 aa, Methylobacillus flagellatus KT; identical to SEQ ID NO: 27787

SEQ ID NO: 49101 - DNA, 1023 bp, Sphingopyxis alaskensis RB2256; identical to SEQ ID NO: 27788
  CDS (1)..(1023): transl_table=11

SEQ ID NO: 49102 - protein, 340 aa, Sphingopyxis alaskensis RB2256; identical to SEQ ID NO: 27789

SEQ ID NO: 49103 - DNA, 1032 bp, Shewanella baltica OS155; identical to SEQ ID NO: 27790
  CDS (1)..(1032): transl_table=11

SEQ ID NO: 49104 - protein, 343 aa, Shewanella baltica OS155; identical to SEQ ID NO: 27791

SEQ ID NO: 49105 - DNA, 1029 bp, Shewanella amazonensis SB2B; identical to SEQ ID NO: 27792
  CDS (1)..(1029): transl_table=11

SEQ ID NO: 49106 - protein, 342 aa, Shewanella amazonensis SB2B; identical to SEQ ID NO: 27793

SEQ ID NO: 49107 - DNA, 1035 bp, Ralstonia metallidurans CH34; identical to SEQ ID NO: 27794
  CDS (1)..(1035): transl_table=11

SEQ ID NO: 49108 - protein, 344 aa, Ralstonia metallidurans CH34; identical to SEQ ID NO: 27795

SEQ ID NO: 49109 - DNA, 1041 bp, Mesorhizobium sp. BNC1; identical to SEQ ID NO: 27796
  CDS (1)..(1041): transl_table=11

SEQ ID NO: 49110 - protein, 346 aa, Mesorhizobium sp. BNC1; identical to SEQ ID NO: 27797

SEQ ID NO: 49111 - DNA, 1041 bp, Silicibacter sp. TM1040; identical to SEQ ID NO: 27798
  CDS (1)..(1041): transl_table=11

SEQ ID NO: 49112 - protein, 346 aa, Silicibacter sp. TM1040; identical to SEQ ID NO: 27799

SEQ ID NO: 49113 - DNA, 1044 bp, Paracoccus denitrificans PD1222; identical to SEQ ID NO: 27800
  CDS (1)..(1044): transl_table=11

SEQ ID NO: 49114 - protein, 347 aa, Paracoccus denitrificans PD1222; identical to SEQ ID NO: 27801

SEQ ID NO: 49115 - DNA, 1035 bp, Shewanella denitrificans OS-217; identical to SEQ ID NO: 27802
  CDS (1)..(1035): transl_table=11

SEQ ID NO: 49116 - protein, 344 aa, Shewanella denitrificans OS-217; identical to SEQ ID NO: 27803

SEQ ID NO: 49117 - DNA, 1038 bp, Shewanella frigidimarina NCIMB 400; identical to SEQ ID NO: 27804
  CDS (1)..(1038): transl_table=11

SEQ ID NO: 49118 - protein, 345 aa, Shewanella frigidimarina NCIMB 400; identical to SEQ ID NO: 27805

SEQ ID NO: 49119 - DNA, 1047 bp, Pseudomonas fluorescens; identical to SEQ ID NO: 27806
  CDS (1)..(1047): transl_table=11

SEQ ID NO: 49120 - protein, 348 aa, Pseudomonas fluorescens; identical to SEQ ID NO: 27807

SEQ ID NO: 49121 - DNA, 888 bp, Theileria parva; identical to SEQ ID NO: 27808
  CDS (1)..(888)

SEQ ID NO: 49122 - protein, 295 aa, Theileria parva; identical to SEQ ID NO: 27809

SEQ ID NO: 49123 - DNA, 1053 bp, Theileria annulata; identical to SEQ ID NO: 27810
  CDS (1)..(1053)

SEQ ID NO: 49124 - protein, 350 aa, Theileria annulata; identical to SEQ ID NO: 27811

SEQ ID NO: 49125 - DNA, 1005 bp, Aspergillus fumigatus Af293; identical to SEQ ID NO: 27812
  CDS (1)..(1005)

SEQ ID NO: 49126 - protein, 334 aa, Aspergillus fumigatus Af293; identical to SEQ ID NO: 27813

SEQ ID NO: 49127 - DNA, 1086 bp, Plasmodium chabaudi; identical to SEQ ID NO: 27814
  CDS (1)..(1086)

SEQ ID NO: 49128 - protein, 361 aa, Plasmodium chabaudi; identical to SEQ ID NO: 27815

SEQ ID NO: 49129 - DNA, 1086 bp, Plasmodium yoelii yoelii; identical to SEQ ID NO: 27816
  CDS (1)..(1086)

SEQ ID NO: 49130 - protein, 361 aa, Plasmodium yoelii yoelii; identical to SEQ ID NO: 27817

SEQ ID NO: 49131 - DNA, 1212 bp, Toxoplasma gondii; identical to SEQ ID NO: 27818
  CDS (1)..(1212)

SEQ ID NO: 49132 - protein, 403 aa, Toxoplasma gondii; identical to SEQ ID NO: 27819

SEQ ID NO: 49133 - DNA, 1038 bp, Beta vulgaris; identical to SEQ ID NO: 27820
  CDS (1)..(1038)

SEQ ID NO: 49134 - protein, 345 aa, Beta vulgaris; identical to SEQ ID NO: 27821

SEQ ID NO: 49135 - DNA, 1038 bp, Agrobacterium tumefaciens; identical to SEQ ID NO: 27822
  CDS (1)..(1038)

SEQ ID NO: 49136 - protein, 345 aa, Agrobacterium tumefaciens; identical to SEQ ID NO: 27823

SEQ ID NO: 49137 - DNA, 1269 bp, Aquifex aeolicus; identical to SEQ ID NO: 27824
  CDS (1)..(1269): transl_table=11

SEQ ID NO: 49138 - protein, 422 aa, Aquifex aeolicus; identical to SEQ ID NO: 27825

SEQ ID NO: 49139 - DNA, 1134 bp, Arabidopsis thaliana; identical to SEQ ID NO: 27826
  CDS (1)..(1134)

SEQ ID NO: 49140 - protein, 377 aa, Arabidopsis thaliana; identical to SEQ ID NO: 27827

SEQ ID NO: 49141 - DNA, 1053 bp, Buchnera aphidicola; identical to SEQ ID NO: 27828
  CDS (1)..(1053): transl_table=11

SEQ ID NO: 49142 - protein, 350 aa, Buchnera aphidicola; identical to SEQ ID NO: 27829

SEQ ID NO: 49143 - DNA, 1050 bp, Buchnera aphidicola; identical to SEQ ID NO: 27830
  CDS (1)..(1050): transl_table=11

SEQ ID NO: 49144 - protein, 349 aa, Buchnera aphidicola; identical to SEQ ID NO: 27831

SEQ ID NO: 49145 - DNA, 1020 bp, Helicobacter pylori J99; identical to SEQ ID NO: 27832
  CDS (1)..(1020): transl_table=11

SEQ ID NO: 49146 - protein, 339 aa, Helicobacter pylori J99; identical to SEQ ID NO: 27833

SEQ ID NO: 49147 - DNA, 1020 bp, Helicobacter pylori; identical to SEQ ID NO: 27834
  CDS (1)..(1020): transl_table=11

SEQ ID NO: 49148 - protein, 339 aa, Helicobacter pylori; identical to SEQ ID NO: 27835

SEQ ID NO: 49149 - DNA, 1281 bp, Listeria innocua; identical to SEQ ID NO: 27836
  CDS (1)..(1281): transl_table=11

SEQ ID NO: 49150 - protein, 426 aa, Listeria innocua; identical to SEQ ID NO: 27837

SEQ ID NO: 49151 - DNA, 1281 bp, Listeria monocytogenes; identical to SEQ ID NO: 27838
  CDS (1)..(1281): transl_table=11

SEQ ID NO: 49152 - protein, 426 aa, Listeria monocytogenes; identical to SEQ ID NO: 27839

SEQ ID NO: 49153 - DNA, 1281 bp, Listeria monocytogenes; identical to SEQ ID NO: 27840
  CDS (1)..(1281): transl_table=11

SEQ ID NO: 49154 - protein, 426 aa, Listeria monocytogenes; identical to SEQ ID NO: 27841

SEQ ID NO: 49155 - DNA, 1035 bp, Neisseria meningitidis; identical to SEQ ID NO: 27842
  CDS (1)..(1035): transl_table=11

SEQ ID NO: 49156 - protein, 344 aa, Neisseria meningitidis; identical to SEQ ID NO: 27843

SEQ ID NO: 49157 - DNA, 1047 bp, Pseudomonas aeruginosa; identical to SEQ ID NO: 27844
  CDS (1)..(1047): transl_table=11

SEQ ID NO: 49158 - protein, 348 aa, Pseudomonas aeruginosa; identical to SEQ ID NO: 27845

SEQ ID NO: 49159 - DNA, 1047 bp, Pseudomonas putida; identical to SEQ ID NO: 27846
  CDS (1)..(1047): transl_table=11

SEQ ID NO: 49160 - protein, 348 aa, Pseudomonas putida; identical to SEQ ID NO: 27847

SEQ ID NO: 49161 - DNA, 1035 bp, Ralstonia solanacearum; identical to SEQ ID NO: 27848
  CDS (1)..(1035): transl_table=11

SEQ ID NO: 49162 - protein, 344 aa, Ralstonia solanacearum; identical to SEQ ID NO: 27849

SEQ ID NO: 49163 - DNA, 1044 bp, Rhizobium meliloti; identical to SEQ ID NO: 27850
  CDS (1)..(1044): transl_table=11

SEQ ID NO: 49164 - protein, 347 aa, Rhizobium meliloti; identical to SEQ ID NO: 27851

SEQ ID NO: 49165 - DNA, 1047 bp, Salmonella typhimurium; identical to SEQ ID NO: 27648
  CDS (1)..(1047)

SEQ ID NO: 49166 - protein, 348 aa, Salmonella typhimurium; identical to SEQ ID NO: 27649

SEQ ID NO: 49167 - DNA, 1014 bp, Schizosaccharomyces pombe; identical to SEQ ID NO: 27854
  CDS (1)..(1014)

SEQ ID NO: 49168 - protein, 337 aa, Schizosaccharomyces pombe; identical to SEQ ID NO: 27855

SEQ ID NO: 49169 - DNA, 1278 bp, Staphylococcus epidermidis; identical to SEQ ID NO: 27856
  CDS (1)..(1278): transl_table=11

SEQ ID NO: 49170 - protein, 425 aa, Staphylococcus epidermidis; identical to SEQ ID NO: 27857

SEQ ID NO: 49171 - DNA, 1278 bp, Staphylococcus epidermidis; identical to SEQ ID NO: 27858
  CDS (1)..(1278): transl_table=11

SEQ ID NO: 49172 - protein, 425 aa, Staphylococcus epidermidis; identical to SEQ ID NO: 27859

SEQ ID NO: 49173 - DNA, 1029 bp, Synechocystis sp; identical to SEQ ID NO: 27860
  CDS (1)..(1029): transl_table=11

SEQ ID NO: 49174 - protein, 342 aa, Synechocystis sp; identical to SEQ ID NO: 27861

SEQ ID NO: 49175 - DNA, 1176 bp, Ustilago maydis; identical to SEQ ID NO: 27862
  CDS (1)..(1176)

SEQ ID NO: 49176 - protein, 391 aa, Ustilago maydis; identical to SEQ ID NO: 27863

SEQ ID NO: 49177 - DNA, 1029 bp, Vibrio cholerae; identical to SEQ ID NO: 27864
  CDS (1)..(1029)

SEQ ID NO: 49178 - protein, 342 aa, Vibrio cholerae; identical to SEQ ID NO: 27865

SEQ ID NO: 49179 - DNA, 1029 bp, Vibrio parahaemolyticus; identical to SEQ ID NO: 27866
  CDS (1)..(1029): transl_table=11

SEQ ID NO: 49180 - protein, 342 aa, Vibrio parahaemolyticus; identical to SEQ ID NO: 27867

SEQ ID NO: 49181 - DNA, 1029 bp, Vibrio vulnificus; identical to SEQ ID NO: 27868
  CDS (1)..(1029)

SEQ ID NO: 49182 - protein, 342 aa, Vibrio vulnificus; identical to SEQ ID NO: 27869

SEQ ID NO: 49183 - DNA, 1029 bp, Vibrio vulnificus; identical to SEQ ID NO: 27870
  CDS (1)..(1029)

SEQ ID NO: 49184 - protein, 342 aa, Vibrio vulnificus; identical to SEQ ID NO: 27871

SEQ ID NO: 49185 - DNA, 1095 bp, Saccharomyces cerevisiae; identical to SEQ ID NO: 27872
  CDS (1)..(1095)

SEQ ID NO: 49186 - protein, 364 aa, Saccharomyces cerevisiae; identical to SEQ ID NO: 27873

SEQ ID NO: 49187 - DNA, 1047 bp, Yersinia pestis; identical to SEQ ID NO: 27874
  CDS (1)..(1047): transl_table=11

SEQ ID NO: 49188 - protein, 348 aa, Yersinia pestis; identical to SEQ ID NO: 27875

SEQ ID NO: 49189 - DNA, 23 bp, Artificial sequence
  (1)..(23): primer
atgactgcaccatcccaggtatt

SEQ ID NO: 49190 - DNA, 24 bp, Artificial sequence
  (1)..(24): primer
ttattgtttaacggaccagcgtac

SEQ ID NO: 49191 - protein, 478 aa, Artificial sequence; identical to SEQ ID NO: 27878
  Variant (2)..(2): xaa in position 2 is any amino acid
  Variant (4)..(5): xaa in position 4 to 5 is any amino acid
  Variant (7)..(7): xaa in position 7 is any amino acid
  Variant (9)..(9): xaa in position 9 is any amino acid
  Variant (15)..(16): xaa in position 15 to 16 is any or no amino acid
  Variant (19)..(20): xaa in position 19 to 20 is any amino acid
  Variant (22)..(33): xaa in position 22 to 33 is any amino acid
  Variant (34)..(41): xaa in position 34 to 41 is any or no amino acid
  Variant (49)..(49): xaa in position 49 is any or no amino acid
  Variant (51)..(51): xaa in position 51 is any or no amino acid
  Variant (54)..(58): xaa in position 54 to 58 is any amino acid
  Variant (59)..(61): xaa in position 59 to 61 is any or no amino acid
  Variant (64)..(64): xaa in position 64 is any amino acid
  Variant (65)..(65): xaa in position 65 is any or no amino acid
  Variant (67)..(84): xaa in position 67 to 84 is any or no amino acid
  Variant (88)..(89): xaa in position 88 to 89 is any or no amino acid
  Variant (92)..(92): xaa in position 92 is any amino acid
  Variant (93)..(98): xaa in position 93 to 98 is any or no amino acid
  Variant (101)..(102): xaa in position 101 to 102 is any amino acid
  Variant (104)..(106): xaa in position 104 to 106 is any amino acid
  Variant (107)..(108): xaa in position 107 to 108 is any or no amino acid
  Variant (110)..(110): xaa in position 110 is any amino acid
  Variant (112)..(112): xaa in position 112 is any amino acid
  Variant (118)..(119): xaa in position 118 to 119 is any amino acid
  Variant (124)..(125): xaa in position 124 to 125 is any amino acid
  Variant (128)..(139): xaa in position 128 to 139 is any amino acid
  Variant (140)..(145): xaa in position 140 to 145 is any or no amino acid
  Variant (147)..(150): xaa in position 147 to 150 is any amino acid
  Variant (152)..(152): xaa in position 152 is any amino acid
  Variant (154)..(154): xaa in position 154 is any amino acid
  Variant (159)..(161): xaa in position 159 to 161 is any amino acid
  Variant (162)..(181): xaa in position 162 to 181 is any or no amino acid
  Variant (183)..(185): xaa in position 183 to 185 is any amino acid
  Variant (187)..(188): xaa in position 187 to 188 is any amino acid
  Variant (191)..(192): xaa in position 191 to 192 is any amino acid
  Variant (193)..(203): xaa in position 193 to 203 is any or no amino acid
  Variant (205)..(206): xaa in position 205 to 206 is any amino acid
  Variant (208)..(211): xaa in position 208 to 211 is any amino acid
  Variant (213)..(213): xaa in position 213 is any amino acid
  Variant (218)..(218): xaa in position 218 is any amino acid
  Variant (224)..(225): xaa in position 224 to 225 is any amino acid
  Variant (227)..(229): xaa in position 227 to 229 is any amino acid
  Variant (231)..(235): xaa in position 231 to 235 is any amino acid
  Variant (236)..(244): xaa in position 236 to 244 is any or no amino acid
  Variant (246)..(246): xaa in position 246 is any or no amino acid
  Variant (251)..(252): xaa in position 251 to 252 is any amino acid
  Variant (255)..(260): xaa in position 255 to 260 is any amino acid
  Variant (262)..(264): xaa in position 262 to 264 is any amino acid
  Variant (265)..(265): xaa in position 265 is any or no amino acid
  Variant (267)..(288): xaa in position 267 to 288 is any or no amino acid
  Variant (290)..(290): xaa in position 290 is any or no amino acid
  Variant (293)..(293): xaa in position 293 is any amino acid
  Variant (296)..(296): xaa in position 296 is any amino acid
  Variant (298)..(303): xaa in position 298 to 303 is any amino acid
  Variant (306)..(310): xaa in position 306 to 310 is any amino acid
  Variant (311)..(311): xaa in position 311 is any or no amino acid
  Variant (314)..(315): xaa in position 314 to 315 is any amino acid
  Variant (317)..(317): xaa in position 317 is any amino acid
  Variant (319)..(319): xaa in position 319 is any amino acid
  Variant (327)..(330): xaa in position 327 to 330 is any amino acid
  Variant (332)..(364): xaa in position 332 to 364 is any or no amino acid
  Variant (367)..(367): xaa in position 367 is any amino acid
  Variant (369)..(369): xaa in position 369 is any amino acid
  Variant (371)..(373): xaa in position 371 to 373 is any amino acid
  Variant (375)..(375): xaa in position 375 is any amino acid
  Variant (376)..(390): xaa in position 376 to 390 is any or no amino acid
  Variant (393)..(395): xaa in position 393 to 395 is any amino acid
  Variant (396)..(396): xaa in position 396 is any or no amino acid
  Variant (398)..(399): xaa in position 398 to 399 is any amino acid
  Variant (401)..(402): xaa in position 401 to 402 is any amino acid
  Variant (404)..(404): xaa in position 404 is any amino acid
  Variant (406)..(407): xaa in position 406 to 407 is any amino acid
  Variant (409)..(410): xaa in position 409 to 410 is any amino acid
  Variant (413)..(413): xaa in position 413 is any amino acid
  Variant (415)..(420): xaa in position 415 to 420 is any amino acid
  Variant (421)..(426): xaa in position 421 to 426 is any or no amino acid
  Variant (428)..(428): xaa in position 428 is any amino acid
  Variant (430)..(430): xaa in position 430 is any amino acid
  Variant (432)..(441): xaa in position 432 to 441 is any amino acid
  Variant (442)..(466): xaa in position 442 to 466 is any or no amino acid
  Variant (468)..(468): xaa in position 468 is any amino acid
  Variant (470)..(472): xaa in position 470 to 472 is any amino acid
  Variant (474)..(475): xaa in position 474 to 475 is any amino acid
  Variant (477)..(477): xaa in position 477 is any amino acid

SEQ ID NO: 49192 - protein, 17 aa, Artificial sequence
  Variant (2)..(3): xaa in position 2 to 3 is any amino acid
  Variant (4)..(5): xaa in position 4 to 5 is any or no amino acid
  Variant (7)..(7): xaa in position 7 is any amino acid
  Variant (8)..(9): xaa in position 8 to 9 is any or no amino acid
  Variant (11)..(11): xaa in position 11 is any amino acid
  Variant (13)..(13): xaa in position 13 is any amino acid
  Variant (15)..(15): xaa in position 15 is Phe, Leu or Val
  Variant (17)..(17): xaa in position 17 is Asp, Glu or Gln
LXXXXPXXXDXHXHXRX

SEQ ID NO: 49193 - protein, 25 aa, Artificial sequence
  Variant (2)..(3): xaa in position 2 to 3 is any amino acid
  Variant (4)..(4): xaa in position 4 is any or no amino acid
  Variant (8)..(10): xaa in position 8 to 10 is any amino acid
  Variant (12)..(12): xaa in position 12 is Ala, Ile, Leu or Val
  Variant (13)..(20): xaa in position 13 to 20 is any amino acid
  Variant (22)..(24): xaa in position 22 to 24 is any amino acid
  Variant (25)..(25): xaa in position 25 is Ile or Leu
AXXXMPNXXXPXXXXXXXXXYXXXX

SEQ ID NO: 49194 - protein, 8 aa, Artificial sequence
  Variant (2)..(2): xaa in position 2 is any or no amino acid
  Variant (4)..(5): xaa in position 4 to 5 is any or no amino acid
LXLXXHGE

SEQ ID NO: 49195 - protein, 41 aa, Artificial sequence; identical to SEQ ID NO: 27882
  Variant (2)..(2): xaa in position 2 is any amino acid
  Variant (4)..(4): xaa in position 4 is Ile, Leu or Val
  Variant (5)..(5): xaa in position 5 is Ala, Leu, Pro or Val
  Variant (7)..(9): xaa in position 7 to 9 is any amino acid
  Variant (10)..(10): xaa in position 10 is Asp or His
  Variant (11)..(12): xaa in position 11 to 12 is any amino acid
  Variant (13)..(13): xaa in position 13 is Ala, Ser, Thr or Val
  Variant (15)..(17): xaa in position 15 to 17 is any amino acid
  Variant (18)..(18): xaa in position 18 is Ala, Ile or Val
  Variant (19)..(19): xaa in position 19 is any amino acid
  Variant (20)..(20): xaa in position 20 is Ala, Asp, Glu, Gly, Asn, Gln, Ser or Thr
  Variant (22)..(24): xaa in position 22 to 24 is any amino acid
  Variant (25)..(26): xaa in position 25 to 26 is any or no amino acid
  Variant (28)..(29): xaa in position 28 to 29 is any or no amino acid
  Variant (31)..(31): xaa in position 31 is Ser or Thr
  Variant (33)..(33): xaa in position 33 is Ser or Thr
  Variant (37)..(40): xaa in position 37 to 40 is any amino acid

SEQ ID NO: 49196 - DNA, 591 bp, Escherichia coli
  CDS (1)..(591)
atgcagcttaaacgtgtggcagaagccaaactgccaaccccatggggcgatttcctgatggtgggatttgaagaactggcaaccggacacgatcatgtcgcgctagtctatggcgatatttccgggcataccccggtacttgcgcgcgtccattccgaatgtctgaccggtgacgccctgttcagcttgcgctgcgattgtggcttccagctcgaagcggcattgacgcaaattgccgaggaaggccgtggtattttgctgtatcaccgtcaggaaggtcgtaacattggtctgctgaataaaatccgcgcttacgcactgcaggatcaaggttacgataccgtagaggctaaccaccagttaggcttcgccgctgatgagcgcgacttcactctttgcgctgatatgttcaaactccttggcgtcaatgaagtccgcttgttaaccaataacccgaaaaaagtcgaaattctgaccgaagcagggattaatattgttgaacgcgtaccattgattgtaggtcgtaaccccaataacgaacattatctcgataccaaagccgagaaaatgggccatttgctgaacaaataa

SEQ ID NO: 49197 - protein, 196 aa, Escherichia coli
MQLKRVAEAKLPTPWGDFLMVGFEELATGHDHVALVYGDISGHTPVLARVHSECLTGDALFSLRCDCGFQLEAALTQIAEEGRGILLYHRQEGRNIGLLNKIRAYALQDQGYDTVEANHQLGFAADERDFTLCADMFKLLGVNEVRLLTNNPKKVEILTEAGINIVERVPLIVGRNPNNEHYLDTKAEKMGHLLNK

SEQ ID NO: 49198 - DNA, 588 bp, Thermoplasma volcanium GSS1
  CDS (1)..(588): transl_table=11
atgatagagctttattcaaatgcaaagctgcctactgaatttgggcttttccgtatatatacgtttgtcaacgacgaaaataaggatcacgcagttattgtaaggggtgatccgagaggaaaggaaaatgtacctctccgcatacattccgaatgcctaactggcgatgtccttggctcacttcgatgcgactgcagagatcagctgatccagtctctgaggtatcttggcagacaggaatacggaatgcttatatacttaaggcaagagggtagaggtatcggtctccttaacaagataaaagcgtacagtctacaggatatgggtgcggatacggtagaagctaatcttaagctaggactgcctgtcgatagtcgaaactatagttttgctgcagaagttctaaggtactttgagataaaatctatatacataatgacaaataacccagaaaagataaaatcgctcatcgaaagtggaatcaacgtgaagggaagaataccaatattcagcgatccaacgccatacgataagttttatttggaaacaaagaaaacaaaactcgggcatgagatcgaaaatatataa

SEQ ID NO: 49199 - protein, 195 aa, Thermoplasma volcanium GSS1
MIELYSNAKLPTEFGLFRIYTFVNDENKDHAVIVRGDPRGKENVPLRIHSECLTGDVLGSLRCDCRDQLIQSLRYLGRQEYGMLIYLRQEGRGIGLLNKIKAYSLQDMGADTVEANLKLGLPVDSRNYSFAAEVLRYFEIKSIYIMTNNPEKIKSLIESGINVKGRIPIFSDPTPYDKFYLETKKTKLGHEIENI

SEQ ID NO: 49200 - DNA, 1431 bp, Arabidopsis thaliana
  CDS (1)..(1431)
atggcgtcgcttactctccggtgcgattcgacgcatcttttgccttcccgtgatgttgtcaagggaacaaaaccatttggaacgagcttggtgtatcctaggatcatatcgaagaagtttaatgttagaatgagagtgatacctgaggaaggagatgtgttctcttcttctaagagtaatggatcatcaatggggattgagttacagccagatttggtttcgtttggaacattagcagctgaaatgattcctacaacaatggattctcctgaagttgaggatgaagagtttgatttagatcgacctactgatggatttgcgtctattcctcaagctattgaagatattcgacatggcaagatggtagttgttgtagatgatgaagatagagaaaacgaaggagatttgataatggcggcatctttggctacacctgaagctatggcttttgttgtaaagcatgggactggaatcgtgtgtgtgagcatgaaaggcgaagacttggagaggttagagcttcctttaatggtaacgcgtaaggataacgaggaaaaactccgcacggccttcacggtttcagtggacgcaaaaaagggaacatccacaggtgtctcagctcgtgatagggcgcaaacaatattaacccttgcatcaaaagattcaaaacctgaagatttcaatcgtcctggtcatatttttcctttgagatacagagaaggtggtgttcttaaaagagcagggcatacagaagcctctgttgacttgactgtgttggccggtttagaaccagtatctgttttatgtgagattgtagatgatgatggttccatggctagattaccaagactccgccaattcgctcaagagaacaacttgaaattaatttcaatcgctgatttaatcagataccgaaggaaaagagagagactggttgagtttactgcggttgcgcctataccgacaatgtggggaccattcaaagcacattgctttaagtcattacttgatggagttgagcacattgcaatggtcaagggagaaatcggagatgggaaggatattctcgtgagagtacacgcggagtgtatcacagatgatatattcggaaatagctctggtggaaaacagttagcgattgcaatgagactgattgaagaaaatgggagaggtgtttttgtctacttacgtggtcctgaaagtaaaggcattgatctaagccacaagcctcgtacttacaacaccaattcagatcaagccgagggtgtttcatttcccgttgcttcacgggaatacggcattggagcacaaattctaagggatcttggagttagagagatgaaggtgatgacgaataatccagcacattacgttggtcttaaaggctatggtttatcaatttctggtaaggttccactcattactactccttaa

SEQ ID NO: 49201 - protein, 476 aa, Arabidopsis thaliana
MASLTLRCDSTHLLPSRDVVKGTKPFGTSLVYPRIISKKFNVRMRVIPEEGDVFSSSKSNGSSMGIELQPDLVSFGTLAAEMIPTTMDSPEVEDEEFDLDRPTDGFASIPQAIEDIRHGKMVVVVDDEDRENEGDLIMAASLATPEAMAFVVKHGTGIVCVSMKGEDLERLELPLMVTRKDNEEKLRTAFTVSVDAKKGTSTGVSARDRAQTILTLASKDSKPEDFNRPGHIFPLRYREGGVLKRAGHTEASVDLTVLAGLEPVSVLCEIVDDDGSMARLPRLRQFAQENNLKLISIADLIRYRRKRERLVEFTAVAPIPTMWGPFKAHCFKSLLDGVEHIAMVKGEIGDGKDILVRVHAECITDDIFGNSSGGKQLAIAMRLIEENGRGVFVYLRGPESKGIDLSHKPRTYNTNSDQAEGVSFPVASREYGIGAQILRDLGVREMKVMTNNPAHYVGLKGYGLSISGKVPLITTP

SEQ ID NO: 49202 - DNA, 1632 bp, Arabidopsis thaliana
  CDS (1)..(1632)
atgtcttccatcaatttatcctcatcatctccttccaccatctctctttcccgctcaagactaagccaaagctctactacattactccatggactacatcgtgttactttaccatctaaccatccattgtcaaccttttccattaaaaccaatactggaaaagttaaggctgcagtgatctctagagaagatgatctgctctcattcaccaacggaaacactcctctctcaaatgggtctctcattgatgatcggaccgaagagccattagaggctgattcggtttcacttggaacacttgctgctgattctgctcctgcaccagccaatggttttgttgctgaagatgatgactttgagttggatttaccaactcctggtttctcttctatccctgaggccattgaagatatacgccaaggaaagcttgtggtggttgtggatgatgaagatagggaaaatgaaggggatttggtgatggctgctcagttagcaacacctgaagctatggcttttattgtgagacatggaactgggatagtttgtgtgagcatgaaagaagatgatctcgagaggttgcaccttcctctaatggtgaatcagaaggaaaacgaagaaaagctctctactgcatttacagtgactgtggatgcaaaacatggtacaacaacgggagtatcagctcgtgacagggcaacaaccatattgtctcttgcatcaagagattcaaagcctgaggatttcaatcgtccaggtcatatcttcccactgaagtatcgggaaggtggggttctgaaaagggctggacacactgaagcatctgttgatctcactgttttagctggactggatcctgttggagtactttgtgaaattgttgatgatgatggttccatggctagattaccaaaacttcgtgaatttgccgccgagaacaacctgaaagttgtttccatcgcagatttgatcaggtatagaagaaagagagataaattagtggaacgtgcttctgcggctcggatcccaacaatgtggggacctttcactgcttactgctataggtccatattagacggaatagagcacatagcaatggttaagggtgagattggtgacggtcaagacattctcgtgagggttcattctgaatgtctaacaggggacatatttgggtctgcaaggtgtgattgcgggaaccagctagcactctcgatgcagcagatcgaggctactggtcgcggtgtgctggtttacctacgtggacatgaaggaagagggatcggtttaggacacaagcttcgagcttacaatctgcaagatgctggtcgagacacggttgaagctaatgaggaattaggacttcctgttgattctagagagtatggaattggtgcacagataataagggatttaggtgttaggacaatgaagctgatgacaaataatcccgcaaagtatgttggtttgaagggatatggattagccattgttgggagagtccctctattgagtcttatcacgaaggagaataagagatatctggagacaaagcggaccaagatgggtcacatgtatggcttgaagttcaaaggggatgttgtggagaagattgagtctgaatctgagtcctaa

SEQ ID NO: 49203 - protein, 543 aa, Arabidopsis thaliana
MSSINLSSSSPSTISLSRSRLSQSSTTLLHGLHRVTLPSNHPLSTFSIKTNTGKVKAAVISREDDLLSFTNGNTPLSNGSLIDDRTEEPLEADSVSLGTLAADSAPAPANGFVAEDDDFELDLPTPGFSSIPEAIEDIRQGKLVVVVDDEDRENEGDLVMAAQLATPEAMAFIVRHGTGIVCVSMKEDDLERLHLPLMVNQKENEEKLSTAFTVTVDAKHGTTTGVSARDRATTILSLASRDSKPEDFNRPGHIFPLKYREGGVLKRAGHTEASVDLTVLAGLDPVGVLCEIVDDDGSMARLPKLREFAAENNLKVVSIADLIRYRRKRDKLVERASAARIPTMWGPFTAYCYRSILDGIEHIAMVKGEIGDGQDILVRVHSECLTGDIFGSARCDCGNQLALSMQQIEATGRGVLVYLRGHEGRGIGLGHKLRAYNLQDAGRDTVEANEELGLPVDSREYGIGAQIIRDLGVRTMKLMTNNPAKYVGLKGYGLAIVGRVPLLSLITKENKRYLETKRTKMGHMYGLKFKGDVVEKIESESES

SEQ ID NO: 49204 - DNA, 651 bp, Vibrio cholerae O1 biovar eltor str. N16961
  CDS (1)..(651): transl_table=11
atgcaaatgttgagaaacgtgcatcccgttacagaaattcaagtgagtgcaaacatggcggaagtaagagccagagtcgattttaaagtcggtgcgaaaagcaatattgacgcagaaatcctgtcatttcatggactgcaatcagacaaagaacacgttgcagtgattttcaaatcagcggataccacccaagaagccccgcttgtgcgtatgcactcggagtgtttaacgggcgatgttttccattcgtctcgttgtgactgtggtgagcagctagaagaaaccattactcgcatggggcagtcaggcggcatcattctgtatttacgtcaagaagggcgaggtattggtctgtacaacaagattgatgcgtatcgcttgcaaagtcagggtatgaatacttatgaagccaataatcacctcggttttggggatgatctgcgtgactttacggaagccgcacaaatgctacaagccttgggggtgaagaagatccgtttggtgacgaacaatccgaaaaagatccgtgagttacaagaacatggcattgagattgtcgaggtggttcatacctcggcacacatcaaagacggtaatgaaaattacctgaaagccaaagtttctcacggtaagcatcaactcaaactgtaa

SEQ ID NO: 49205 - protein, 216 aa, Vibrio cholerae O1 biovar eltor str. N16961
MQMLRNVHPVTEIQVSANMAEVRARVDFKVGAKSNIDAEILSFHGLQSDKEHVAVIFKSADTTQEAPLVRMHSECLTGDVFHSSRCDCGEQLEETITRMGQSGGIILYLRQEGRGIGLYNKIDAYRLQSQGMNTYEANNHLGFGDDLRDFTEAAQMLQALGVKKIRLVTNNPKKIRELQEHGIEIVEVVHTSAHIKDGNENYLKAKVSHGKHQLKL

SEQ ID NO: 49206 - DNA, 1110 bp, Vibrio cholerae O1 biovar eltor str. N16961
  CDS (1)..(1110): transl_table=11
atgccaattagcaccccacaagagatcattgaagacattcgtcaaggcaaaatggtcatcctgatggatgatgaagatcgtgaaaatgaaggcgatctgatcatggcggctgagcacattacgccagcagcgatcaattttatggcaacccatggtcgcggactcatctgtttaacgctcacgaaagagcgttgtcgccgtctgggtttaaatcccatggtacaagataataatgcccagtacaccaccaatttcaccgtttcgattgaagctgccgaaggcgtgaccaccggtatttcagcggcggatcgcgcgcgcacagtacaagcggcagtggcaaaagaagcgaaagcggccgatttggttcagccggggcatattttcccgttggctgcacaagatggcggagtattaacgcgcgctgggcacacagaagctgggtgtgatttggcacgcttggcaggtttagagcccgcgtcggtgattgtggaaattcttaatgatgacggcaccatggcgcgtcgtccggacttagaagtgttcgctgaaaaacacggcttaaagctgggtacgattgcagacttgattgagtaccgcaaccacaccgaaaccaccattgagcgtgtcgcgcagtgtaaactgccaaccgaatatggtgagtttgagctggtgacttaccgcgacatcatcgataagcaaatccactttgctctgcgtaaaggcgatattactagtgcgccaactcttgtgcgtgtgcatctgcaagatacttttaccgatctgctgcacagcaaccgtgcggcagagcgcagttggccacttgcgacagcaatgcagcgtattgggcaagaaggcggggtgttggtgatcctgggtcatgaagaatcgagtgagctcttgctacaccgagtgaaaatgtttgagctgcaagataaaggcgaagcccctgcgatggccaaaaaacaaggcacttcacgccgggtcggggttggctcgcaaatccttgctgatcttggagtgaaagagatgcgtctgctctcttcaccaaacaaaaagtaccacgcattgggtggttttggtctcaatgtggtcgaatacgtctgcgaataa

SEQ ID NO: 49207 - protein, 369 aa, Vibrio cholerae O1 biovar eltor str. N16961
MPISTPQEIIEDIRQGKMVILMDDEDRENEGDLIMAAEHITPAAINFMATHGRGLICLTLTKERCRRLGLNPMVQDNNAQYTTNFTVSIEAAEGVTTGISAADRARTVQAAVAKEAKAADLVQPGHIFPLAAQDGGVLTRAGHTEAGCDLARLAGLEPASVIVEILNDDGTMARRPDLEVFAEKHGLKLGTIADLIEYRNHTETTIERVAQCKLPTEYGEFELVTYRDIIDKQIHFALRKGDITSAPTLVRVHLQDTFTDLLHSNRAAERSWPLATAMQRIGQEGGVLVILGHEESSELLLHRVKMFELQDKGEAPAMAKKQGTSRRVGVGSQILADLGVKEMRLLSSPNKKYHALGGFGLNVVEYVCE

SEQ ID NO: 49208 - DNA, 1215 bp, Bacillus halodurans C-125
  CDS (1)..(1215): transl_table=11
atggacaaaaagctatttgatccgattgaagaagcaatatatgaattaatgcaaggtcgagtcgtgatcgtttgtgatgatgaggatcgggaaaacgaaggggattttgtagcccttgctgaaaaagcaacaccagaagtgattaacttcatgatcacgcatggccgtggtctcgtttgcacgccaatcacggaagagcgggcaaaggaattagatcttgtccccatggtggaccataataccgatccccatggtacggcgtttaccgtcagcattgatcatcaaatgacgaccacaggaatttctgcccatgaacgggctatgacgattcaggcgttaattgataagaaaacgaaaaagcaccacttcaaacgaccaggtcacattttccccctaatagcgaaaaacggaggagtactccgacgggccggtcatacagaagcggccgttgatctagctcgtttgtcaggcgctgagccggcaggggttatttgtgaaatcattaaagaagatggttcaatggcacgagttcctgatttgcgaaaaatcgccgatcagtttgaactgaagatgatcacaattaaagatttaatcgaatatcgtcaccgtaaagacaagcttgtcaagcgtgaagtagatatttccttaccgacggatttcggctcattccgtgcaatcggttatacagatgtcattgatggaaaagagagtgtcgctttagtgaaaggacagattgttgaaggtgaaccaacactcgttcgtgttcactccgaatgtttaacaggtgatgtgttcggttctcaccgttgcgattgtggcccacaactccaggcagctctcacacaaatcgagcaacaaggcaaagggatactcctttatatgcgtcaagagggtcgtggtatcggtctcatgaataagttgaaggcatacaagcttcaagaagaaggctatgatactgtagaagcaaatgagaaattaggctttcctgctgatcttcgggactatggaatgggcgcgcaaattttacgcgacttaggtgtgtcaaaaatgcgcctccttacaaacaatccgcgaaaaattacgggcttgaaagggtatggccttgaagtggttgaacgggtgccgctccaattacctcataacaaagataatgagcgctatttgaaaacaaagcacgaaaagttaggacatctgctaaattttactcattcgtaa

SEQ ID NO: 49209 - protein, 404 aa, Bacillus halodurans C-125
MDKKLFDPIEEAIYELMQGRVVIVCDDEDRENEGDFVALAEKATPEVINFMITHGRGLVCTPITEERAKELDLVPMVDHNTDPHGTAFTVSIDHQMTTTGISAHERAMTIQALIDKKTKKHHFKRPGHIFPLIAKNGGVLRRAGHTEAAVDLARLSGAEPAGVICEIIKEDGSMARVPDLRKIADQFELKMITIKDLIEYRHRKDKLVKREVDISLPTDFGSFRAIGYTDVIDGKESVALVKGQIVEGEPTLVRVHSECLTGDVFGSHRCDCGPQLQAALTQIEQQGKGILLYMRQEGRGIGLMNKLKAYKLQEEGYDTVEANEKLGFPADLRDYGMGAQILRDLGVSKMRLLTNNPRKITGLKGYGLEVVERVPLQLPHNKDNERYLKTKHEKLGHLLNFTHS

SEQ ID NO: 49210 - DNA, 1197 bp, Lactococcus lactis subsp. lactis Il1403
  CDS (1)..(1197): transl_table=11
atgttccaatataataaagtagaagaagcacttgctgcacttaaagcaggggaaatgattatcgttagtgacgatgaaaatagagaaaatgagggcgaccttatctgtgcggccgaatttatcagtccagaaataattaattttatggcaagtgaggccaaaggattgatatgcgcaccactcagtgaaacttatgctaagaatttacaattagaagcaatggtagagaaaaatacagataatcatggaacagcttttacagtttcggttgatcatattgaaactagcacaggaatttcggcttttgaacgggccttaaccataaaaaaacttgttgatgccgagagtttaccaagtgattttcgtagaccaggtcatgtatttccacttattgccaagaaaaatggtctttttgagcgaaatggtcatactgaggctacggttgacttgttgcgtctggctggtttaaaagaagtaggtgtctgcgttgaaataatggacgaagatggaacaatgatgcataaggagaaactgaaggaaaaagcgcaagagtggggcttgaaatatatcacaattaaagctattcaagagtatcttaagcaaaatgaactacaagtagaacaggtgactagagctaaactaccgacgaaatatggtatgtttgatattttaggatttgtcaataaaataaatggtgagcaccatgttgctttagttaaaggagatattggtgacggtcaagctattctttgccgcgttcactcagaatgcttaactagtgatgcttttggttctttgaaatgtgactgcggtggacaattagaagaagcattaaaaaaaataaatgatgaggggcgtggcgtgcttttatatcttcgacaagaaggacgtggaattggtttgattaataaacttcgtgcctactcacttcaagatgaaggacttgatacggttgaagctaatttagctttggggtttgaagaagatgagcgagaatattctattggagcacaaattttaaaaataattggggtgaaatcattgaaattaatgactaataatccgcaaaagattaatgattttcaaaaatatggtctagtagttgaagaaagagtagctctccaaatcaaagataacccctttgaccttgattatttaaaagtaaaacaaaataaaatgggacatttgtttgactaa

SEQ ID NO: 49211 - protein, 398 aa, Lactococcus lactis subsp. lactis Il1403
MFQYNKVEEALAALKAGEMIIVSDDENRENEGDLICAAEFISPEIINFMASEAKGLICAPLSETYAKNLQLEAMVEKNTDNHGTAFTVSVDHIETSTGISAFERALTIKKLVDAESLPSDFRRPGHVFPLIAKKNGLFERNGHTEATVDLLRLAGLKEVGVCVEIMDEDGTMMHKEKLKEKAQEWGLKYITIKAIQEYLKQNELQVEQVTRAKLPTKYGMFDILGFVNKINGEHHVALVKGDIGDGQAILCRVHSECLTSDAFGSLKCDCGGQLEEALKKINDEGRGVLLYLRQEGRGIGLINKLRAYSLQDEGLDTVEANLALGFEEDEREYSIGAQILKIIGVKSLKLMTNNPQKINDFQKYGLVVEERVALQIKDNPFDLDYLKVKQNKMGHLFD

SEQ ID NO: 49212 - DNA, 561 bp, Campylobacter jejuni subsp. jejuni NCTC 11168
  CDS (1)..(561): transl_table=11
atggaaataaaaatttcagaaattgcgaatttacctagcaaatggggaaatttccaaatgcaaagtttcaaagaaaacgataaagaacatttatgcatatttaaaaacactccaaaagatacactcaatctaagaattcattcagagtgcttaacaggagatgctttaggaagtttaaaatgcgactgcggagaacaacttgaattttcgctaaaatatatagaaaagaatggcggaatggtgatttatcttagacaagaaggaaggggtatagggctttttaacaaggttaatgcttatgctttacaagataaaggttttgatacgattaaagcaaatcatcagcttggctttaaagccgatgagagaacttatgaaattgtagaatttatactcaaacactatgaaatttctaaggttaatttactcacaaataaccctgaaaagctagattctatcaaagaaaaaatcatcacacgcataccgattttaatagaacctaatcgttttaatgtagagtatttaaacataaaacaaactcaaatgggacatcttaaataa

SEQ ID NO: 49213 - protein, 186 aa, Campylobacter jejuni subsp. jejuni NCTC 11168
MEIKISEIANLPSKWGNFQMQSFKENDKEHLCIFKNTPKDTLNLRIHSECLTGDALGSLKCDCGEQLEFSLKYIEKNGGMVIYLRQEGRGIGLFNKVNAYALQDKGFDTIKANHQLGFKADERTYEIVEFILKHYEISKVNLLTNNPEKLDSIKEKIITRIPILIEPNRFNVEYLNIKQTQMGHLK

SEQ ID NO: 49214 - DNA, 1215 bp, Deinococcus radiodurans R1
  CDS (1)..(1215): transl_table=11
atgagcgactccatcaccctctcgaccattcccgacctcctcgccgaactccgtgccggacgcccggtcatcctcgtggacgacgagaaccgcgagaacgagggcgacctgctgatgcccgccgcgactgccacgccgcagtgggtcaatttcatggcgcgcgagggccggggcctgatttgcgtgacgctcacgcccgagcgcgcccggcggctcgacctcacgccgatggtgggggccggagcttatggacagggcacggaccccaatggcaccgccttcaccgtcagtgtggatcacagcagcaactccaccggcatcagcgcctacgaccgcgccgcgacgatcgccgcgctgctggaggacacttcgcagccgaccgactttcgccggcctgggcacatctttccgctggtggcccgccccggcggggtgctgcgccgcgccgggcacaccgaggccgggtgcgacctcgcccgcctcgctggctttgcgcccgtcggggtcatctgcgaaatcatgggcgacgacggcgagatgagccgcctgcccgacctgctggccttcggcgagaagcacgggctgaaggtcggcagcatcgaggcgctgatcgcctaccgcatggagcacgaccccttcatggagccggtcgcggaggccgagctgccgacccgtttcggcgactttcgcctcatcggttttcaggacaccctcagcggcgccgagcatgtggcgctggtgatgggcgaggtcacgcccgagccgctgctggtgcgtgttcactccgagtgcttgaccggcgacgccttccactcgctgcgctgcgactgcggcccgcagctcgacgcggcgttgcaggcgattgccgaggaaggccggggcgccgtcatctacttgcggcaggaggggcgcggcatcggcctgctcaacaaaattcgcgcctacgccctgcaagacggcggggccgacacggtggacgccaacttgcaactcggcttgcccgccgacgcccgcgacttcggcatcggggcgcagatcctgcacctgctcggcgcccggaaactccgcatcatgacgaacaatccgcgcaaactgcacagtctctcgggcttcggcctcgaagtcgtggagcgcgtgccgctgcatgtgggcgaagacccgcacaacgccggctacctgcgaacgaaacgggagaagctggggcatctgcgttga

SEQ ID NO: 49215 - protein, 404 aa, Deinococcus radiodurans R1
MSDSITLSTIPDLLAELRAGRPVILVDDENRENEGDLLMPAATATPQWVNFMAREGRGLICVTLTPERARRLDLTPMVGAGAYGQGTDPNGTAFTVSVDHSSNSTGISAYDRAATIAALLEDTSQPTDFRRPGHIFPLVARPGGVLRRAGHTEAGCDLARLAGFAPVGVICEIMGDDGEMSRLPDLLAFGEKHGLKVGSIEALIAYRMEHDPFMEPVAEAELPTRFGDFRLIGFQDTLSGAEHVALVMGEVTPEPLLVRVHSECLTGDAFHSLRCDCGPQLDAALQAIAEEGRGAVIYLRQEGRGIGLLNKIRAYALQDGGADTVDANLQLGLPADARDFGIGAQILHLLGARKLRIMTNNPRKLHSLSGFGLEVVERVPLHVGEDPHNAGYLRTKREKLGHLR

SEQ ID NO: 49216 - DNA, 1197 bp, Xylella fastidiosa 9a5c
  CDS (1)..(1197): transl_table=11
atgaatactcccacacacactcacccacatccgttcggctccacggcaacgatccgttgcgaacgtgccgctgccgaactgcgtaccggtcgacccgtcctgttgattgatgctcatacgcgtcggcatgcggtcatggctctggatagcatgaccgctcaaagctttacgacatttgcgaacgctgtcggcaacactcactacctattcctgactccagcacgttccaacgtgctcggcctggaggctccccaaggcgcacgcatcccactggcgaccctgtcctacgacagcctggtcaagctcgcctacctgcgtcagccaacacacccaacaacatgggtgcctggagacatcatggatgcagcagcgaccgagatcactcgacttgcgctgcttctgccagcaatcgtcgccgccccattaacacaccataccgaacatgcctttgcagattgccaaacacttgatttaacagatctcgataccgctgccgcgggcgcctccacaacagagtacgaattggtcacacgtactccggtgccactccgtgatctaggcatgagcgaattcatcgtattccgtggtggcattgcacagcgcgaccaagttgcgatcttgatcggtcaacccgacctaagcagtgcagtccccgtacgcgtgcattcctcctgcctgaccggcgacctctttggctcgctcaagtgtgactgcggcgaccaattacgtcatggcttggccacactgaaagcccttggcggtggtgtgctgctgtacttggaccaagaaggacgtggtaacggcattgccgcaaaaatacgcgcctacggctaccaacacgtaggactggatacgatcgacgcggatgcacaactcggattcggcccggacgaacgccgctacaccggtgcagtgatgatgctacgcgcgctaggcatcacccggatacaactgctatccaataatcccaccaaagtagagcgtttacgcgcggcaggaatcatcgtcgagcaacgcatcccggtgataggacagatcaccgaacagaacgaatactacctgcgtaccaaagtcagccgtgccggccacgacctggacatagatgccttgatcatgacatcacagagacctcaagacccatcggagactgtcgacggcgagaccgtaaaatccatccccaaaaccggccacgcgtaa

SEQ ID NO: 49217 - protein, 398 aa, Xylella fastidiosa 9a5c
MNTPTHTHPHPFGSTATIRCERAAAELRTGRPVLLIDAHTRRHAVMALDSMTAQSFTTFANAVGNTHYLFLTPARSNVLGLEAPQGARIPLATLSYDSLVKLAYLRQPTHPTTWVPGDIMDAAATEITRLALLLPAIVAAPLTHHTEHAFADCQTLDLTDLDTAAAGASTTEYELVTRTPVPLRDLGMSEFIVFRGGIAQRDQVAILIGQPDLSSAVPVRVHSSCLTGDLFGSLKCDCGDQLRHGLATLKALGGGVLLYLDQEGRGNGIAAKIRAYGYQHVGLDTIDADAQLGFGPDERRYTGAVMMLRALGITRIQLLSNNPTKVERLRAAGIIVEQRIPVIGQITEQNEYYLRTKVSRAGHDLDIDALIMTSQRPQDPSETVDGETVKSIPKTGHA

SEQ ID NO: 49218 - DNA, 1308 bp, Mycobacterium leprae TN
  CDS (1)..(1308): transl_table=11
gtgggcccttttgatagcaaggtggcaaagatgacgaggttggactccgtcgagcgggcagttgccgacattgcggctggtaaagccgttgtcgtcatcgacgatgaggaccgcgagaacgaaggcgacctgatcttcgccgccgaaaaggcaacgctggagatggtggcctttatggtccgctatacctcgggatacttgtgcgcgccactggatggtgcgatctgcgaccggttgggacttttgccgatgtttgcggtgaatcaagacaaacatgggactgcctacacggtcactgtcgatgcgagaaacggtgtaggaaccgggatttcggcttctgatcgggctaccacaatgcgattattagctgacccggctagtgtcgctgacgatttcacccgccccggccatgtggttccgttgcgtgccaaggacggcggtgtgttgcgccggccgggtcacacagaggccgccgtcgacttggcccggctggcaggattgcagcccgcaggagcgatctgcgagatcgtcagtcagaaggacgaaggctcgatggcacagaccgacgagttgcgggtcttcgctgatgagcacgatctggcgctgatcaccattgccgatctgatcgcatggcggcgcaagcatgagaagcacatcgagcgggttgctgaagcgcggatcccaacccgtcatggagagtttcgtgctattggctatactagtatttacgacgacgttaagcatgtggcactggtccgcggcgaaattgccggatcaagcggtgacggcgatgacatattggtccgggtgcactccgagtgtttgacgggtgatgtgttcggctcacggcgttgcgattgtgggacccaactcgatgccgctatggctatggtggcgcgagaaggacgcggtgtggtgttatacatgcgcggccatgaaggtcgaggtatcgggctgatgcataaactgcaagcataccagctacaggatgctggcgcggacaccgtggacgctaacatcaagcttggattcccttctgatgcaagggattacggaattggtgcgcagatactcgtcgatctcggagtgcgctcgatgcgactgttaaccaacaatcccgccaagcgggttgggctggacgggtacggactgcagatcatcgagcgggtgccgcttccggtgcgggccaacgcggataacatccgttacttgatgaccaagcgtgacaagatgggtcacgacctgggcgggttggatgattttcatgaatcaaactattttccaggtgaattcggcggtgctttatga

SEQ ID NO: 49219 - protein, 435 aa, Mycobacterium leprae TN
MGPFDSKVAKMTRLDSVERAVADIAAGKAVVVIDDEDRENEGDLIFAAEKATLEMVAFMVRYTSGYLCAPLDGAICDRLGLLPMFAVNQDKHGTAYTVTVDARNGVGTGISASDRATTMRLLADPASVADDFTRPGHVVPLRAKDGGVLRRPGHTEAAVDLARLAGLQPAGAICEIVSQKDEGSMAQTDELRVFADEHDLALITIADLIAWRRKHEKHIERVAEARIPTRHGEFRAIGYTSIYDDVKHVALVRGEIAGSSGDGDDILVRVHSECLTGDVFGSRRCDCGTQLDAAMAMVAREGRGVVLYMRGHEGRGIGLMHKLQAYQLQDAGADTVDANIKLGFPSDARDYGIGAQILVDLGVRSMRLLTNNPAKRVGLDGYGLQIIERVPLPVRANADNIRYLMTKRDKMGHDLGGLDDFHESNYFPGEFGGAL

SEQ ID NO: 49220 - DNA, 1206 bp, Streptococcus pneumoniae TIGR4
  CDS (1)..(1206): transl_table=11
atggaatatcgaaaaatacaagaagcattagaagcattgcagaagggacgacttgttcttgttatagacgacaaggatagagaaaatgaaggagacttaatttgttctgcacaagcagctacaacagaaaatgttaattttatggctacttatgccaaaggattaatttgtatgcctatgagcgaaagtttagctaatcaattaatgctttcacctatggttgaaaacaatacagataatcataagactgcttttacagtttcaattgattataaagaaacgaccacaggtatttctgccgaggaaagaggactgaccgcacgtatgtgtgtagctgaagatataacaccctctgattttcgcaggccaggacacatgtttcctttaattgcaaaaaaaggtggtgtcctagaaagaaatggacacacagaagcaactgttgatttattaaaattagctggactaaaagagtgtggcctatgttgtgaaataatgaatcatgatggcaaaatgatgagaacagatgatttaattcagttctcgaaaaaacacaacattccactaattaccatcaaagaattacaagaatatagaaaagtatatgatcagctggtagaacgagtttcaactgtcaatatgcctactagatacggtaatttcaaagcaattagctatatagataaactaaatggggaacatcatcttgctcttattatgggaaatatagaggatgaagccaatgtattatgtcgggtccactccgaatgtttaacaggagatgttttaggctctttacgttgcgattgtggacagcaattcgataaggctatgaaaatgattgttgagaatggttcgggtgtcttactttacttgcgacaggagggacgaggaattggacttatcaataaattaaaagcctatcatttacaagatcaaggcatggatacgcttgatgccaatcttgcattaggctttgaaggtgatttaagagaatatcatattggagcaaaaatgcttaaagatctgggacttcagtcacttcatttactgacaaataatcctgacaaggttgaacagttagaaaaatatggaattaccatttccagtagaatatcaatcgaaatagaagccaatccttacgatagtttttatttagaaacaaagaaaaatcgaatgggtcacattttaaatatggaggaaaaataa

SEQ ID NO: 49221 - protein, 401 aa, Streptococcus pneumoniae TIGR4
MEYRKIQEALEALQKGRLVLVIDDKDRENEGDLICSAQAATTENVNFMATYAKGLICMPMSESLANQLMLSPMVENNTDNHKTAFTVSIDYKETTTGISAEERGLTARMCVAEDITPSDFRRPGHMFPLIAKKGGVLERNGHTEATVDLLKLAGLKECGLCCEIMNHDGKMMRTDDLIQFSKKHNIPLITIKELQEYRKVYDQLVERVSTVNMPTRYGNFKAISYIDKLNGEHHLALIMGNIEDEANVLCRVHSECLTGDVLGSLRCDCGQQFDKAMKMIVENGSGVLLYLRQEGRGIGLINKLKAYHLQDQGMDTLDANLALGFEGDLREYHIGAKMLKDLGLQSLHLLTNNPDKVEQLEKYGITISSRISIEIEANPYDSFYLETKKNRMGHILNMEEK

SEQ ID NO: 49222 - DNA, 1206 bp, Clostridium acetobutylicum ATCC 824
  CDS (1)..(1206): transl_table=11
atgaatttcaaatttaatactgtagaagaagcaattcttgatataagacaaggaaagatggttattgttgtagacgatgaagatagagaaaacgaaggagatttggtggcagcaggagcaacgataacaggagaaactataaattatatggcaaggtatgccagaggactcatatgtacgcctatggattcagatagcatggaaaggcttggaataaacaccatggtagaaaaaaatacagagtatttcggtacggattttggggtttctgtagatgctgcaaggactagaacaggaatttcagcatatgaaagagctgaaactataaagaaactttctgataaagatgccaaggaagaagattttgtaaaaccaggacacacatttcctctaagagctaaaaaaaatggagtattggatagaaatggacatacagaggctaccgttgatttagtaagacttgcaggtttctatccttcagttggagtatgctgtgaaattatgaatgaagatggcactatggcaagactaccaaagcttatggagttctcaagaaaaaatgatattaaaataataactgttgaaaaattgattgaatatagaaaaaagaatgaggcacttataaaaagagaagcagaggccaagcttccaacaaaatatggtgagttcaaaatagttggatataaaagcctgattgataataaggaaaatctagctatagttaagggagagcttaaagctgaagaagaggtgcttgtaagagttcattctaaatgccttacgggagatgtatttggatctctaagatgtgattgtggaaatcagctttcatatgcacttagtgcaatagaaaagcagggggcaggagttgttctttatatggatcaagagggaagagatataggacttttgaataagttaaaggcatatatgctccaagaaaagggtcttgatacagttgaagcaaatttgaaattaggatttgaagctgatttaagagaatattgggcggctgccgaaatgcttaaagatttaggtgttaaaaaagttaaattaatgacaaataatcctgaaaaaataaacgaattaaataaatatggaattgatgttgtaagcagagttcctattaatacagaacatgttaaagaaaatgaattttatctaagaactaaaaagcaaaaaatgggtcacttaattgaaatttaa

SEQ ID NO: 49223 - protein, 401 aa, Clostridium acetobutylicum ATCC 824
MNFKFNTVEEAILDIRQGKMVIVVDDEDRENEGDLVAAGATITGETINYMARYARGLICTPMDSDSMERLGINTMVEKNTEYFGTDFGVSVDAARTRTGISAYERAETIKKLSDKDAKEEDFVKPGHTFPLRAKKNGVLDRNGHTEATVDLVRLAGFYPSVGVCCEIMNEDGTMARLPKLMEFSRKNDIKIITVEKLIEYRKKNEALIKREAEAKLPTKYGEFKIVGYKSLIDNKENLAIVKGELKAEEEVLVRVHSKCLTGDVFGSLRCDCGNQLSYALSAIEKQGAGVVLYMDQEGRDIGLLNKLKAYMLQEKGLDTVEANLKLGFEADLREYWAAAEMLKDLGVKKVKLMTNNPEKINELNKYGIDVVSRVPINTEHVKENEFYLRTKKQKMGHLIEI

SEQ ID NO: 49224 - DNA, 1206 bp, Streptococcus pneumoniae R6
  CDS (1)..(1206): transl_table=11
atggaatatcgaaaaatacaagaagcattagaagcattgcagaagggacgacttgttcttgttatagacgacaaggatagagaaaatgaaggagacttaatttgttctgcacaagcagctacaacagaaaatgttaattttatggctacttatgccaaaggattaatttgtatgcctatgagcgaaagtttagctaatcaattaatgctttcacctatggttgaaaacaatacagataatcataagactgcttttacagtttcaattgattataaagaaacgaccacaggtatttctgccgaggaaagaggactgaccgcacgtatgtgtgtagctgaagatataacaccctctgattttcgcaggccaggacacatgtttcctttaattgcaaaaaaaggtggtgtcctagaaagaaatggacacacagaagcaactgttgatttattaaaattagctggactaaaagagtgtggcctatgttgtgaaataatgaatcatgatggcaaaatgatgagaacagatgatttaattcagttctcgaagaaacacaacattccattaattaccatcaaagaattacaagaatatagaaaagtatatgatcagctggtagaacgagtttcaactgtcaatatgcctactagatacggtaatttcaaagcaattagctatatagataaactaaatggggaacatcatcttgctcttattatgggaaatatagaggatgaagccaatgtattatgtcgggtccactccgaatgtttaacaggagatgttttaggctctttacgttgcgattgtggacagcaattcgataaagctatgaaaatgattgttgagaatggttcgggtgtcttactttacttgcgacaggagggacgaggaattggacttatcaataaattaaaagcctatcatttacaagatcaaggcatggatacgcttgatgccaatcttgcattaggctttgaaggtgatttaagaaaatatcatattggagcacaaatgcttaaagatctgggacttcagtcacttcatttactgacaaataatcctgacaaggttgaacagttagaaaaatatggaattaccatttccagtagaatatcaatcgaaatagaagccaatccttacgatagtttttatttagaaacaaagaaaaatcgaatgggtcacattttaaatatggaggaaaaataa

SEQ ID NO: 49225 - protein, 401 aa, Streptococcus pneumoniae R6
MEYRKIQEALEALQKGRLVLVIDDKDRENEGDLICSAQAATTENVNFMATYAKGLICMPMSESLANQLMLSPMVENNTDNHKTAFTVSIDYKETTTGISAEERGLTARMCVAEDITPSDFRRPGHMFPLIAKKGGVLERNGHTEATVDLLKLAGLKECGLCCEIMNHDGKMMRTDDLIQFSKKHNIPLITIKELQEYRKVYDQLVERVSTVNMPTRYGNFKAISYIDKLNGEHHLALIMGNIEDEANVLCRVHSECLTGDVLGSLRCDCGQQFDKAMKMIVENGSGVLLYLRQEGRGIGLINKLKAYHLQDQGMDTLDANLALGFEGDLRKYHIGAQMLKDLGLQSLHLLTNNPDKVEQLEKYGITISSRISIEIEANPYDSFYLETKKNRMGHILNMEEK

SEQ ID NO: 49226 - DNA, 1182 bp, Staphylococcus aureus subsp. aureus Mu50
  CDS (1)..(1182): transl_table=11
atgcaattcgataatattgacagtgctttaatggctttaaaaaatggagaaacaattattgtagtagatgatgagaatcgtgaaaatgaaggtgatttagtagcggttactgaatggatgaacgataataccattaattttatggcgaaagaagcaaggggattaatatgcgcaccagtgtctaaagatattgcacaacgtttggatttggtacaaatggttgatgataactccgacatctttggtacgcaatttacagtgagtattgatcatgtagatacaacaacaggaattagtgcttatgaacgtacattgactgccaaaaagctcattgatcctagtagtgaagctaaagattttaatcgtcctggtcatttatttccattagtagcacaagataaaggcgtattagctagaaatggacacacagaagcggctgttgatttagctaaacttactggtgccaagcccgctggtgtcatttgtgagattatgaatgatgacggcacgatggcgaaaggacaagatttacaaaattttaaagaaaaacatcaattaaagatgattacgattgatgatttaattgaatatcgtaaaaaattagaaccagaaattgaatttaaggcaaaagtgaaaatgcctacagatttcggaacatttgatatgtatggttttaaagcgacatacacagatgaagagatagttgtactgacaaaaggtgcaattcgacaacatgaaaatgtacgcttacattctgcgtgccttacaggcgatattttccatagtcaacgttgtgattgtggtgctcaacttgaatcgtctatgaagtatatcaatgaacatggtggcatgattatttatctacctcaagaaggtcgtggcataggattgttaaacaaattacgcgcatatgaattaattgagcaaggatatgatacagtaactgcaaatttagcattaggttttgatgaagatttacgagattatcatattgctgcacagattttaaaatattttaacatcgaacatatcaatttattaagtaataatccaagtaaatttgagggattaaaacaatatggcattgatattgcagaaagaattgaagttatcgtaccagaaacggtacataatcatgattatatggtaacgaaaaaaataaaaatgggtcatttaatatag

SEQ ID NO: 49227 - protein, 393 aa, Staphylococcus aureus subsp. aureus Mu50
MQFDNIDSALMALKNGETIIVVDDENRENEGDLVAVTEWMNDNTINFMAKEARGLICAPVSKDIAQRLDLVQMVDDNSDIFGTQFTVSIDHVDTTTGISAYERTLTAKKLIDPSSEAKDFNRPGHLFPLVAQDKGVLARNGHTEAAVDLAKLTGAKPAGVICEIMNDDGTMAKGQDLQNFKEKHQLKMITIDDLIEYRKKLEPEIEFKAKVKMPTDFGTFDMYGFKATYTDEEIVVLTKGAIRQHENVRLHSACLTGDIFHSQRCDCGAQLESSMKYINEHGGMIIYLPQEGRGIGLLNKLRAYELIEQGYDTVTANLALGFDEDLRDYHIAAQILKYFNIEHINLLSNNPSKFEGLKQYGIDIAERIEVIVPETVHNHDYMVTKKIKMGHLI

SEQ ID NO: 49228 - DNA, 588 bp, Thermoplasma acidophilum DSM 1728
  CDS (1)..(588): transl_table=11
atgatcgaactttactcaaacgcaaggttgccaactgaatttgggcttttcaggatatatacatttgtaaatgatgaaaacaaggaccatgccgttatcgtacggggagatccgaggggaaaggaggatgtacctgtaagaatacattccgaatgcctcaccggtgacgttctcggatcgctgagatgcgactgcagggatcagctgatacagtccctgagatacctcggcaggcaggattacggtatgctgatttatctgaggcaggagggcagaggcatcggactcctcaacaagatcaaggcatacagcctccaggacagcggtgctgacactgtcgaagcgaatctgaaactcggcctgccggtagacagcagggattattcatttgcttcagaggtgataaagttcttcgaaataaagtccatatacataatgacaaacaacccggaaaagatgaaggcgcttatcgaaagcggcattaacgtcaagggtagaataccgattttcagcgatccaacgccatacgacaaattctatcttgaaaccaagaagataaagcttgggcacgagatagagaacatatga

SEQ ID NO: 49229 - protein, 195 aa, Thermoplasma acidophilum DSM 1728
MIELYSNARLPTEFGLFRIYTFVNDENKDHAVIVRGDPRGKEDVPVRIHSECLTGDVLGSLRCDCRDQLIQSLRYLGRQDYGMLIYLRQEGRGIGLLNKIKAYSLQDSGADTVEANLKLGLPVDSRDYSFASEVIKFFEIKSIYIMTNNPEKMKALIESGINVKGRIPIFSDPTPYDKFYLETKKIKLGHEIENI

SEQ ID NO: 49230 - DNA, 1203 bp, Caulobacter crescentus CB15
  CDS (1)..(1203): transl_table=11
atgtcgcgcctatctgaagccctgacccgcctgaaggccggcggcatgatcgtgttggtcgatgacgaggatcgcgagaacgagggcgatctggtcatggccgccgagtttgcggacgctgcggccatcgccttcatggccaagcgggccagcggcctgatctgcctgaccctggaggcagagacgatcgatcgcctttgcctggcgccgatggtcagcgacaaccgcaccagccgccagaccgccttcaccgtctcgatcgaggccgccaccggcgtggacaccggcatctcggccttcgaccgcgcccgcaccatcgccgcggccatcgccccggacgcccaggctgcagacctggtttcgcccggacacgtgtttcccctgcgcgcccgacccggcggggttctggtccgcaacggccataccgaggcctcggtggatctgatgcggatggccggtctgcggccggccggcgtgatctgcgagatcatgaaggacgacgggtcgatggcgcggcggcctgatctggaggtcttctgccgcgagcacgatctgccgctgctgacgatcgccgagctggtggcccatcgcaaggcgaccgagctgctggtggacgaggtggccgccgcgcgcctgccgtcggaccacgccggccaggccttcagcgtccgggccttccgcagccggatcgacggcggcgagcatctggccatggtcgccggcccgctgaccggcgcgccgctggtgcgggtgcattccgaatgcctgaccggcgacgccctgggctcgcggcgctgcgactgcggcgaacaactgcgcgagagcctccggcagatcagcgacagcggcaacggcgccctgatctatctgcgcaatcatgaggggcggggcctgggcctggccaacaagatcgcggcctatgcgctgcaggaccagggactggacaccgtccaggccaatcacgccctgggcttcgccgacgaccagcgcgactacggcgtggcggcgcagatcctgcgggcgctcggcgtcggcgaggtcaagctcttgagcaacaatccgcgcaaggcggccggactgcgcgccaatggcgtgacggtgcggcgcgaggttccgctgctgatcccggccaatcccgacaacgccgcctatctcgaaaccaagcgcgacaagctgggccacagcctggcgcgcgcctcctga

SEQ ID NO: 49231 - protein, 400 aa, Caulobacter crescentus CB15
MSRLSEALTRLKAGGMIVLVDDEDRENEGDLVMAAEFADAAAIAFMAKRASGLICLTLEAETIDRLCLAPMVSDNRTSRQTAFTVSIEAATGVDTGISAFDRARTIAAAIAPDAQAADLVSPGHVFPLRARPGGVLVRNGHTEASVDLMRMAGLRPAGVICEIMKDDGSMARRPDLEVFCREHDLPLLTIAELVAHRKATELLVDEVAAARLPSDHAGQAFSVRAFRSRIDGGEHLAMVAGPLTGAPLVRVHSECLTGDALGSRRCDCGEQLRESLRQISDSGNGALIYLRNHEGRGLGLANKIAAYALQDQGLDTVQANHALGFADDQRDYGVAAQILRALGVGEVKLLSNNPRKAAGLRANGVTVRREVPLLIPANPDNAAYLETKRDKLGHSLARAS

SEQ ID NO: 49232 - DNA, 1764 bp, Nostoc sp. PCC 7120
  CDS (1)..(1764): transl_table=11
gtgtcacaacctaaaaatacacagcagtcctcaactaatcccctgaacggggagaaccctggcacgggtgttgttcctcagatatttgcctcttcaaccgaaaagtttatgtttgattctattgatgctgccttatcagatttaaaagccggtcgtgccattgtagtggtagatgatgaaaatcgagaaaatgaaggcgatttgatttgtgctgcccaatttgccacacctgacatgattaattttatggcggtggaagcaagagggttgatttgtttagcaatgacaggcgatcgcctcgatgaactcgatctaccattgatggtgacaaatatcaccgaccccaaccagacagcttttactgtcagtattgatgctagcccccatttgggagtatctactggtatatcagccgaagaccgggcgcgaacaattcagattacactcaacccagccaccaaaccttcagatttgcgtcgtcctggtcatatttttcctttacgggctaaagctggcggagtactgaaacgcgcagggcatacagaggcggcggttgatttatctcgcttggctggattgtacccggctggggtgatttgtgaaattcaaaaccccgatggttcaatggcgagattacaacagttaattgaatatgccaaacaccacaacctgaaaattattagtattgctgatttaattagttatcgcctgcaacacgatcgcctggtatatcgtgaagtagtcactaaactacccagtcaattcggtcagtttgacatctacgcctatcgccacaccctcgacaatacagaacacgtcgccattgtcaagggcaatcctgagaactttcgagatgaacctgtgatggtgcggatgcactcagaatgtttaacaggtgatgcgttgggttctttacgctgcgattgtcggatgcagttacaagctgccttgaaaatgattgaaactgctggtcaaggtgtggttgtctacctaaggcaagaaggacgaggaattggcttaattaacaaacttaaagcctattctttacaggatatgggactggatacagtggaagctaacgagcgcttgggtttccccgcagacttgcgtgattatggcatgggagcgcaaatgcttatggatttgggcgtgaaaaagattcgcctgattactaataatccccggaaaattgccggggtaaaagggtatgggttggaagtagttgaccgcctgccattactcattgaagccaacgattataattcctattacttggcgaccaaggcgaaaaaactcggtcatatgcttttgcagacttacctcgtaactgtagctattcactggcaagatgacccgcaattggtgacaaaacgctatgaacgtttagagaaactgcggcatttagttagaggctatgatttattgttacaggaagaagcccgaccattggcgatcgctcttttcgacaagccatctttgacagtacacttagggtttgaccaagaaaaagtcgctagttgtgattggtatagccaaagcggtcatccctacgtacaagcaattttgccaattctcgataacctagcaactctaccttacgtccagaaacttgaatttttgatttctcctggtagtgatcccctcagtaatttgcaagtccaactagacaggcaaacgatttcacctgataaattaccttcttctgtaagtaatgagttggagacacagaaaatttacagtttgagtaaagaattggaagattga

SEQ ID NO: 49233 - protein, 587 aa, Nostoc sp. PCC 7120
MSQPKNTQQSSTNPLNGENPGTGVVPQIFASSTEKFMFDSIDAALSDLKAGRAIVVVDDENRENEGDLICAAQFATPDMINFMAVEARGLICLAMTGDRLDELDLPLMVTNITDPNQTAFTVSIDASPHLGVSTGISAEDRARTIQITLNPATKPSDLRRPGHIFPLRAKAGGVLKRAGHTEAAVDLSRLAGLYPAGVICEIQNPDGSMARLQQLIEYAKHHNLKIISIADLISYRLQHDRLVYREVVTKLPSQFGQFDIYAYRHTLDNTEHVAIVKGNPENFRDEPVMVRMHSECLTGDALGSLRCDCRMQLQAALKMIETAGQGVVVYLRQEGRGIGLINKLKAYSLQDMGLDTVEANERLGFPADLRDYGMGAQMLMDLGVKKIRLITNNPRKIAGVKGYGLEVVDRLPLLIEANDYNSYYLATKAKKLGHMLLQTYLVTVAIHWQDDPQLVTKRYERLEKLRHLVRGYDLLLQEEARPLAIALFDKPSLTVHLGFDQEKVASCDWYSQSGHPYVQAILPILDNLATLPYVQKLEFLISPGSDPLSNLQVQLDRQTISPDKLPSSVSNELETQKIYSLSKELED

SEQ ID NO: 49234 - DNA, 1116 bp, Brucella melitensis 16M
  CDS (1)..(1116): transl_table=11
atgagctataatcagaaacaggtcgttgatgcgatttgcgcttttgaacgcggtgaaatcgtcgtggtcatggatgacgacggtcgcgaaaacgaaggcgatctgatcgtcgccgccgtgcattgcacaccggaaaagatggccttcatcgtgcgccatacgtccggcattgtctgcacgccgatgacgcgtgaggaagccaagcgcctcaacctgacgccgatggtggcggaaaacgaatccgctcacacgaccgcttttacggtcacggtcgattatcgccatggcaccacgaccggcatttcagccgaagaccgcacgctgaccgtgcgcaacctggccaatcccaatgccggtgcttcggatttcgtgcgccccggccatattttcccgctggttgcccgtgagggcggtgtgctgatgcgctccggccatacggaagccgccgttgatctgtgcaagctcgccaacctgccgcccatcggcgttatctgcgaactcgtcaacgatgacggcacggtcatgcgcggtcccgatgtggcggctttcgccgaggagcacaaattgcaccgcgtcacggttgccgatctcatcgcctatcgccagcgcaaggaaacgctggtcaggcgcattggcgatgcgcctgtcgaaacctgtgctggcaaggctcatgcctatagttatgaactgccgtgggagccgatgcagcatgtggcggttgtcttcggcgatattcgcgacggtgaggaagtgccggtccgtctccatcgcgaggatgtgctgaacgatgttttcggcaagggcggcagcaatctcgatgccatcatgcagcgcatggggcaagagggccggggcattctggtctatctgcgtgaaggctccgtcggcgtgcgttcggatcatcgcgatgcccgcgcccgtgaggcgctgcaaggcgagcatgaagcccatgcggaagccgttgcccgcgaggaagaatggcgccagatcggccttggcgcgcagattttgaaggatctcggcgtttcctccatcgtgcttctggcctcgcgtgagcgccactatgtcggccttgaaggtttcggcatttgcatcacgcgtacggaaattatctaa

SEQ ID NO: 49235 - protein, 371 aa, Brucella melitensis 16M
MSYNQKQVVDAICAFERGEIVVVMDDDGRENEGDLIVAAVHCTPEKMAFIVRHTSGIVCTPMTREEAKRLNLTPMVAENESAHTTAFTVTVDYRHGTTTGISAEDRTLTVRNLANPNAGASDFVRPGHIFPLVAREGGVLMRSGHTEAAVDLCKLANLPPIGVICELVNDDGTVMRGPDVAAFAEEHKLHRVTVADLIAYRQRKETLVRRIGDAPVETCAGKAHAYSYELPWEPMQHVAVVFGDIRDGEEVPVRLHREDVLNDVFGKGGSNLDAIMQRMGQEGRGILVYLREGSVGVRSDHRDARAREALQGEHEAHAEAVAREEEWRQIGLGAQILKDLGVSSIVLLASRERHYVGLEGFGICITRTEII

SEQ ID NO: 49236 - DNA, 1146 bp, Clostridium perfringens str. 13
  CDS (1)..(1146): transl_table=11
atggttattgttattgatgatgagggaagagaaaatgagggggatctagttatggctggagaacttgttactggagaaaaaataaattttatggctacttatggaaagggtttaatatgtgctccagtaagtgagagcatagctgaaaatttaggattgaatcctatggtttcacataatacagataatcatgaaactgcatttacagtatctatagattataaagatacaactacaggaatatcagcctttgaaagggctcatacaattaaagaattaataaatgaagaaagtaaagcagagtattttagaagaccaggacatgtattccctttaatagctaagaatggtggcgttttaaagagagatgggcatacagaggcagcaattgacttagcaaagttagctggattaaaagaagttggggtaatatgtgaaataatgaaagatgatggaactatggctagaactgatgaattattagaatttgcaaagattcataatatgaaaataataactatagaagatttaattgcttatagaacagaaagagataattttgtttatagagttgttgaaactaatatgccaactaaatatggagattttaaggctattgggtttatagataaacttacaggagagcatcatgtggctttagttaaaggagagataaaatcagaggagccagtattattaagagtgcattcagagtgtttaactggagatgtttttggatcaagaagatgtgattgtggagagcagtttcatagtgctatggaaaaaataaatgaagagggaaaaggaatattactttatatgagacaagaaggaagaggaataggtcttataaataagttgaaagcttataagcttcaagatgaaggattagatactgtagaagctaatatagccttgggatttccagaagatcttagagattatggcgttggagcacaaattctaaaagatttaggtgtaagggaaatcaggttaatgactaataatcctaaaaaaataactggcttagagggatatggacttaaaatagtagaaagagtacctatagaaataaagtgtaatgaggaaaatgagttttatttgaaaactaagaaagagaaaatgcaccatttaataatgcagtaa

SEQ ID NO: 49237 - protein, 381 aa, Clostridium perfringens str. 13
MVIVIDDEGRENEGDLVMAGELVTGEKINFMATYGKGLICAPVSESIAENLGLNPMVSHNTDNHETAFTVSIDYKDTTTGISAFERAHTIKELINEESKAEYFRRPGHVFPLIAKNGGVLKRDGHTEAAIDLAKLAGLKEVGVICEIMKDDGTMARTDELLEFAKIHNMKIITIEDLIAYRTERDNFVYRVVETNMPTKYGDFKAIGFIDKLTGEHHVALVKGEIKSEEPVLLRVHSECLTGDVFGSRRCDCGEQFHSAMEKINEEGKGILLYMRQEGRGIGLINKLKAYKLQDEGLDTVEANIALGFPEDLRDYGVGAQILKDLGVREIRLMTNNPKKITGLEGYGLKIVERVPIEIKCNEENEFYLKTKKEKMHHLIMQ

SEQ ID NO: 49238 - DNA, 1530 bp, Arabidopsis thaliana
  CDS (1)..(1530)
atgatggattctgctttatatcatcctcgaatctttttcgctcacagcttcatcaatggcttgtatagttctcctaggtttgctaatacttgctggagattggttagtcgttcaagttgggagatcaaggctagtgagaatagtgatcgcaatgtgttcgatgaaaatcctgttaggaaaaccgacgggtcgttgtttgattctgcttcgtttgagacagttgacgcggaaatcacgcctgagactgatgatttcttcgtgagtgacgcagagggtgatccagattgtcctactcaaggttattcctctattgaacttgctcttcaagctctacgcaaaggaaagtttgtgatcgttgttgacgatgaaaccggagatgttgaagggaatctgatcatggctgcaactcttacgagtccaaaagacatagcttttctgattaagaatggttcaggtattgtctcagttggtatgaagaaagaaaaccttgaaagattaagccttacacttatgtcacctgaaatggaagacgaagattcctctgctccaactttcaccatcactgtggatgcaaaatctggaacatcaactggagtatcagcttcagacagggcgatgacggttcttgcactttcgtctctcgatgctaaaccagatgatttcaggaggcctggtcatgtattccctctcaagtacagagatggtggagttttaaggagagctggtcacaccgaagcttcagtggatctaatgatattggctggtttacgtcccctctctgttctttcagctattcttgatcaagaagatgggtctatggcttcactgccgtatatgaaaaagcttgctacggaacatgatatccccattgtatcgttgactgatttaatcagatatcgaagaaagcgagataagcttgttgagagaatcacagtgtctcgtttgcctaccaaatggggtcttttccaagcttattgttatcgatctaaactcgatggaaccgaaaatatcgccctcgttaagggaaacgttggaaatggtgaggacattctggtgcgagtgcattcagagtgcttgacaggagacatttttggctcagcacggtgtgactgtggaaaccaattggacttagccatggagttaatcgagaaagagggaagaggagttgttgtgtatctccgtggccacgaaggaagaggcattggccttggtcacaagcttagagcttataacttgcaggacgaaggacacgacactgttcaggccaatgttgaacttggcctatccattgattctcgtgaatacggtatcggtgctcagatgctacgagacataggagtgagaacaatgagactaatgacgaataaccctgccaaattcactggtctgaaagggtacggactcgctgtagttggccgtgtgccggtggtgacaccaatcaccaaggagaacagaagatatatggagaccaaacgcaagaagatgggtcacatttatatctctgataacaacgatcagccattagcttga

SEQ ID NO: 49239 - protein, 509 aa, Arabidopsis thaliana
MMDSALYHPRIFFAHSFINGLYSSPRFANTCWRLVSRSSWEIKASENSDRNVFDENPVRKTDGSLFDSASFETVDAEITPETDDFFVSDAEGDPDCPTQGYSSIELALQALRKGKFVIVVDDETGDVEGNLIMAATLTSPKDIAFLIKNGSGIVSVGMKKENLERLSLTLMSPEMEDEDSSAPTFTITVDAKSGTSTGVSASDRAMTVLALSSLDAKPDDFRRPGHVFPLKYRDGGVLRRAGHTEASVDLMILAGLRPLSVLSAILDQEDGSMASLPYMKKLATEHDIPIVSLTDLIRYRRKRDKLVERITVSRLPTKWGLFQAYCYRSKLDGTENIALVKGNVGNGEDILVRVHSECLTGDIFGSARCDCGNQLDLAMELIEKEGRGVVVYLRGHEGRGIGLGHKLRAYNLQDEGHDTVQANVELGLSIDSREYGIGAQMLRDIGVRTMRLMTNNPAKFTGLKGYGLAVVGRVPVVTPITKENRRYMETKRKKMGHIYISDNNDQPLA

SEQ ID NO: 49240 - DNA, 1173 bp, Pyrococcus furiosus DSM 3638
  CDS (1)..(1173): transl_table=11
gtgagaaatatgaacatcgaagaaattaggaacagcttcctctcaggaagacctgcagttcttattgacgaggagagggagaatgaggctgatctagtatttcccgcagaaattgcaacccctaaagtcgtaaactttatgctttctgccaaaggcttgctctgcctagctctagatatggaagaaggaataaaacgaggattctttaaacttcccaataatggaggagagaccaactttctaatcccagttgactacaaagatgtattcactggcattaccgcggaagaaagagcactaaccgcaagaaaagtagcagaaggacttggaattgagaactttcgatatcctggccatcttccactcctgggaggattaggattaaataagcgaaaaggtcacacagaggcctcccttgaattagtagagatggcaggattcaagagatatgcactcattatagagatattagacgataaagggtattcccacaatttagattatgccttccattttgccaaggaacatgatcttcccctcattagaataagggagatttggaaggagttcgtaagaaggaagcaattaattcatgtttacagcaaggcaaagcttcccactaaatacggagactttgaaatttacagcttcaaaaacgacctagattttaaggatcatgttgcgctcgtgaaaaagccgtttaagggaacacctctcgtaagagttcactccaagtgcttaacaggggatacacttggatccctaaaatgtgactgtgggagccagctagagaatgcactccgaacgatatcccaggagggaggagtgttaatttacctagaccaagaagggagggggattggattaagagagaagataagagcctacgaatttcaagacaggggattagacaccgtagaagcaaacaaggcacttggttttgctcctgatgagaggacttatgaagttgcttttcaaattttaagagcccttggaattgaaaaaataaaacttctcacaaacaatccctcaaaagtcaaggctctaagagagcttgggattgaaattgaagatgtaatacctcttcctggggaaataaacagatacaacttcttctatcttaaaacaaaggttgaaaaacttggacataaaattccgggggtagaggtatga

SEQ ID NO: 49241 - protein, 390 aa, Pyrococcus furiosus DSM 3638
MRNMNIEEIRNSFLSGRPAVLIDEERENEADLVFPAEIATPKVVNFMLSAKGLLCLALDMEEGIKRGFFKLPNNGGETNFLIPVDYKDVFTGITAEERALTARKVAEGLGIENFRYPGHLPLLGGLGLNKRKGHTEASLELVEMAGFKRYALIIEILDDKGYSHNLDYAFHFAKEHDLPLIRIREIWKEFVRRKQLIHVYSKAKLPTKYGDFEIYSFKNDLDFKDHVALVKKPFKGTPLVRVHSKCLTGDTLGSLKCDCGSQLENALRTISQEGGVLIYLDQEGRGIGLREKIRAYEFQDRGLDTVEANKALGFAPDERTYEVAFQILRALGIEKIKLLTNNPSKVKALRELGIEIEDVIPLPGEINRYNFFYLKTKVEKLGHKIPGVEV

SEQ ID NO: 49242 - DNA, 981 bp, Schizosaccharomyces pombe 972h-
  CDS (1)..(981)
atggataaaaaagagggcgatcaagtgcatcatgacaaaacattgctccaggatttaagtcttcctgaaaatgttgcttctgaaaaacgtctgccaattgacgatgtacaatgtgtaaattcgcctatgttaagtcctgcgcttgatattgagcctaaacccaacgttgtcggtactgctgaaaggcttccaaaggttcgatgcgttgttagagcaagaattcctacagttaaggggacggagattttcctccatttatacaaaaacgattttgataataaagagcatttagcaattgtttttggtcaacaaattcgctcagatagtcttgatgctgtgcaagaaggcgaaacagaaatggaccgtatggtacgaggcgcatacgtggggacactttatcctggccgtaaaagctcttatattgatgttaactcttcaaaaactaccgaagagcagaaagaagaagcacggaagactaattttgtaccgctggttcgaattcattccgagtgctataccggtgaaactgcttggtcggctcgttgtgattgtggtgaacaacttgatgaagcagcccgtttaattagtgaagaagggaatggtgtcataatatatcttcgtcaagaaggtcgcggaattggtttgtccgagaaactcaaggcttataatcttcaggatttaggaaacgacaccgtccaagccaatttactgcttcaacatccagcagatggaagatcgtatgcagttgctactgctatgttgatggatcttggtcagcgtgatatcagacttttgacgaataatcctgaaaaggttaatagcattgaaggcccaaataaagaagttcgtgtagtagaacggatttcaatgatacccaagtcatggagaggtgaaaagggaattgaaagtgctgaagtagtcctttatctcaaaactaaaattgagaaaatgggacatttacttgacttaccagattcataa

SEQ ID NO: 49243 - protein, 326 aa, Schizosaccharomyces pombe 972h-
MDKKEGDQVHHDKTLLQDLSLPENVASEKRLPIDDVQCVNSPMLSPALDIEPKPNVVGTAERLPKVRCVVRARIPTVKGTEIFLHLYKNDFDNKEHLAIVFGQQIRSDSLDAVQEGETEMDRMVRGAYVGTLYPGRKSSYIDVNSSKTTEEQKEEARKTNFVPLVRIHSECYTGETAWSARCDCGEQLDEAARLISEEGNGVIIYLRQEGRGIGLSEKLKAYNLQDLGNDTVQANLLLQHPADGRSYAVATAMLMDLGQRDIRLLTNNPEKVNSIEGPNKEVRVVERISMIPKSWRGEKGIESAEVVLYLKTKIEKMGHLLDLPDS

SEQ ID NO: 49244 - DNA, 1269 bp, Corynebacterium glutamicum ATCC 13032
  CDS (1)..(1269): transl_table=11
gtgagtgaacatgagcaggcacacagccaattagattctgttgaagaggccatcgctgacatcgctgcgggtaaagccgtcgtggtggtagatgatgaagatcgtgaaaatgaaggcgacatcatctttgccgccgaattagccactccagaattagtcgctttcatggtgcgttattcctcgggatacatctgtgcgccattaaccgcaaaggatgcagatcgtcttgatctgcctccgatgaccgcgcacaatcaggatgcccgcggcaccgcttacaccgtgaccgttgatgccaacaccggcaccacaggcatttctgcaacagaccgcgcccacactttgcgcttgcttgctgatccagaagccgaccgcacggatttcacccgtcccggacacgttgtgccactgcgtgctcgtgaaggtggcgtcttggtgcgcgctggacacaccgaagcagctgtcgatttggctcgcgctgcaggcctgcgcccagcaggtgttatctgcgaagtggtcagtgaagaggaccccaccggcatggctcgggttcctgagctgcgccgcttctgcgatgagcacgatctgaagctgatctctattgagcagctcattgagtggcgtcgcaagaatgaaattttggtggagcgccaggtggaaactgtgctgcctaccgatttcggcacgttcaaggctgttggttaccgttccatcatcgatggcaccgagcttgttgccattgttgccggcgacgtggcatccgacggtggcgaaaacgtcctggttcgagtccactctgagtgcttgactggtgatgtttttggatcccggcgctgcgactgtggacagcagctgcacgagtctttgcgcctgatccaggaagctggtcggggagtagtggtgtacatgcgtgggcatgagggacgaggcattggtctgctcgccaagctacgcgcctaccaactccaggatgaaggtgccgacaccgtcgatgccaacctcgcacttggtcttccagccgatgcccgcgaatttggcaccagcgcccagattctctacgacttgggtgtgcgctcgctcaacttgatcagcaacaacccagccaagaaggtgggacttgaaggccacggcatttccattgccagccgaacccccatccctgttgctgttcatgaagacaatgttcgatacctgaaaaccaagcgtgaccgcatgggacatgacctcccagatgtcgcactgtgggaacaagagcacccagaaaactaa

SEQ ID NO: 49245 - protein, 422 aa, Corynebacterium glutamicum ATCC 13032
MSEHEQAHSQLDSVEEAIADIAAGKAVVVVDDEDRENEGDIIFAAELATPELVAFMVRYSSGYICAPLTAKDADRLDLPPMTAHNQDARGTAYTVTVDANTGTTGISATDRAHTLRLLADPEADRTDFTRPGHVVPLRAREGGVLVRAGHTEAAVDLARAAGLRPAGVICEVVSEEDPTGMARVPELRRFCDEHDLKLISIEQLIEWRRKNEILVERQVETVLPTDFGTFKAVGYRSIIDGTELVAIVAGDVASDGGENVLVRVHSECLTGDVFGSRRCDCGQQLHESLRLIQEAGRGVVVYMRGHEGRGIGLLAKLRAYQLQDEGADTVDANLALGLPADAREFGTSAQILYDLGVRSLNLISNNPAKKVGLEGHGISIASRTPIPVAVHEDNVRYLKTKRDRMGHDLPDVALWEQEHPEN

SEQ ID NO: 49246 - DNA, 1200 bp, Fusobacterium nucleatum subsp. nucleatum ATCC 25586
  CDS (1)..(1200): transl_table=11
atgatttacaaaattgaggatgtattagaagatattaagaatggtattcctctaataatagtagatgatgaaaacagagaaaatgaaggagacctttttgttgctgctgagaaagcaacttatgaaagtattaatcttatggcaacatttgcaagaggtttaacttgtacacctatgacaagcgaatatgcaatcagattaggtttagatccaatgactgcaagaaatactgatgcaaaatgtactgcctttactgtatctgttgatgcaaaagaaggaactacaactgggatttcaatagctgatagacttacaacaataaaaaaattagcaaataaaaattctgttccatcagattttacaaagcctggacatatttttccactgattgcaaaagataaaggtgtgttggaaagagaaggacatactgaggcaacagttgatttatgtaaaatttgtggactcacacctgtatctgttatctgtgaaattttaaaagatgatggtactatggcaagaatggatgatttagaaatttttgctaaagagcataatttaaaaattattacaatagctgatttaatcaaatacagaaaaaagactgaacaacttatgaaaattgatgttgttgctaatatgccaactgatagtggcacatttaaaattgtaggttttgataatctcattgatggtaaagaacatattgcccttgtcaaaggtgatgttgctggtaaagaaaatgttacagttagaatacactctgaatgtttcacaggagatattttaggttctttaagatgtgattgtggttctcaattaaaaactgcaatgagaagaattgataaacttggagaaggaattattctttatctaagacaagaaggtaggggtataggacttttaaataaattaagagcctataatcttcaagaagaaggtatggacacactagatgcaaatttacatcttggttttggtgcagatatgagagattacgctgttgctgcacagatgttaaaagcattaggagtaaaatctataaaacttttaacaaataacccattaaaaataaatgggcttgaagaatatggaattcctgttgttaaaagagaagaaattgagattgaagctaataaaattaataaagtatacttaaaaactaaaaaagaaagaatgggacatcttttaaaaattaaataa

SEQ ID NO: 49247 - protein, 399 aa, Fusobacterium nucleatum subsp. nucleatum ATCC 25586
MIYKIEDVLEDIKNGIPLIIVDDENRENEGDLFVAAEKATYESINLMATFARGLTCTPMTSEYAIRLGLDPMTARNTDAKCTAFTVSVDAKEGTTTGISIADRLTTIKKLANKNSVPSDFTKPGHIFPLIAKDKGVLEREGHTEATVDLCKICGLTPVSVICEILKDDGTMARMDDLEIFAKEHNLKIITIADLIKYRKKTEQLMKIDVVANMPTDSGTFKIVGFDNLIDGKEHIALVKGDVAGKENVTVRIHSECFTGDILGSLRCDCGSQLKTAMRRIDKLGEGIILYLRQEGRGIGLLNKLRAYNLQEEGMDTLDANLHLGFGADMRDYAVAAQMLKALGVKSIKLLTNNPLKINGLEEYGIPVVKREEIEIEANKINKVYLKTKKERMGHLLKIK

SEQ ID NO: 49248 - DNA, 1290 bp, Streptomyces coelicolor A3(2)
  CDS (1)..(1290): transl_table=11
atgagcacggcacccatcctctacagccccgacggccccgaggacctcgtcctcgaccccgtcgagcaggccgtcgcggacatcgccgcgggccgccccgtcgtggtcgtcgacgacgagaaccgcgagaacgagggcgacctcgtcatcgccgccgagaaggcgaccgaggagatcgtcgccttcatgatgaccgagtgccgcggcctgatctgcgcccccatggagggcgaggaactggaccggctccggctcccgcagatggtcgacgacaacaccgagtcgatgaagaccgccttcaccgtctccgtggacgccggtgccgcccacggcgtcaccaccggcatctccgccgccgaccgcgccaccaccctccggctcctggcgggcggcaccgccgagcccggcgacctggtccgccccgggcacgtcttcccgctgcgcgcccgccccggcggcgtactcgtccgcaacggccacaccgaggccgccgtcgacctggcccgcctcgcgggactgcgcccggccggcgccatcgtggagatcgccggtgaggacgggcgcatgctgcggctgcccgagctgatcccgttcgcccgcaagcacggcctgacgatcatctccatcgaggacctcatcgcctaccggcgcagcgcggaacccaccgtccgccgcgaggccgaggtacggctgcccacgaagcacggcgagttcacggcgtacggctaccgctccaccgtcgacggcgtcgagcacatcgccctcgtgcacggcgagatcggcgacggcgaggacgtcctggtccgcgtccactccgagtgcctcaccggcgacgtcttcggctcccagcgctgcgactgcggcccccagctcgacgcctccctggaccgcatccaggccgagggccggggagtcgtcgtctacctgcgcggccacgaggggcgcggcatcggcctgatgtccaagctgcgcgcctacgaactccaggagcgcggccgggacaccctcgacgccaacctggaactcggcctgcccgccgacgcccgcgactacggcgcaggcgcgcagatcctcgccgacctcggcgtgcgagccgtccgcctcctgaccaacaacccggacaagagcgacgccctcgaacggcacggcatcacggtcaccggccgcgagcccatgcccgtccaggccggcgagcacaacctccgctacctgcgcaccaagcgggaccggatgggacacgacctgccctggctggacacgacccccgtgtccacctgcggcaaccagtaa

SEQ ID NO: 49249 - protein, 429 aa, Streptomyces coelicolor A3(2)
MSTAPILYSPDGPEDLVLDPVEQAVADIAAGRPVVVVDDENRENEGDLVIAAEKATEEIVAFMMTECRGLICAPMEGEELDRLRLPQMVDDNTESMKTAFTVSVDAGAAHGVTTGISAADRATTLRLLAGGTAEPGDLVRPGHVFPLRARPGGVLVRNGHTEAAVDLARLAGLRPAGAIVEIAGEDGRMLRLPELIPFARKHGLTIISIEDLIAYRRSAEPTVRREAEVRLPTKHGEFTAYGYRSTVDGVEHIALVHGEIGDGEDVLVRVHSECLTGDVFGSQRCDCGPQLDASLDRIQAEGRGVVVYLRGHEGRGIGLMSKLRAYELQERGRDTLDANLELGLPADARDYGAGAQILADLGVRAVRLLTNNPDKSDALERHGITVTGREPMPVQAGEHNLRYLRTKRDRMGHDLPWLDTTPVSTCGNQ

SEQ ID NO: 49250 - DNA, 645 bp, Streptomyces coelicolor A3(2)
  CDS (1)..(645): transl_table=11
atgcgcaccgaagagaacgaagacgtgatcgtcgcaccctcccccgccgtgcaggtgagggcccgggtggaagtccccatcgatgtccccggcctgggaccccgggcgagcaccatggtcagtttcgacggactgcacgacggtcgcgagcacgtcgcgctccttatgccgggctgggaaaagaagagcgatccactggtgcgggttcattccgaatgcctcaccggtgacgtcttcggatctcagcgctgcgactgcggtccccaacttcacgaggcactcgccatgtgctcccacgaaggcggcatcatcctgtatctgcgacaggaggggcgcggtatcgggctgtacaacaagttcgacgcctacctgctgcaggacgggggcctggacaccttcgaagcgaatgcagtgctcaatttcagccatgatctgcgggactaccgggtggcggccgagatgctgagcgctctgggcgtgcccagaatccgtctgctgtccaacaacccggagaagggaaaccagctccgttcgcacggcgttgtcatatcggacgtcgtcgcgacggggaccttcgtcaatgagaacaaccaggcctacctgacggccaagcgcgaacgagccggtcatgcactcgaggtctga

SEQ ID NO: 49251 - protein, 214 aa, Streptomyces coelicolor A3(2)
MRTEENEDVIVAPSPAVQVRARVEVPIDVPGLGPRASTMVSFDGLHDGREHVALLMPGWEKKSDPLVRVHSECLTGDVFGSQRCDCGPQLHEALAMCSHEGGIILYLRQEGRGIGLYNKFDAYLLQDGGLDTFEANAVLNFSHDLRDYRVAAEMLSALGVPRIRLLSNNPEKGNQLRSHGVVISDVVATGTFVNENNQAYLTAKRERAGHALEV

SEQ ID NO: 49252 - DNA, 1131 bp, Xanthomonas campestris pv. campestris str. ATCC 33913
  CDS (1)..(1131): transl_table=11
atgaatttcgcgcctgtccccgaattgatcgaagagctgcgcgccggccgcatggtggtgatcgtcgatgacgaagaccgcgaaaacgaaggcgatctgatcatggcggccgagttggtcaagccgtcggacatcaacttcatggtcacccacgcacgtggcctggtgtgcctgtcgctgacccgcgagcgctgcacgcagctcggtctggcaccgatggtgcgcaacaacaccgcgcagttccataccaacttcaccgtcagcattgaggcggccgaaggggtcaccaccgggatttccgcctacgaccgcgcgcataccgtgcgcaccgcggtgcggccggatgccaaaccgcacgatctcagccagccggggcacattttcccgctgattgcgcagccgggtggcgtgctgacgcgcgccgggcacaccgaggcggccagcgatctgccgatgctggccgggctggaaccggccggtgtactggtggaagtactcaaccccgacggcagcatggcgcgccgcccgcagctggaggtgttcgcgcgcgagcatgggctgaagatgggctcgatcgccgatctgatcgcctaccggctggccaacgaacacaccgtcgagcgcgtggatgaacgtgagatcgaaaccgagttcgggccgttccatctggtgacctaccgcgaccgcatcgcgcacgacctgcatttcgcgctggtgcgtggcaccccggatccgaccacgccaaccctggtccgcgtgcaggtggaaaacccgctggccgatctgctgcactggcagcgcgatgatttcggcgtggccgccaccgatgcgctgcgcgcgattgctgccgaagggcagggcgtgatggtggtgctgtcggccccgcgcgacagcgaatcgctgctggcacgcctgcgccaacagccggaggtggccgccaacgccaaggatgtgagccagtggcgccgcaacggtgctggcgcgcagatcctggccgacctgggcctgggcaagctgcgcgtgctgggtacgccgcggcggcaggtcggcctggccggcttcggcctggaggtggtggagtttctggaatgccatccgggcgccgcctcgcgcgtggccgccgcgccctga

SEQ ID NO: 49253 - protein, 376 aa, Xanthomonas campestris pv. campestris str. ATCC 33913
MNFAPVPELIEELRAGRMVVIVDDEDRENEGDLIMAAELVKPSDINFMVTHARGLVCLSLTRERCTQLGLAPMVRNNTAQFHTNFTVSIEAAEGVTTGISAYDRAHTVRTAVRPDAKPHDLSQPGHIFPLIAQPGGVLTRAGHTEAASDLPMLAGLEPAGVLVEVLNPDGSMARRPQLEVFAREHGLKMGSIADLIAYRLANEHTVERVDEREIETEFGPFHLVTYRDRIAHDLHFALVRGTPDPTTPTLVRVQVENPLADLLHWQRDDFGVAATDALRAIAAEGQGVMVVLSAPRDSESLLARLRQQPEVAANAKDVSQWRRNGAGAQILADLGLGKLRVLGTPRRQVGLAGFGLEVVEFLECHPGAASRVAAAP

SEQ ID NO: 49254 - DNA, 1134 bp, Xanthomonas campestris pv. campestris str. ATCC 33913
  CDS (1)..(1134): transl_table=11
atgagcagtccctctcccttccccagcgcgcaacccttcggtgacccggccgcgatccgctgcgagcgcgccgcctccgaactgcgtgccggccgcccggtcctcatcaccgatgcgcaggggcacacccgcgccgtgctcgggctggacagcagcacggcgcagtcgtacacggccttcgcgcgcgccgcgcagggccggcattacctgttcgtgacccccacccgcgcacaggtgctgggcctggtggccccgcagggtgcgcgtgtggcgctggccagccacgattacgaccagctcgccgcactcgcctatctgcgcgataccccagtgccctcgcagtggaccccgggcgatgcgctggacgccggcgcggtggagatcgcacggcttgggctgctgctgccggcgatgctggcggtggagctgcccggcgagcaagaccgcgccgccttcgccggctgccagtcactggcgctggacgacctggacagcggctgcgccacctcggcggcggctggctacgaattggtcacccgcagcccggtgccgttgcgcggcttgggcatgagcgagttcgtggtgttccgcggtggcgtggcgcagcgcgatcaggtggcgattgtggtgggtcagccggatctgggcagtgcggtgccggtgcgcgtgcattcgtcctgcctcaccggcgacctgttcggctcgctcaagtgcgactgcggcgaccagctgcggcacgggctggccaagctcaaggagctcggcggcggcgtgttgctgtatctggatcaggaaggccgcgggacgggcatcgcctcgaagatgcgtgcgtacggctatcagcacgccgggctggacaccatcgatgccgatgcgcagctgggctttggcccggatgagcgccgctacggcagtgcggtggcgatgttgcgcggcctgggcatcagccggatccgcctgctgaccaacaacccgaccaaggccgagcggctgcgcgccgccggcatcgtggtggaagaccgcatcccggtcaccggcgacatcacgccggagaacgagcagtacctgcgcaccaaggcggcccgcgccggccatgcgctggatgtcgacgcgctgatcctggcggcccagtaa

SEQ ID NO: 49255 - protein, 377 aa, Xanthomonas campestris pv. campestris str. ATCC 33913
MSSPSPFPSAQPFGDPAAIRCERAASELRAGRPVLITDAQGHTRAVLGLDSSTAQSYTAFARAAQGRHYLFVTPTRAQVLGLVAPQGARVALASHDYDQLAALAYLRDTPVPSQWTPGDALDAGAVEIARLGLLLPAMLAVELPGEQDRAAFAGCQSLALDDLDSGCATSAAAGYELVTRSPVPLRGLGMSEFVVFRGGVAQRDQVAIVVGQPDLGSAVPVRVHSSCLTGDLFGSLKCDCGDQLRHGLAKLKELGGGVLLYLDQEGRGTGIASKMRAYGYQHAGLDTIDADAQLGFGPDERRYGSAVAMLRGLGISRIRLLTNNPTKAERLRAAGIVVEDRIPVTGDITPENEQYLRTKAARAGHALDVDALILAAQ

SEQ ID NO: 49256 - DNA, 1140 bp, Xanthomonas axonopodis pv. citri str. 306
  CDS (1)..(1140): transl_table=11
atgaatttcgcgcccgttccggaactgatcgaagaactgcgcgccggacgcatggtggtcatcgtcgatgacgaagaccgcgaaaacgaaggcgatctgatcatggccgccgagttggtgaagccgtcggacatcaacttcatggtcacccacgcgcgcgggctggtgtgcctgtcgctgacccgcgagcgctgcgcgcagctgggtctggcgccgatggtgcgcaacaacaccgcgcagttccagaccaacttcactgtcagcatcgaagcggccgaaggggtgaccaccggcatttcggcctacgaccgcgcgcacaccgtgcgcaccgcagtccgcccggatgcccggccacaggatttgagccagcccgggcatatcttcccgttgatctcccagcccggtggcgtgctgacccgtgccggccacaccgaagcggccagcgatctgccgatgctggccggactggaaccggccggtgtgctggtggaagtgctcaacccggacggcagcatggcgcgtcgcccgcagctggaagtgttcgcgcgcgagcatgggctgaagatgggctcgatcgccgacctgatcgcatatcggcttgccaatgagcacaccgtcgagcgcgtggacgagcgcgagatcaccaccgaattcggtccgttcaagctggtgacctaccgcgaccgcatcgcgcacgacctgcactttgcgctgttgcgcgggcgcgccgatccgcagacgccgacgctggtgcgcgtacaggtggaaaacccattggccgacctgctgcactggcagcgcgatgacttcggcgtggcagccactgatgccttgcgcgcgatcgccgccgaggggcagggcgtgatggtggtgctgtcggcgccacgcgacagcgaatcgctgctggcacggctgcgccagcagcccgaagccgccgccaatgccaaggacgtgagtcagtggcggcgcaacggcgccggtgcgcagatcctggccgacctcggcctgggcaagttgcgcgtgctgggcaccccccggcgccaggtggggttggccggattcgggctggaggtggtcgagtatttggagtgccatgccggtgaaggcgtgcgctcggtgccgccgtctgccgttccctga

SEQ ID NO: 49257 - protein, 379 aa, Xanthomonas axonopodis pv. citri str. 306
MNFAPVPELIEELRAGRMVVIVDDEDRENEGDLIMAAELVKPSDINFMVTHARGLVCLSLTRERCAQLGLAPMVRNNTAQFQTNFTVSIEAAEGVTTGISAYDRAHTVRTAVRPDARPQDLSQPGHIFPLISQPGGVLTRAGHTEAASDLPMLAGLEPAGVLVEVLNPDGSMARRPQLEVFAREHGLKMGSIADLIAYRLANEHTVERVDEREITTEFGPFKLVTYRDRIAHDLHFALLRGRADPQTPTLVRVQVENPLADLLHWQRDDFGVAATDALRAIAAEGQGVMVVLSAPRDSESLLARLRQQPEAAANAKDVSQWRRNGAGAQILADLGLGKLRVLGTPRRQVGLAGFGLEVVEYLECHAGEGVRSVPPSAVP

SEQ ID NO: 49258 - DNA, 1134 bp, Xanthomonas axonopodis pv. citri str. 306
  CDS (1)..(1134): transl_table=11
atgagcagccccctcccctcccccagcacacaggccttcggcgatccggcggcgattcgctgtgagcgcgccgcttccgaactgcgtgccgggcgcccggtcttgctgacggcggcgaatgggcaggcgcgtgcggtgctggcgctggatagcagcacggcacagtcgtatgcggcgttcgcccgtgccgcacggggccgccactatctctttgtgacgcccactcgcgcccaggtgctggggctgagcgcgccgcagggtgcgcgcgtgggcttgatcgatcacagctacgaccagctcgccgcgttggcctacctgcgcgacaccccggtgcctgcgcagtggacggccggcgatgcgctggatgccggcggcgtggagatcgcgcggcttggcctgctgctgccggcgttgctggcggtggagctgcgcgatgtgcacgaccatgccgcgttcgccggctgccagtcgctggcgctggacgatttgctgcgcggctgtgccacctccgcggctgccggctacgagctggtgacccgcaccccggtgccgctgcgcggcctgggcatgagtgagttcgtggtgtttcgcggcggtgtggcgcagcgcgatcaggtggcgatcgtggtcggccagccggacctgggcactgccgtcccggtgcgcgtgcattcgtcgtgcctcaccggcgacctgttcggctcgctcaaatgcgattgcggcgaccagctgcggcacggcctggccaagttgaaggagctcggtggcggcgtcctgctgtatctggaccaggaaggtcgcggcaccggcatcgccgccaagatgcgcgcctacggctatcagcatgcgggcctggacaccatcgacgccgatgcgcaattgggctttggtccggacgagcgccgctacggcagtgcggtggcgatgttgcgcgggctgggcatcggccggatccggttgttgaccaacaacccggccaaggccgagcgcctgcgcgcggccggcatcgtggtcgaagaccgcatcgcgatcaccggcgacatcaccgccgaaaacgagcagtacctgcgcaccaaggccgcacgcgccggccacgcgctggatgtggatgcgttgatcctggccgcgcaataa

SEQ ID NO: 49259 - protein, 377 aa, Xanthomonas axonopodis pv. citri str. 306
MSSPLPSPSTQAFGDPAAIRCERAASELRAGRPVLLTAANGQARAVLALDSSTAQSYAAFARAARGRHYLFVTPTRAQVLGLSAPQGARVGLIDHSYDQLAALAYLRDTPVPAQWTAGDALDAGGVEIARLGLLLPALLAVELRDVHDHAAFAGCQSLALDDLLRGCATSAAAGYELVTRTPVPLRGLGMSEFVVFRGGVAQRDQVAIVVGQPDLGTAVPVRVHSSCLTGDLFGSLKCDCGDQLRHGLAKLKELGGGVLLYLDQEGRGTGIAAKMRAYGYQHAGLDTIDADAQLGFGPDERRYGSAVAMLRGLGIGRIRLLTNNPAKAERLRAAGIVVEDRIAITGDITAENEQYLRTKAARAGHALDVDALILAAQ

SEQ ID NO: 49260 - DNA, 1182 bp, Staphylococcus aureus subsp. aureus MW2
  CDS (1)..(1182): transl_table=11
atgcaattcgataatattgacagtgctttaatggctttaaaaaatggagaaacaattattgtagtagatgatgagaatcgtgaaaatgaaggtgatttagtagcggtcactgaatggatgaacgataataccattaattttatggcgaaagaagcaaggggattaatatgcgcaccagtgtctaaagatattgcacaacgtttggatttggtacaaatggttgatgataactccgacatctttggtacgcaatttacagtaagtattgatcatgtagatacaacaacaggaattagtgcttatgaacgtacattgactgccaaaaagctcattgatcctagtagtgaagctaaagattttaatcgtcctggtcatttatttccattagtagcacaagataaaggcgtattagctagaaatggacacacagaagcggctgttgatttagctaaacttactggtgccaagcccgctggtgtcatttgtgagattatgaatgatgacggcacgatggcgaaaggacaagatttacaaaagtttaaagaaaaacatcaattaaagatgattacgattgatgatttaattgaatatcgtaaaaaattagaaccagaaattgaatttaaggcaaaagtgaaaatgcctacagatttcggaacatttgatatgtatggttttaaagcgacttacacagatgaagagatagttgtactgacaaaaggtgcaattcgacaacatgaaaatgtacgcttacattctgcgtgccttacaggcgatattttccatagtcaacgttgtgattgtggtgctcaacttgaatcgtctatgaagtatatcaatgaacatggtggcatgattatttatctacctcaagaaggtcgtggcataggattgttaaacaaattacgcgcatatgaattaattgagcaaggatatgatacagtaactgcaaatttagcattaggttttgatgaagatttgcgagattatcatattgctgcacagattttaaaatattttaacatcgaacatatcaatttattaagtaataatccaagtaaatttgagggattaaaacaatatggcattgatattgcagaaagaattgaagttatcgtaccagaaacggtacataatcatgattatatggaaacgaaaaaaataaaaatgggtcatttaatatag

SEQ ID NO: 49261 - protein, 393 aa, Staphylococcus aureus subsp. aureus MW2
MQFDNIDSALMALKNGETIIVVDDENRENEGDLVAVTEWMNDNTINFMAKEARGLICAPVSKDIAQRLDLVQMVDDNSDIFGTQFTVSIDHVDTTTGISAYERTLTAKKLIDPSSEAKDFNRPGHLFPLVAQDKGVLARNGHTEAAVDLAKLTGAKPAGVICEIMNDDGTMAKGQDLQKFKEKHQLKMITIDDLIEYRKKLEPEIEFKAKVKMPTDFGTFDMYGFKATYTDEEIVVLTKGAIRQHENVRLHSACLTGDIFHSQRCDCGAQLESSMKYINEHGGMIIYLPQEGRGIGLLNKLRAYELIEQGYDTVTANLALGFDEDLRDYHIAAQILKYFNIEHINLLSNNPSKFEGLKQYGIDIAERIEVIVPETVHNHDYMETKKIKMGHLI

SEQ ID NO: 49262 - DNA, 1344 bp, Rhizobium etli
  CDS (1)..(1344): transl_table=11
ttgtcgacagagagctcgatgccgcgcgtcgcgccgtcagcccataataaggaggaggattccatgtctttttcgagcatagatgaggcgatcgaggcgatcgaagcgggcgagatggttatcgtggtcgacgacgaaaaccgggagaatgaaggcgacctagtcgttgctgccgaaaaaataacagctgagcacatcgctttcatgatgaaatatgcgagaggccttatctgcgtgccacttccagccgaacgtctcgacaaactcgagatccccctgatggtcacacgtaattcggactcactgcagacggcatttaccgtttccgtcgattgcaaacacggcacaacgacagggatttcagccgaagatcgagcagcaaccgtcaagtcgctcatcgatccgcagacgcggccggaagacctatcgcgaccgggtcacatttttcctttgcgtgcaaatcgtctcggtgtcctgggccgtcctggccacaccgaagctgccgtggatcttgcacgacttgccggcctggcgccggctggcgtaatctgcgagatcgccaatgacgacggaaccatgtctcgactgccagatctcgagaagttcgcaatcgaacatggcctgcacatagtaacgatcgacgctttgattgagtactgcaggagtcgtgatacgagggtaaagcgttacgcgcagtcctttatgccaacgcggtttggggatttcaaggcaattgcttatcgcgatagtttgacgggaacggaacacttagctttgacacttggcgagttgtgcgagaaggaagacgttctggtacgggtgcattctgaatgtctgacaggtgaggcgttccggtccatgcgatgcgactgcggtcaacagctcgaaatggctcttcgggcggtccagttagcgggcgctggttgcgtgatctacatgcgtgggcaagaggggcgtggcattggcttaggaaacaaaattgcggcttacagcctgcaggatcatggtcgtgatactcttgaggcaaatcgggaactcggcttcgcatctgattcccgcgaatataacgcagcggcggatatcatccgcgacctcggtatcggcagcgttcggcttctgaccaacaatcctacaaaaatagaggcgctgcgaacgtcaggcgtcatcgtgtcgtctcgccagagtctgatcgccgcatctagcgcgtccaacatcacttattttaagacaaagcgcgatcggtttggccacctgttggaccaggacacgtcagctgaacacgtcggccggagcaacgtcttttcagtgtttggcgcgcaggtgttctctggaccccttggataa

SEQ ID NO: 49263 - protein, 447 aa, Rhizobium etli
MSTESSMPRVAPSAHNKEEDSMSFSSIDEAIEAIEAGEMVIVVDDENRENEGDLVVAAEKITAEHIAFMMKYARGLICVPLPAERLDKLEIPLMVTRNSDSLQTAFTVSVDCKHGTTTGISAEDRAATVKSLIDPQTRPEDLSRPGHIFPLRANRLGVLGRPGHTEAAVDLARLAGLAPAGVICEIANDDGTMSRLPDLEKFAIEHGLHIVTIDALIEYCRSRDTRVKRYAQSFMPTRFGDFKAIAYRDSLTGTEHLALTLGELCEKEDVLVRVHSECLTGEAFRSMRCDCGQQLEMALRAVQLAGAGCVIYMRGQEGRGIGLGNKIAAYSLQDHGRDTLEANRELGFASDSREYNAAADIIRDLGIGSVRLLTNNPTKIEALRTSGVIVSSRQSLIAASSASNITYFKTKRDRFGHLLDQDTSAEHVGRSNVFSVFGAQVFSGPLG

SEQ ID NO: 49264 - DNA, 1284 bp, Chlorobium tepidum TLS
  CDS (1)..(1284): transl_table=11
gtgatgagcaacaatcagttcgattccatagaatcagccatcgaagacattaaaaacggcaagctgatcatcgtcgtcgatgacgaagatcgggaggatgaaggcgattttattgccgctgccgagcatgtgacccccgagatggtgaacttcatcaccaaagaggcgcgcggcctgctctgcgtggctattcccatggagcgcgcccgcgagttgcagcttgaaccgatggtgcagcgcaacacctcccagcacgaaacaaacttcaccgtttcaatcgacgcgatcgccgaaggggtgaccaccggcatttcggcctacgaccgatacatgacgctcaagatgcttgccgatccgtcctccacggcggacgacttctcacgccccggccacatcttcccgctccgggcgatggatggcggtgtgctacgcagggttggtcacaccgaggccgcggtcgatctctgtcgtcttgccggatgccagccagccggtttgctctgcgaaatcctgcacgacgacggcagcatggcgcgtgtgcccgaactgctgaagctcaaagagaagctcggcatgaagctcatcacgatcaaagatctcgtggcttaccggatgcagcggtcgaagctcgtgcaccgcgccgtcgagtcgaagctaccgaccgcgtatggcgagttcaagctcattgcctacgaaaccatcgtcgatcagcagaatcacatggccttcgtcaagggcgatgttggcaacggcgagccggtgcttgcccgggtgcactcgcagtgcgccacgggcgataccttcggttcgttgcgttgcgactgcggtcaccagctcgaaaccgctctgcgcatgattgaaaaggaggggcgtggcgtcctgatttacctcatgcaggaggggcgaggcatcggcctcatcaacaagctcaaggcctacaaccttcaggacgaagggttcgacacggtcgaggccaacgagaagctcggtttcaaacccgaccttcgcgactacggcatcggtgcgcagattcttcaggaccttggtgtcaggaagatgcggttgatgaccaacaacccgaaaaagattgtcggtctggaaggctatggtcttgaaatcgtcgaacgcgtaccgctcgaaatcgagccgaacgaggtgaaccgccactacctgcagaccaagcgcgacaagcttggtcacatgattcaaatggcttcgggcaatgaacggattctcttcgagcgccttgccgatgagcagttgaaacagcacaaaaaagattaa

SEQ ID NO: 49265 - protein, 427 aa, Chlorobium tepidum TLS
MMSNNQFDSIESAIEDIKNGKLIIVVDDEDREDEGDFIAAAEHVTPEMVNFITKEARGLLCVAIPMERARELQLEPMVQRNTSQHETNFTVSIDAIAEGVTTGISAYDRYMTLKMLADPSSTADDFSRPGHIFPLRAMDGGVLRRVGHTEAAVDLCRLAGCQPAGLLCEILHDDGSMARVPELLKLKEKLGMKLITIKDLVAYRMQRSKLVHRAVESKLPTAYGEFKLIAYETIVDQQNHMAFVKGDVGNGEPVLARVHSQCATGDTFGSLRCDCGHQLETALRMIEKEGRGVLIYLMQEGRGIGLINKLKAYNLQDEGFDTVEANEKLGFKPDLRDYGIGAQILQDLGVRKMRLMTNNPKKIVGLEGYGLEIVERVPLEIEPNEVNRHYLQTKRDKLGHMIQMASGNERILFERLADEQLKQHKKD

SEQ ID NO: 49266 - DNA, 603 bp, Yersinia pestis KIM
  CDS (1)..(603): transl_table=11
atgaacaatgatatgcagctaaaacgtgtagcagaagcaaagttacccactccttggggtgactttttaatggtcggttttgaagagttggccaccgggcatgaccacctggccttgatattcggtgatatctccggtgataaaccggttctgtcccgtgtacattctgaatgcctgactggtgatgctttatttagcctgcgttgtgactgtggttttcagttagaggttgcactgacgcgtatcgcggaagaaggccgtggtgtgctgatttatcatcgtcaggagggccgtaatattggcttgctgaataaaattcgtgcttatgcattgcaggatttaggggctgatacggtagaagccaatcatcagcttggttttgctgcggatgaacgtgatttcacactctgttctgatatgtataaattattaggcatcaaagcggttcgtctgctgaccaacaaccctaaaaaggtcgagatcctcacccaagcggggatcaatatcgtcgaacgtgtgccactgatcgtgggcgaaaacccaaaaaacgaacattatctggcaaccaaagcggccaaaatggggcatttactcaccaaataa

SEQ ID NO: 49267 - protein, 200 aa, Yersinia pestis KIM
MNNDMQLKRVAEAKLPTPWGDFLMVGFEELATGHDHLALIFGDISGDKPVLSRVHSECLTGDALFSLRCDCGFQLEVALTRIAEEGRGVLIYHRQEGRNIGLLNKIRAYALQDLGADTVEANHQLGFAADERDFTLCSDMYKLLGIKAVRLLTNNPKKVEILTQAGINIVERVPLIVGENPKNEHYLATKAAKMGHLLTK

SEQ ID NO: 49268 - DNA, 1644 bp, Thermosynechococcus elongatus BP-1
  CDS (1)..(1644): transl_table=11
gtgcctgtgtttgactccattgaatcagcattagaagccctgcggcgcggcgaagtgattgtggtcgtcgatgatgaaaatcgcgagaatgagggggatctgattggtgctgccgagcgggtgacccccgccatgattaacttcatggctgttcatgcacggggactgatttgccttgccatggagggcgatcgcctcgatgaattggatttgcccttaatggtaacaacaaataccgatagcaaccaaactgcctttacggttagcgttgatgccggtgcccgttggggcgtgaccacaggtatttccgccgaggatcgcgcccgcacgattcaagcgttaattgatccgagcacgcaacctcaagatctccgtcgccctggccatgttttccccctgcgatcgcgccctgggggagttcttaagcgagctggccacaccgaggccgcagtggatctgacacggctggcgggtctttacccagcgggtgtgatctgtgaaattcaaaatcccgacggcaccatgtcgcggctgccccaactcatggagtatgcccgcacccaccaactcaaaatcattagcattgccgacctcattagctaccgtctccagcatgagcgctttgtgcgccgcgaggccgtcgccaagctaccgacggagttcggtgaatttcaaatctatggctaccgcaattccctcgatcaatcggagcacgtcgccattgtcaaaggggatcccgctacatttggggagcaacccgtgctggtgcgcgtccattctgaatgcttgacgggcgatgcccttggttccttgcgctgtgattgtcggatgcaactgcaggcagctctgaaaatgattaacgccgccggtcggggtgtagtggtttacctacggcaggaggggcgggggattgggctggtcaacaagctgcgtgcttattccctgcaggatttaggcatggatacggtggaggccaatgagcacctgggctttccagcggatttgcgcaattatggcgtcggtgcccagatactcaatgatttgggggtgaagcagattcgcctgattaccaataacccccgcaaaattgctggcctcaagggctatggccttgaagtggtggatcgggtgcccctgttgattgaagcaaccccctacaacaccccctacttgacgaccaaggcagaaaaactggggcatctgctgctgcaaacgtacctgattacggtggcttttcgctggcaggggtcgcaattggctgcgggcgatcgctatgaacgactggaaaaactgcgtcatctggccgcaggcgtccatttgctggtgcgcgaagaagctcggcccgttgctcaggccatctttgggcatcctgacctcattgttcactttggctttgaccagccccatgtggccgatcgccagtggtataagcagccagaacatccctatgtgcttgcggtgcaaaccctgctgcggcaattttgccaatggccaacgctaaaaggatttgagtttctggtggccacgggcaccgatccaatgctcaacctaccgatggatttggatcgccaagcctacacccaacagtctcccagtgaatggcggcctcatctcatctattcctggtctgcagcagcaggttaa

SEQ ID NO: 49269 - protein, 547 aa, Thermosynechococcus elongatus BP-1
MPVFDSIESALEALRRGEVIVVVDDENRENEGDLIGAAERVTPAMINFMAVHARGLICLAMEGDRLDELDLPLMVTTNTDSNQTAFTVSVDAGARWGVTTGISAEDRARTIQALIDPSTQPQDLRRPGHVFPLRSRPGGVLKRAGHTEAAVDLTRLAGLYPAGVICEIQNPDGTMSRLPQLMEYARTHQLKIISIADLISYRLQHERFVRREAVAKLPTEFGEFQIYGYRNSLDQSEHVAIVKGDPATFGEQPVLVRVHSECLTGDALGSLRCDCRMQLQAALKMINAAGRGVVVYLRQEGRGIGLVNKLRAYSLQDLGMDTVEANEHLGFPADLRNYGVGAQILNDLGVKQIRLITNNPRKIAGLKGYGLEVVDRVPLLIEATPYNTPYLTTKAEKLGHLLLQTYLITVAFRWQGSQLAAGDRYERLEKLRHLAAGVHLLVREEARPVAQAIFGHPDLIVHFGFDQPHVADRQWYKQPEHPYVLAVQTLLRQFCQWPTLKGFEFLVATGTDPMLNLPMDLDRQAYTQQSPSEWRPHLIYSWSAAAG

SEQ ID NO: 49270 - DNA, 1194 bp, Streptococcus agalactiae 2603V/R
  CDS (1)..(1194): transl_table=11
atggcctttagtccaataaaaaaacttttacaagacatcaaatcagggaaaatggtagtgttgatggatgacgaaaatagagagaatgaaggagaccttatttgtgcggctgaaatggtgacaaaagagtcgattaattttatggctaaatttgggaaaggattaatttgcttacctctgtctaattactatgctgaaaagttagaattagctcaaatggctagccataatactgataatcatgaaacagcttttaccatatctattgatcatctatcaactagtactgggatttctgcggaagatagagctttgacagctaagatggttgctaacgacagtagcaaagctaaagactttagacgtcctgggcacttatttcccttgttagccaaggaaggaggtgttttagctagaaatggacatactgaagcaaccgttgatctatgtcgtttagctggattaaaggaatgtggactttgttgtgaaataatggctgaagatggtagtatgatgagaaaggatgagttattagcatttgctcaaaagcacgatttagctatcgctaccataaaacaattgcaagactatagacgtcaagaagagggaggggtggttagagaaattgagattcagctaccaacgcaattcggtcattttacggcttatggatatagcgaagttgtggcaaataaggaacatgttgcccttgttaaaggggatattagtagtggtgaagatgttttatgtcgtttacactcagaatgtttgacaggtgatgtctttcattccttgagatgtgattgtggggaacaactggctaatgccctccaacaaatagaggctgaaggtcgtggagtccttctttatatgagacaggaaggtcgaggaattggtttgattaataagttaaaagcttatcatttgcaagaagaaggcttagatactttagaagctaatttggctttaggttttgaaggagatgagagagactatggagttagtgctcaacttttaaaagatttaggtataaattctataaacttactaaccaataatccagataaaatccaacaacttgaagcagaaggaatttgcgtcaaaaacagagtgccattacaggtggcagtaacagcttatgaccttaattatttaaaaactaaaaaagaaaaaatgggacatcttttagattaa

SEQ ID NO: 49271 - protein, 397 aa, Streptococcus agalactiae 2603V/R
MAFSPIKKLLQDIKSGKMVVLMDDENRENEGDLICAAEMVTKESINFMAKFGKGLICLPLSNYYAEKLELAQMASHNTDNHETAFTISIDHLSTSTGISAEDRALTAKMVANDSSKAKDFRRPGHLFPLLAKEGGVLARNGHTEATVDLCRLAGLKECGLCCEIMAEDGSMMRKDELLAFAQKHDLAIATIKQLQDYRRQEEGGVVREIEIQLPTQFGHFTAYGYSEVVANKEHVALVKGDISSGEDVLCRLHSECLTGDVFHSLRCDCGEQLANALQQIEAEGRGVLLYMRQEGRGIGLINKLKAYHLQEEGLDTLEANLALGFEGDERDYGVSAQLLKDLGINSINLLTNNPDKIQQLEAEGICVKNRVPLQVAVTAYDLNYLKTKKEKMGHLLD

SEQ ID NO: 49272 - DNA, 756 bp, Oceanobacillus iheyensis HTE831
  CDS (1)..(756): transl_table=11
atgttaaatacgaaactagaatcagaggcttttgcccttttaaaagataaaattcaacttattcaacaaaatgatcatgctatatatttggttggaccaatccaacttcccataaatttagatggagagacaacagtgtttcaatggtattgttggttaaattttgatgagataacagaagactatgaaaatatgattgaaaagttatcctcagcaaacctggctgaatatcaacaatctagtgtcttggtatatggagattttgctcatgcagaagaagcacttattcgtatgcattcgatttgccacactggtgacatatttggtagcaaacgttgtgactgtggttttcaattaaaggaatccatgaagaaaattagagaacatggcactggagccttattctatttagcaaatcacgaaggacgtggcataggattattcagtaaagcgatggcctatgtactgcaagagaatggctatgacaccgtggaggcaaatgaaagtcttggatacgtaaatgatgctagagattatgaagatgcaatctccgttttacgtacacttcgcagcaaacccgttaccctgatcacaaataatcctttgaaagtagatgcgcttgaaaatgccggactacagctttctggaagaaccccactatggggagatcgctcagaatataacaaaaaatatctagacacgaaggtgataaaatctggtcacttacgagaggatggtaaatgcagtaatgactga

SEQ ID NO: 49273 - protein, 251 aa, Oceanobacillus iheyensis HTE831
MLNTKLESEAFALLKDKIQLIQQNDHAIYLVGPIQLPINLDGETTVFQWYCWLNFDEITEDYENMIEKLSSANLAEYQQSSVLVYGDFAHAEEALIRMHSICHTGDIFGSKRCDCGFQLKESMKKIREHGTGALFYLANHEGRGIGLFSKAMAYVLQENGYDTVEANESLGYVNDARDYEDAISVLRTLRSKPVTLITNNPLKVDALENAGLQLSGRTPLWGDRSEYNKKYLDTKVIKSGHLREDGKCSND

SEQ ID NO: 49274 - DNA, 1116 bp, Brucella suis 1330
  CDS (1)..(1116): transl_table=11
atgagctataatcagaaacaggtcgttgatgcgattcgcgcttttgaacgcggtgaaatcgtcgtggtcatggatgacgacggtcgcgaaaacgaaggcgatctgatcgtcgccgccgtgcattgcacaccggaaaagatggccttcatcgtgcgccatacgtccggcattgtctgcacgccgatgacgcgtgaggaagccaagcgcctcaacctgacgccgatggtggcggaaaacgaatccgctcacacgaccgcttttacggtcacggtcgattatcgccatggcaccacgaccggcatttcagccgaagaccgcacgctgaccgtgcgcaacctggccaatcccaatgccggtgcttcggatttcgtgcgccccggccatattttcccgctggttgcccgtgagggcggtgtgctgatgcgctccggccatacggaagccgccgttgatctgtgcaagctcgccaacctgccgcccatcggcgttatctgcgaactcgtcaacgatgacggcacggtcaagcgcggtcccgatgtggcggctttcgccgaggagcacaaattgcaccgcgtcacggttgccgatctcatcgcctatcgccagcgcaaggaaacgctggtcaggcgcattggcgatgcgcctgtcgaaacctgtgctggcaaggctcatgcctatagttatgaactgccgtgggagccgatgcggcatgtggcggttgtcttcggcgatattcgcgacggcgaggaagtgccggtccgtctccatcgcgaggatgtgctgaacgatgttttcggcaagggcggcagcaatctcgatgccatcatgcagcgcatggggcaggagggccggggcattctggtctatctgcgtgaaggctccgtcggcgtgcgttcggatcatcgcgatgcccgcgcccgtgaggcgctgcaaggcgagcatgaagcccatgcggaagccgttgcccgcgaggaagaatggcgccagatcggccttggcgcgcagattttgaaggatctcggcgtttcctccatcgtgcttctggcctcgcgtgagcgccactatgtcggccttgaaggtttcggcatttgcatcacgcgtacggaaattatctaa

SEQ ID NO: 49275 - protein, 371 aa, Brucella suis 1330
MSYNQKQVVDAIRAFERGEIVVVMDDDGRENEGDLIVAAVHCTPEKMAFIVRHTSGIVCTPMTREEAKRLNLTPMVAENESAHTTAFTVTVDYRHGTTTGISAEDRTLTVRNLANPNAGASDFVRPGHIFPLVAREGGVLMRSGHTEAAVDLCKLANLPPIGVICELVNDDGTVKRGPDVAAFAEEHKLHRVTVADLIAYRQRKETLVRRIGDAPVETCAGKAHAYSYELPWEPMRHVAVVFGDIRDGEEVPVRLHREDVLNDVFGKGGSNLDAIMQRMGQEGRGILVYLREGSVGVRSDHRDARAREALQGEHEAHAEAVAREEEWRQIGLGAQILKDLGVSSIVLLASRERHYVGLEGFGICITRTEII

SEQ ID NO: 49276 - DNA, 1206 bp, Leptospira interrogans serovar Lai str. 56601
  CDS (1)..(1206): transl_table=11
atgattcaacccattgaaaatgcaatcgaagaaattaagtccggtaaaatgattatacttgtggattcggaagaccgggaaaacgaaggagaccttgtagttgcggccgaatttgcggataaagaaaaaatcaactttatggctgcttttgggcgtggtctgatttgtatacctatggaagtagaacgtcttaaaaaattaggactgaatcggatggtagacgattattccctaggagacaaacatggaactgcgtttactgtttcagtggacgccaaacacggaacttcgaccggaatttctgcacaggatagggcggttacggtccaagtccttttagatgataaaaccgtttctgccgatttgatgcgccctggccatttatttcctctacaagcggtacccggtggagttttaagaagggctgggcataccgaagctgctgtagatctgtcaaaacttgctggtttgtatccggcgggtgtaatttgcgaaattatgaacgacgatgggactatggcccgtttgcccgatttagaaaaatttgcagagaaacacggactgaatatttatacgatcgaagatttgatccgttatcgaagagccaaagaaaatttaattcgtttagaagtagaatctaaactaccgactgaatacggagagtttaccatccgagcgtattctactctgatagacgataagattcatatcgccttgatcaaaggagatattaaaaaagaagaaactataatggttcgggtgcatagcgaatgtttgactggagatattttttcgagtaatcgttgtgattgtggaccacagcttcatgccgctttggaaatgatttctaaagaagggaggggggttcttctttatatgagacaggaaggaagaggaattggtctgatcaataaattaaaagcttataatattcaagataagggatatgatacggtcgaagccaatgaaaaattaggctttgcaccggatcttagagattatggaattggagcccaaattttgagagaaataggtgtaggtaaaatgaagattttaacgaataatcctcgtaaaatcgtaggtttagatggttacggtttagaagtggtagaaagagttccgatcgaaattcaacccggttccgacaaccatgattatttgatgactaaaaaattaaagcttggtcatatgttaggtcttggttga

SEQ ID NO: 49277 - protein, 401 aa, Leptospira interrogans serovar Lai str. 56601
MIQPIENAIEEIKSGKMIILVDSEDRENEGDLVVAAEFADKEKINFMAAFGRGLICIPMEVERLKKLGLNRMVDDYSLGDKHGTAFTVSVDAKHGTSTGISAQDRAVTVQVLLDDKTVSADLMRPGHLFPLQAVPGGVLRRAGHTEAAVDLSKLAGLYPAGVICEIMNDDGTMARLPDLEKFAEKHGLNIYTIEDLIRYRRAKENLIRLEVESKLPTEYGEFTIRAYSTLIDDKIHIALIKGDIKKEETIMVRVHSECLTGDIFSSNRCDCGPQLHAALEMISKEGRGVLLYMRQEGRGIGLINKLKAYNIQDKGYDTVEANEKLGFAPDLRDYGIGAQILREIGVGKMKILTNNPRKIVGLDGYGLEVVERVPIEIQPGSDNHDYLMTKKLKLGHMLGLG

SEQ ID NO: 49278 - DNA, 1104 bp, Shewanella oneidensis MR-1
  CDS (1)..(1104): transl_table=11
atggcgctgcacagtatagaagagatcatcgaggatattcgtcaaggcaaaatggttattttgatggatgacgaggacagagaaaacgaaggcgatctgattttggcggccgaaatggtgacgccagaagcgattaactttatggcgaaatacggccgcgggttaatctgccaaacgatgaccaaggcccgttgccagcagttaaatctgcccttgatggtaaccaataacaatgcgcagttctcgaccaactttacggtatcgattgaagctgccgaaggcgtaaccacagggatttcggcccacgatcgcgctgtaaccgttaaagcggccgtagcaaaagatgctaaagcgtcggacttagttcagcctgggcatatcttcccgttaatggcgcaggatggtggcgtattaacccgcgcaggtcacactgaagcgggctgtgatttagcccgtttagcagggcttgaaccatcgggggtgattgttgaaattttgaacgaagacggcactatggcccgtcgcccagatttagagattttctctgaaaaacatggcattaaaatcggcactattgcggccctgattgaataccgtaataccaaagaaacgaccgttgtgcgtgaagccaaatgcaaactgccaacccgtttcggtgagttcgatatggtgacctttagggatactatcgacaatcaattgcactttgccttagtgaaaggcgaggtgaagcctgactgtttagtacgggtacatttacagaatacctttaacgatctacttcactctgagcgtgatcagcaacgtagctggccgctcgaaaaagcgatggcgcggatttctgccgaaggtggtgtattagtactgcttggcaatcaggaacattccagtgaaatcctcgccaaagtcaaagcctttgaagcggaagatcaaggtcagaccccagtatcggctaaatggcaaggcacctcacgccgtgtaggtgtgggttcgcaaatcctcgccagtttaggcgtgacaaaaatgcgactcttaagctcgcccaaacgttatcactcactttcaggctttggccttgaagtgaccgaatgcgtagctgagtaa

SEQ ID NO: 49279 - protein, 367 aa, Shewanella oneidensis MR-1
MALHSIEEIIEDIRQGKMVILMDDEDRENEGDLILAAEMVTPEAINFMAKYGRGLICQTMTKARCQQLNLPLMVTNNNAQFSTNFTVSIEAAEGVTTGISAHDRAVTVKAAVAKDAKASDLVQPGHIFPLMAQDGGVLTRAGHTEAGCDLARLAGLEPSGVIVEILNEDGTMARRPDLEIFSEKHGIKIGTIAALIEYRNTKETTVVREAKCKLPTRFGEFDMVTFRDTIDNQLHFALVKGEVKPDCLVRVHLQNTFNDLLHSERDQQRSWPLEKAMARISAEGGVLVLLGNQEHSSEILAKVKAFEAEDQGQTPVSAKWQGTSRRVGVGSQILASLGVTKMRLLSSPKRYHSLSGFGLEVTECVAE

SEQ ID NO: 49280 - DNA, 1194 bp, Streptococcus agalactiae NEM316
  CDS (1)..(1194): transl_table=11
atggcctttagtccaataaaaaaacttttacaagacatcaaatcagggaaaatggtagtgttgatggatgacgaaaatagagagaatgaaggagaccttatttgtgcggctgaaatggtgacaaaagagtcgattaattttatggctaaatttgggaaaggattaatttgcttacctctgtctaattactatgctgaaaagttagaattagctcaaatggctagccataatactgataatcatgaaacagcttttaccatatctattgatcatctatcaactagtactgggatttctgcggaagatagagctttgacagctaagatggttgctaacgacagtagcaaagctaaagactttagacgtcctgggcacttatttcccttgttagccaaggaaggaggtgttttagctagaaatggacatactgaagcaaccgttgatctatgtcgtttagctggattaaaggaatgtggactttgttgtgaaataatggctgaagatggtagtatgatgagaaaggatgagttattagcatttgctcaaaagcacgatttagctatcgctaccataaaacaattgcaagactatagacgtcaagaagagggaggggtggttagagaaattgagattcagctaccaacgcaattcggtcattttacggcttatggatatagcgaagttgtggcaaataaggaacatgttgcccttgttaaaggggatattagtagtggtgaagatgttttatgtcgtttacactcagaatgtttgacaggtgatgtctttcattccttgagatgtgattgtggggaacaactggctaatgccctccaacaaatagaggctgaaggtcgtggagtccttctttatatgagacaggaaggtcgaggaattggtttgattaataagttaaaagcttatcatttgcaagaagaaggcttagatactttagaagctaatttggctttaggttttgaaggagatgagagagactatggagttagtgctcaacttttaaaagatttaggtataaattctataaacttactaaccaataatccagataaaatccaacaacttgaagcagaaggaatttgcgtcaaaaacagagtgccattacaggtggcagcaacagcttatgaccttaattatttaaaaactaaaaaagaaaaaatgggacatcttttagattaa

SEQ ID NO: 49281 - protein, 397 aa, Streptococcus agalactiae NEM316
MAFSPIKKLLQDIKSGKMVVLMDDENRENEGDLICAAEMVTKESINFMAKFGKGLICLPLSNYYAEKLELAQMASHNTDNHETAFTISIDHLSTSTGISAEDRALTAKMVANDSSKAKDFRRPGHLFPLLAKEGGVLARNGHTEATVDLCRLAGLKECGLCCEIMAEDGSMMRKDELLAFAQKHDLAIATIKQLQDYRRQEEGGVVREIEIQLPTQFGHFTAYGYSEVVANKEHVALVKGDISSGEDVLCRLHSECLTGDVFHSLRCDCGEQLANALQQIEAEGRGVLLYMRQEGRGIGLINKLKAYHLQEEGLDTLEANLALGFEGDERDYGVSAQLLKDLGINSINLLTNNPDKIQQLEAEGICVKNRVPLQVAATAYDLNYLKTKKEKMGHLLD

SEQ ID NO: 49282 - DNA, 1305 bp, Corynebacterium efficiens YS-314
  CDS (1)..(1305): transl_table=11
ttgatgactgtgaccgagaacgccgtgactgagaacgccgcacagaacatccagctggacacagtggaggaagccatcgccgagatcgccgccggccgggcggtggttgttgtcgatgatgagaaccgggagaacgaaggcgatatcatcttcgccgccgaactcgccaccccggagctggtggccttcatggtccgttactcctccggttatatctgcacgccgatgacctcagaggacgcggaccgcctggacctgccgccgatgaccgcgcacaaccaggatgcccgcggcaccgcctacaccgtgaccgtggacgccaacaccggatccaccggtatctccgcaaccgaccgtgcgcacaccatccggctgctcgccgaccccaactccgaccgcaccgacttcacccggcccggacacgtggtgcccctgcgcgcccgcgagggcggtgtcctcgtgcgcgccgggcacaccgaggccgcggtggacctggcacgggccgccggtctgcgccccgccggtgtgatctgtgaggtggtcagtgaggaggaccccaccggcatggcccggctcccggagctgcgccggttctgtgacacccacggtctcaagctgatctccattgagcagctcatcgcctggcgacgccagaacgagatcctcgtcgagcgtgtcgtggagacgaaactccccaccgagatcggggagttcaccgcggtgggttaccgctccaaggtggatggcaccgaactcatggccatcgtcgagggtgacccatcctccgatggtggggagaacgtcctggtccgggtccattccgaatgcctcaccggtgatgtcttcggctcccgccgctgtgactgcgggcagcagctcaacgaatccctgcgcatgatccatgaggcaggtcgcggcgtggtggtctacatgcgcggacatgagggccgcggcatcggcctgctggccaagctgcgcgcctaccagcttcaggatgagggtgccgacaccgtcgatgccaacctttccctcggactgccggcggatgcccgggaattcggcaccggggcgcagatcctctacgacctgggtgtgcgctccatcaacctgatgagcaacaaccccaccaagcgcatgggactggagggccacggcatctccatcgccggccggacccccatccctgttcaggtgcatgaggacaatatccgttacctgcgcaccaaacgcgaccgcatggggcacatcctgcccgcgatcgatgaatgggacgcggcccacggtaacaccgacaagacgacctag

SEQ ID NO: 49283 - protein, 434 aa, Corynebacterium efficiens YS-314
MMTVTENAVTENAAQNIQLDTVEEAIAEIAAGRAVVVVDDENRENEGDIIFAAELATPELVAFMVRYSSGYICTPMTSEDADRLDLPPMTAHNQDARGTAYTVTVDANTGSTGISATDRAHTIRLLADPNSDRTDFTRPGHVVPLRAREGGVLVRAGHTEAAVDLARAAGLRPAGVICEVVSEEDPTGMARLPELRRFCDTHGLKLISIEQLIAWRRQNEILVERVVETKLPTEIGEFTAVGYRSKVDGTELMAIVEGDPSSDGGENVLVRVHSECLTGDVFGSRRCDCGQQLNESLRMIHEAGRGVVVYMRGHEGRGIGLLAKLRAYQLQDEGADTVDANLSLGLPADAREFGTGAQILYDLGVRSINLMSNNPTKRMGLEGHGISIAGRTPIPVQVHEDNIRYLRTKRDRMGHILPAIDEWDAAHGNTDKTT

SEQ ID NO: 49284 - DNA, 1110 bp, Pseudomonas putida KT2440
  CDS (1)..(1110): transl_table=11
ttgagaagggggtgccgcgtggcgctcaacagcatcgaagaactggtcgaagacatccgccagggcaaaatggtcatcctgatggatgacgaagatcgcgagaacgaaggcgacatcatcatggcggccgaatgctgccagccggagcacatcaacttcatggccaagcacgcccgtggcctgatctgcatgccgatgacccgcgagcgttgcgaaacgctgaagctgccgttgatggcgccgcgcaacggctcgggcttcggcaccaagttcaccgtgtcgatcgaggccgccgagggcgtcaccaccggtatttccgccgccgaccgcgcacgcactgtgcaggctgctgctgccaaggacgccaaggccgaagacattgtcagccctggtcacatcttcccgctgatggcccagccaggcggtacgctggcgcgtgccggccacaccgaagccgcctgtgacctggcgcgcatggccggtttcgagccaagcggcgtgatctgcgaagtgatgaacgacgacggcaccatgtcgcgccgcgccgaactggaagtgttcgccgccgagcacggcctgaagatcggcaccattgccgacctgatccactaccgcatgatccacgagcgcaccgtgcagcgtgtttccgagcaatcggtggagagcgagctgggtgagttcaacctggtcacctaccgtgatgcggtcgaaggcgacgtgcacatggccttgaccctgggcaagatctgcgcggaagaaccgaccctggtgcgcgtgcacaacatggacccgctgcgcgacctgctgctggtcaagcagccaggccgctggagcctgcgcgcggccatggccgcagtggccgaggccggcagtggtgtggtgttgctgctggggcacccgctggacggcgacgtgctgctggcgcacatccgcgaaagcgcgggcgatgcgccggccaaggcaccgaccacctacagcactgtgggtgccggttcgcagatcctgcgtgacctcggtgtgcgcaagatgcgcctgatgagttcgccgatgaagttcaacgcgatatccggattcgatctggaagttgtagaatacgtgccctccgagtga

SEQ ID NO: 49285 - protein, 369 aa, Pseudomonas putida KT2440
MRRGCRVALNSIEELVEDIRQGKMVILMDDEDRENEGDIIMAAECCQPEHINFMAKHARGLICMPMTRERCETLKLPLMAPRNGSGFGTKFTVSIEAAEGVTTGISAADRARTVQAAAAKDAKAEDIVSPGHIFPLMAQPGGTLARAGHTEAACDLARMAGFEPSGVICEVMNDDGTMSRRAELEVFAAEHGLKIGTIADLIHYRMIHERTVQRVSEQSVESELGEFNLVTYRDAVEGDVHMALTLGKICAEEPTLVRVHNMDPLRDLLLVKQPGRWSLRAAMAAVAEAGSGVVLLLGHPLDGDVLLAHIRESAGDAPAKAPTTYSTVGAGSQILRDLGVRKMRLMSSPMKFNAISGFDLEVVEYVPSE

SEQ ID NO: 49286 - DNA, 1122 bp, Pseudomonas putida KT2440
  CDS (1)..(1122): transl_table=11
atggctttcaacaccatcgaggaacttctcgaggactaccggcaaggcaagatggtcctgctggtggatgacgaggaccgggaaaacgagggcgatctgctgatcgccgccgagcgctgcgacgcccaggccatcaacttcatggctcgcgaggcgcgcgggctgatctgcctgaccttgaccgacgatcactgccagcgcctgggcctggagcagatggttccggccaacggtagcgtgttcagcaccgcgttcaccgtgtcgatcgaggcggccaccggggtcaccaccggcatttccgccgctgaccgggcacgcaccgtggcagcggccatggcccccaacgcccgccccgaagacctggtgcaacctggccacatcttccccctgcgcgcccgcgaaggcggcgtgctgacccgtgccggccacaccgaagcaggctgcgacctggcacgcctggccggcttcagcccggcctcggtcatcgttgaagtgctgaacgacgacggcaccatggctcgccgccccgacctggaagtgttcgccgcccggcatggcatcaagattggcaccatcgccgacctgatccactaccgcctgagcaccgagcagaccgtcaagcgcatcggcgagcgcgagctgccgacggtgcatggcaccttccgcctggtcacctatgaagaccgcatcgaaggtggcgtgcacatggccatggtcatgggcgacattcgccgcgaacagccgaccctggtgcgggtgcatgtgattgacccgctgcgcgacctggtgggcgccgagtacgccggccccgccaactggacgctgtgggcggcgctgcagaaggtggctgaggaaggtactggcgtggtggtgatcctggccaaccacgaatcctcccaggccttgcttgagcgtgtgccacaactgacccaccctgtgcggccctatcaacgtggccagtccaaggtgtattccgaagtgggtaccggggcgcagattctgcaggaccttggcgtgggcaagctgcgtcacctggggccgccgctgaaatacgcggggctggcgggctatgagctggaggtggtgcagagcatcccgttcgacccggggatggatggctga

SEQ ID NO: 49287 - protein, 373 aa, Pseudomonas putida KT2440
MAFNTIEELLEDYRQGKMVLLVDDEDRENEGDLLIAAERCDAQAINFMAREARGLICLTLTDDHCQRLGLEQMVPANGSVFSTAFTVSIEAATGVTTGISAADRARTVAAAMAPNARPEDLVQPGHIFPLRAREGGVLTRAGHTEAGCDLARLAGFSPASVIVEVLNDDGTMARRPDLEVFAARHGIKIGTIADLIHYRLSTEQTVKRIGERELPTVHGTFRLVTYEDRIEGGVHMAMVMGDIRREQPTLVRVHVIDPLRDLVGAEYAGPANWTLWAALQKVAEEGTGVVVILANHESSQALLERVPQLTHPVRPYQRGQSKVYSEVGTGAQILQDLGVGKLRHLGPPLKYAGLAGYELEVVQSIPFDPGMDG

SEQ ID NO: 49288 - DNA, 1110 bp, Vibrio vulnificus CMCP6
  CDS (1)..(1110): transl_table=11
atgccaatcagtacaccccaagagatcattgaagacattcgtttgggcaaaatggtcatcttaatggacgatgaagaccgcgaaaacgaaggtgatttgattatggcggcggagcacattacgccagaagccatcaattttatggccaaatatggtcgcggtttgatctgtttgactatgaccaaagagcgttgccagcgtcttggattaccaccaatggtgcaagataacaacgcgcaatacactaccaacttcaccgtttccattgaagcggcggaaggcgtgacaaccggtatttcagcagcggatcgtgctcgtaccgtgcaagcggcagtcgcaaaagaagctaaagcggcagacttggtgcaaccggggcacattttcccattagccgcgcaagatggtggcgtgttgactcgcgcggggcatactgaggcgggctgcgaccttgctcgtttggcgggtttcgaaccagcctctgttatcgttgaaattctgaatgacgatggcaccatggcgcgccgccctgatttggaagtgtttgctgagcagcatggtctcaaacttggcaccattgccgatttgattgagtatcgaaacaacacggaaaccacgattgagcgcgttgctgagtgcaagctacccactgagtttggtgagtttgatctcgtgacctaccgcgacaccattgataatcaaattcactttgctttgcgtaaaggtacgatgggtgatcaaacaccactggttcgtgttcacttacaagacacctttaccgatttactgcgcagcgatcgcaatgctgagcgcagttggacgcttgataaagcgatgaagcgtattggccaagaagggggcgttttggtgattctagggaatgaagagtcgcctgagctgctgatccatcgcgtcaaaatgtttgaagctcaagacaaagaagaggcgcctaaattggctaagaagcagggcacttcacgtcgtgttggtgtcggctcgcaaattcttgcagacttaggtgtgcacgacatgcgtctactttcttccagcaacaagaaataccatgcccttggcggttttggtttgaatgttgttgagtatgtgtgtgaataa

SEQ ID NO: 49289 - protein, 369 aa, Vibrio vulnificus CMCP6
MPISTPQEIIEDIRLGKMVILMDDEDRENEGDLIMAAEHITPEAINFMAKYGRGLICLTMTKERCQRLGLPPMVQDNNAQYTTNFTVSIEAAEGVTTGISAADRARTVQAAVAKEAKAADLVQPGHIFPLAAQDGGVLTRAGHTEAGCDLARLAGFEPASVIVEILNDDGTMARRPDLEVFAEQHGLKLGTIADLIEYRNNTETTIERVAECKLPTEFGEFDLVTYRDTIDNQIHFALRKGTMGDQTPLVRVHLQDTFTDLLRSDRNAERSWTLDKAMKRIGQEGGVLVILGNEESPELLIHRVKMFEAQDKEEAPKLAKKQGTSRRVGVGSQILADLGVHDMRLLSSSNKKYHALGGFGLNVVEYVCE

SEQ ID NO: 49290 - DNA, 1056 bp, Vibrio vulnificus CMCP6
  CDS (1)..(1056): transl_table=11
atggagcaaccgatttatttctatgagccagatgaaaatcatggctttctcgccaacttctatccatgctcgatcaccgtttctgggacgtgctggccgagcagtgaacattactaccaagcacaaaaattcgacgatgtccggctacaggaaaaagtgttgagggcagaagatgctgcacaagcttttcggctttcacgcgaatatcagcagtggcaaaggcatgactggtatgacattcgagtagaagtgatgagattcattgtgcgcgagaaatttttgcaaaacacgcccctagcgcatcaactgcttgcgacgggagatactgaactgaaagaacattcgcataaggatgccttttggggggatgggggcgatgggcatggacgcaatgagctcgggcgtattttgatgatggttcgagaggagttgcaagagcacgcgccatacaatctggtgcagtttattgacagtgcgaagttgcctacccagtgggggacatttcaaatgtatggtttcattgaaaaagccaccgggaaagagcatttggcgctcgtgtatggggatattgaacaacaggcagcgcctttgattcgtctgcactctgagtgtttaacaggcgatgcgctgtttagtgcccgctgtgattgcggttttcagctcgccaaagccttgcaaaacatcgtggcagaaggggcgggcgtgttgctctatttgcggcaggaagggcgggggataggccttatcaataaaattcgcgcttatcacttacaagatgacggggccgacacggtggaagctaacgagcaacttggctttggcgccgatatgcgcgattacgcgttttgtcgcggcattctcagttttctcggcattgaacgtgtgaggctgatgaccaacaacccacgcaaggtgaaggcactgcaattggccaatattgaggtgacggagcgcgtgccgctgcaagaaggcaataatccgcacaatcatcagtatttaagaaccaaagccgataagctaggccacatgtttgatcgcaacttcgttaaaccttag

SEQ ID NO: 49291 - protein, 351 aa, Vibrio vulnificus CMCP6
MEQPIYFYEPDENHGFLANFYPCSITVSGTCWPSSEHYYQAQKFDDVRLQEKVLRAEDAAQAFRLSREYQQWQRHDWYDIRVEVMRFIVREKFLQNTPLAHQLLATGDTELKEHSHKDAFWGDGGDGHGRNELGRILMMVREELQEHAPYNLVQFIDSAKLPTQWGTFQMYGFIEKATGKEHLALVYGDIEQQAAPLIRLHSECLTGDALFSARCDCGFQLAKALQNIVAEGAGVLLYLRQEGRGIGLINKIRAYHLQDDGADTVEANEQLGFGADMRDYAFCRGILSFLGIERVRLMTNNPRKVKALQLANIEVTERVPLQEGNNPHNHQYLRTKADKLGHMFDRNFVKP

SEQ ID NO: 49292 - DNA, 1182 bp, Staphylococcus epidermidis ATCC 12228
  CDS (1)..(1182): transl_table=11
atgcaattcgatacaattgagttggctatagaggctttaagaaatggagagagcattattgtagttgacgatgaagatagagaaaatgaaggagatcttgtagctgttacggaatggatggatgataataccattaattttatggctaaagagggtcgtggtctgatttgtgcaccaattgataaatctatagctgaaagattaaaactacaatctatggagcaaaataacactgatatttatggcacacattttactgtaagcattgatcattataaaactactacaggaatcagtgcacatgaacgtacacaaacggctagagcactcatagatgaaaatactaatcctgaagattttcatcgtccggggcacttatttccacttatagcaaaagagaatggtgtgttaacacgtaatggtcatactgaagctgccgtagatttggcacggttaacaggagcacaaccagctggagtaatctgcgaaattatgaatgatgatgggacaatggctaagggtgaagatctccagtcatttaaagaacgccaccatttaaaaatgattactataaaaagtttggttgcttttcgtaaggctgttgaacttaatgttaatcttaaggcaaaggtcaagatgccaactgattttggtcattttgatatgtatggatttacaacggattatagcgatgaagaaatcgtagctattgttaaaggagatttaaaaagcaatcctaatgtacgtatgcattctgcttgtctgactggggatatttttcatagtcaaagatgtgattgcggggcacaacttgaagcgtcaatgaaatatattgacgaacatggtggaatgattatttatttacctcaagaaggtagaggaatagggttaattaataagttgcgcgcatatgagttgatagaaaaaggttatgatacagttactgcaaatcttgctcttggttttgatgaggatttgagagattatcatgttgcagctgaaatattaaagtattttgatataagtgaaattaacttgctcagcaataatcctaaaaaatttgaaggtttagaagattacggcattgagatcgtagatagaattgaacttatcgttccagaaacacaatataaccatagttatatggaaactaaaaaaaataaaatgggacatttaatatag

SEQ ID NO: 49293 - protein, 393 aa, Staphylococcus epidermidis ATCC 12228
MQFDTIELAIEALRNGESIIVVDDEDRENEGDLVAVTEWMDDNTINFMAKEGRGLICAPIDKSIAERLKLQSMEQNNTDIYGTHFTVSIDHYKTTTGISAHERTQTARALIDENTNPEDFHRPGHLFPLIAKENGVLTRNGHTEAAVDLARLTGAQPAGVICEIMNDDGTMAKGEDLQSFKERHHLKMITIKSLVAFRKAVELNVNLKAKVKMPTDFGHFDMYGFTTDYSDEEIVAIVKGDLKSNPNVRMHSACLTGDIFHSQRCDCGAQLEASMKYIDEHGGMIIYLPQEGRGIGLINKLRAYELIEKGYDTVTANLALGFDEDLRDYHVAAEILKYFDISEINLLSNNPKKFEGLEDYGIEIVDRIELIVPETQYNHSYMETKKNKMGHLI

SEQ ID NO: 49294 - DNA, 1257 bp, Bradyrhizobium japonicum USDA 110
  CDS (1)..(1257): transl_table=11
atgagccgcgcgaaccgtaccgatcacatccgcctgacctcccatccggagccgggcaggaaggccgcttttccgatccattggggcgcagccgatgcgcgcacccgcgggccgatcatcgggacggtgtcgcgcgctggggatcgcaacgtgatcggcagccatggcggctcctacgcgatgtaccgcgcgctcgccgtctccgccggggcgctcgatcccatcaggcgtcccgacctcaccaacacgtttccggcagccaccatcgggccgtttccgcaatggaacgatccggccaagatcgtcgcgctcgacccctgggggcatctcgtcgccgagaattttggcaaggagatcgccgagggctccgacatccggccgagcatcgcggtgacgcgcgcccggctcgacctgcccgagatccgcgaggcgctggccgcaaaacggctgcgcgccgacggcgaggtcgtgcatgccaatggcagcgtgtcggtggtgaagatcgcgatcgatccggtctggtatctgccgggcctcgccacgcgcttcggcaccggcgagaccgagctgcgccgcacgctgttcgagcagaccgccggcatgttcccggagctggtgacgcggccggacatgaaggtgttcctgccgccgatcggcggcaccacagtctacatgttcggcgacgtcagcaagctgcccgaccatcgcaccaagatcacctgccgcgtccatgacgagtgcaacggctccgacgtgttcggctccgacatctgcacctgccggccctatctcatccacggcatcgaggaatccgcgcgcggcgcgcaggagggcgggctcgggctcgtcgtctacaaccgcaaggaaggccgcgcgcttggcgaggtcacgaaattcctggtctacaacgcccgcaagcgccaggaggacggcgatgccgccgccgcctatttcgagcggaccgaatgcgtcgccggcgtgcaggacgcgcgcttccagcaattgatgccggataccatccactggctggggctgaagcgcatcgaccgcttcctgtcgatgagcgacatgaagcacgacgcgctgacctcgcagggcatcgacatcgtcgagcgcgtgccgatcccgccggagctgattccagccgacgcctatgtcgagatcgcggccaagaaggctgccggctactactcgaccgacatcgcgccggagaaggacgtcaacggcgtggtcgggcgttcgctggaaaaatactga

SEQ ID NO: 49295 - protein, 418 aa, Bradyrhizobium japonicum USDA 110
MSRANRTDHIRLTSHPEPGRKAAFPIHWGAADARTRGPIIGTVSRAGDRNVIGSHGGSYAMYRALAVSAGALDPIRRPDLTNTFPAATIGPFPQWNDPAKIVALDPWGHLVAENFGKEIAEGSDIRPSIAVTRARLDLPEIREALAAKRLRADGEVVHANGSVSVVKIAIDPVWYLPGLATRFGTGETELRRTLFEQTAGMFPELVTRPDMKVFLPPIGGTTVYMFGDVSKLPDHRTKITCRVHDECNGSDVFGSDICTCRPYLIHGIEESARGAQEGGLGLVVYNRKEGRALGEVTKFLVYNARKRQEDGDAAAAYFERTECVAGVQDARFQQLMPDTIHWLGLKRIDRFLSMSDMKHDALTSQGIDIVERVPIPPELIPADAYVEIAAKKAAGYYSTDIAPEKDVNGVVGRSLEKY

SEQ ID NO: 49296 - DNA, 1197 bp, Xylella fastidiosa Temecula1
  CDS (1)..(1197): transl_table=11
atgaatactcccacacacactcacccacatccgttcggctccacggcaacgatccgctgcgaacgtgccgctgccgaactgcgtactggtcggcctgtcctgttgattgatgctcatgcgcgtcggcatgcggtcatggctctggatagcatgaccgctcaaagctttgcgacatttgcgaacgctgtcggcaacactcactacctattcctgactccagtacgctccaacgtgctcggcctggaggctccccaaggcgcacgcatcccactggcgaccctgtcctacgacagcctggccaagctcgcctacctgcgtcagccaacacgcccaacagcatgggcgcctggagacatcatggatgcagcagcgacagagatcactcgacttgccctgctcctgccagcaatcgtcgccgccccattaacccagcataccgaacatgcctttgcagattgccaaacacttgacttagcagatctcgataccgctgccgcgtgcgcctccacaacagagtacgaattggtcacacgtactccggtgccactacgtgatctaggcatgagcgaattcatcgtattccgtggtggcattgcacagcgcgaccaagttgcgatcctgatcggtcgacccgacctaagcagtgcagtccccgtgcgcgtgcattcctcctgcctaaccggtgacctctttggctcgctcaagtgtgactgcggcgaccaattgcgtcatagcttggccacactaaaagcccttggcggtggtgtgctgctgtacttggaccaagaaggacgtggaaacggaattgccgcaaaaatacgcgcctacggctaccaacatgtaggactggatacgatcgacgcagatgcacagctcggattcggtccggacgaacgccgctacaccggtgcagtgatgatgctacgcgcgctaggcatcacccggatacaactgctatccaataatcccgcaaaagcagagcgcttacgcgcggcaggaatcatcgtcaagcaacgcatctcggtgataggacagatcaccaaacagaacgaacactacctgcgcaccaaagtcagccgtgccggccacgacctggacatagatgccttaatcatgacatcacagagacctcaagacccatcggaaactgtcgatggagagaccgtaaaacccatcgcaaaaaccggccacgcataa

SEQ ID NO: 49297 - protein, 398 aa, Xylella fastidiosa Temecula1
MNTPTHTHPHPFGSTATIRCERAAAELRTGRPVLLIDAHARRHAVMALDSMTAQSFATFANAVGNTHYLFLTPVRSNVLGLEAPQGARIPLATLSYDSLAKLAYLRQPTRPTAWAPGDIMDAAATEITRLALLLPAIVAAPLTQHTEHAFADCQTLDLADLDTAAACASTTEYELVTRTPVPLRDLGMSEFIVFRGGIAQRDQVAILIGRPDLSSAVPVRVHSSCLTGDLFGSLKCDCGDQLRHSLATLKALGGGVLLYLDQEGRGNGIAAKIRAYGYQHVGLDTIDADAQLGFGPDERRYTGAVMMLRALGITRIQLLSNNPAKAERLRAAGIIVKQRISVIGQITKQNEHYLRTKVSRAGHDLDIDALIMTSQRPQDPSETVDGETVKPIAKTGHA

SEQ ID NO: 49298 - DNA, 1209 bp, Clostridium tetani E88
  CDS (1)..(1209): transl_table=11
gtggtaaaaatgtttaagtttaatagtattgaagaggctattgctgatataaaagaaggaaaaatggttattgtggtagatgatgaggatagggaaaatgagggggatcttttaatggcagcagaaaaagtaactcctgaaaatattaattttatgattaaatatggaagaggattagtgtgcatgcctataattggagaaagattaaaggaattaaaccttaatcaaatggtagatataaatacagatacaaatggaacagcttttacagtctccatagacttcatagatactactacaggtatttcagcttatgaaagggctcataccatatcaaaagtattagatagcagtgtaaagggagaggactttaaaagaccaggacatgtttttccattagaagcaaaagaaggtggggtattaaaaagagcaggacatactgaagcttctgtagatctagcaaggcttgcaggattttatccagcaggagtaatttgtgagattgtaggggaagatggaaagatggcaagactccctcaattaatggagtattctaaggaacataatttaaaaattataaatatagcagatttaatagcttatagaagaaagaaagaaactctagtaaaaagagttgtagaagctaaaatgccaacaagatggggagaatttaaaataataggctatgaaaacaaaataaatggtgagcaccatgtagcccttgtaatgggagatatagaaaatggagaagatgtattagttagaatgcattcagaatgtcttacaggagatgctctaggctctgtaagatgtgattgtgggtatcaatatgaagcagctatgaaagctataagtgaagagagaagaggagtactagtatacatgcgccaagaaggaagaggtatagggcttattaacaaattaaaggcttataatcttcaagacaagggcatggatactgtggaagctaatattgccttaggttttccacctgatttaagagattatggaataggagctcaaatattaaatgatttaggaattaaaaagataaatcttatgacaaacaatcctaaaaaaataacttcattatctggttatggaataaaaatagtaaaaagagttccactagaaattcatgaaaatgaggaaagtgaattttacctaaaaactaaaaaagaaaaaatgggtcatttattacatttttaa

SEQ ID NO: 49299 - protein, 402 aa, Clostridium tetani E88
MVKMFKFNSIEEAIADIKEGKMVIVVDDEDRENEGDLLMAAEKVTPENINFMIKYGRGLVCMPIIGERLKELNLNQMVDINTDTNGTAFTVSIDFIDTTTGISAYERAHTISKVLDSSVKGEDFKRPGHVFPLEAKEGGVLKRAGHTEASVDLARLAGFYPAGVICEIVGEDGKMARLPQLMEYSKEHNLKIINIADLIAYRRKKETLVKRVVEAKMPTRWGEFKIIGYENKINGEHHVALVMGDIENGEDVLVRMHSECLTGDALGSVRCDCGYQYEAAMKAISEERRGVLVYMRQEGRGIGLINKLKAYNLQDKGMDTVEANIALGFPPDLRDYGIGAQILNDLGIKKINLMTNNPKKITSLSGYGIKIVKRVPLEIHENEESEFYLKTKKEKMGHLLHF

SEQ ID NO: 49300 - DNA, 1215 bp, Lactobacillus plantarum WCFS1
  CDS (1)..(1215): transl_table=11
atggatacaatgaaaaaggtagcagcggccttggccgcattaaaacggggcgaattgattattgttgcggatgatgagacgcgtgaagcggaaggagacatggttggcctagccgctaaagcaaccactgcgacagtgaatcggatgattacatcagcgcggggactactctgtgttccgatggcgccaagtatcgccacgcgactacatttgacaccgatgactagtgaacacgatgcgtttggaacggcatttacagtctcaacggatcaccatacgacgtccacgggaatctcggcagctgatcgggcgaccacgattcaagcgttagccaatcccaatagtcaggccgctgatttctatcatcccgggcacgtttttccattgattgcgcggactggtggattgttagcgcggcgtggtcatactgaagcggccgtcacgttagcacaattagcaggtgtgacccccgcggcctatatttgtgaagttatcaagaaaaatggcttaatggcgcggcgccgtgatctcaaagctttggcagagggcttacaattaccgctaatcaccattgaagatattaccacctacgtgattcaaacgggtgccgcccagctaacaacgaccccgagtgtcaacttaccgaccaaggatggtcagttcacgatgactggtttcgaagtccccggtcatacggcgttgccagtggcactgcaagctggtgatatcagtggcgatgaaccagtgttagtgcggttacactctgaatgttttacgggcgatgttttaggatcgcggcggtgtgactgtggtgatcaattacacgctgcactccaaaaaatcagtcaagctcagcgcggtgttttcgtctatttacggcaagagggtcgcggtattggcttggctaacaaactagcagcttacgcactccaagaacacggggttgatacgtatgatgcgaacgtgcagttgggctttcaaccggatgagcgccggtatgatattgcggcattagtgctacgccaaatggggattacacgggttcgtttgctgactaataatcctgacaaggttgagcagttacgtgcagcggggattgatgttgttgaacgggtccccttagaaataccagccaatcagtacgatcaagcttacttaaaaacaaaacgtgatcgatttcatcatcaactcacactaacggagggacacgaatga

SEQ ID NO: 49301 - protein, 404 aa, Lactobacillus plantarum WCFS1
MDTMKKVAAALAALKRGELIIVADDETREAEGDMVGLAAKATTATVNRMITSARGLLCVPMAPSIATRLHLTPMTSEHDAFGTAFTVSTDHHTTSTGISAADRATTIQALANPNSQAADFYHPGHVFPLIARTGGLLARRGHTEAAVTLAQLAGVTPAAYICEVIKKNGLMARRRDLKALAEGLQLPLITIEDITTYVIQTGAAQLTTTPSVNLPTKDGQFTMTGFEVPGHTALPVALQAGDISGDEPVLVRLHSECFTGDVLGSRRCDCGDQLHAALQKISQAQRGVFVYLRQEGRGIGLANKLAAYALQEHGVDTYDANVQLGFQPDERRYDIAALVLRQMGITRVRLLTNNPDKVEQLRAAGIDVVERVPLEIPANQYDQAYLKTKRDRFHHQLTLTEGHE

SEQ ID NO: 49302 - DNA, 636 bp, Tropheryma whipplei str. Twist
  CDS (1)..(636): transl_table=11
atgatggggaatatggataagggtctagattcgcaaaaacaagaaactgctcgcagctgcagatttgaggttgaaacaaatcttccaacaaaatttggaaccctcagggtacgtggctatcgggatataaaaaataacgagcatatcgcactgattacaaagcaaattaagagtgaggatgttttgctcagaattcactcagaatgtataacgggagaagtatttatgtctctgaagtgtgattgtcatgggcaattgcacaaagcccttgagcggatcagtgcagaaggcggacttgttatatatatgagggggcacgaaggtcgcggtataggtatcttgaataaattgcgagcatacagattgcaagagcagggccttgatacattcgactcaaacgtgaagctgggccttcctgttgatgccagggattatggacctgctgcagaaatactgcacgatctgggtgtgcgctcagtaaggcttctaagtaataatccagataaacagctgcaacttgaacaatccgggatacgcgtcacgggggtgctgccctggcaagttgggcttggtaaatgcaatcatgaataccttaaagtaaaacgcgacaaaatgggtcataaaatcgagttatag

SEQ ID NO: 49303 - protein, 211 aa, Tropheryma whipplei str. Twist
MMGNMDKGLDSQKQETARSCRFEVETNLPTKFGTLRVRGYRDIKNNEHIALITKQIKSEDVLLRIHSECITGEVFMSLKCDCHGQLHKALERISAEGGLVIYMRGHEGRGIGILNKLRAYRLQEQGLDTFDSNVKLGLPVDARDYGPAAEILHDLGVRSVRLLSNNPDKQLQLEQSGIRVTGVLPWQVGLGKCNHEYLKVKRDKMGHKIEL

SEQ ID NO: 49304 - DNA, 1092 bp, Pseudomonas syringae pv. tomato str. DC3000
  CDS (1)..(1092): transl_table=11
gtggcgctcaataatatcgaagaactggttgaagacatccgccagggcaagatggtcatcctcatggatgacgaagaccgcgagaacgaaggcgacctgatcatggccgccgaatgcgtcaagcctgagcacatcaacttcatggcgcgtttcgcccgtggcctgatctgcatgccgatgacccgcgagcgctgcgaaaccctcaagctgccgctgatggcgccgcgcaacggctccggtttcggcaccaagttcaccgtctccatcgaagctgccgaaggcgtgaccaccggtatttccgcagccgaccgtgcgcgtaccgtgcaggccgccgctgccaaagaagccaaagccgaagacatcgtcagcccggggcacatcttcccgctgatggctcaggccggtggcactctggctcgcgccgggcataccgaagcggcgtgcgatctggcgcgcatggccgggttcgagccgacggggctgatctgcgaagtcatgaacgacgacggcaccatgtcgcgtcgcgccgaacttgaagaatttaccctgcaacacgacatcaagatcggcaccatcgccgacttgatccactaccggatgatccacgaacgtaccgttcagcggattgccgagcagccgatggacagcgaactgggcagtttcaacctggtgacctaccgtgattcggtcgagggcgatgtgcatctggcgctgaccctgggcaagatctgcgcagaagagccgaccctcgtacgcgtccacaatatggacccgttgcgcgacctgctgatggtcaaacagcccggccgctggagcctgcgcgccgccatgcgtgcggttagcgaggcgggcagcggtgttgtgctgttgcttggtcaccccctggatggcgatgtattgctggctcatatccgcgaaaccgcagggcagcaaccgatcaagacgccgaccacttacagcacggtgggtgccggttcgcagatccttcgtgacctcggtgtgcgcaaaatgcgcctgatgagttcgccaatgaagttcaatgcgatatccggtttcgatctggaagttgtagaatacgtgccctccgaataa

SEQ ID NO: 49305 - protein, 363 aa, Pseudomonas syringae pv. tomato str. DC3000
MALNNIEELVEDIRQGKMVILMDDEDRENEGDLIMAAECVKPEHINFMARFARGLICMPMTRERCETLKLPLMAPRNGSGFGTKFTVSIEAAEGVTTGISAADRARTVQAAAAKEAKAEDIVSPGHIFPLMAQAGGTLARAGHTEAACDLARMAGFEPTGLICEVMNDDGTMSRRAELEEFTLQHDIKIGTIADLIHYRMIHERTVQRIAEQPMDSELGSFNLVTYRDSVEGDVHLALTLGKICAEEPTLVRVHNMDPLRDLLMVKQPGRWSLRAAMRAVSEAGSGVVLLLGHPLDGDVLLAHIRETAGQQPIKTPTTYSTVGAGSQILRDLGVRKMRLMSSPMKFNAISGFDLEVVEYVPSE

SEQ ID NO: 49306 - DNA, 666 bp, Pseudomonas syringae pv. tomato str. DC3000
  CDS (1)..(666): transl_table=11
atgcaaatcttgcgaatttccagtcttcatactgatcaggagcacacggtgcccgtcgtatttgtcgccgcttccaaactgcccacaccctttgcagaatttgccatgcacggctttatcgagtcagcaaccggccgtgaacacgttgtcctgagcctgggcgatgtagcggatggcgctccggttcttggccgggtgcactccgaatgcctgaccggtgatgcactgttcagtcagcgttgcgattgcggctctcaactggaagccgccatgcgcgccattgctaccgaggggcgcggcgtattgctgtatctgcgtcaggaagggcgcggcatcggcctgatgaacaagatccgcgcctacgagctgcaggacggcggggccgatacggtcgaagccaacgagcgtcttggttttgccgccgaccagcgcgactacgccatctgcctgccgatgcttcagcatctgggtgtgcagtcgctgcgcttgatgaccaacaacccgcgtaaagtcaaagcgctgaccgacatgggcatcaatgtcgccgagcgtgtgccgctgcacactgggcaaaacccgcacaatcgcctttatctggcgaccaaggccggcaagttggggcacatgatgggtaacgaacaccaaagcgaggtcggccccgcgtga

SEQ ID NO: 49307 - protein, 221 aa, Pseudomonas syringae pv. tomato str. DC3000
MQILRISSLHTDQEHTVPVVFVAASKLPTPFAEFAMHGFIESATGREHVVLSLGDVADGAPVLGRVHSECLTGDALFSQRCDCGSQLEAAMRAIATEGRGVLLYLRQEGRGIGLMNKIRAYELQDGGADTVEANERLGFAADQRDYAICLPMLQHLGVQSLRLMTNNPRKVKALTDMGINVAERVPLHTGQNPHNRLYLATKAGKLGHMMGNEHQSEVGPA

SEQ ID NO: 49308 - DNA, 1110 bp, Vibrio parahaemolyticus RIMD 2210633
  CDS (1)..(1110): transl_table=11
atgccaatcagtacaccacaagaaattattgatgatattcgcgcaggcaaaatggtcatcctaatggatgatgaagaccgtgagaatgaaggtgacttgatcatggctgccgagcatattacgccggaagcgatcaactttatggcgacttacggtcgtggcttgatctgtctgaccatgactaaagcgcgttgtgaaaatctcggcttgccgccaatggtgcaagacaacaacgcgcagtacaccactaactttactgtttctattgaagctgctgaaggcgtaaccacgggtatttcagcggctgaccgcgcacgtaccgttcaagctgcggttgcgccaaacgcaaaagcggcagacttggttcaaccggggcatattttccctcttgctgcgcaagatggtggtgtattgactcgcgctggtcacaccgaagcgggttgtgatttagctcgccttgcggggcttgagcctgcttctgtgattgttgagattctaaacgacgacggcaccatggctcgccgccctgatcttgaaatctttgctgaaaaacacggcttgaagttaggcactattgcggaccttatcgaataccgcaacaacacagaaacgaccattgagcgtgtagcagaatgcaaactgccaactgaacacggtgagttcactttggtgacttacaaagacaccatcgatagtcaagtgcattacgcgatgtgtaaaggtgatttggccggcgaagcgccgctggttcgtgtgcatctacaagacgtattcaccgatgtattacgcagtgaccgcaatgcagagcgcagctggacacttgataaagcgatgaagcgtatcggtgaagaaggcggtgttctggttgtacttggcaatgaagaatcaaccgagttgctcatccaccgcgtgaaaatgttcgaagcgcaagataaaggcgaagcacctactttagcgaaaaagcagggcacgtctcgccgcgtgggagtggggtcgcaaattctcgcagaccttggtgttcacgatatgcgtcttctgtcttcgaccaacaaaaaataccatgcattgggcggtttcggcctgaacgtggttgaatacgtttgcgaataa

SEQ ID NO: 49309 - protein, 369 aa, Vibrio parahaemolyticus RIMD 2210633
MPISTPQEIIDDIRAGKMVILMDDEDRENEGDLIMAAEHITPEAINFMATYGRGLICLTMTKARCENLGLPPMVQDNNAQYTTNFTVSIEAAEGVTTGISAADRARTVQAAVAPNAKAADLVQPGHIFPLAAQDGGVLTRAGHTEAGCDLARLAGLEPASVIVEILNDDGTMARRPDLEIFAEKHGLKLGTIADLIEYRNNTETTIERVAECKLPTEHGEFTLVTYKDTIDSQVHYAMCKGDLAGEAPLVRVHLQDVFTDVLRSDRNAERSWTLDKAMKRIGEEGGVLVVLGNEESTELLIHRVKMFEAQDKGEAPTLAKKQGTSRRVGVGSQILADLGVHDMRLLSSTNKKYHALGGFGLNVVEYVCE

SEQ ID NO: 49310 - DNA, 1107 bp, Vibrio parahaemolyticus RIMD 2210633
  CDS (1)..(1107): transl_table=11
atgccttttgttgactatccatatcatctaagcaggagcgcgaatatggttgatcagatccttttctacgagcccgatgagccgcacggcttcctctccaacttctgtcatgcccccgtcgaaatatcttcccaatcttggcccaccagcgaacactactatcaagctcagaaatttgttgatgcccaactgcaaaccaaaattcagaaagcccaatcgccggatgaagcgttcgcgttaagccgtcagtacgagcatctcgttcgcagcgattgggacaacatgaagctctcagttatggcgttcattgtgcgagaaaaattcctccaaaacccgaaacttgctcagaaactgatgcgcacgggcaatgcttgccttaccgagcattcgcacaaggacgcattttggggagatggaggagacggtaaaggtttgaatcacctaggagaaattctgatgaacgtacgcgcagagctgcgacatgtcgagccttacaatttggttaagttcatcgacaaagctaagctgccaactcagtggggcacattcatgatgcacggcttcatcgagacggctacagggaaggagcatctcgcgctggtgtatggcgacccgacgtctcagcctgcgccattgattcggctccattctgaatgtctcactggggacgcactatttagcacccgctgcgattgcggttttcagttaaatcgtgcgttgcaaaacatcgtcgaagagggctgcggcgtgctgctctatttgcgtcaggagggacgtggcatcggtttaatcaacaaaattcgcgcctatcacttgcaggatgatggtgcggataccgttgaggcgaatgagcgtttagggtttgctgctgatatgcgagactatgcgttttgcaaagggatgttagagcatttagggattgacgaagtgcgtctgatgaccaacaacccccgtaagcttgcggctttgaaaaacgcacacatcaatgtcgttgagcgtgtgccactgcaagaaggtcgcaatccaagcaaccaacactatctaaaaaccaaagcaaacaaattagggcacatgtttgatccccattttgttgatcaaacggaatga

SEQ ID NO: 49311 - protein, 368 aa, Vibrio parahaemolyticus RIMD 2210633
MPFVDYPYHLSRSANMVDQILFYEPDEPHGFLSNFCHAPVEISSQSWPTSEHYYQAQKFVDAQLQTKIQKAQSPDEAFALSRQYEHLVRSDWDNMKLSVMAFIVREKFLQNPKLAQKLMRTGNACLTEHSHKDAFWGDGGDGKGLNHLGEILMNVRAELRHVEPYNLVKFIDKAKLPTQWGTFMMHGFIETATGKEHLALVYGDPTSQPAPLIRLHSECLTGDALFSTRCDCGFQLNRALQNIVEEGCGVLLYLRQEGRGIGLINKIRAYHLQDDGADTVEANERLGFAADMRDYAFCKGMLEHLGIDEVRLMTNNPRKLAALKNAHINVVERVPLQEGRNPSNQHYLKTKANKLGHMFDPHFVDQTE

SEQ ID NO: 49312 - DNA, 1215 bp, Bacteroides thetaiotaomicron VPI-5482
  CDS (1)..(1215): transl_table=11
atggaagagattaaaatggatagaatagaagatgcgattgccgatttcaaagaaggcaagtttgtcattgtagtggatgatgaagatcgtgaaaacgaaggtgatttaatcatagctgccgaaaagataactcctgagaaagttaactttatgttgaaacatgcgcgtggtgtgctctgtgcgcctatcacggtgtcgcgttgtaaagaactggatttgccgcatcaggtcagtgataatacttctgtattgggcactccttttacagtgacaattgacaaactggaaggttgtagtaccggagtttctgcttccgaccgtgctgccactattcaggcgttggccgatcctgcttctacaccggctactttcggacgtcccggacatattaatccgctgtatgcacaggaaaaaggagtacttcgtcgtgccggacatacagaagctaccatcgatatggcacgccttgccggactttaccctgcaggtgctctgatggaaataatgagcgatgacggtacgatggcacgtctgccggaacttcgtgcaatggccgatgaacatggactgaaactgatttccattcatgacttgattgcttatcgtctgaaacaggagtcaatcgtagaaaaaggcgttgaggtaaatatgccgaccgaacatggtatgttccgtctgattcctttccgtcagaaatcgaatggactggagcatatggctatatttaaaggtacatggaatgaagacgaacctatcttggtgcgtgtccattcatcttgcgctactggtgatattcttggctcacaccgttgtgactgtggcgagcaactgcataaagcgatggaaatgattgaaaaagaaggaaaaggtgtggtggtttatctgaatcaggaaggccgtggtatcggtttgatggaaaagatgaaagcatataaacttcaggaagacggtatggataccgttgacgccaacctttgcttaggacacctggcagacgaacgcgactatggagtaggagcccagattctgcgtgaactgggagtgcacaaaatgaaacttctgacaaataatcccgtgaaacgtgtagggctggaagcctatggactggaaattgtagaaaatgtacctgttgaaacagttcctaatccatataatgagcgatatctgagaacaaagaaagaaagaatgggacatacattacattttaataagtaa

SEQ ID NO: 49313 - protein, 404 aa, Bacteroides thetaiotaomicron VPI-5482
MEEIKMDRIEDAIADFKEGKFVIVVDDEDRENEGDLIIAAEKITPEKVNFMLKHARGVLCAPITVSRCKELDLPHQVSDNTSVLGTPFTVTIDKLEGCSTGVSASDRAATIQALADPASTPATFGRPGHINPLYAQEKGVLRRAGHTEATIDMARLAGLYPAGALMEIMSDDGTMARLPELRAMADEHGLKLISIHDLIAYRLKQESIVEKGVEVNMPTEHGMFRLIPFRQKSNGLEHMAIFKGTWNEDEPILVRVHSSCATGDILGSHRCDCGEQLHKAMEMIEKEGKGVVVYLNQEGRGIGLMEKMKAYKLQEDGMDTVDANLCLGHLADERDYGVGAQILRELGVHKMKLLTNNPVKRVGLEAYGLEIVENVPVETVPNPYNERYLRTKKERMGHTLHFNK

SEQ ID NO: 49314 - DNA, 1221 bp, Coxiella burnetii RSA 493
  CDS (1)..(1221): transl_table=11
atgcaaaaaccatttgataatattgaaacggcgattgtcgctttacgtcaaggtaaaatgattattttggtcgatgatgagtcgcgtgaaaatgaaggcgatttaatcattgcggcggaacatgccacaccagaacacattaatttcatgacgctttatggacggggtcttatttgtttacccatgtgctccagcgattttgagcggttaaatattcccatgatgaccagccgaaatgggtcgcgttatgagaccccttttggcgtatccattgaagctgcttacgatgttacgacgggtatttcagcccacgaccgcgcgcgcaccattcaaatagctatcgatgagaaaagtacgcctgaagacatcatcatgcccgggcatatgttcccattaaaagccaacgacgcaggtgtgctcgcgcgagccggccacacggaaggcagtgtggatttatgccgtctggcagggctaaaaccggcggctgttttatgcgaaattttaaataaagacggaagcatggcgcgattgcccgatttacaacttctggctaaacaattccgtttgccgttagtgagtattcaggaccttattacttatcggattaatcatgaaacgctcattgatgaggtttcagaatcgcttctgccaattaaaaatcgaggccgatttaccattaaaacttttcgcagtcgggtggatcacttagaacatgttgctttggttaatcagaaaatcgaggaagataaaccgtgtttagtgcgtgttcattctgaatgtttaacgggcgatgtatttggttccgcgcgctgtgattgcggcggtcagttggaagcagccttggatgaaattgcaacgcaagggggcgttttgctttacttgcgccaagagggacggggcattggtttagcgaataaaataaaagcctatgctttacaggaagccggtttagacacggtggaagccaatcatcatctcggttttggagctgatttaagggattatggtttggccgcgcaaatgttgcgagttttagggattcgggaaattcgattgttaacgaataatcccaataaagtagaaagcttaacgcggtatggcatttctgttgctgaacgggtggcgttggaaaccgcgcccacatgcgataatattcgttatctgaaagcaaagcgggaaaagctgggccatttgttgaacctcataggagaagcaaaatga

SEQ ID NO: 49315 - protein, 406 aa, Coxiella burnetii RSA 493
MQKPFDNIETAIVALRQGKMIILVDDESRENEGDLIIAAEHATPEHINFMTLYGRGLICLPMCSSDFERLNIPMMTSRNGSRYETPFGVSIEAAYDVTTGISAHDRARTIQIAIDEKSTPEDIIMPGHMFPLKANDAGVLARAGHTEGSVDLCRLAGLKPAAVLCEILNKDGSMARLPDLQLLAKQFRLPLVSIQDLITYRINHETLIDEVSESLLPIKNRGRFTIKTFRSRVDHLEHVALVNQKIEEDKPCLVRVHSECLTGDVFGSARCDCGGQLEAALDEIATQGGVLLYLRQEGRGIGLANKIKAYALQEAGLDTVEANHHLGFGADLRDYGLAAQMLRVLGIREIRLLTNNPNKVESLTRYGISVAERVALETAPTCDNIRYLKAKREKLGHLLNLIGEAK

SEQ ID NO: 49316 - DNA, 678 bp, Streptomyces avermitilis MA-4680
  CDS (1)..(678): transl_table=11
atgcgcgactcacgcaacgccaccgcatccagtgacagcaggaatccgacaggcctgtcggcaaccacggtgcgcacccgcgtgacggtcccactccgcttcggcgacggctgtacagtgaccgccgacctcgccaccttccaccacctcgccgacgggcaggaacacgtggccgtcatcctcggcgaacccgccgctggccggcccccgctggtgcgcctgcactccgagtgcctgaccggcgacgtcttcggctcggcccgctgcgactgcggcccccagctgcgcgaggcgctcgagcgcatcgccgaccgcggaggcgtcctgctctacctccgccaggagggacgcggcatcggcctctacaacaagctcgacgcctacgccctccaggaccagggcctcgacacctacgaggccaacacgaccctcggcctccccgaggacgcccgcgactacaccgccgccgcgcagatgctcgccgccctaggcatctttgagctggacctgctgtccaacaatccggacaaggcggcccagctgcgcaccctgggcctaacggtgacccagcacgttcccacgggcgtgttcaccacggcccacaacatccgctacctccgtaccaaggtggtccgcactcagcacacactgccgctgacggaactgacggtgggctga

SEQ ID NO: 49317 - protein, 225 aa, Streptomyces avermitilis MA-4680
MRDSRNATASSDSRNPTGLSATTVRTRVTVPLRFGDGCTVTADLATFHHLADGQEHVAVILGEPAAGRPPLVRLHSECLTGDVFGSARCDCGPQLREALERIADRGGVLLYLRQEGRGIGLYNKLDAYALQDQGLDTYEANTTLGLPEDARDYTAAAQMLAALGIFELDLLSNNPDKAAQLRTLGLTVTQHVPTGVFTTAHNIRYLRTKVVRTQHTLPLTELTVG

SEQ ID NO: 49318 - DNA, 693 bp, Streptomyces avermitilis MA-4680
  CDS (1)..(693): transl_table=11
atgacagaaaactttggcgtactcggcgggactgcgcatctctcaggtgtcgaacgagtcgtgaatgcccccctgcccaccgtgtacggcgatttccatgccgtcggttacctcgaccacgatcgcggagaggagcaagtggccctggtgtacggcgagatcggtgacatcgggggcctcggcggtgtgcgtggcgccggggaggagggggtgctcacccggctccattcggaatgcctgacaggggacgccttcgggtccaggcactgcgagtgcggcccccaactcaccaccgccctgcgggagatcgtcgccgcggggcgcggcatcctcgtctacctccgcggccacgagggccgggggatcggcctgctcgccaagctgcgcgcgatgaagctccaggcggaggggctggacaccgtggaggcgaacctcgccctcggcctcccggtggacgcccgtgactacggggtggcggcgaagatcctgcacgacctcggggtgaggtccgtacgcctgctctccaacaacccgcgcaaactggagtcgctgctccagcacggcatcaacgtcgtcgaacaggttccgctgctgataccgccgtgcgaggagaacatcacctatctgcgcaccaagcgggagcggctcgaccacatcctgccgcacctggacgccgtggcccgctcctcctga

SEQ ID NO: 49319 - protein, 230 aa, Streptomyces avermitilis MA-4680
MTENFGVLGGTAHLSGVERVVNAPLPTVYGDFHAVGYLDHDRGEEQVALVYGEIGDIGGLGGVRGAGEEGVLTRLHSECLTGDAFGSRHCECGPQLTTALREIVAAGRGILVYLRGHEGRGIGLLAKLRAMKLQAEGLDTVEANLALGLPVDARDYGVAAKILHDLGVRSVRLLSNNPRKLESLLQHGINVVEQVPLLIPPCEENITYLRTKRERLDHILPHLDAVARSS

SEQ ID NO: 49320 - DNA, 708 bp, Streptomyces avermitilis MA-4680
  CDS (1)..(708): transl_table=11
atgcgtgatcttccgagcgccaccgtgcgcacccgcgtcaccgtcccgctgcgtttcggcgacggctacacggtcaccggcgaactggtgaccttccacggcctggccgacggccaggaacacgtggccgtcgtactcggcgagcccggcccgaacccattggtgcgactgcactccgaatgcctgaccggagacgtcttcggctcggcccgctgcgactgcggcccgcagctgcgcgaggcggtggagcggatagccgaccgcggcggtgtcctgctctacctccgccaggaaggccggggcatcggcctctacaacaagctcgacgcgtacgccctccaggaccagggcctggacacgtacgaggcgaacgcggccctcggcctgcccgaggacggccgcgactacacggcggccgcgcagatgctcggcgccctcggcatcgacgccctcgacctgctctccaacaaccccgacaaggcgggccaactgcgcgacctgggcctcacggtcaccgaccgcgtcccgacgggcgtcttcaccaccgcccagaacgtccgctatctgcgcgccaaggtcgtccacacccagcacacactgccgctgacggaactgacggagctcaccgagcgcgcggagcgggccggactggcgaagctcaccgaacggacgggcctgacggagatgacggaactgacggcaggctga

SEQ ID NO: 49321 - protein, 235 aa, Streptomyces avermitilis MA-4680
MRDLPSATVRTRVTVPLRFGDGYTVTGELVTFHGLADGQEHVAVVLGEPGPNPLVRLHSECLTGDVFGSARCDCGPQLREAVERIADRGGVLLYLRQEGRGIGLYNKLDAYALQDQGLDTYEANAALGLPEDGRDYTAAAQMLGALGIDALDLLSNNPDKAGQLRDLGLTVTDRVPTGVFTTAQNVRYLRAKVVHTQHTLPLTELTELTERAERAGLAKLTERTGLTEMTELTAG

SEQ ID NO: 49322 - DNA, 1290 bp, Streptomyces avermitilis MA-4680
  CDS (1)..(1290): transl_table=11
atgaccacggcgccgatcctgtacagcacggacaacatcgaggacttcgcgctcgacccggtcgagcgggccatcgccgacatcgcggccggccgcccggtcgtggtcgtcgacgacgaggaccgggagaacgagggcgacctcgtcatcgccgccgagaaggcgacccccgaaatcgtcgccttcatgatgagcgagtgccgcggcctgatctgcgcgcccatggagggcggcgaactggaccgcctccagctgccgcagatggtcgaccacaacaccgagtcgatgcggacggcgttcaccgtgtcggtcgacgcgagcggcgcgcacggggtcaccaccgggatctccgccgccgaccgcgcgaccacgctccggctgctcgcccagggagaggcgggggccgccgacttcgtccgccccggccacatcttcccgctgcgcgccaagcccggcggggtcctcgtccgcaacggccacaccgaggccgccgtcgacctcgcccgcctcgcgggtctgcgaccggccggcgcgatcgtcgagatcgccggcgaggacggccacatgctgcggctgccggagctgatcccgttcgcccgcaagcacggcctgacgatcatctccatcgaggacctgatcgcctaccgccagagctccgagcccaccgtccggcgcgaggccgaggtccatctgcccaccgccttcggcgagttcacggcctacggctaccgctccaccgtcgacggcgtcgaacacgtcgccctggtccacggcgagatcggcgacggcgagggcgtactcgtccgcgtccactccgaatgcctcaccggcgacgtcttccactcgctgcgctgcgactgcggcccccagctggaggcctccctggagcgcatccgcagcgagggccgcggcgtcgtggtctacctccgcggacacgagggacgcggcatcgggctggtgtccaagctgcgcgcgtacgagctccaggagcgcggccgcgacaccctcgacgccaacctggaactcggcctgcccgccgacgcccgcgactacgcggccggtgcgcagatcctggaggacctcggcgtccgcagcctgcggctgatgaccaacaaccccgacaagaccgacgcgctcctgaggcacggcctcaaggtcaccgggcgcgagccgatgcccgtacaggcgggcgagcacaacctccggtacctgaccaccaagcgggaccggatgggccacgatctgccctggctggacacggtccccgtgtccacctgcggcaaccagtaa

SEQ ID NO: 49323 - protein, 429 aa, Streptomyces avermitilis MA-4680
MTTAPILYSTDNIEDFALDPVERAIADIAAGRPVVVVDDEDRENEGDLVIAAEKATPEIVAFMMSECRGLICAPMEGGELDRLQLPQMVDHNTESMRTAFTVSVDASGAHGVTTGISAADRATTLRLLAQGEAGAADFVRPGHIFPLRAKPGGVLVRNGHTEAAVDLARLAGLRPAGAIVEIAGEDGHMLRLPELIPFARKHGLTIISIEDLIAYRQSSEPTVRREAEVHLPTAFGEFTAYGYRSTVDGVEHVALVHGEIGDGEGVLVRVHSECLTGDVFHSLRCDCGPQLEASLERIRSEGRGVVVYLRGHEGRGIGLVSKLRAYELQERGRDTLDANLELGLPADARDYAAGAQILEDLGVRSLRLMTNNPDKTDALLRHGLKVTGREPMPVQAGEHNLRYLTTKRDRMGHDLPWLDTVPVSTCGNQ

SEQ ID NO: 49324 - DNA, 1260 bp, Chlamydophila caviae GPIC
  CDS (1)..(1260): transl_table=11
atgatgaaatccgaaggtgatgcatctgcatcatgttttgtcccaatagaaaaggcgatagcagatatctctgaggggaaatttgttattgttgttgacgaagcttcgcgagaagatgaaggggatcttatcatcgcaggtgagaagataaccgtagaaaagatggcttttcttcttaaatatacgacaggaatcgtttgtgcttctttagaacaggaaagaataagagatttagaattcccccctatggttgaagacaatcgctgtcgttatcgtacagcgtttaccgtctcagtagatgctgcaaaaggcataacgacaggggtgtcagcagcagatagaacgaaagtcgtagaattattatccaatcctaatagccgtcccgaagattttgtccgtccgggacatttctttcccttggcaggtacgccggggggggtattgaaacgagctggacataccgaggctgctttagatcttatgcgtttagcaaatatgcagccttgtggcgtcctttcagaacttgttaatgaagaccataccatgatgcgtcttgctcaaattatagaatttgctaaggaacatgaaatctcagtaatctccatatctgatttgatagcctaccggatgctctccgaaaggttagttattcctgtttcctcagcgcgtcttcctacagaatatggagatttcaatattcatgtttacgagtctcttctcgatggtattcaacacatcgctttagtgaaaggtgatgttagcggcaaagagaacgttcttgtccgagtgcattccgaatgtcttacaggagatattatggggtcgatgcgctgtgactgtgggcatcagctgcgttctgctatggaatatatcggattagaaggggaaggtgttattgtttatctacgtggtcaggaaggacgtggtattggattaggtcataaggttcgtgcttacgccttacaagatcgcgggtatgacactgtcgatgctaatttagaaataggcttccctgtcgattctagagagtatgggataggggcgcagattttggttgatctaggattgacaaagataaaattgattactcataatcctcacaagtatttcggtctgcaagggtttgggttggaaattgttgataggatcgcgcttccaattcatgtttctgaagagaacgaacattatctgcgcacaaaaaaagagcgtatggggcactggatagacctcccctatgctgaggaagtaaacataagataa

SEQ ID NO: 49325 - protein, 419 aa, Chlamydophila caviae GPIC
MMKSEGDASASCFVPIEKAIADISEGKFVIVVDEASREDEGDLIIAGEKITVEKMAFLLKYTTGIVCASLEQERIRDLEFPPMVEDNRCRYRTAFTVSVDAAKGITTGVSAADRTKVVELLSNPNSRPEDFVRPGHFFPLAGTPGGVLKRAGHTEAALDLMRLANMQPCGVLSELVNEDHTMMRLAQIIEFAKEHEISVISISDLIAYRMLSERLVIPVSSARLPTEYGDFNIHVYESLLDGIQHIALVKGDVSGKENVLVRVHSECLTGDIMGSMRCDCGHQLRSAMEYIGLEGEGVIVYLRGQEGRGIGLGHKVRAYALQDRGYDTVDANLEIGFPVDSREYGIGAQILVDLGLTKIKLITHNPHKYFGLQGFGLEIVDRIALPIHVSEENEHYLRTKKERMGHWIDLPYAEEVNIR

SEQ ID NO: 49326 - DNA, 738 bp, Bacillus cereus ATCC 14579
  CDS (1)..(738): transl_table=11
atggttacaacagatacaattcatatgttagaagataaaattcaatttatacatcaagatggaaaggatatttatttagtaggacctatcaaattgccaattaatttatatggggagactaaaattttccaatggtattcttggttacaatgtagtgaggttacaaatagtgtagaaggaattatcaaaaaactctcatctattaatttagctgatatgcagcaatctagtgtgcttgtatatggtgattttgagaattctgaagatgccctaattcgtatgcatagtatttgtcacaccggtgatatctttggtagtaaacgttgtgactgtggattccaattaaagcagtctttacaaatgattacagaacatggttcaggtgctttattttacttagcgaatcatgaaggaagaggaattggtttgtttagtaaagcaatgacgtacctcttgcaagaaaatgggttagatacagtagaagctaatctgaacctaggctttgaagatgatgttcgaaactatgatgatacaattgaagtattaaaagcgctacgctcaaaacctgtaaaacttattacaaataatccgaaaaaattagaagcgttacaaaaagctggattaaatgttacgagtcgtgaaccgttatggggtgatatctcagagtttaatgagaaatatttgcaaacgaagattcagcgttctggacattttgaagggggacacttacatgcttga

SEQ ID NO: 49327 - protein, 245 aa, Bacillus cereus ATCC 14579
MVTTDTIHMLEDKIQFIHQDGKDIYLVGPIKLPINLYGETKIFQWYSWLQCSEVTNSVEGIIKKLSSINLADMQQSSVLVYGDFENSEDALIRMHSICHTGDIFGSKRCDCGFQLKQSLQMITEHGSGALFYLANHEGRGIGLFSKAMTYLLQENGLDTVEANLNLGFEDDVRNYDDTIEVLKALRSKPVKLITNNPKKLEALQKAGLNVTSREPLWGDISEFNEKYLQTKIQRSGHFEGGHLHA

SEQ ID NO: 49328 - DNA, 1194 bp, Bacillus cereus ATCC 14579
  CDS (1)..(1194): transl_table=11
atgtttcatcgtattgaagaagctctagaagatttaaaaaaaggtaaagtcgttatcgtatgtgatgatgaaaaccgagaaaatgaaggcgattttattgctttagcagagtacattacaccagaaacaataaattttatgattacacatggccgtggtctcgtttgtgtaccgattacggaaggatacgcagaacgtctacaattagaaccaatggtatctcataatacagattcacatcatactgcgtttacagtgagcattgaccatgtctctacaacaacagggattagcgctcacgaacgtgcaactacgatacaagaattgttaaaccccgcatcaaaaggtgctgatttcaatcgacctggacatatctttccattaattgcgaaagaaggcggtgtcctgcgtcgtgcaggtcatacagaagctgctgttgatttagcaaagctatgcggtgccgaaccagctggagttatttgcgagattataaatgaggacggcacgatggcacgtgtacctgatttaatagaatgcgcaaaacaatttgatataaaaatgattacaatagaagatttaattgcttaccgccgccatcatgaaacacttgtgacgagagaagcggaaattacattacctacagatttcggtactttccacgcaattggctattctaactcattagatacgaaagaacatatcgcacttgtaaaaggtgatatttcaacaggtgaaccggtacttgtacgtgttcattctgaatgcttaacaggagatgtattcggttcacatcgctgcgattgcggaccacaactccatgcagcacttgctcaaattgagcgtgaaggaaaaggtgttcttctttatatgaggcaagaaggaagaggcattgggcttcttaataagcttcgtgcttataaattacaagaagaaggattcgatactgtagaagcaaatgaaaaactcggcttccctgctgatcttcgtgattacggtatcggtgctcaaatattaaaagatttaggtttacagagtttacgattattaacgaataacccaagaaaaattgctggcttacaaggttacgatttagaagtagtcgagcgtgtaccgttgcaaatgccagcaaaagaagagaataaatcgtatttacaaacgaaagtaaacaaattaggacacttactaaacttataa

SEQ ID NO: 49329 - protein, 397 aa, Bacillus cereus ATCC 14579
MFHRIEEALEDLKKGKVVIVCDDENRENEGDFIALAEYITPETINFMITHGRGLVCVPITEGYAERLQLEPMVSHNTDSHHTAFTVSIDHVSTTTGISAHERATTIQELLNPASKGADFNRPGHIFPLIAKEGGVLRRAGHTEAAVDLAKLCGAEPAGVICEIINEDGTMARVPDLIECAKQFDIKMITIEDLIAYRRHHETLVTREAEITLPTDFGTFHAIGYSNSLDTKEHIALVKGDISTGEPVLVRVHSECLTGDVFGSHRCDCGPQLHAALAQIEREGKGVLLYMRQEGRGIGLLNKLRAYKLQEEGFDTVEANEKLGFPADLRDYGIGAQILKDLGLQSLRLLTNNPRKIAGLQGYDLEVVERVPLQMPAKEENKSYLQTKVNKLGHLLNL

SEQ ID NO: 49330 - DNA, 1194 bp, Bacillus anthracis str. Ames
  CDS (1)..(1194): transl_table=11
atgtttcatcgtattgaagaagctctagaagatttaaaacaaggaaaagtcgttatcgtatgtgatgatgaaaaccgtgaaaacgaaggcgattttatcgctttagcagagtatattacgcccgaaacaattaactttatgattacacatggacgcggtctcgtttgtgtaccgattacggaaggatacgcagaacgtctacaattagaaccaatggtatctcataatacagattcgcatcatactgcatttacagtgagcattgaccatgtttctacaacaacaggcattagcgctcacgaacgtgcaactacaatacaacaattgttaaatcctgcatcaaaaggtgctgatttcaatcgacctggacatatctttccattaatcgcgaaagaaggcggtgtcctgcgtcgtgctggtcatacagaagctgctgtcgatttagcacagctttgcggagcagaaccagctggagtcatttgcgagattatcaatgaggacggtacgatggcacgcgtccctgatttactacagtgtgcaaaacaatttgatataaaaatgattacaatagaagatttaattgcttatcgccgccatcatgaaacacttgtgacgagagaagtggaaattacattacctacagatttcggtacttttcaagcaattggctattctaactcattagatacgaaagaacatattgcactcgtaaaaggtgatatttcaacaggtgagcctgtacttgtacgcgttcattcagagtgcttaacaggagatgtatttggctcgtgccgctgtgattgcggaccacaactccatgctgcacttgctcaaattgaacgtgaaggaaaaggcgttcttctttatatgagacaagaaggacgaggcattggccttcttaataagcttcgcgcttataagttacaagaagaaggcttcgatactgtagaagcaaacgaaaaacttgggtttcccgctgaccttcgtgattacggtatcggcgctcaaatattaaaagatttaggtttacaacatttacgattattaacgaataatccaagaaaaatcgctggcttacaaggttacgatttaaccgttacggagcgcgtaccgttgcaaatgccagcaaaagaagagaataaaacgtatttacaaacgaaagtaaacaaattaggacatttattaaacttataa

SEQ ID NO: 49331 - protein, 397 aa, Bacillus anthracis str. Ames
MFHRIEEALEDLKQGKVVIVCDDENRENEGDFIALAEYITPETINFMITHGRGLVCVPITEGYAERLQLEPMVSHNTDSHHTAFTVSIDHVSTTTGISAHERATTIQQLLNPASKGADFNRPGHIFPLIAKEGGVLRRAGHTEAAVDLAQLCGAEPAGVICEIINEDGTMARVPDLLQCAKQFDIKMITIEDLIAYRRHHETLVTREVEITLPTDFGTFQAIGYSNSLDTKEHIALVKGDISTGEPVLVRVHSECLTGDVFGSCRCDCGPQLHAALAQIEREGKGVLLYMRQEGRGIGLLNKLRAYKLQEEGFDTVEANEKLGFPADLRDYGIGAQILKDLGLQHLRLLTNNPRKIAGLQGYDLTVTERVPLQMPAKEENKTYLQTKVNKLGHLLNL

SEQ ID NO: 49332 - DNA, 585 bp, Helicobacter hepaticus ATCC 51449
  CDS (1)..(585): transl_table=11
atgaaatatgaaatatcagaacaagccaaacttcctacgcgttttggtaacttttttactaaaagttttcgtgaatatgggaaaaataacactctttttgaacatcttgtagtttttacacatacacttggagaaactcctcttgtaaggattcactctgaatgtctcacaggcgatgtttttggttcaaaaaaatgtgattgtggtaatgaacttgccttagcaatggaacaaattgcgcacaataccgaaggtggaatgcttatttatttgcgtcaagaaggacgtggtattggattatttaataaaattaatgcttatgccctgcaagataaaggctatgacacagtggaggcaaatcaacaactcggatttgcaggtgatatgcgtagttacgaaattgtgggagaaatttttaaacattttcatattacacacatcaatcttcttacaaataatccgcgtaaaatagacgcattagcaccttatgcaaaagttgtgcgtcatagcattatcacgccaagcaatccccataatcaagcatatttggaagtcaaaaaacaaaagcttgggcacttgctctaa

SEQ ID NO: 49333 - protein, 194 aa, Helicobacter hepaticus ATCC 51449
MKYEISEQAKLPTRFGNFFTKSFREYGKNNTLFEHLVVFTHTLGETPLVRIHSECLTGDVFGSKKCDCGNELALAMEQIAHNTEGGMLIYLRQEGRGIGLFNKINAYALQDKGYDTVEANQQLGFAGDMRSYEIVGEIFKHFHITHINLLTNNPRKIDALAPYAKVVRHSIITPSNPHNQAYLEVKKQKLGHLL

SEQ ID NO: 49334 - DNA, 1221 bp, Rhodopirellula baltica SH 1
  CDS (1)..(1221): transl_table=11
atgtcatcctcgattgagttgaacacgattcccgaagccgtcgaagccatcgcgcgaggcgaagtcatcatcgtgatcgacgcggaagaccgtgaaaacgaaggtgacttcatttgtgcaggcgaaaaagccacgcctgagttaatcaatttcatcctgggcgggcgtggacagttgtgtgtttcggttctgccggaagtctgcaaacgcttggaattgaccccggttgtgccgcaaaacaatgccccgctgcagacggcattcatgactccaatcgacatcgcaaccgcgaaaacggggatcaccgcggccgaacgtagcgaaacgattcgtcggttgaccgacttggaagccacccaagaagacttcgtgcgtcccggtcacgtgtacccgttattggccaaagaaggcggcgtgctgcggcgggccggccacaccgaagccgcaatcgacctgtctcgcatggccgggttggctcccgtcggtgttctgtgcgaggtcttgaacgaaaccggcgaccgcgcctcccgcgacgatctggctcgactggccaaacaacacgatttgaaaatcatcagcatcgaacacttgatcgcacatcggcgagttagcgaaaaactcgtcagccgcgccgccacgtcaaaactgccgacccgatatggcgactttgaagtcatcgtttacgaagtcaactacgaagctcaagaaccgatcgcgttggtgtacggcgacctgaccgcacccggcacaccaccgctggttcgaatgcacagcagttgcttcaccggcgatttaatccaatccctgcgttgcgattgcggcgaccagcttcacatggcactggacatgatcagtcgcgaaggccgtggtgcgttgatctacttgcctcaagaaggtcgcggcattggtttggcgcaaaagattcgtgcgtatgcattgcaagacaaaggcatggacaccgtcgaagccaaccacgctcttggattcaaagccgatatgcgtgactacggtgtgggtcttcagatcctcaaagaccttggtttgtcagaagtccgtctgctcaccaacaatccaaagaaaacgaaggcattcaacctccgtggctttgacctgaaagttgtcgaccaagtgccgatcgttccaccaaccaacgaacacaatgttcgctatttggaaacgaaacgtgaaaaaatgggtcaccagttgcctccgttgtcgtga

SEQ ID NO: 49335 - protein, 406 aa, Rhodopirellula baltica SH 1
MSSSIELNTIPEAVEAIARGEVIIVIDAEDRENEGDFICAGEKATPELINFILGGRGQLCVSVLPEVCKRLELTPVVPQNNAPLQTAFMTPIDIATAKTGITAAERSETIRRLTDLEATQEDFVRPGHVYPLLAKEGGVLRRAGHTEAAIDLSRMAGLAPVGVLCEVLNETGDRASRDDLARLAKQHDLKIISIEHLIAHRRVSEKLVSRAATSKLPTRYGDFEVIVYEVNYEAQEPIALVYGDLTAPGTPPLVRMHSSCFTGDLIQSLRCDCGDQLHMALDMISREGRGALIYLPQEGRGIGLAQKIRAYALQDKGMDTVEANHALGFKADMRDYGVGLQILKDLGLSEVRLLTNNPKKTKAFNLRGFDLKVVDQVPIVPPTNEHNVRYLETKREKMGHQLPPLS

SEQ ID NO: 49336 - DNA, 1206 bp, Haemophilus ducreyi 35000HP
  CDS (1)..(1206): transl_table=11
atgtttcaattttcaacagtagatgaagccttagcagcaattgcggcgggcaaaattattttagtttctgatgatgaaaaccgtgagaatgaaggcgatttcatttgtgccttagaatttgctacaccagaaaatattaattttatggcgacttatggcaaaggtttgatttgtacgccaatttcacaagcgctagcggataaattaagttttcatccaatggtaacaaataatacggataatcatgaaacagctttcactgtatccgttgatcatattaatacgggcaccggtatttcagcctttgaacgctcactgaccgcattaaaaatgcttgagcaaaatgcacaagcggctgattttcgtcgcccagggcatatgttcccactgattgctaaagaggggggcgtgttggtacgtaatggccatacagaagcaacagtcgatttagcgcgcttagcaggcttaaagcctgcaggcttatgttgtgaaatcatggctgatgatggcactatgatgactatgccacaattgcaagccttagccgttaaacataatatgccttttattaccattgcgcagctacaagaatatcgccgtaaatatgacagcttggttaaattggtttcagttgtgaaaatgccgactaaatatggtgaatttatggcgcatagttttgttgaagtgatttcaggcaaagaacatatcgctttagtaaaaggcgagattggtgatggtcaagccgtattagcacgtatccattcagaatgcttaaccggcgatgcctttggttctcaacgttgtgattgtggccaacaatttgctgcagcaatgacgcaaattgagaaagaagggcgaggcgttgtattatatttacgccaagaaggtcgcggtattggtttaattaataaattacgtgcctatgaactacaagataaaggtatggatacggttgaggcaaaccttgcgctaggttttaaggaagatgaacgcgaatactatattggtgcgcagattttccaagccttaggcgtgaaatccactcgcttattgaccaataatccagccaaaattagtggcttaaaacaacaaggcttaaatattatcgcacgtgagccaattattgttgaaccaaaccaaaatgatattgattacttgaaagtaaaacagatcaaaatggggcatatgtttaactttgaacaatag

SEQ ID NO: 49337 - protein, 401 aa, Haemophilus ducreyi 35000HP
MFQFSTVDEALAAIAAGKIILVSDDENRENEGDFICALEFATPENINFMATYGKGLICTPISQALADKLSFHPMVTNNTDNHETAFTVSVDHINTGTGISAFERSLTALKMLEQNAQAADFRRPGHMFPLIAKEGGVLVRNGHTEATVDLARLAGLKPAGLCCEIMADDGTMMTMPQLQALAVKHNMPFITIAQLQEYRRKYDSLVKLVSVVKMPTKYGEFMAHSFVEVISGKEHIALVKGEIGDGQAVLARIHSECLTGDAFGSQRCDCGQQFAAAMTQIEKEGRGVVLYLRQEGRGIGLINKLRAYELQDKGMDTVEANLALGFKEDEREYYIGAQIFQALGVKSTRLLTNNPAKISGLKQQGLNIIAREPIIVEPNQNDIDYLKVKQIKMGHMFNFEQ

SEQ ID NO: 49338 - DNA, 1641 bp, Prochlorococcus marinus subsp. marinus str. CCMP1375
  CDS (1)..(1641): transl_table=11
ttgacagcaacaaattccctaaatatagcctttgatcagatagcagatgctttagctgctattcgcaatggagagtgtgttgtagttgttgatgatgaaagcagggagaacgaaggagatttaatttgcgctgcacagtttgccactccacaacaaataaattttatggccactgaagcaagaggattgatttgtcttgctatggatggggaaagattagaccaacttgatcttccacttatggttgatagaaatacagattccaatcaaacagcattcactgtaagcatagatgcagggcctgaatatggagtatcaacaggtatttcagctgaagatagggcaagaacgattcaagtggctataaaccctcaaacaaagccaaataggttaagaagacccggacatgtttttcctttgagagcaaataaaggaggcgttttaaaaagggcaggacatacagaagcagctgtagatctttcacttttatctgggttatcagcggcgggggttatttgtgaaattcaaaatgcagatggttctatggctcggttaccagaactaacaaaatatgcaaaaacatggggtctaaaaataataagcattgcagacttaataagattcagattagaaaatgaaagatttgtctataggaaagcaaaaacaagattgccaagtatattcggtgacttccaagcaataggctataccaatgaactagatggcacagaacatattgcactagtgaaaggcaacataaatgaattgaaagaaccagttttagtaagaatgcactctgaatgtttaacaggagatgcttttggctcgcttaggtgtgactgtcgaccacaactagaagctgctctaaatcttatatctgaagaaggagaaggcgtcgttgtttacttacggcaagaaggtagaggtattggactaataaataaacttaaggcatatagtcttcaagatggaggattagatactgttgaagcaaatttaaaacttggctttgctgcagatttgcggaactatggagttggcgctcaaatactcaccgatcttggtatcaatagacttagattattgacaaacaatcctcgaaagattgctgggctaggaggatacgggttacgcgtggaaagtagggagccattagttattaatcctactgattataatgctaattatttagcaattaaaagaactaaacttggccactatatcggtaatgatgatgattcggggaaatattatgttatctactggaaaggaatagtttcttctaatatgttgtcagcctataaaaacaaagcagagcaaatagcctcagataataaagtagagttaaatccagagtcctcatccagattactggcattactccaaaggcctcagtttgtttggagggtacaaaattgtattgattttgaatctataattaatctattaaaagaaattataaaatgggacggtactaaaagtataggtatctttataacaaatagcaaagaacaagctattcatccttcacaagatgtagaaactatacttgaaaatatatccaatttaaaagatactaattacaaaaatatagctaatatcaatgataaggatctaccatttattatgacttggcaataa

SEQ ID NO: 49339 - protein, 546 aa, Prochlorococcus marinus subsp. marinus str. CCMP1375
MTATNSLNIAFDQIADALAAIRNGECVVVVDDESRENEGDLICAAQFATPQQINFMATEARGLICLAMDGERLDQLDLPLMVDRNTDSNQTAFTVSIDAGPEYGVSTGISAEDRARTIQVAINPQTKPNRLRRPGHVFPLRANKGGVLKRAGHTEAAVDLSLLSGLSAAGVICEIQNADGSMARLPELTKYAKTWGLKIISIADLIRFRLENERFVYRKAKTRLPSIFGDFQAIGYTNELDGTEHIALVKGNINELKEPVLVRMHSECLTGDAFGSLRCDCRPQLEAALNLISEEGEGVVVYLRQEGRGIGLINKLKAYSLQDGGLDTVEANLKLGFAADLRNYGVGAQILTDLGINRLRLLTNNPRKIAGLGGYGLRVESREPLVINPTDYNANYLAIKRTKLGHYIGNDDDSGKYYVIYWKGIVSSNMLSAYKNKAEQIASDNKVELNPESSSRLLALLQRPQFVWRVQNCIDFESIINLLKEIIKWDGTKSIGIFITNSKEQAIHPSQDVETILENISNLKDTNYKNIANINDKDLPFIMTWQ

SEQ ID NO: 49340 - DNA, 600 bp, Candidatus Blochmannia floridanus
  CDS (1)..(600): transl_table=11
atgcaattaaaacgcgtagcagaagcaaaactaccaacattttggggagactttttaataataggatttaaagaaaatcaaacagaacacaatcatattgctttaacatatggtgatcttacaggatcaaatccagtactaacacgcatacattctgaatgtttaacaggtgatgcactatttagttctagatgtgattgtggtattcaattaagtacagcattacgttatattacggaagaaggccaaggtatattgatatatcatcgacaagaaggacgtaatattggtctactcaataaaattcgtgcttattccttacaagatcatggagcagatactgtagaagcaaatcaatgcttaggttttaatgcagatgaaagagatttcacagtatgtgcagatattttaaaattattgaacatacaaactattcgccttttgacaaataatcctcaaaaaatagaaatattaaataaatcccatatcatagttacggaaagagttccgctaatagtaggaagaaatcctaaaaattcaaaatatctagatacaaaagcactaaaattaggacatttattttcttcctactacaaataa

SEQ ID NO: 49341 - protein, 199 aa, Candidatus Blochmannia floridanus
MQLKRVAEAKLPTFWGDFLIIGFKENQTEHNHIALTYGDLTGSNPVLTRIHSECLTGDALFSSRCDCGIQLSTALRYITEEGQGILIYHRQEGRNIGLLNKIRAYSLQDHGADTVEANQCLGFNADERDFTVCADILKLLNIQTIRLLTNNPQKIEILNKSHIIVTERVPLIVGRNPKNSKYLDTKALKLGHLFSSYYK

SEQ ID NO: 49342 - DNA, 1734 bp, Prochlorococcus marinus subsp. pastoris str. CCMP1986
  CDS (1)..(1734): transl_table=11
atgaaagaaacaagtcccaaatcaaataatggaacaattgtggataataacgaaaattttaatatagaatttgatcccataagcgatgcattagctgccataagaaatggagaatgcataattgttgttgatgatgagagaagagaaaatgaaggcgatttaatttgtgccgctcagtttgcaactcctcaacaaattaattttatggcaacagagggtagaggtttaatatgtttagcaatgcaaggagagaagttagatgccttagatcttcctttaatggttgataggaatacagatgaaaatcaaactgcatttactatttcaatagatgcaggtcctgagaataatgtaactactggaatatcagcagaggatagagctaaaactatccaagttgcaataaatccttcaactaagccagaagatttaagaagaccaggacatatatttccactaagagcaaaaaaaggaggagtattaaaaagagctggacataccgaagcagctgtagacattgctgctatgtctggtctttatcctgctggtgtgatttgtgaaattcaaaatccagatggttcaatgtcaagacttccacaacttaagcaatatgcaaaagaatggggcatgaagctaatatccattgcagacctaatcagttatagatttcaaaacgaaagatttgtttatagaaaatctgacgcaatcctccctagtattttcggtaattttaaggcatatggatacataaatgaacttgacggttctgaacatattgcactagtaaagcaaaagtcaaataaattgagtgaaccagtattagtaaggatgcattcagaatgtttaaccggtgatgcttttggatcactacgttgtgattgtagaccccagttagaggccgcgttagcaaggattgaaaaagaagaagagggtgtggttgtttatttaagacaagaaggaagaggtattggtttgattaataaattaaaagcatacagtttacaagatggtggtttggatactgtagaagcaaatgaaaaattgggttttcctgcagacctaagaaattatggagttggagcacaaatattaactgaccttgggatcaaaaagttaaaactacttacaaataatcctaggaaaattgctggattaggtggatatggaatagaagttacagagagagtcccattagtgatatgtcctggagagcataattctgaatatctaaatgttaagagacaaaaacttggacatatgttggaagaagaaaaattaaattcaatagatatagatccttatattgctattttcctagatggtgactataaatcaatagatttagttcctatcaaaaataaaataattgaattctgcgaaaaaaataaaataaatattatgttagaaagctctcctagactattagcattttggaatagacctaaattagtatggaaaatattgcatgacaaaaacagagaagatttcactattaacgataatgaaattaataagattgaaatttttattaaatttttatcagaatataataaaagttcaaaagtaggaattatcgtatcaaaaaatattcaacaggctttacatccaaaaaacagtattaaattaaaaaataccaagttttcaataaagaatgaagaattacactcatccactaggaaatttaatctcgataaagaaacgttcagtattatatttgataaaaaattatcttaa

SEQ ID NO: 49343 - protein, 577 aa, Prochlorococcus marinus subsp. pastoris str. CCMP1986
MKETSPKSNNGTIVDNNENFNIEFDPISDALAAIRNGECIIVVDDERRENEGDLICAAQFATPQQINFMATEGRGLICLAMQGEKLDALDLPLMVDRNTDENQTAFTISIDAGPENNVTTGISAEDRAKTIQVAINPSTKPEDLRRPGHIFPLRAKKGGVLKRAGHTEAAVDIAAMSGLYPAGVICEIQNPDGSMSRLPQLKQYAKEWGMKLISIADLISYRFQNERFVYRKSDAILPSIFGNFKAYGYINELDGSEHIALVKQKSNKLSEPVLVRMHSECLTGDAFGSLRCDCRPQLEAALARIEKEEEGVVVYLRQEGRGIGLINKLKAYSLQDGGLDTVEANEKLGFPADLRNYGVGAQILTDLGIKKLKLLTNNPRKIAGLGGYGIEVTERVPLVICPGEHNSEYLNVKRQKLGHMLEEEKLNSIDIDPYIAIFLDGDYKSIDLVPIKNKIIEFCEKNKINIMLESSPRLLAFWNRPKLVWKILHDKNREDFTINDNEINKIEIFIKFLSEYNKSSKVGIIVSKNIQQALHPKNSIKLKNTKFSIKNEELHSSTRKFNLDKETFSIIFDKKLS

SEQ ID NO: 49344 - DNA, 1905 bp, Prochlorococcus marinus str. MIT 9313
  CDS (1)..(1905): transl_table=11
atggaggtggggatggtcctcaagcaatctgatggtttgaagaccgccgtagcccgtagcgccgataaccgctactcggctgcctcgaacctgagaaatgtcagaggctggagagcgagggggactttccattgccttcatcggacgccggctgatcgtactggtgtcgataatgaacccagtacgttcatccctaaggccctgaggacatctcctatacccgctgaatcggtcgagatccgcttcgacgaaatttctgatgcacttgccgcgatccgaaacggtgaatgcgttgtggttgttgatgatgagcgcagagaaaacgagggcgacctaatttgtgctgctcagttcgctacgcctgagcaaatcaatttcatggccacagaggctcgtggtctgatctgccttgcgatgcaaggcagtcgcctagatcaacttgacctgccgctgatggttgatcgcaacacagatgccaaccaaacggcttttaccgtaagcatcgatgcagggcctgaaaaaggggtttctaccggtatttcagcggaggatcgagcgcgcacgattcaagtggccctacatccggagactcgtccaagagacctacgccgcccaggacatattttcccccttagagcgagtcaaggaggtgttctcaaaagggctggacatacagaatccgccgtggatttgtcacagctggcagggcttgctccagctggcgtgatctgcgagatccaaaactcagacggatcaatggcaagactgccgcaattgcaaaactatgcgcggcgttggggactcaagctcatcaacatcgccgatctgattcgttaccgtcttgagaacgaacgctttgtataccgtcaagccactgccgatttaccaagtctctttggcagttttcaggcaatcggctatttaaatggtttggatggatcggaacacattgctcttgtcaagggcgatccacgaaaactgaaagaaccagttttagtgcgcatgcactccgaatgtcttacgggagatgcttttggatcactgcgctgcgattgtcgcccccaacttgaggcagcgttagctcgcatcgaacaagaaggtgaaggcgtggttgtttatctccgccaggaaggtcgcggcattggactaattaacaaattaaaggcctatagccttcaagatggcggtctagacactgtggaagccaatgaaagtttgggtttccctgcagatctgcgcaactatggggttggtgctcaaattctcactgaccttggcatccaccgtttacgtctacttacaaacaacccacgcaaaattgctggactgggtggatatggcttacaagtcgaaagtcgtgtccccctagtgatctgtcctggagatcacaacgccgcttatttagctgttaagcgggaaaaacttggacacttgattgatgctggcaaatcagagaataaagctccagaagttggaccttttgttgtggttgcctgggacggtgaggtgaacggagagacgttggctaagctgaggacccgtgcacatgattgggccaaaagcaatgaacttgagctcatagcagaaagctcaccccgtctacttgctctatgggatcgccccctttttgtatggcgtgtatgtccacgagtcaaaacctcttctgaggtttcatcagatccacttaaaaaagcatcgctggagttactgcttcaagagttgattcaatggtcagggagccgtcgaattggtcttctgcgtactgaccgtgctgagcaagcaatgcatcctcctcaggatctaaagagagaagagcgttcgttggcaacactatttaaagatgatttttcaccactaaaagattgggatgccacgagctttcccaatctgatcctttggtcgtga

SEQ ID NO: 49345 - protein, 634 aa, Prochlorococcus marinus str. MIT 9313
MEVGMVLKQSDGLKTAVARSADNRYSAASNLRNVRGWRARGTFHCLHRTPADRTGVDNEPSTFIPKALRTSPIPAESVEIRFDEISDALAAIRNGECVVVVDDERRENEGDLICAAQFATPEQINFMATEARGLICLAMQGSRLDQLDLPLMVDRNTDANQTAFTVSIDAGPEKGVSTGISAEDRARTIQVALHPETRPRDLRRPGHIFPLRASQGGVLKRAGHTESAVDLSQLAGLAPAGVICEIQNSDGSMARLPQLQNYARRWGLKLINIADLIRYRLENERFVYRQATADLPSLFGSFQAIGYLNGLDGSEHIALVKGDPRKLKEPVLVRMHSECLTGDAFGSLRCDCRPQLEAALARIEQEGEGVVVYLRQEGRGIGLINKLKAYSLQDGGLDTVEANESLGFPADLRNYGVGAQILTDLGIHRLRLLTNNPRKIAGLGGYGLQVESRVPLVICPGDHNAAYLAVKREKLGHLIDAGKSENKAPEVGPFVVVAWDGEVNGETLAKLRTRAHDWAKSNELELIAESSPRLLALWDRPLFVWRVCPRVKTSSEVSSDPLKKASLELLLQELIQWSGSRRIGLLRTDRAEQAMHPPQDLKREERSLATLFKDDFSPLKDWDATSFPNLILWS

SEQ ID NO: 49346 - DNA, 1704 bp, Synechococcus sp. WH 8102
  CDS (1)..(1704): transl_table=11
atggcgacgtccaaccaacagttgatcgtacagagattgataatgatggaattgcagtacggcaggcttctgaactccagttcccagcatcagcaggacgatccgatccgcttcgatgacatcgccgaggcgttggccgccattcgcaatggtgcctgtgtggtggtggtcgatgacgagcagcgtgaaaacgaaggcgatctgatctgcgccgctcaattcgccacaccggaagcgatcaatttcatggcgaccgaggcccgcgggctgatctgtctggccatggaggggaagcggctggacgagcttgatcttcccctgatggtggatcgcaacaccgatgccaacgaaacggccttcacggtgagcatcgatgcgggggctgagcacggcgtcagcactggaatctctgcggaggatcgtgcccggacgattcaggttgccctcaatcccaagacgcgacctgcggagctgcgacgaccgggacacatttttccgctgcgggccaagcctggcggcgtgttgaaacgcgccggacacacggaagcagctgttgacctggcccagcttgcgggtcttacaccctccggcgtgatctgcgagatccagaacagcgatggctccatggcccgtctgccggaactgagggcttacgccgatacctggggcttgaagctcatcagcatcgctgaactgatccgctatcggctcgacaacgaacggtttgtgcgacggcaggcccatgcggaactgccgagtcagttcggttcgttccaggccattggctactgcaatgaactggatggctcggaacatgtggccctcgtcaaaggtgacccggcctccctgcgtgaaccggtgctggtgcggatgcattcggaatgcctcaccggtgatgccttcggatccctgcgctgcgactgccgccctcagctggaggcagcactgcgccaaatcgaacgtgagggggaaggtgtggtggtttacctacgccaggagggtcgcggcatcggtctgatcaacaaacttcgcgcctacagccttcaggatggaggccttgacaccgttgaggccaacgaacggctggggttccccgctgacttgcgcaactacggggtgggagcgcagatcctctcagatctcggcatccatcgcttgcgactgctgaccaacaacccccgcaagatcgctgggctcgggggctatggacttcaggtggaagaacgggtccccctggtgatggatgccggtgatcacaacgccgactatctggctgccaagcgcgacaaactcggccatctcatggacagcgatggtccctgcaccgttctcgccgtcgcggtgaacgatcgaacggagagcctgccctcgatccgctcccgtgtggaagatctcgctgagacccacggccaaaccctggaagcgctgcatgagccgcgcttgctggcgctctgggaccgtccccagttcgtctggaagctcacgccggaggtggatgctccgctggcactgctgcagtcgattgcccagctggaatccacacaacgcattggtttgcttcgcgtcagcaccgagcgcagtgcgctccacccatcacaaacgctggaacgggaagagcgttccttggttgagctcatccagaccaatggggacgaacgtctgacgcaacgtccgtccctcctgcactggtcagccagggactga

SEQ ID NO: 49347 - protein, 567 aa, Synechococcus sp. WH 8102
MATSNQQLIVQRLIMMELQYGRLLNSSSQHQQDDPIRFDDIAEALAAIRNGACVVVVDDEQRENEGDLICAAQFATPEAINFMATEARGLICLAMEGKRLDELDLPLMVDRNTDANETAFTVSIDAGAEHGVSTGISAEDRARTIQVALNPKTRPAELRRPGHIFPLRAKPGGVLKRAGHTEAAVDLAQLAGLTPSGVICEIQNSDGSMARLPELRAYADTWGLKLISIAELIRYRLDNERFVRRQAHAELPSQFGSFQAIGYCNELDGSEHVALVKGDPASLREPVLVRMHSECLTGDAFGSLRCDCRPQLEAALRQIEREGEGVVVYLRQEGRGIGLINKLRAYSLQDGGLDTVEANERLGFPADLRNYGVGAQILSDLGIHRLRLLTNNPRKIAGLGGYGLQVEERVPLVMDAGDHNADYLAAKRDKLGHLMDSDGPCTVLAVAVNDRTESLPSIRSRVEDLAETHGQTLEALHEPRLLALWDRPQFVWKLTPEVDAPLALLQSIAQLESTQRIGLLRVSTERSALHPSQTLEREERSLVELIQTNGDERLTQRPSLLHWSARD

SEQ ID NO: 49348 - DNA, 618 bp, Chromobacterium violaceum ATCC 12472
  CDS (1)..(618): transl_table=11
atgtcgccgcacccgcaacccgctcccgaacccgtcatccagtatatcgccagctgcaagctgcccacgccgtggggcgaattcgtcatgcacggcttcgaggaagagagcggccaggagcatgtggcgctgacgctgggcgaggtgggcgacggcctgccggtgctggcgcggcttcactcggagtgcctgaccggcgacgcgctcttttctctgcgctgcgactgcggcttccagctggaggccgcgatggaggcgatcagcaaagccggccgcggcgcgctgctgtatttgcgccaggaaggccgcggcatcggcctgatcaacaagatccgcgcctacaagctgcaggatggcggcgcggatacggtggaagccaatgaaaggctgggtttcccagccgacatgcgcgatttccgcattgcccgccacatgctggcgcatctgggcatcggcagcgtcaaggtgatgaccaacaatccgcgcaagctggccacgctggaagcggccggcatcgcggtggtggagcgtgtgccgctgcaagtggggcgcaatccgtataatgaccgttacctggacaccaaggccgccaagctgggccacatgctgctcaagtaa

SEQ ID NO: 49349 - protein, 205 aa, Chromobacterium violaceum ATCC 12472
MSPHPQPAPEPVIQYIASCKLPTPWGEFVMHGFEEESGQEHVALTLGEVGDGLPVLARLHSECLTGDALFSLRCDCGFQLEAAMEAISKAGRGALLYLRQEGRGIGLINKIRAYKLQDGGADTVEANERLGFPADMRDFRIARHMLAHLGIGSVKVMTNNPRKLATLEAAGIAVVERVPLQVGRNPYNDRYLDTKAAKLGHMLLK

SEQ ID NO: 49350 - DNA, 1218 bp, Porphyromonas gingivalis W83
  CDS (1)..(1218): transl_table=11
atggaagaaatcaagctgaatactattgaagaagccctggaagacttcaaggaaggtaagttcctgatcgtcgtggatgatgaagatcgtgaaaatgaaggcgactttatcatcgcagcggagaagataacgccggataaagtgaacttcatgatgcaccacggccgcggcgtcctctgcgctcccatatccgaagagcgtgctcacgagctggagctggagatgcaagtgccggacaatacctcggtacacgagactccctttaccgttacggtagaccgcctcggcaatggctgtaccacgggtgtttccatgtacgaccgtgcacagacgattttggctctggccgatcccaacacacgtccgtcggatttgggacgtccggggcatatctgcccactccgtgcgcgcagccgtggtgttctgcgtcgggcaggacacacggaagcggctgtggatttggcacgtctatgcggcatgcaaccggctgcagccctcatagagattatcaatgaggacggtaccatggcacgtttgccacagctatgggaggtctccaagcgttttggactgaagatcattgccatcaaagatctgatagcctaccgcctcaaacaagaatccatcgtagaaaagggtgtagaagtggatatgcctaccgaatacggacacttccgactcatacctttccgtcaaaaatccaatggactggagcacatagctttgttcaaggggacgtgggacgaaaatgaaccgatactcgttcgtatgcactcatcctgtgccactggcgacatattcggatctatgcgttgtgactgtggcggccaattactgcaagcaatggagaagatcgagaaagaaggcaaaggagctatcatctatctgaatcaggaaggccgcggtatcggcctgatggaaaagatgaaagcttataagctacaggaacagggtatggatacgatagacgccaacctctgcctcggacacaaagccgatgaacgtgattatggcataggcgcccaaattctgcgtcttttgggtatcaagaaaatgcgcttgatgacaaacaacccggtcaaacgtatcggactggaagctttcggcttggagatcgtagaaaatatccccctggaaactgccccaaatcgctacaacgagttctatctgcgcaccaagaaagaacgtatggggcacgagctgcacaacatcaaataa

SEQ ID NO: 49351 - protein, 405 aa, Porphyromonas gingivalis W83
MEEIKLNTIEEALEDFKEGKFLIVVDDEDRENEGDFIIAAEKITPDKVNFMMHHGRGVLCAPISEERAHELELEMQVPDNTSVHETPFTVTVDRLGNGCTTGVSMYDRAQTILALADPNTRPSDLGRPGHICPLRARSRGVLRRAGHTEAAVDLARLCGMQPAAALIEIINEDGTMARLPQLWEVSKRFGLKIIAIKDLIAYRLKQESIVEKGVEVDMPTEYGHFRLIPFRQKSNGLEHIALFKGTWDENEPILVRMHSSCATGDIFGSMRCDCGGQLLQAMEKIEKEGKGAIIYLNQEGRGIGLMEKMKAYKLQEQGMDTIDANLCLGHKADERDYGIGAQILRLLGIKKMRLMTNNPVKRIGLEAFGLEIVENIPLETAPNRYNEFYLRTKKERMGHELHNIK

SEQ ID NO: 49352 - DNA, 570 bp, Wolinella succinogenes DSM 1740
  CDS (1)..(570): transl_table=11
atgacagcgctaaaagcctctcaaaaagccaagcttcccactcgacacggaatctttacgattcaagcgtttgcgcatgagggaaaagaacacttagccatcttctctgaccccttaccccccgtcccgcttcttcgagtgcactctgaatgcctcacgggtgatgtttttggcagcctcaaatgcgattgtggcagcgagctctccatcgccatggagcgaatcgccaaagagggcggaatcgcgctctatcttcgccaagaggggaggggaattggactctttcacaaggtcaatgcctacgcccttcaagatcaagggtatgacaccgttgaggcgaatctcgcccttggtttcaaggaagatgagcgaaactatgaggtggtcggtgagattttgagcttttatggaatcgatgaagtgaagctcctcaccaataaccccaaaaaggtggaggcgatgagccactttgtgaagattcactccagagaagcgattctagccccgcacaattgctacaatgaaaactatctcaaaaccaagcaagagaagctcggacacctgctttag

SEQ ID NO: 49353 - protein, 189 aa, Wolinella succinogenes DSM 1740
MTALKASQKAKLPTRHGIFTIQAFAHEGKEHLAIFSDPLPPVPLLRVHSECLTGDVFGSLKCDCGSELSIAMERIAKEGGIALYLRQEGRGIGLFHKVNAYALQDQGYDTVEANLALGFKEDERNYEVVGEILSFYGIDEVKLLTNNPKKVEAMSHFVKIHSREAILAPHNCYNENYLKTKQEKLGHLL

SEQ ID NO: 49354 - DNA, 1719 bp, Gloeobacter violaceus PCC 7421
  CDS (1)..(1719): transl_table=11
gtggccactggttttcactccgttcccgagatcctggacgaattgcgcgccggccgggcggtggtggtcgtcgacgacgagaaccgcgagaacgaaggcgatctcatctgtgccgcccagttcgcctcccccgaaatgatcaacttcatggccacccacgcccggggcctcatttgcctggcgatgaccgccgagcggctcgaccagttgcagttgccgctgatggtgagcgaaaacaccgaccgcaaccagacggcttttaccgtgagcatcgacgccggcccccacctgggggtgagcaccggcatctccgccgccgaccgggccaagaccatccaggcggccatcgattcgcgcacccgtgcaggcgacctgacccgccccggccacatctttccgatccgcgcccgcgagggaggcgtgctgaagcgcgccggtcacaccgaggcggcggtcgatctggcgcgcatggcggggctgtatccggccggggtgatctgcgaaatccagaaccccgacggttcgatgtcgcgcctgccggaactgctccagtacgcccgcaccttcaacctcaagattgtcaccatcgccgaaattatcgcctaccggctgcagaacgaacgcttcatcaagcgcgagacggtggcgatgctgcctaccgccttcggcaaattcgagatttttgcctaccgcgacaccctcgacggcaaggaacacgtcgccctggtgcgccgtccacccgcgggctcgggcctttttgacggggcgccgccttttgccggcagcgaggagccggtactggtgcgcgtccactccgaatgcctgaccggcgacaccttcggctcgctgcgctgcgactgccgccagcagttgcaggctgccctcaagatgatcgaccaccacggccagggtgtggtcgtctatctgcgccaggagggccgcggcatcgggctgatcaacaagctcaaagcttacgccttacaagatatgggcctcgacacggtcgaagcgaacgagcggctggggtttgccgccgatctgcgcagctatggcgtcggcgcccagatcctcaacgacctgggggtgcaccgcatgaaattgatcaccaacaatccgcgcaagatcgcgggcctgagcggctataacctcgaagtggtggaccgcgtgcccctcatcatcgaagagaccgactacaactccacctacctcaacaccaaagcccagaagctcgggcacctgctgccgggggtgcggcttttgacgctgggggtgctctggcgtcgggcgactatgcagccctacgacccggagcgctccaatcaagtcgaactgctgcgcgaactgtttggtcagcaggatctgctcatccaggaggagcgccgcccggtggcgagcgccgtctttgggccggacgccgtcgtggtgcacatcgggctcccttctgcgggcaacaagagccccaacgcttggtataccgacccgacgagtgcttgccgccgggcgatcttggccgctttggaggaacttgtgcagaacaacccaccgcaagtgctgcaatttttggtcagctccggagctgatccgctcaatcacctcagcgaacgccttcagcatcgcgaagaagatctagcatccctgccggatgccatcaaaggaccgctctcccccgagactgtctacatcttcaaagccgacgccacccaaccacccacctcctga

SEQ ID NO: 49355 - protein, 572 aa, Gloeobacter violaceus PCC 7421
MATGFHSVPEILDELRAGRAVVVVDDENRENEGDLICAAQFASPEMINFMATHARGLICLAMTAERLDQLQLPLMVSENTDRNQTAFTVSIDAGPHLGVSTGISAADRAKTIQAAIDSRTRAGDLTRPGHIFPIRAREGGVLKRAGHTEAAVDLARMAGLYPAGVICEIQNPDGSMSRLPELLQYARTFNLKIVTIAEIIAYRLQNERFIKRETVAMLPTAFGKFEIFAYRDTLDGKEHVALVRRPPAGSGLFDGAPPFAGSEEPVLVRVHSECLTGDTFGSLRCDCRQQLQAALKMIDHHGQGVVVYLRQEGRGIGLINKLKAYALQDMGLDTVEANERLGFAADLRSYGVGAQILNDLGVHRMKLITNNPRKIAGLSGYNLEVVDRVPLIIEETDYNSTYLNTKAQKLGHLLPGVRLLTLGVLWRRATMQPYDPERSNQVELLRELFGQQDLLIQEERRPVASAVFGPDAVVVHIGLPSAGNKSPNAWYTDPTSACRRAILAALEELVQNNPPQVLQFLVSSGADPLNHLSERLQHREEDLASLPDAIKGPLSPETVYIFKADATQPPTS

SEQ ID NO: 49356 - DNA, 609 bp, Photorhabdus luminescens subsp. laumondii TTO1
  CDS (1)..(609): transl_table=11
atgaacaataaaatgcaattaaaacgagtcgctgaggccaagttacccactccttggggtgattttttaatggtcggctttgaagaaatcgccacaggtcaagatcatgtcgcattagtatacggtactatttctggcaatgaacctgtgctttccaggatccattcagaatgtctgaccggtgacgccctgtttagtctgcgttgtgattgcggttttcaacttgaagccgcccttgctcaaattgctaaagaagggcgaggtgtattactttaccatcggcaagaaggtcgtaatattggcttaatcaacaaaattcgtgcttacgcgttacaggataacggtatcgatactgtagaagctaaccatcagttaggttttgccgccgatgagcgtgatttcaccttatgtgcagatatgtataaattactcggtattcaagctattcgtctgctgacaaataatcccaaaaaagtggaaattatgaccgaagcagggattaatatcgtagaacgtgttccattaattaccggccgaaatcctaagaatgcttattatttggatactaaagccagaaaaatgggtcatttgttatctgagcaaaattag

SEQ ID NO: 49357 - protein, 202 aa, Photorhabdus luminescens subsp. laumondii TTO1
MNNKMQLKRVAEAKLPTPWGDFLMVGFEEIATGQDHVALVYGTISGNEPVLSRIHSECLTGDALFSLRCDCGFQLEAALAQIAKEGRGVLLYHRQEGRNIGLINKIRAYALQDNGIDTVEANHQLGFAADERDFTLCADMYKLLGIQAIRLLTNNPKKVEIMTEAGINIVERVPLITGRNPKNAYYLDTKARKMGHLLSEQN

SEQ ID NO: 49358 - DNA, 597 bp, Photorhabdus luminescens subsp. laumondii TTO1
  CDS (1)..(597): transl_table=11
atgaataatatatcaattagaaatagtacttttataccgttgaaatctattaacaatgaatctgaatttatatcatttaatggatttacccaggataaagagcatttagctatacgtataggaaaatggtcagagaaacacatacctttggttaggatccattctgaatgtgtgacaggagaaatatttcactctcttttatgtgactgtggtgagcagttaaatgaatctttaaaagaaattgatattcatggaggagtcttaatttatttacgccaggaaggccgtggaattggattatataataaaatagatgcatataagctacagcgcaatgggttagatacataccaagctaatcaagctcttggtttcttagatgattatcgtgatttttctctcgcggctaaaatgttactggccatgaatatttcaaaaattcgtttgataactaataatccagataaaatacatcaaattactcagaatggaattgaaatatatgaagttattaataccaagacattcttaaatgaaaaaaataaaaattatttgactgctaaaaaaataaaaacctttcatgctcttgaactataa

SEQ ID NO: 49359 - protein, 198 aa, Photorhabdus luminescens subsp. laumondii TTO1
MNNISIRNSTFIPLKSINNESEFISFNGFTQDKEHLAIRIGKWSEKHIPLVRIHSECVTGEIFHSLLCDCGEQLNESLKEIDIHGGVLIYLRQEGRGIGLYNKIDAYKLQRNGLDTYQANQALGFLDDYRDFSLAAKMLLAMNISKIRLITNNPDKIHQITQNGIEIYEVINTKTFLNEKNKNYLTAKKIKTFHALEL

SEQ ID NO: 49360 - DNA, 1155 bp, Vibrio vulnificus YJ016
  CDS (1)..(1155): transl_table=11
gtgtctatcagcgttttagcgcttaaattgacaggaaatatcgctatgccaatcagtacaccccaagagatcattgaagacattcgtttgggcaaaatggtcatcttaatggacgatgaagaccgcgaaaacgaaggtgatttgattatggcggcggagcacattacgccagaagccatcaattttatggccaaatatggtcgcggtttgatctgtttgaccatgaccaaagagcgttgccagcgtcttggattaccaccaatggtgcaagataacaacgcgcaatacaccaccaacttcactgtttccatcgaagcggcggaaggcgtgacaacaggtatttcagcagcggatcgtgctcgtaccgtgcaagcggcagtcgcaaaagaagctaaagcggcagacttggtgcaaccggggcacattttcccattagccgcgcaagatggtggcgtattgactcgcgcgggtcataccgaggcaggctgcgaccttgctcgtttggcgggtttcgaaccagcctctgttatcgttgaaattctgaatgacgatggcaccatggcacgtcgccctgatttggaagtgtttgctgagcagcatggtctcaaactcggcaccattgccgatttgattgagtatcgaaacaacacggaaaccacgattgagcgcgttgctgagtgcaagctacccaccgagtttggtgagtttgatctggtgacttaccgcgacaccattgataatcaaattcactttgctttgcgtaaaggcactgtgggtgatcaaacaccactggttcgtgttcatttacaagacacctttaccgatttactgcgcagcgatcgcaatgctgagcgcagttggacgcttgataaagcgatgaagcgtattggccaagaagggggcgttctggtgattctggggaatgaagagtcgcctgagctgctgatccatcgcgtcaaaatgtttgaagctcaagacaaagaagaggcacccaaattggcgaagaagcagggcacttcacgtcgtgttggtgtcggctcgcaaattcttgcagacttaggtgtgcacgatatgcgtctactttcttccagcaacaagaaataccatgcccttggcggttttggtctgaacgttattgagtatgtgtgtgaataa

SEQ ID NO: 49361 - protein, 384 aa, Vibrio vulnificus YJ016
MSISVLALKLTGNIAMPISTPQEIIEDIRLGKMVILMDDEDRENEGDLIMAAEHITPEAINFMAKYGRGLICLTMTKERCQRLGLPPMVQDNNAQYTTNFTVSIEAAEGVTTGISAADRARTVQAAVAKEAKAADLVQPGHIFPLAAQDGGVLTRAGHTEAGCDLARLAGFEPASVIVEILNDDGTMARRPDLEVFAEQHGLKLGTIADLIEYRNNTETTIERVAECKLPTEFGEFDLVTYRDTIDNQIHFALRKGTVGDQTPLVRVHLQDTFTDLLRSDRNAERSWTLDKAMKRIGQEGGVLVILGNEESPELLIHRVKMFEAQDKEEAPKLAKKQGTSRRVGVGSQILADLGVHDMRLLSSSNKKYHALGGFGLNVIEYVCE

SEQ ID NO: 49362 - DNA, 648 bp, Vibrio vulnificus YJ016
  CDS (1)..(648): transl_table=11
atgtacaaaagagtcgttagattagacgtaaccaatcaagtgagtagagatatggcggaagttcgagccagagtcgattttaaagtcggtgcaaaaagtaatattgatgcggaaattctttcatttcgtggtttgaagaccgacaaagagcatgtggcagtcatctttaaatcggcagatgtgactcaagaagtccccctagttcgaatgcattctgaatgcctcactggggatgtgttccattcatctcgctgtgactgtggcgagcagttggaagagacgatcaatcgtatgggtgagtctggcggcatcattctttatcttcgccaagaaggtcgcgggatcggcctttacaacaaaatcgatgcttaccgtttgcaaagcgaagggatgaatacttacgaggccaataaccatcttggctttgatgacgatcttcgtgactttacggaagcggtacaaatgcttgaagcgttagggatcaaacagattcgattagtgaccaacaatcctaagaagattcgtgaactaagtgagtacgggatagagattgttgaagtggtcaacacttctgctcacatcaaagaaggcaatgaaagctacttaaaggcgaaagtctctcatggtaagcaccatttaaaagtgtaa

SEQ ID NO: 49363 - protein, 215 aa, Vibrio vulnificus YJ016
MYKRVVRLDVTNQVSRDMAEVRARVDFKVGAKSNIDAEILSFRGLKTDKEHVAVIFKSADVTQEVPLVRMHSECLTGDVFHSSRCDCGEQLEETINRMGESGGIILYLRQEGRGIGLYNKIDAYRLQSEGMNTYEANNHLGFDDDLRDFTEAVQMLEALGIKQIRLVTNNPKKIRELSEYGIEIVEVVNTSAHIKEGNESYLKAKVSHGKHHLKV

SEQ ID NO: 49364 - DNA, 1104 bp, Vibrio vulnificus YJ016
  CDS (1)..(1104): transl_table=11
gtgcattttgtttcttattctttgtgttatgacgtcaggagcaacatcatggagcaaccgatttatttctatgagccagatgaaaatcatggctttctcgccaacttctatccatgttcgatcaccgtttctgggacgtgctggccgagcagtgaacactactaccaagcacaaaaattcgacgatgtccggctacaggaaaaagtgctgagggcagaagatgctgcacaagcttttcggctttcacgcgaatatcagcagtggcaaaggcatgactggtatgacattcgagtagaagtgatgagattcattgtgcgcgagaaatttttgcaaaacacgcccctagcgcatcaactgcttgcgacgggagatactgaactgaaagaacattcgcataaggatgccttttggggggatgggggcgatgggcatggacgcaatgagctcgggcgtattttgatgatggttcgagaggagttgcaagagcacgcgccatacaatctggtgcagtttattgacagtgcgaagttgcctacccagtgggggacatttcaaatgtatggtttcattgaaaaagccaccgggaaagagcatttggcgctcgtgtatggggatattgaacaacaggcagcgcctttgattcgtctgcactctgagtgtttaacaggcgatgcgctgtttagtgcccgctgtgattgcggttttcagctcgccaaagccttgcaaaacatcgtggcagaaggggcgggcgtgttgctctatttgcggcaggaagggcgggggataggccttatcaataaaattcgcgcttatcacttacaagatgacggggccgacacggtggaagctaacgagcaacttggctttggcgccgatatgcgcgattacgcgttttgtcgcggcattctcagttttctcggcattgaacgtgtgaggctgatgaccaacaacccacgcaaggtgaaggcactgcaattggccaatattgaggtgacggagcgcgtgccgctgcaagaaggcaataatccgcacaatcatcagtatttaagaaccaaagccgataagctaggccacatgtttgatcgcaacttcgttaaaccttag

SEQ ID NO: 49365 - protein, 367 aa, Vibrio vulnificus YJ016
MHFVSYSLCYDVRSNIMEQPIYFYEPDENHGFLANFYPCSITVSGTCWPSSEHYYQAQKFDDVRLQEKVLRAEDAAQAFRLSREYQQWQRHDWYDIRVEVMRFIVREKFLQNTPLAHQLLATGDTELKEHSHKDAFWGDGGDGHGRNELGRILMMVREELQEHAPYNLVQFIDSAKLPTQWGTFQMYGFIEKATGKEHLALVYGDIEQQAAPLIRLHSECLTGDALFSARCDCGFQLAKALQNIVAEGAGVLLYLRQEGRGIGLINKIRAYHLQDDGADTVEANEQLGFGADMRDYAFCRGILSFLGIERVRLMTNNPRKVKALQLANIEVTERVPLQEGNNPHNHQYLRTKADKLGHMFDRNFVKP

SEQ ID NO: 49366 - DNA, 1239 bp, Corynebacterium diphtheriae NCTC 13129
  CDS (1)..(1239): transl_table=11
gtgactttggatagcatcgaaagggccatcgcggatattgcgaatggaaagcctgtggtcgtagtcgactcagaagatcgtgaaaacgaaggcgatttaatttttgcggctgataaagcaacgccagagttagtagcctttatggttcgatattcttcgggttatatatgtgcctctttgacgtcagaagagtgcgatcgacttcagcttccgccaatgacatcccataacgaggatgcgcggggtaccgcatatgccgtcacggtagacgcgaatacaggaacaactggtatttctgcaacaagtcgtgcagatacgttgaggaaacttgccgacagtcaattcggacctcaagatttcacgcgtcctggccatgtggttccactgcgtgcgaaagcaggaggtgtgcttgaacgggcagggcatactgaagcggctgtcgatctagctcgaatggctggcttgaatccagcaggcgtcctgtgtgaagtcgtcagcgaagatgatcccacagacatggcacgagcacctgaactacgacgatttgcggatcgacatgatcttgcacttatttcgattgaacagcttattgagtggcgacgtaggtacgaattacttgttgaacgagccgtgtcaacacaactgccaactgagttcggacggtttaccgcggtcggctatcgtggaatcgttgacggtgtagaacatattgcgctagttgcaggcgatattacttctgatgagggcaaggatgttctccttagagtccattctgaatgcttgaccggagatgttttgggttctcgtcggtgtgactgtgggccgcaattacaggcgtcccttcgtgctatttccgagcgagggcgcggagtcgtggtgtacttgcgtggacatgaaggacgtggaatcggattacttcacaagcttcaggcgtatcatctgcaagatgaaggggccgatacggttgacgcaaataaggcattaggcctaccagttgacgcccgtaattactctgttgctgcacacattctacgagatcttggcgtgcagtcggtatgtttgctgacgaataatccagaaaaatcccttgaactggaacgctatggggtcaaagtaactggacgagagcctgtcaaagtggaagtgcacgaagataatattcgttatttgaccacaaaacgggatcgaatgaaccatgatctgccatggattgccgaatacaaaaaggagcaaagctaa

SEQ ID NO: 49367 - protein, 412 aa, Corynebacterium diphtheriae NCTC 13129
MTLDSIERAIADIANGKPVVVVDSEDRENEGDLIFAADKATPELVAFMVRYSSGYICASLTSEECDRLQLPPMTSHNEDARGTAYAVTVDANTGTTGISATSRADTLRKLADSQFGPQDFTRPGHVVPLRAKAGGVLERAGHTEAAVDLARMAGLNPAGVLCEVVSEDDPTDMARAPELRRFADRHDLALISIEQLIEWRRRYELLVERAVSTQLPTEFGRFTAVGYRGIVDGVEHIALVAGDITSDEGKDVLLRVHSECLTGDVLGSRRCDCGPQLQASLRAISERGRGVVVYLRGHEGRGIGLLHKLQAYHLQDEGADTVDANKALGLPVDARNYSVAAHILRDLGVQSVCLLTNNPEKSLELERYGVKVTGREPVKVEVHEDNIRYLTTKRDRMNHDLPWIAEYKKEQS

SEQ ID NO: 49368 - DNA, 1203 bp, Geobacter sulfurreducens PCA
  CDS (1)..(1203): transl_table=11
atgccggttgcacgtattgaggaagcaattgaagatatccgccaaggcaagatggtgattctggtggacgatgaggaccgtgagaacgaaggcgacctgaccatggccgcggaaatggtgacccccgaggcgatcaacttcatggcccggttcgggcgggggctcatctgtctcaccatgacgaccgaacggtgcgatcatctccaactgccactcatggtttcggcaaacacttcctcgttcggcacggccttcaccgtatccatcgaggcaaaacggggggtgacaaccggcatctcagcggcggaccgggcccacaccattctgaccgctgttgccgatgacgcaaaggcagatgacctcgcccgtccgggccatgtgttcccgctgcgggccaagccgggcggagtgctcgttcgtgccggccaaaccgaaggctcggtcgatctggctcgtcttgccggactcaagcccgccggcgtcatttgtgagatcatgaacgatgacggcaccatggcgcgaatgccgcaactcaaggttttcgccaaggagcacggaatcaggatctgcaccatcgcggatctggtggcctatcggctcaagcacgagtccctggtgaggcgtgcggcagacgtgcttctgcccacggatttcggggaattcagggccattgcatttgagaacgacgttgaccgactggagcacttggcgctggttaagggagagatcaggggggatgagccggtgctcgtccgggtgcattccgagtgcatgaccggcgacgttttcggcagcctgcgctgcgactgcggcagccagctccatcgggctatggaaatgatcgaggccgaagggcgcggggtcatcctctacatgcgccaggaagggcgcggtatcggtctgttcaacaagttaaaagcctatgccctgcaggacgaagggaaagacacggtggaggcgaacctggccctgggcttcaagccggacctgcgtgattatggcatcggcgcccagattctcgtgaacctgggggtgcggaacatcaggcttctgaccaacaacccccgcaaactgatcggcctccagggttacggcatcaatatcgtggagcgagttcccatcgaaattccgcccaccactacgaatctcgactatctcaaggccaagcgcgaaaagctcggccatttgctggaaaatatctga

SEQ ID NO: 49369 - protein, 400 aa, Geobacter sulfurreducens PCA
MPVARIEEAIEDIRQGKMVILVDDEDRENEGDLTMAAEMVTPEAINFMARFGRGLICLTMTTERCDHLQLPLMVSANTSSFGTAFTVSIEAKRGVTTGISAADRAHTILTAVADDAKADDLARPGHVFPLRAKPGGVLVRAGQTEGSVDLARLAGLKPAGVICEIMNDDGTMARMPQLKVFAKEHGIRICTIADLVAYRLKHESLVRRAADVLLPTDFGEFRAIAFENDVDRLEHLALVKGEIRGDEPVLVRVHSECMTGDVFGSLRCDCGSQLHRAMEMIEAEGRGVILYMRQEGRGIGLFNKLKAYALQDEGKDTVEANLALGFKPDLRDYGIGAQILVNLGVRNIRLLTNNPRKLIGLQGYGINIVERVPIEIPPTTTNLDYLKAKREKLGHLLENI

SEQ ID NO: 49370 - DNA, 1278 bp, Mycobacterium avium subsp. paratuberculosis K-10
  CDS (1)..(1278): transl_table=11
atgacgaggttggactccgtcgaaagggcggttgccgacattgcggccggcaaggccgtcatcgtcatcgacgacgaagaccgggagaacgagggcgatctgatcttcgccgccgagaaggcgacgccggagatggtggcgttcatggtgcgctacacctcgggctacctgtgtgtgccgctggacggggcgatctgcgaccgcctgggcctgctgccgatgtatgcggtcaaccaggacaagcacgggaccgcttacacggtcacggtcgacgcgagaaacggtgtgggcaccgggatttcggcctcggaccgggccaccaccatgcgcctgctggccgatcccaccagcatcgccgaggatttcacccggcccggtcatgtggttccgttgcgcgccaaggacggtggcgtgctgcgccggcccggtcacaccgaggccgccgtggacctggcccggatggccggcctgcagccggccggcgccatctgcgagatcgtcagccagaaggacgagggctcgatggcgcagaccgacgagctgcgggtgttcgccgacgaacacgacctcgccatgatcaccatcgccgacctgatcgagtggcgccgcaagcacgagaagcacatcgagcgcatcgcggaggcccggatcccgactcggcacggcgagtttcgcgccatcggttacaccagcatctacgaggaggtcgaacacgtcgcgctggttcgcggcgagatcgccggccccaactccgacggcgacgacgtgctggtgcgggtgcactcggagtgcctgaccggtgacgtgttcggttcgcgccgttgcgattgcggaccccagctcgacgccgccatggccatggtggcccgtgaggggcgcggcatcgtgctgtacatgcgcgggcacgagggccgcggcatcgggctgatgcacaagctgcaggcctaccagctgcaggacgccggcgaggacaccgtcgacgccaacctcaaactcggattgcctgctgacgcaagggattacggaatcggcgcgcagatcctggtcgatctgggggtgcgttcgatgcggctgctgaccaacaaccccgccaagcgggtggggctggacggctacggtctgcacatcatcgagcgggtgccgctgccggtgcgcaccaacgccgagaacattcgttacctgatgaccaagcgcgataagatgggccacgatctggccggcctggacgattttcacgaatcggtccatctgccaggcgaattcggcggcgccctgtga

SEQ ID NO: 49371 - protein, 425 aa, Mycobacterium avium subsp. paratuberculosis K-10
MTRLDSVERAVADIAAGKAVIVIDDEDRENEGDLIFAAEKATPEMVAFMVRYTSGYLCVPLDGAICDRLGLLPMYAVNQDKHGTAYTVTVDARNGVGTGISASDRATTMRLLADPTSIAEDFTRPGHVVPLRAKDGGVLRRPGHTEAAVDLARMAGLQPAGAICEIVSQKDEGSMAQTDELRVFADEHDLAMITIADLIEWRRKHEKHIERIAEARIPTRHGEFRAIGYTSIYEEVEHVALVRGEIAGPNSDGDDVLVRVHSECLTGDVFGSRRCDCGPQLDAAMAMVAREGRGIVLYMRGHEGRGIGLMHKLQAYQLQDAGEDTVDANLKLGLPADARDYGIGAQILVDLGVRSMRLLTNNPAKRVGLDGYGLHIIERVPLPVRTNAENIRYLMTKRDKMGHDLAGLDDFHESVHLPGEFGGAL

SEQ ID NO: 49372 - DNA, 1083 bp, Wolbachia endosymbiont of Drosophila melanogaster
  CDS (1)..(1083): transl_table=11
atgtttataggaaatcagagtagcaataaggtagaaagagctatcagcgaaatcaggcgcggtcggccaattgtaatatatgatgaaagtaattacctattgtttgctgctgctgaggctttagaaagagatttatttaatcaatacaagcttacatcaagtaatgtatatgttactttaacttcaagtaaggtaaaatacatatctcagaataaagaacataacagcaaacgtctgttggtgaataattttgatgaactgctctatttaataaactgttcaaaggaagattgcataaaagagttgcaatgctcaaagacaatagatgaatgtgctattgccttgcttaagttctcagaattattgccatacgcgttagtggctgatatgacttttgagaataaccatgaaatgcgaaattggtgcgagaaaaatgacgttattgcactggacacgtcattcataaataattttcaagaaaatcaggatgtatatgaagtgtgcaaaacatcattatttttaaaacagactcaagaagtaaatatcatatcttatagaaccgaaagtggtggaagagaacatcatgcaattatcattggcaatccagataaagatgacgaaccattagtgagaattcattcttcgtgctatacgggtgacttgttagatagcttgtcatgcgattgcagaagtcagttacatcaagcaattcaaatgatagctgactctggaagtggtattatattgtatttgatgcaagatggaagaggcattggtttaactaataagttaagagcgtacagtatgcaaagaggacataatcttgatactgttgatgcaaatagaatattgggttttgaagatgatgaaaggagttttgctgttgcagctaaaatgcttaagaaattgaacattaacaaaatccaattacttacaaacaatgataggaaattgtcagaattggaaagtagtggtataggagttacaaagtgtctaccacttattgtggaacgtaataaatataacgattcatatatggagacaaagtttggtaaattaggccatagattaagagttttttag

SEQ ID NO: 49373 - protein, 360 aa, Wolbachia endosymbiont of Drosophila melanogaster
MFIGNQSSNKVERAISEIRRGRPIVIYDESNYLLFAAAEALERDLFNQYKLTSSNVYVTLTSSKVKYISQNKEHNSKRLLVNNFDELLYLINCSKEDCIKELQCSKTIDECAIALLKFSELLPYALVADMTFENNHEMRNWCEKNDVIALDTSFINNFQENQDVYEVCKTSLFLKQTQEVNIISYRTESGGREHHAIIIGNPDKDDEPLVRIHSSCYTGDLLDSLSCDCRSQLHQAIQMIADSGSGIILYLMQDGRGIGLTNKLRAYSMQRGHNLDTVDANRILGFEDDERSFAVAAKMLKKLNINKIQLLTNNDRKLSELESSGIGVTKCLPLIVERNKYNDSYMETKFGKLGHRLRVF

SEQ ID NO: 49374 - DNA, 1131 bp, Bdellovibrio bacteriovorus HD100
  CDS (1)..(1131): transl_table=11
atggaattcaatacaatccctgagatcatcgatgatgttcgtaacggcaagatggtcatcctggtggatgacgaggatcgtgaaaacgaaggcgatctgattctggccgctgaattcgcgacgccacaaaatatcaacttcatggtgaaagaagcccgcggcctggtgtgcctgtgtctgacagcccagcaggtcgagcgtctgcagcttccactgatggttcgtgatgatctgaactttgcgccgaacaaaacggcgttcatggtcagcatcgaagcttctgaagggatctcgaccggtatttctgctgccgaccgtgcgctgacgtgccgagtggctgcgaaccctcatgcaaaaccctctgacattcacatgccgggtcacatcttcccaatccgcgcccagcagggtggggttttgaagcgtgcgggtcacacagaggccagcgtggatctggcccgtctggcgggtttgaatccggcagccgtgatctgtgaagtgatgaacgatgacggcacaatggctcgcgtgggtgatctgcgtgagttcgcaaaaaagcacgacatcaaaattggcacgatcgtggatctgatcgcttatcgtctggcgaatgaaactttggtggaagagctgcacagcgttccactgccggcgtcttttggtgaaaacatgcaggcgcgtgttttccgcagcaccgtggatgggttggaacatttggtgattcaaaaaggtgaaatcaagaaagatcatccgaccctggttcgtgttcacgtggataacttcacccgtgatttcatggcggtggttcagcgtggggcttcgtccgtgcttgaaagcatcaaggcgatttcccaggaagaaagcggtgctttcgtgcttctgcgcgggaacaaccgaacttccggtctgactcaggagctgaatgttctggtgggtcttgaggacatccgtccgacgacgccgttgatggatgaacgtgattacggcattggtgcgcagatcctgcgtgagattggcgcgaacaaaatccgcctgttgaccaataagcctgaaaagaaagtcggcctgaaggcctttgatattgaaatcgttgaaattgtcgcaatggaaaacttgaagggaccaaaataa

SEQ ID NO: 49375 - protein, 376 aa, Bdellovibrio bacteriovorus HD100
MEFNTIPEIIDDVRNGKMVILVDDEDRENEGDLILAAEFATPQNINFMVKEARGLVCLCLTAQQVERLQLPLMVRDDLNFAPNKTAFMVSIEASEGISTGISAADRALTCRVAANPHAKPSDIHMPGHIFPIRAQQGGVLKRAGHTEASVDLARLAGLNPAAVICEVMNDDGTMARVGDLREFAKKHDIKIGTIVDLIAYRLANETLVEELHSVPLPASFGENMQARVFRSTVDGLEHLVIQKGEIKKDHPTLVRVHVDNFTRDFMAVVQRGASSVLESIKAISQEESGAFVLLRGNNRTSGLTQELNVLVGLEDIRPTTPLMDERDYGIGAQILREIGANKIRLLTNKPEKKVGLKAFDIEIVEIVAMENLKGPK

SEQ ID NO: 49376 - DNA, 1194 bp, Bacillus cereus ATCC 10987
  CDS (1)..(1194): transl_table=11
atgtttcatcgtattgaagaagctctagaagatttaaaacaaggaaaagtcgtgatcgtatgtgatgatgaaaaccgcgaaaatgaaggcgactttatcgctttagcagagtatattacgccagaaacaattaactttatgattacacatgggcgcggcctcgtttgtgtaccaattacagaaggatacgcagaacgtctacaattagaaccaatggtagctcataatacagattcgcatcatactgcatttacagtgagcattgatcatgtttctacaacaactgggattagtgcccacgaacgtgcaactacgatacgagaaatgttaaatcctgcatcaaaaggtgctgatttcaatcgtcctggacatatctttccattaattgcgaaagaaggtggtgtcctgcgccgtgctggtcatacagaagctgctgtcgatttagcacagctttgcggagcagaaccagctggcgtcatttgcgaaattattaatgaggacggtacgatggcacgcgtacctgatttactacagtgcgcaaaacaatttgatataaaaatgattacaatagaagatttaattgcttatcgccgccaccatgaaacattagtgacgcgtgaagtggaaattacattacctacagatttcggtactttccatgcaattggctattctaattcattagatacgaaagaacatattgcactcgtaaaaggtgatatttcaacaggagagcctgtacttgtacgcgttcattcagagtgcttaacaggagatgtatttggctcgtgccgctgcgattgcggaccacaactccatgctgcacttgctcaaattgagcgtgaaggaaagggcgttcttctttatatgagacaagaaggacgaggcattgggcttcttaataagcttcgcgcttataagttacaagaagaaggcttcgatactgtagaagcaaacgaaaagcttggcttccctgctgatctgcgtgattacggtattggcgctcaaatattaaaagatttaggtttacaacatttacggttattaacgaataatcctcgaaaaattgctggcttacaaggttacgatttagaagtaatcgagcgtgtaccgttacaaatgccagcaaaagaagagaataaaacgtatttacaaacgaaagtaaacaaattaggacatttactaaacttataa

SEQ ID NO: 49377 - protein, 397 aa, Bacillus cereus ATCC 10987
MFHRIEEALEDLKQGKVVIVCDDENRENEGDFIALAEYITPETINFMITHGRGLVCVPITEGYAERLQLEPMVAHNTDSHHTAFTVSIDHVSTTTGISAHERATTIREMLNPASKGADFNRPGHIFPLIAKEGGVLRRAGHTEAAVDLAQLCGAEPAGVICEIINEDGTMARVPDLLQCAKQFDIKMITIEDLIAYRRHHETLVTREVEITLPTDFGTFHAIGYSNSLDTKEHIALVKGDISTGEPVLVRVHSECLTGDVFGSCRCDCGPQLHAALAQIEREGKGVLLYMRQEGRGIGLLNKLRAYKLQEEGFDTVEANEKLGFPADLRDYGIGAQILKDLGLQHLRLLTNNPRKIAGLQGYDLEVIERVPLQMPAKEENKTYLQTKVNKLGHLLNL

SEQ ID NO: 49378 - DNA, 906 bp, Eremothecium gossypii
  CDS (1)..(906)
atgactgaatacacagtgccagaagtgacctgtgtcgcacgcgcgcgcataccgacggtacagggcaccgatgtcttcctccatctataccacaactcgatcgacagcaaggaacacctagcgattgtcttcggcgagaacatacgctcgcggagtctgttccggtaccggaaagacgacacgcagcaggcgcggatggtgcggggcgcctacgtgggccagctgtaccccgggcggaccgaggcagacgcggatcggcgtcagggcctggagctgcggtttgatgagacagggcagctggtggtggagcgggcgacgacgtggaccagggagccgacactggtgcggctgcactcggagtgttacacgggcgagacggcgtggagcgcgcggtgcgactgcggggagcagttcgaccaggcgggtaagctgatggctgcggcgacagagggcgaggtggttggcggtgcggggcacggcgtgatcgtgtacctgcggcaggagggccgcggcatcgggctaggcgagaagctgaaggcgtacaacctgcaggacctgggcgcggacacggtgcaggcgaacgagctgctcaaccaccctgcggacgcgcgcgacttctcgttggggcgcgcaatcctactggacctcggtatcgaggacatccggttgctcacgaataaccccgacaaggtgcagcaggtgcactgtccgccggcgctacgctgcatcgagcgggtgcccatggtgccgctttcatggactcagcccacacagggcgtgcgctcgcgcgagctggacggctacctgcgcgccaaggtcgagcgcatggggcacatgctgcagcggccgctggtgctgcacacgtctgcggcggccgagctcccccgcgccaacacacacatataa

SEQ ID NO: 49379 - protein, 301 aa, Eremothecium gossypii
MTEYTVPEVTCVARARIPTVQGTDVFLHLYHNSIDSKEHLAIVFGENIRSRSLFRYRKDDTQQARMVRGAYVGQLYPGRTEADADRRQGLELRFDETGQLVVERATTWTREPTLVRLHSECYTGETAWSARCDCGEQFDQAGKLMAAATEGEVVGGAGHGVIVYLRQEGRGIGLGEKLKAYNLQDLGADTVQANELLNHPADARDFSLGRAILLDLGIEDIRLLTNNPDKVQQVHCPPALRCIERVPMVPLSWTQPTQGVRSRELDGYLRAKVERMGHMLQRPLVLHTSAAAELPRANTHI

SEQ ID NO: 49380 - DNA, 1200 bp, Thermus thermophilus HB27
  CDS (1)..(1200): transl_table=11
atggaagggatcgccagcgtcaaggaacttctggaggagctcaaggcgggccgtcccgtgatcctggtggacgacgaggaccgggagaacgagggcgacctgatcatggcggcggagcacgtgaccccggagtgggtgaacttcatgctcaaggagtgccggggcctcctctgcgtggccctcacggaggagagggccaaggccctggacctccccctcatggtggagaggaaccaggacccccagggaacccgcttcaccgtgagcgtggacgcccgggggacgaccacggggatcagcgcctttgagcgggcggccaccatcaggctcctcgccgaccccgaggtcacggcccaggacttccgccgcccggggcacgtcttccccctggtggcgaggcccgggggggtcttgcgccgcgccgggcacacggaggccacggtggacctgttgcgcctcgccggcctcaccccggtgggcagcctcattgagatcctcaaggaggacggcaccatggcccgcctgccggacctcttggccttcgctaggaggcacggcctcaaggtgggtaccatcgccgacctcatccgctaccgcctggagaagggggacctctacgtgcggcgggaggcggaggccctgctccccacccgcttcggggagttccgcatcctgggctaccgcgacaccctcacgggggaggagcacgccgccttggtcatgggaagctgggcgccggaggagcccgtcctcgtgcgcatgcactccgagtgcctcaccggggacgccctccactccctgcggtgcgactgcggtttccagagggacctggccctgcagcggatcgccgaggaggggaagggggtcttggtctacctgaggcaggaggggcgggggatcggcctcgtgaacaagatcaaggcctaccacctccaggaccaagggctggacacggtggaggccaacctggccctggggtttcccccggacctccgggactacggcgtgggggcccagatcctctacgacctcggggtgcggaagatgcgcctcctcaccaacaacccgcgcaaggtccgggccctctccggcttcggcatagagatcgtggagcgcatccccttgagggccggggacaacccccacaacgagcgctacctccaggccaagaaggagaagctcgggcactggatggattga

SEQ ID NO: 49381 - protein, 399 aa, Thermus thermophilus HB27
MEGIASVKELLEELKAGRPVILVDDEDRENEGDLIMAAEHVTPEWVNFMLKECRGLLCVALTEERAKALDLPLMVERNQDPQGTRFTVSVDARGTTTGISAFERAATIRLLADPEVTAQDFRRPGHVFPLVARPGGVLRRAGHTEATVDLLRLAGLTPVGSLIEILKEDGTMARLPDLLAFARRHGLKVGTIADLIRYRLEKGDLYVRREAEALLPTRFGEFRILGYRDTLTGEEHAALVMGSWAPEEPVLVRMHSECLTGDALHSLRCDCGFQRDLALQRIAEEGKGVLVYLRQEGRGIGLVNKIKAYHLQDQGLDTVEANLALGFPPDLRDYGVGAQILYDLGVRKMRLLTNNPRKVRALSGFGIEIVERIPLRAGDNPHNERYLQAKKEKLGHWMD

SEQ ID NO: 49382 - DNA, 1230 bp, Desulfovibrio vulgaris subsp. vulgaris str. Hildenborough
  CDS (1)..(1230): transl_table=11
atgtccatctgcaaggccgaagaggccatcgacgccatccgcaagggcgagatgatcatcctcgtcgacgacgaggaccgcgaaaacgaaggcgaccttaccatcgccgcgcagcacgtcacgcccgaggtcatcaacttcatggccacccacgggcgcggcctcatctgcctggccctctcccccgagtgggtggacaagctacagctgcccctgatggcccgccgcaacgagtccaagttcggcaccaacttcactgtttccatcgaggcgcgccgcggtgtcaccaccggcatctccgccgccgaccgtgccacgaccatcctgaccgccgtcgccgacgacgtgaaggccgaagacatcgtcacgcccggtcacatcttcccccttcgtgcccagaagggtggggtcatggtccgtgccggacagaccgagggtagcgtcgacctcgccaagctcgccaatctcaagcctgccgcagtcatctgcgaaatcatgcgcgaagatggcgagatggcgcggatgcccgacctcatcgagttcgccgaaaagcacaacatgaagatcgccaccatcaaggacctcatccgctaccggatgcagtcgggccttctttcggtgaagcgcgtgggtgaagccaagatgcccacccgctacggcgatttccagatcatcgcctacgagaacgaactgcacgacgagacccacatcgccctcgtcaagggtgacatctcgcccagcgagcccgtgctcgtgcgcgtgcacagcgaatgcctcaccggtgacgtgctgggttcgttgcgttgcgactgcggcggccagctcgccgcggcactgtgccagattgcggccaaggggtcgggcgtgctgctgtacatgcgccaggaaggacgcggcatcggcctcggcaacaagatcaaggcctacgggcttcaggaccaagggtacgacaccgttgaggccaaccacaagcttggcttcaaggccgacctgcgcgactatggaatcggtgcgcagattctcgtcgacctcggggtgcgcaagatgcgcatgatgaccaacaaccccaagaagatcgtcggcctcgaaggctacggcatagaagtcgtcgaacgtgtgcccatcgaactcgagtcgtgcgccttcaatgaagagtacctgcgcaccaagaaggagaagatgggccacctgcttgaactgaagcaccacgagaacggaggcgacgcctag

SEQ ID NO: 49383 - protein, 409 aa, Desulfovibrio vulgaris subsp. vulgaris str. Hildenborough
MSICKAEEAIDAIRKGEMIILVDDEDRENEGDLTIAAQHVTPEVINFMATHGRGLICLALSPEWVDKLQLPLMARRNESKFGTNFTVSIEARRGVTTGISAADRATTILTAVADDVKAEDIVTPGHIFPLRAQKGGVMVRAGQTEGSVDLAKLANLKPAAVICEIMREDGEMARMPDLIEFAEKHNMKIATIKDLIRYRMQSGLLSVKRVGEAKMPTRYGDFQIIAYENELHDETHIALVKGDISPSEPVLVRVHSECLTGDVLGSLRCDCGGQLAAALCQIAAKGSGVLLYMRQEGRGIGLGNKIKAYGLQDQGYDTVEANHKLGFKADLRDYGIGAQILVDLGVRKMRMMTNNPKKIVGLEGYGIEVVERVPIELESCAFNEEYLRTKKEKMGHLLELKHHENGGDA

SEQ ID NO: 49384 - DNA, 1032 bp, Mycoplasma mobile 163K
  CDS (1)..(1032): transl_table=4
atgccttttcattttatgaagggacttatgattataaaagagaataatttcaaaaaattttttttgaaattatcacttaatgaaaaatattctgatttagttttcacagaattaaaaaaatatgaaaatcaagaatctgaaaaaacagctacttacaaatttaaaataagtaaaaaaatcattttaatagaaggaaaagaagatagaattcttctaagaacactgaaatgaattgacgatattgttgataaaattcttcgtgaatttaatttgagttttggaatcaatattaattttaaaaacagatttactagcaatgaaaataataatttaattatttttaatttttatagcaatgatttgaaaattgctttggaagaattagatgatctaattttggatttaaatatttctgaaaagcaaaatttaatttcatttagatttgactttgattctgtttttcaagaaagtaaaagtatattaatggaaacatctgatggatttttcaacatgaaatcttttgaagttccatcgcacaataaagaatttgtaatcaaatgaaatggggacttaaaaaaaatagttaatgcaagaatccactataaatgtatgacttcagaggtttttggttcaattatgtgtgattgcaaagatcaattggaaagctttaatgaattaatgaaaaaagagggtggacttttactttatgcttatgaagaaggaagaggattcggaatgttacataaattaaatgcttattacaacactgaaaaagaaggtttagatactgttgatgccatgataaaagagacaggaaaaacagaagcaaggaaatttgatatggcaggagaaataataagaaaattaggaattaaagaagtcaatttatatacaaataatccaagaaaaataattcctttattagatagaagaatcaaagtaaataggaaaaaacattgaactgaaacaaagtctaaagaagcaaagaaatatactgaagataaaattaaaaaaatggagcatttagaataa

SEQ ID NO: 49385 - protein, 343 aa, Mycoplasma mobile 163K
MPFHFMKGLMIIKENNFKKFFLKLSLNEKYSDLVFTELKKYENQESEKTATYKFKISKKIILIEGKEDRILLRTLKWIDDIVDKILREFNLSFGININFKNRFTSNENNNLIIFNFYSNDLKIALEELDDLILDLNISEKQNLISFRFDFDSVFQESKSILMETSDGFFNMKSFEVPSHNKEFVIKWNGDLKKIVNARIHYKCMTSEVFGSIMCDCKDQLESFNELMKKEGGLLLYAYEEGRGFGMLHKLNAYYNTEKEGLDTVDAMIKETGKTEARKFDMAGEIIRKLGIKEVNLYTNNPRKIIPLLDRRIKVNRKKHWTETKSKEAKKYTEDKIKKMEHLE

SEQ ID NO: 49386 - DNA, 579 bp, Picrophilus torridus DSM 9790
  CDS (1)..(579): transl_table=11
atgatagagttctattctaaggcaaggctgccatcaaggtttggcagcttcgaaatatacgttttcaagaacgatgagaacaaggatcatgcggttatagttcatggtgatgtgagaggcaaaagtgatgttccggttagaatacacagcgagtgcctaaccggtgatgtccttggatcaatgaggtgtgactgccgtgaccagcttatagaatcactaaaatacataggaagccagccatacggcatgctaatatacatgaggcaggaggggcgtggcataggccttttaaacaagataagggcatacaatttacaggatcagggacttgacacagttgaggcaaatcttgagcagggccttcccgtggatgagagaaagtacgattatgccgttgatgtaataaagtactttaacatagagagcatccagcttataacaaacaatcctgaaaaactaaaataccttgaggagcacggcataaagataacaaagaggataccaataataataccaccaacaaagtttgatgaattttatctcgagacaaaaagggagaggatgggccatctattttga

SEQ ID NO: 49387 - protein, 192 aa, Picrophilus torridus DSM 9790
MIEFYSKARLPSRFGSFEIYVFKNDENKDHAVIVHGDVRGKSDVPVRIHSECLTGDVLGSMRCDCRDQLIESLKYIGSQPYGMLIYMRQEGRGIGLLNKIRAYNLQDQGLDTVEANLEQGLPVDERKYDYAVDVIKYFNIESIQLITNNPEKLKYLEEHGIKITKRIPIIIPPTKFDEFYLETKRERMGHLF

SEQ ID NO: 49388 - DNA, 1182 bp, Staphylococcus aureus subsp. aureus MRSA252
  CDS (1)..(1182): transl_table=11
atgcaattcgataatattgacagtgctttaatggctttaaaaaatggagaaacaattattgtagtagatgatgagaatcgtgaaaatgaaggtgatttagtagcggtcactgaatggatgaacgataataccattaattttatggcgaaagaagcaaggggattaatatgcgcaccagtgtctaaagatattgcacaacgtttggatttggtacaaatggttgatgataactccgacatctttggtacgcaatttacagtgagtattgatcatgtagatacaacaacaggaataagcgcttatgaacgtacattgactgccaaaaagctcattgatccaagtagtgaagctaaagattttaatcgtcctggtcatttatttccattagtagcacaagataaaggggtattagctcgtaatggtcatactgaagcggctgttgatttagctaaacttactggtgccaagcccgctggtgtcatttgtgagattatgaatgatgacggcacgatggcgaaaggacaagatttacaaaagtttaaagaaaaacataaattaaagatgattacgattgatgatttaattgaatatcgtaaaaaattagaaccagaaattgaatttaaggcaaaagtgaaaatgcctacagatttcggaacatttgatatgtatggttttaaagcgacttacacagatgaagagatagttgtactgacaaaaggtgcaattcgacaacatgaaaatgtacgcttacattctgcgtgccttacaggcgatattttccatagtcaacgttgtgattgtggtgctcaacttgaatcgtctatgaagtatatcaatgaacatggcggcatgattatttatctacctcaagaaggtcgtggcataggattgttaaacaaattacgcgcatatgaattaattgagcaaggatatgatacagtaactgcaaatttagcattaggttttgatgaagatttgcgagattatcatattgctgcacagattttaaaatattttaacatcgaacatatcaatttattaagtaataatccaagtaaattcgaaggattaaaacaatatggcattgatattgcagaaagaattgaagttatcgtaccagaaacggtacataatcatgattatatggaaacgaaaaaaataaaaatgggtcatttaatatag

SEQ ID NO: 49389 - protein, 393 aa, Staphylococcus aureus subsp. aureus MRSA252
MQFDNIDSALMALKNGETIIVVDDENRENEGDLVAVTEWMNDNTINFMAKEARGLICAPVSKDIAQRLDLVQMVDDNSDIFGTQFTVSIDHVDTTTGISAYERTLTAKKLIDPSSEAKDFNRPGHLFPLVAQDKGVLARNGHTEAAVDLAKLTGAKPAGVICEIMNDDGTMAKGQDLQKFKEKHKLKMITIDDLIEYRKKLEPEIEFKAKVKMPTDFGTFDMYGFKATYTDEEIVVLTKGAIRQHENVRLHSACLTGDIFHSQRCDCGAQLESSMKYINEHGGMIIYLPQEGRGIGLLNKLRAYELIEQGYDTVTANLALGFDEDLRDYHIAAQILKYFNIEHINLLSNNPSKFEGLKQYGIDIAERIEVIVPETVHNHDYMETKKIKMGHLI

SEQ ID NO: 49390 - DNA, 603 bp, Acinetobacter sp. ADP1
  CDS (1)..(603): transl_table=11
gtggctattgagtttgtcgcgacgtctaaacttccgaccaagtttggtgacttcaatatttctgtgttccaagatccagtcacaggcgaagaacatgttgctctgtccaaaggtttagaaatagcaccaacaggcccagtactggttcgtatccattcagaatgtctgactggcgatgctttcgcttctctgaaatgtgattgcggcccacagttacaagcgactcaaaagctcatcaatgatgtgggacaaggtgttattttatatttgcgccaagaaggtcgcggaattggattaaccaacaaaattcgtgcctatgccttgcaggatcaaggacacgatacagtcgatgccaacttattgcttaatctgcctgcagatgctagacgttatgatatgtgcagtatcatgctcgatcatctacaagtgaaacaagtaaagttaatcaccaataatcctttaaaattaaaggcattgactgatttaggtattaatgtgatagaccgtgttccattaacagtcgggaaaaatccatttaatgaacagtatctaaaaacaaaaaaagaacgcatggcccatctttatcaaaaggatgacttctaa

SEQ ID NO: 49391 - protein, 200 aa, Acinetobacter sp. ADP1
MAIEFVATSKLPTKFGDFNISVFQDPVTGEEHVALSKGLEIAPTGPVLVRIHSECLTGDAFASLKCDCGPQLQATQKLINDVGQGVILYLRQEGRGIGLTNKIRAYALQDQGHDTVDANLLLNLPADARRYDMCSIMLDHLQVKQVKLITNNPLKLKALTDLGINVIDRVPLTVGKNPFNEQYLKTKKERMAHLYQKDDF

SEQ ID NO: 49392 - DNA, 594 bp, Erwinia carotovora subsp. atroseptica SCRI1043
  CDS (1)..(594): transl_table=11
atgcagctaaaacgggtggcggaagccaaattacccactccgtggggcgattttctgatggtgggttttgaagagatcgccacgggtcacgatcaccttgcactcgtctatggtgatatttccggttcagttcctgtactggctcgcgtgcattccgagtgcctgacgggggatgccctgtttagcctgcgctgcgactgtggtttccagcttgaggctgcattaggccacatcgccgaagaaggtcgcggcgtgctgttataccatcgtcaggaaggccgtaatatcgggttgctcaataaaatccgcgcttatgcgttgcaggatctgggggcagatacggtagaagcgaatcatcagcttgggttcgccgccgatgagcgcgattttacgctgtgtgcagatatgttcaaattgctggacgttgatgaagttcgcctgttgactaataatccacagaaagtgaaaatcctcaacgaagcaggcatcaatatcgtcgaacgtgtgccattaatcgtcggacgtaacccgaagaatgagcactatctggcaaccaaagccgccaaaatggggcacatactggatatgaaataa

SEQ ID NO: 49393 - protein, 197 aa, Erwinia carotovora subsp. atroseptica SCRI1043
MQLKRVAEAKLPTPWGDFLMVGFEEIATGHDHLALVYGDISGSVPVLARVHSECLTGDALFSLRCDCGFQLEAALGHIAEEGRGVLLYHRQEGRNIGLLNKIRAYALQDLGADTVEANHQLGFAADERDFTLCADMFKLLDVDEVRLLTNNPQKVKILNEAGINIVERVPLIVGRNPKNEHYLATKAAKMGHILDMK

SEQ ID NO: 49394 - DNA, 1278 bp, Leifsonia xyli subsp. xyli str. CTCB07
  CDS (1)..(1278): transl_table=11
atgagcctcgccaccattccggaggccctcgccgagctgcgcgccggtcggccgatcatcgtcgtggacaacgagagccgcgagaacgagggagatgtcgtcctggccgccgagctcgccagccaggagtggatcgcctggaccgtcaagaactcctccggcttcctctgcgccccgatgacgaacgagatcgccgaccgcctggagctgcccgtcatggtggcgaccaacgaggacacccgcggaaccaactacacggtgagcgtcgacgccgccgaccgcctctccacgggcatcagcgccggcgaccgcgcgcacacgctccgcgtgctcgccggcctggattcgaccccgagcagtctgcaccgcccggggcacatcctgccgctgcgcgcggcggagggtggcgtgcgcgagcgcgacggccacaccgaggccactgtcgacctgctcaaactggcgggtatgacgcccgtcggcgccatcgcggagatcgtgtccggcgacggcgagatgatgcgcctgcccggcctcatcgaactcggcgagcgcgaaggcatcctcgtcatcaccatcgaggcgttgatcgcttacctacaggagttccactgcgatcggcgactcgagtctccgacgcccgtccccgagtcgtcgcgcgtgatcttcgaggtggagacgaccgtcccgacgccgaacggtccgttccggatgcgcgcctaccgcgaccggatgaccggcgcggaccatgtcgccatcgtcgcaggctccccggacccgaccggcacgctggtgcgcgtccactccgagtgcctgaccggcgaggcattcggctcgctcaagtgcgagtgcggaccgcagctggacgccgcgctcgagaccgtccagcgcgagggcggcgtcgtcgtctacctgcgcggccacgagggccgcggcatcggcctgatcaacaagttgcgcgcctataaactgcaggaggacggcctggacaccctcgacgccaacctcgcgctggggctgccgatcgacgcgcgcgactacggggcggccaccgccatcctgcaagacctcggcatgcgctcggtccggctgctgacgaacaacccggagaaggtgcgccagctggaagagcacggcatcgaggtcgaggagcgcgtcgcgctcgtcgtgggtgtcggggcgttcaacgagggttacctggagaccaagcgcgaccggatgggtcacgctatcggagagatctaccagacggcgagcgccgcagagaggacgacacaatga

SEQ ID NO: 49395 - protein, 425 aa, Leifsonia xyli subsp. xyli str. CTCB07
MSLATIPEALAELRAGRPIIVVDNESRENEGDVVLAAELASQEWIAWTVKNSSGFLCAPMTNEIADRLELPVMVATNEDTRGTNYTVSVDAADRLSTGISAGDRAHTLRVLAGLDSTPSSLHRPGHILPLRAAEGGVRERDGHTEATVDLLKLAGMTPVGAIAEIVSGDGEMMRLPGLIELGEREGILVITIEALIAYLQEFHCDRRLESPTPVPESSRVIFEVETTVPTPNGPFRMRAYRDRMTGADHVAIVAGSPDPTGTLVRVHSECLTGEAFGSLKCECGPQLDAALETVQREGGVVVYLRGHEGRGIGLINKLRAYKLQEDGLDTLDANLALGLPIDARDYGAATAILQDLGMRSVRLLTNNPEKVRQLEEHGIEVEERVALVVGVGAFNEGYLETKRDRMGHAIGEIYQTASAAERTTQ

SEQ ID NO: 49396 - DNA, 1257 bp, Desulfotalea psychrophila LSv54
  CDS (1)..(1257): transl_table=11
ttgtctgagccgatttttatattttataaggaaagtgtgaacgttatggccgtaagttctattgaagaagcaattgaagatatcaaagcaggaaagatggttatcttggttgatgatgaagatcgagaaaatgaaggtgatctttgcatggccgcagagtttgttgctgccgctgacatcaactttatggcaacccatggtcgtggtcttatctgtctgaccttgactccaaagcttgttgatcagcttgccctgccaatgatggttcaagagaataagtctccgtacggtactggctttactattagtattgaggcgaagacaggcgtggaaacgggtatttctgcagctgatcgagcccgtactattcaggtcgccgtagcagatggtgccggaccacaggacttggtcagccctggacatgtttttcctcttcgtgctcgcgaaggtggtgtgctctgtcgtacaggacaaaccgagggatctgttgatcttgctcgtctttctggggcgactcctgccggtgttatttgtgaaatcatgaaggatgatggcaccatggcccgcatgccggatcttgagatttttgccgctgaacatgaattgaaaattgtaaccgtagcagatctggttgagtacagattgcgtcaggatttacttgttcaccgtcaggttgcggcgcgtattcccaccgctgatgcgggtgaatttaccgctattgtttataccaatgatgttgataattttgagcatttggctctggttaagggtgatcttgaggctgccgaagaagtacttgtgcgggttcattcagaatgtcttaccggtgatctctttggctctgctcgctgtgattgtggcccccaacttcatgaggccatgcgtatgattgaccgagccggttgtggtgttgtcctttatatgcgtcaagagggtcgtggtattggcctgattaacaaactgaaggcctataatcttcaggacaatcaaggccttgatactgtagaggcgaacatcgagcttggctttaaggcagatcttcgtgactatggtatcggtgctcagatattgcgtgatcttggtattaccaagatgtctcttcttaccaacaatccaaagaaaattatcggccttgagggttatggtattgaagtgatttctcgggtgcccattgaaattgaggcaagtgaggaaaatgaaggctatctgagatgtaagcgggataggatgggacatttgttgaatatgaaagagtag

SEQ ID NO: 49397 - protein, 418 aa, Desulfotalea psychrophila LSv54
MSEPIFIFYKESVNVMAVSSIEEAIEDIKAGKMVILVDDEDRENEGDLCMAAEFVAAADINFMATHGRGLICLTLTPKLVDQLALPMMVQENKSPYGTGFTISIEAKTGVETGISAADRARTIQVAVADGAGPQDLVSPGHVFPLRAREGGVLCRTGQTEGSVDLARLSGATPAGVICEIMKDDGTMARMPDLEIFAAEHELKIVTVADLVEYRLRQDLLVHRQVAARIPTADAGEFTAIVYTNDVDNFEHLALVKGDLEAAEEVLVRVHSECLTGDLFGSARCDCGPQLHEAMRMIDRAGCGVVLYMRQEGRGIGLINKLKAYNLQDNQGLDTVEANIELGFKADLRDYGIGAQILRDLGITKMSLLTNNPKKIIGLEGYGIEVISRVPIEIEASEENEGYLRCKRDRMGHLLNMKE

SEQ ID NO: 49398 - DNA, 1197 bp, Bacillus licheniformis ATCC 14580
  CDS (1)..(1197): transl_table=11
atgtttcacacaattgaagaagcgattcgcgatttgaagcagggaaaagtcatcatcgtagtcgatgacgagaacagggaaaacgaaggcgatttcgttgcgctggcggaatacgcaacacccgatgtaatcaactttatggcttcgcacggaagggggttgatctgcgcgccgctcaatgaagagatcgcttcccggcttgagctccaaccgatggtggacgaaaataccgattctcaccacacagcatttacggtcagtgtcgatcaccgcgatacaaagacggggattagcgctcaggagcggtcgctgaccgtcatgtcgctgatcgctgatcacgcgcatccgggtgattttaaaaggccggggcacattttccccctgatcgcgaaaaaaggcggcgttttaaaaagagccggacatacggaggcggccgttgaccttgcagaagcgtgcgggtccgcgccggccggcgtcatctgcgaaatcatgaatgaagacggcacgatggcaagggtgcctgaactcaaaaaaatagccgatcagcacggcttgaaaatgatcacgattaaagatttgatcgaataccgctacagcaagggaacgctgatcaaccgggaagtgaaaattacgctgccttccgaattcggtaccttcaaggtttacggctatacaaacgaaatcgatgacaaagaacatatagcactcgtcaaaggcgacatacctttcggtgacgagcctgtgcttgtccgggtacactcagaatgcctgacgggcgatgttttcggctcttaccgctgcgactgcggcccgcagcttgccgctgcgctcgcgcaaatcgaacaagcgggccggggcgtactcctgtatttgagacaggaaggaaggggaatcggcttaatcaataaactgaaagcttataagctgcaggaagaaggatacgacaccgtacaggctaacgaaaagctcggttttcttccagaccttcgcaactacgggatcggcgcccaaatcttaagggacctcggcgtgaagcaaatgaagctgttaacgaacaacccgcgaaaaattgcaggtctcgaaggttacggcctgacgatcgcagacagggtgccgctgcagatggagacaaaaaaagataatgaaaagtatctaaaaacgaaaaaatcaaaattggggcatatgcttcatttttaa

SEQ ID NO: 49399 - protein, 398 aa, Bacillus licheniformis ATCC 14580
MFHTIEEAIRDLKQGKVIIVVDDENRENEGDFVALAEYATPDVINFMASHGRGLICAPLNEEIASRLELQPMVDENTDSHHTAFTVSVDHRDTKTGISAQERSLTVMSLIADHAHPGDFKRPGHIFPLIAKKGGVLKRAGHTEAAVDLAEACGSAPAGVICEIMNEDGTMARVPELKKIADQHGLKMITIKDLIEYRYSKGTLINREVKITLPSEFGTFKVYGYTNEIDDKEHIALVKGDIPFGDEPVLVRVHSECLTGDVFGSYRCDCGPQLAAALAQIEQAGRGVLLYLRQEGRGIGLINKLKAYKLQEEGYDTVQANEKLGFLPDLRNYGIGAQILRDLGVKQMKLLTNNPRKIAGLEGYGLTIADRVPLQMETKKDNEKYLKTKKSKLGHMLHF

SEQ ID NO: 49400 - DNA, 1194 bp, Bacillus cereus E33L
  CDS (1)..(1194): transl_table=11
atgtttcatcgtattgaagaagctctagaagatttaaaacaaggaaaagtcgttatcgtatgtgatgatgaaaaccgtgaaaacgaaggcgattttatcgctttagcagagtatattacgccagaaacaattaactttatgattacacatggacgcggtctcgtttgtgtaccgattacagaaggatacgcagaacgtctacaattagaaccaatggtatctcataatacagattcgcatcatactgcatttacagtgagcattgaccatgtttctacaacaacaggcattagcgctcacgaacgtgcaactacgatacaacaattgttaaatcctgcatcaaaaggtgctgatttcaatcgacctggacatatctttccattaatcgcgaaagaaggcggtgtcctgcgtcgtgctggtcatacagaagctgctgtcgatttagcacagctctgcggggcagaaccagctggagtcatttgcgagattatcaatgaggacggtgcgatggcacgcgtccctgatttactacagtgcgcaaaacaatttgatataaaaatgattacaatagaagatttaattgcttatcgccgccatcatgaaacacttgtgacgagagaagtggaaattacattacctacagatttcggtacttttcaagcaattggctattctaactcattagatacgaaagaacatattgcactcgtaaaaggtgatatttcaacaggtgagcctgtacttgtacgcgttcattcagagtgcttaacaggagatgtatttggctcgtgccgctgtgattgcggaccacaactccatgctgcacttgcacaaattgagcgtgaaggaaaaggcgttcttctttatatgagacaagaaggacgaggcattggccttcttaataagcttcgcgcttataagttacaagaagaaggcttcgatactgtagaagcaaatgaaaagcttggttttcccgctgaccttcgtgattacggtatcggcgctcaaatattaaaagatttaggtttacaacatttacgattattaacgaataatccaagaaaaatcgctggcttacaaggttacgatttaacagttacggagcgcgtaccgttacaaatgccagcaaaagaagagaataaaacgtatttacaaacgaaagtaaacaaattaggacatttactaaacttataa

SEQ ID NO: 49401 - protein, 397 aa, Bacillus cereus E33L
MFHRIEEALEDLKQGKVVIVCDDENRENEGDFIALAEYITPETINFMITHGRGLVCVPITEGYAERLQLEPMVSHNTDSHHTAFTVSIDHVSTTTGISAHERATTIQQLLNPASKGADFNRPGHIFPLIAKEGGVLRRAGHTEAAVDLAQLCGAEPAGVICEIINEDGAMARVPDLLQCAKQFDIKMITIEDLIAYRRHHETLVTREVEITLPTDFGTFQAIGYSNSLDTKEHIALVKGDISTGEPVLVRVHSECLTGDVFGSCRCDCGPQLHAALAQIEREGKGVLLYMRQEGRGIGLLNKLRAYKLQEEGFDTVEANEKLGFPADLRDYGIGAQILKDLGLQHLRLLTNNPRKIAGLQGYDLTVTERVPLQMPAKEENKTYLQTKVNKLGHLLNL

SEQ ID NO: 49402 - DNA, 660 bp, Mannheimia succiniciproducens MBEL55E
  CDS (1)..(660): transl_table=11
atgtcaaaaattcaacgtgttgcagaagccaatcttcccaccgagtttgggcttttccgcattgtaggatttgaatttccggatactaaaaaagaacatgtggcactggtaatgggcgatattagcaatagtgaagaaaaccccgtgttagcccgtattcattccgaatgcttaaccggcgatgcattacacagcttaaaatgcgattgcggttttcaactgagcacagcattacgtcaaatcagcgaagcggggcgcggcgtattgatttaccatcgcgaagaagggcgaggaatcggcttaatcaacaaaatccgggcatattcattgcaagataacggaatggatactatcgaagcaaatctggcgctgggctttgccgccgacgaacggaatttcaaagtttgcgcggatatttttgaattattaggtatctgcaaggttcgcctgttaacaaacaaccccgcaaaaatcgacaccatgaaaaaagcgggcatcaacgtagttgaacgaattccgctaaatgtcggcgaaaaccgctacaacaccggatatctggacaccaaagcaaaaaaaatgggccattacatcgtacacgacaatgaaaaacattatttagattgcccgtattgccaatctgaaatccccaataagaaataa

SEQ ID NO: 49403 - protein, 219 aa, Mannheimia succiniciproducens MBEL55E
MSKIQRVAEANLPTEFGLFRIVGFEFPDTKKEHVALVMGDISNSEENPVLARIHSECLTGDALHSLKCDCGFQLSTALRQISEAGRGVLIYHREEGRGIGLINKIRAYSLQDNGMDTIEANLALGFAADERNFKVCADIFELLGICKVRLLTNNPAKIDTMKKAGINVVERIPLNVGENRYNTGYLDTKAKKMGHYIVHDNEKHYLDCPYCQSEIPNKK

SEQ ID NO: 49404 - DNA, 1218 bp, Bacillus licheniformis ATCC 14580
  CDS (1)..(1218): transl_table=11
atgaaaggaggctgtgcgtctatgtttcacacaattgaagaagcgattcgcgatttgaagcagggaaaagtcatcatcgtagtcgatgacgagaacagggaaaacgaaggcgatttcgttgcgctggcggaatacgcaacacccgatgtaatcaactttatggcttcgcacggaagggggttgatctgcgcgccgctcaatgaagagatcgcttcccggcttgagctccaaccgatggtggacgaaaataccgattctcaccacacagcatttacggtcagtgtcgatcaccgcgatacaaagacggggattagcgctcaggagcggtcgctgaccgtcatgtcgctgatcgctgatcacgcgcatccgggtgattttaaaaggccggggcacattttccccctgatcgcgaaaaaaggcggcgttttaaaaagagccggacatacggaggcggccgttgaccttgcagaagcgtgcgggtccgcgccggccggcgtcatctgcgaaatcatgaatgaagacggcacgatggcaagggtgcctgaactcaaaaaaatagccgatcagcacggcttgaaaatgatcacgattaaagatttgatcgaataccgctacagcaagggaacgctgatcaaccgggaagtgaaaattacgctgccttccgaattcggtaccttcaaggtttacggctatacaaacgaaatcgatgacaaagaacatatagcactcgtcaaaggcgacatacctttcggtgacgagcctgtgcttgtccgggtacactcagaatgcctgacgggcgatgttttcggctcttaccgctgcgactgcggcccgcagcttgccgctgcgctcgcgcaaatcgaacaagcgggccggggcgtactcctgtatttgagacaggaaggaaggggaatcggcttaatcaataaactgaaagcttataagctgcaggaagaaggatacgacaccgtacaggctaacgaaaagctcggttttcttccagaccttcgcaactacgggatcggcgcccaaatcttaagggacctcggcgtgaagcaaatgaagctgttaacgaacaacccgcgaaaaattgcaggtctcgaaggttacggcctgacgatcgcagacagggtgccgctgcagatggagacaaaaaaagataatgaaaagtatctaaaaacgaaaaaatcaaaattggggcatatgcttcatttttaa

SEQ ID NO: 49405 - protein, 405 aa, Bacillus licheniformis ATCC 14580
MKGGCASMFHTIEEAIRDLKQGKVIIVVDDENRENEGDFVALAEYATPDVINFMASHGRGLICAPLNEEIASRLELQPMVDENTDSHHTAFTVSVDHRDTKTGISAQERSLTVMSLIADHAHPGDFKRPGHIFPLIAKKGGVLKRAGHTEAAVDLAEACGSAPAGVICEIMNEDGTMARVPELKKIADQHGLKMITIKDLIEYRYSKGTLINREVKITLPSEFGTFKVYGYTNEIDDKEHIALVKGDIPFGDEPVLVRVHSECLTGDVFGSYRCDCGPQLAAALAQIEQAGRGVLLYLRQEGRGIGLINKLKAYKLQEEGYDTVQANEKLGFLPDLRNYGIGAQILRDLGVKQMKLLTNNPRKIAGLEGYGLTIADRVPLQMETKKDNEKYLKTKKSKLGHMLHF

SEQ ID NO: 49406 - DNA, 645 bp, Burkholderia mallei ATCC 23344
  CDS (1)..(645): transl_table=11
atgaacgatggtcgaatttccccaacgatgagcgcgtccgtccgtacgcgcgtcaatgtgcccattcgtccgcgcaccgcgcaacagcggttcgacgccgaaatggtcacgttccagggcttgtgcgacagcgccgagcatctcgcgctcgttttcgggccgctcgccgacgcgccgctcgtgcgcgtgcattccgagtgcctgacgggcgacgtgttcggctccgcgcgctgcgattgcggcgagcagctcgacgagtcggtcgcgatgttcggccgtgaaggcggcatcctgctctatctgcgccaggaggggcgcggcatcgggctgtacaacaagctcgacgcgtaccgcctgcagatctcgcagggcctcgacacgttcgcggcgaaccgcgcgctgaatttccccgacgacctgcgcgatttccgcgtcgccgcgcaaatgctgcaggcgctcggcgtcaccgagatctcgctcgtcaccaacaacccggacaaggtctcgcagatcgagaagcacggcatccggatccggcgcgtgctgcagacgggcgtgttcgtcaacaccacgaaccacggctacctgcgcgcgaagatcgatcaccaccgccacgccatcaacctcagccaggaactgcaatga

SEQ ID NO: 49407 - protein, 214 aa, Burkholderia mallei ATCC 23344
MNDGRISPTMSASVRTRVNVPIRPRTAQQRFDAEMVTFQGLCDSAEHLALVFGPLADAPLVRVHSECLTGDVFGSARCDCGEQLDESVAMFGREGGILLYLRQEGRGIGLYNKLDAYRLQISQGLDTFAANRALNFPDDLRDFRVAAQMLQALGVTEISLVTNNPDKVSQIEKHGIRIRRVLQTGVFVNTTNHGYLRAKIDHHRHAINLSQELQ

SEQ ID NO: 49408 - DNA, 597 bp, Burkholderia mallei ATCC 23344
  CDS (1)..(597): transl_table=11
gtgacgctcgtcgccaccgcgacgcttcctacccgctacggcacgttcacgtcgtatgcgtttcgcgtggcgggcggcgatgccgagcacctcgcgctcgtgatgggcgacgtcgccgagcagccgtcggtgctgacgcggcttcattccgagtgcctgacgggtgacgtgttcggctcgtatcgatgcgattgcggcgagcagctcgatctctcgctgcgctacatcgcggccgaagggcgcggcgtattgctgtatctgcgcggccacgaaggccgcgggatcggcctgagcaacaagatccgcgcgtatgcgctgcaggagcaggggcgcgacaccgtcgaggcgaacctcgacctcgggctacccgacgacgcgcgcgaatacgattccgccgccgcgatcctgcgcatcctgaaagtcacgtccgtgcgactgatgagcaataatccgaagaagttcgacacgctcgcgcggcacggtatcccggtctgcgagcgcgtcgcgctcgccgtgccggtgcgcgaggagaacgagcgctatatccgcacgaagcagctcaagttcggccactattatttcgacgaaaacgaatag

SEQ ID NO: 49409 - protein, 198 aa, Burkholderia mallei ATCC 23344
MTLVATATLPTRYGTFTSYAFRVAGGDAEHLALVMGDVAEQPSVLTRLHSECLTGDVFGSYRCDCGEQLDLSLRYIAAEGRGVLLYLRGHEGRGIGLSNKIRAYALQEQGRDTVEANLDLGLPDDAREYDSAAAILRILKVTSVRLMSNNPKKFDTLARHGIPVCERVALAVPVREENERYIRTKQLKFGHYYFDENE

SEQ ID NO: 49410 - DNA, 1116 bp, Methylococcus capsulatus str. Bath
  CDS (1)..(1116): transl_table=11
atgacgctgaatacgatcgaagaaatcatagaagacatccgccaaggcaggatggtcgtcatcatggacgatgaggaccgggaaaacgaaggcgatctcgtcatggcggcggggcatgtgcggccggaggacatcaacttcatggcgcgttatggccggggtctgatctgtctgacactgactcgtgagcgctgccagcagttgcggctgcccttgatggtgaatgagaaccggacgccgcattcgaccaatttcacggtgtcgatcgaagccgccaccggtgtcaccacgggtatttcggccagcgaccgggcgcgtaccatccagtgcgccgtcgctccggacgccaggcccgacgatctggtccagccgggccatatcttcccgctcatggcgcaacccggcggggtgctcaaccgtgccggacacacggaggcgggctgcgacctggcgcgcctggccggcctggtaccggcggctgtcatcgtcgaaatcctcaacgaggacggttcgatggcgcggcgtgccgacctggaaaagtttgcggccgtccatggcctcaagatcggcaccatcgccgacctgatccattaccggatgcagaacgagcagaccgtggaacgcatctgcgaatgcgatttcccgaccgaacacggtcgcttccgcctccacgcctatcaggaccgtctggacaacaaactgcatctcgccctgacgctgggcgacgtcgccggcggcgagccggtgctggtaagggtccatggccgcaatctgctgaccgatttgttcggggtgaggcgcggcgacatcggtatctccctgcgcgcggccatgaagcggatcgccgacgaggggcgtggcgtgctcgtcgtgatccgcaacgaggaagacgatcgttgcttggtggagcgcatacatcagtaccagatggaggaccacggtgtggacatcggccagcgcgaggaccctggcgtggactggcgcacgaccggaaccggagcgcagattctcgccgacctgggcgtgcgcaaactgcgggtactgggcgcgcacaagaaatatttggggctttccggctacgggctggaagtcgtggactacgtgacaaccgactga

SEQ ID NO: 49411 - protein, 371 aa, Methylococcus capsulatus str. Bath
MTLNTIEEIIEDIRQGRMVVIMDDEDRENEGDLVMAAGHVRPEDINFMARYGRGLICLTLTRERCQQLRLPLMVNENRTPHSTNFTVSIEAATGVTTGISASDRARTIQCAVAPDARPDDLVQPGHIFPLMAQPGGVLNRAGHTEAGCDLARLAGLVPAAVIVEILNEDGSMARRADLEKFAAVHGLKIGTIADLIHYRMQNEQTVERICECDFPTEHGRFRLHAYQDRLDNKLHLALTLGDVAGGEPVLVRVHGRNLLTDLFGVRRGDIGISLRAAMKRIADEGRGVLVVIRNEEDDRCLVERIHQYQMEDHGVDIGQREDPGVDWRTTGTGAQILADLGVRKLRVLGAHKKYLGLSGYGLEVVDYVTTD

SEQ ID NO: 49412 - DNA, 1245 bp, Nocardia farcinica IFM 10152
  CDS (1)..(1245): transl_table=11
gtgaccaggttcgacaccatcgagcgcgcagtcgccgacatcgccgccggtaaggcggtcgtcgtcgtcgacgacgaggaccgcgagaacgagggcgacctcatcttcgcggcggagaaggccacccccgaactggtcgccttcatgatccgctacacctccggctacatctgtgtgccgctcaccggtgaggactgcgatcggctcggcctgccgccgatgtatgcgaccaaccaggacaagcacggcaccgcctacacggtctcggtcgacgcgcgcgagggcatcaccaccggaatctcggcggccgaccgggccaccaccatgcggctgctcgccgacgccgacgcgaaggccgacgacctgacccgccccggccacgtcgtgccgttgcgcgccaaggacggcggcgtgctgcgccgccccggccacaccgaggcggccgtggacctggcgcggatggccgggttgcggccggccggcgtgatctgcgagatcgtcagccagaaggacgagggccacatggcccgcaccgaggaactgcgcgtgttcgccgacgaccacgatctggcgctgatctcgatcgcggacatgatcgcctggcggcgcaagcacgagaagcaggtggtgcgggtcgccgaggcgcgcatccccaccgcgcacggcgcgttcaccgcggtcggctaccagagcatctacgacgatgtcgaacacgtcgccctggtgcgcggcgacatcggcgacggcgaggacgtgctggtgcgcgtgcactccgaatgcctcaccggtgacgtgttcggttcgctgcgctgcgactgcgggccgcaactggacgcggccctggagatggtggaccaggaaggccggggcgtcgtgctgtacatgcgcgggcacgagggccgcggcatcggcctgatgcacaagctgcaggcctaccagttgcaggactccggccgcgacaccgtcgacgccaacctggatctcggtctgcccgccgatgcccgcgactacggcaccggcgcccagatcctggtggacctgggcatccggtcgatgcgcctgctgaccaacaaccccgccaagcgggtcggcctggacggctacggcctcaccatcaccgaacgggtgccgatgcccctgcgcgccaacgccgagaatctgcgctacctgcgcaccaagcgcgaccgcatggggcacgacctggtcgggctcgacgatctggatctgggagagaccgcacagtga

SEQ ID NO: 49413 - protein, 414 aa, Nocardia farcinica IFM 10152
MTRFDTIERAVADIAAGKAVVVVDDEDRENEGDLIFAAEKATPELVAFMIRYTSGYICVPLTGEDCDRLGLPPMYATNQDKHGTAYTVSVDAREGITTGISAADRATTMRLLADADAKADDLTRPGHVVPLRAKDGGVLRRPGHTEAAVDLARMAGLRPAGVICEIVSQKDEGHMARTEELRVFADDHDLALISIADMIAWRRKHEKQVVRVAEARIPTAHGAFTAVGYQSIYDDVEHVALVRGDIGDGEDVLVRVHSECLTGDVFGSLRCDCGPQLDAALEMVDQEGRGVVLYMRGHEGRGIGLMHKLQAYQLQDSGRDTVDANLDLGLPADARDYGTGAQILVDLGIRSMRLLTNNPAKRVGLDGYGLTITERVPMPLRANAENLRYLRTKRDRMGHDLVGLDDLDLGETAQ

SEQ ID NO: 49414 - DNA, 1209 bp, Legionella pneumophila str. Paris
  CDS (1)..(1209): transl_table=11
atgaaacattcattagcaacaatagaagaggctgtggcgacacttaaagccggtaaaatgattattctaatggatgatgaagatagagagaatgaaggtgatttggtgattgctgctgagcacgctactcctgaagccattaattttatgtctcgtcttggttgtggtttaatttgtttgcctatggctgaagaattgatagacaaaatccagctgcccatgatggctcggcataacaaatcgccgtatggtacggcgtttacggtttcgattgaagcagctaacggtgtctccacaggcatctcagcaagagacagagctcgaacaattcaagtggctattgatccaaaaagtgggccatctgatatcatttcacctggacatgtttttcctttacgggctagaaagagaggagttttagaaagaccaggtcaaacagaaggtagtgttgatttggtaagacttgccggattgaccccggcggcagtgatttgtgagatcattaatgaagatggaacaatgagcagacgtgatgaattagctcttttttcaaaaaaacatcaaatacctttagtcaccattaaagatttgattaattaccgaattcgtcacgaaaatcttattaatcctgtcgcaaccactcagattcctctggaggagaatggtgtttttactatgactgtttttgagaatcagatagattccggtgaacattttgtcttggttaaaccccctttgtatggtaatcaagtgcctttggttcgaattcattctgagtgcataacaggtgatgtttttggctccagaaaatgtgattgtggaaagcaactggagttgtctttatcccagatcggagctgaaggtggtatattaatttatttgcgtcaggaaggccgtggaataggtttggcaaacaaattaaaggcgtatgctttgcaagagcaggggtttgatacagtcgatgctaatctggaattaggattgcccgctgacgatagagattatgccgtagcataccaaatactgaaatatttgggggttgacgcattaaggttgctgacaaataatcctttaaaaatagcttctcttgagcgttacggaatgaaaattactcaacgtattcctttggaaattaagccctccagagaaaatcactgttatttaaaaaccaaaaaaataaagctggggcatttattagccattgattag

SEQ ID NO: 49415 - protein, 402 aa, Legionella pneumophila str. Paris
MKHSLATIEEAVATLKAGKMIILMDDEDRENEGDLVIAAEHATPEAINFMSRLGCGLICLPMAEELIDKIQLPMMARHNKSPYGTAFTVSIEAANGVSTGISARDRARTIQVAIDPKSGPSDIISPGHVFPLRARKRGVLERPGQTEGSVDLVRLAGLTPAAVICEIINEDGTMSRRDELALFSKKHQIPLVTIKDLINYRIRHENLINPVATTQIPLEENGVFTMTVFENQIDSGEHFVLVKPPLYGNQVPLVRIHSECITGDVFGSRKCDCGKQLELSLSQIGAEGGILIYLRQEGRGIGLANKLKAYALQEQGFDTVDANLELGLPADDRDYAVAYQILKYLGVDALRLLTNNPLKIASLERYGMKITQRIPLEIKPSRENHCYLKTKKIKLGHLLAID

SEQ ID NO: 49416 - DNA, 1104 bp, Photobacterium profundum SS9
  CDS (1)..(1104): transl_table=11
atgggtttaagcactgcgaaagaaattattgatgatattcgccatggtaagatggttatcttgatggatgatgaagatcgtgaaaatgaaggcgatcttatcattgcagcagagaaaattacgccagaagctgttaacttcatggcaatgttcggtcgtggtttgatttgcctaacgttaacacatgcacgttgtaagcaactcagcctgccattaatggtacaagacaatactgaacagtttagcactaacttcactgtttctattgaagccgccgttggcgttacaaccggtatttcagccgcagatcgtgcaacaacagtacaagccgctgttgccccgaatgccagcttttctgatatcgtgatgccgggacatatcttcccattaatggcacaagaaggtggcgtacttagccgtgctggtcatactgaagcaggttgtgatattgcgcgtttagcaggtcttgagccttcaagtgttattgtggaaattctaaatgaagatggcacaatggcacgtcgtcctcagttagaagtatttgctgaaaagcatggtttgaagctaggtacgatagctgaccttatcgaatatcgtaataacaacgaaaccacgattgaacgaattgcagaatgccgtttaccaacagagtttggtgagttcgatatgattacgtaccgtgatactatcgataatgaaattcactatgcattgcgtagtggtgatgtgaaagaaaatgcagaaacgttagtacgtgttcatttgcaagacacgtttaaagatgttttacattcaggtgcatcgcaatggacattgcctactgcaatgcaacgcattgcttctgaaggtggtgtgttggttgtgctgagcaagcaagaaaatcatgacacgattatcacgaaagtgaaaaaccttgcggcgaacgataacggacagccgaaagtgaaattgaacccgaaagatcaatctcgtcaggttggtgtgggctctcagattttatcggatttaggcgtttcaaaaatgcgtctgcttgcatcaagtacacaacgttatcattcactttcaggttttggcctagaagttgtagaatatatttgtgaataa

SEQ ID NO: 49417 - protein, 367 aa, Photobacterium profundum SS9
MGLSTAKEIIDDIRHGKMVILMDDEDRENEGDLIIAAEKITPEAVNFMAMFGRGLICLTLTHARCKQLSLPLMVQDNTEQFSTNFTVSIEAAVGVTTGISAADRATTVQAAVAPNASFSDIVMPGHIFPLMAQEGGVLSRAGHTEAGCDIARLAGLEPSSVIVEILNEDGTMARRPQLEVFAEKHGLKLGTIADLIEYRNNNETTIERIAECRLPTEFGEFDMITYRDTIDNEIHYALRSGDVKENAETLVRVHLQDTFKDVLHSGASQWTLPTAMQRIASEGGVLVVLSKQENHDTIITKVKNLAANDNGQPKVKLNPKDQSRQVGVGSQILSDLGVSKMRLLASSTQRYHSLSGFGLEVVEYICE

SEQ ID NO: 49418 - DNA, 1053 bp, Photobacterium profundum SS9
  CDS (1)..(1053): transl_table=11
atggttgaagacataaaattttatgagccagaagataatcacggttttttatccaactttgctttaagtcctataacactgagtgatgtggtatggccgagtagtgaacattattatcaagctcaaaaatttacagatctaagtattcaaaataaaatattaaatgcaaaaacaccggatgaggcttttaaaattagtcgtgattttgctgaacaagaaaaagatgattggatggaagttcgtggtgctgtaatgcgatttattgtattcgaaaaatttcgtcagaatacatattttacgcacctattagtcagtactggtgatcatgttcttaaagagcactcgcataaagatgattactggggagacggtggcgacggaagtggcagaaatgagttaggtaaaattctcatggatgttcgagagtattttgctaaaaaagaaccttttaaccttgttcattttgttgatagtgcaaagctgccgactcaatggggcacatttcaaatgtatggcttcattgaggtgaagacggggaaagaacatcttgcccttgtttatggtcaaccaacccctggtgagcctactcttatccgcttacattctgaatgtctaacaggcgatgcattatttagtcaacgttgtgattgtggttttcaactagctcgcgcaatggagaatatcgttaagaaaggatctggggtcctattatatttgaagcaagaagggcgaggcatcggtttaattaataagattcgcgcttatcacctgcaagacgaaggagcagatacagtagaagctaacgaaaggttaggctttgcagctgatatgcgtgattatgccttctgtagaggaatgctaagttttcttaatattgaatcagttagtttaatgacaaataatccacgtaagattaatgcactgactgataacggtattaatgttgttgaacgtgtcaccttgcaagaaggtaataacccttttaatgaaggttaccttaaaacaaaatcagccaaactaggccatatgtttgatgcggaatttattaagtaa

SEQ ID NO: 49419 - protein, 350 aa, Photobacterium profundum SS9
MVEDIKFYEPEDNHGFLSNFALSPITLSDVVWPSSEHYYQAQKFTDLSIQNKILNAKTPDEAFKISRDFAEQEKDDWMEVRGAVMRFIVFEKFRQNTYFTHLLVSTGDHVLKEHSHKDDYWGDGGDGSGRNELGKILMDVREYFAKKEPFNLVHFVDSAKLPTQWGTFQMYGFIEVKTGKEHLALVYGQPTPGEPTLIRLHSECLTGDALFSQRCDCGFQLARAMENIVKKGSGVLLYLKQEGRGIGLINKIRAYHLQDEGADTVEANERLGFAADMRDYAFCRGMLSFLNIESVSLMTNNPRKINALTDNGINVVERVTLQEGNNPFNEGYLKTKSAKLGHMFDAEFIK

SEQ ID NO: 49420 - DNA, 1200 bp, Thermus thermophilus HB8
  CDS (1)..(1200): transl_table=11
atggaagggatcgccagcgtcaaggaacttctggaggagctcaaggcgggccgccccgtgatcttggtggacgacgaggaccgggagaacgagggcgacctgatcatggcggcggagcacgtgaccccggagtgggtgaacttcatgctcaaggagtgccggggcctcctctgcgtggccctcacggaggagagggccaaggccctggacctccccctcatggtggagaggaaccaggacccccagggcacccgcttcaccgtgagcgtggacgcccgggggacgaccacggggatcagcgcctttgagcgggcggccaccatccggctcctcgccgaccccgaggccacggcccaggacttccgccgcccggggcacgtctttcccctggtggcgaggcccgggggggtcttgcgccgcgccgggcacacggaggccacggtggacctgttgcgcctcgccggcctcaccccggtgggcagcctcattgagatcctcaaggaggacggcaccatggcccgcctgcccgacctcctggccttcgctaggaggcacggcctcaaggtgggcaccatcgccgacctcatccgctaccgcctggagaagggggacctctacgtgcggcgggaggcggaggccctccttcccacccgctttggggagttccgcatcctgggctaccgcgacaccctcacgggggaggagcacgccgccttggtcatgggaagctgggcgccggaggagcccgtcctcgtgcgcatgcactccgagtgcctcaccggggacgccctccactccctgcggtgcgactgcggcttccagagggacctggccctacagcggatcgccgaggaggggaagggggtcttggtctacctgaggcaggaggggcgggggatcggcctcgtgaacaagatcaaggcctaccacctccaggaccaagggctggacacggtggaggccaacctggccctggggtttcccccggacctccgggactacggcgtgggggcccagatcctctacgacctcggggtgcggaagatgcgcctcctcaccaacaacccgcgcaaggtccgggccctctccggcttcggcatagagatcgtggagcgcatccccttgagggccggggacaacccccacaacgagcgctacctccaggccaagaaggagaagctcgggcactggatggattga

SEQ ID NO: 49421 - protein, 399 aa, Thermus thermophilus HB8
MEGIASVKELLEELKAGRPVILVDDEDRENEGDLIMAAEHVTPEWVNFMLKECRGLLCVALTEERAKALDLPLMVERNQDPQGTRFTVSVDARGTTTGISAFERAATIRLLADPEATAQDFRRPGHVFPLVARPGGVLRRAGHTEATVDLLRLAGLTPVGSLIEILKEDGTMARLPDLLAFARRHGLKVGTIADLIRYRLEKGDLYVRREAEALLPTRFGEFRILGYRDTLTGEEHAALVMGSWAPEEPVLVRMHSECLTGDALHSLRCDCGFQRDLALQRIAEEGKGVLVYLRQEGRGIGLVNKIKAYHLQDQGLDTVEANLALGFPPDLRDYGVGAQILYDLGVRKMRLLTNNPRKVRALSGFGIEIVERIPLRAGDNPHNERYLQAKKEKLGHWMD

SEQ ID NO: 49422 - DNA, 1197 bp, Geobacillus kaustophilus HTA426
  CDS (1)..(1197): transl_table=11
ttgatgtttgacacgattgaagcagcgctttcggcgctgaaaaacggagaagtgatcatcgtttgcgatgacgaagaccgcgaaaatgaaggcgattttgtcgtgctggccgaaaaagctactccggatgtcattaactttatgatcactcatggccgcgggctcgtctgcgtgccgattacggaggaattggcggagcggctcgagcttgagccgatggtcactcataacacggacgcgcatggcacagcgtttacggtgagtgtcgactacaaaacgacaacgacgggaatcagcgcctacgagcgggcggcgacgattcaggcgctgcttgatccgaatgtgaaagcgagcgattttaaacgtcctggccacgtttttccgttgattgcgaaaaagggaggcgtcttgcggcgcgccggccatacagaagcggcggttgatttggcccgtttgtgcggcgcgaagccggccggcgtcatttgcgaaatcattaaagaggacgggacgatggctcgcgttcctgatttgcggcaaatcgccgaccagttcggattgaaaatgatcacgatcaaagatttgatcgcctatcggagccagcgggaaaagctcgtgaaacgggaggtggacgtttggctgccgaccgaattcggcgaatttcgcgccatcggctacacaaacgtgctcgacggaaaagagcatgtggcgcttgtcaaaggagagatcatcccggatgagccgatcttggtgcgcgtccattccgaatgcttaactggcgatgtgtttggctcgtaccggtgcgactgcggtccgcagctgcatgcggcgctcaggcaaatcgaggcggaagggcgcggggtgttgctttacatgcgccaagaagggcgcggcatcggccttatgaacaagttgcgcgcttacaagctgcaggagcaaggttatgacaccgtcgaggcgaacgaaaagctcggcttccccgccgatttgcgcgattatggcatcggggcgcaaattttgaaagatcttggcgtgacgaaaatgcgcctgctcacgaacaacccgcgcaaaatcgccggcttaaaagggcatggactcgaagtcgttgaacgggtgcccattcagatgccagcgaaaaaggaaaatgaaaaatatttgcgcacgaaacatgaaaaattaggacatatgcttcatttttaa

SEQ ID NO: 49423 - protein, 398 aa, Geobacillus kaustophilus HTA426
MMFDTIEAALSALKNGEVIIVCDDEDRENEGDFVVLAEKATPDVINFMITHGRGLVCVPITEELAERLELEPMVTHNTDAHGTAFTVSVDYKTTTTGISAYERAATIQALLDPNVKASDFKRPGHVFPLIAKKGGVLRRAGHTEAAVDLARLCGAKPAGVICEIIKEDGTMARVPDLRQIADQFGLKMITIKDLIAYRSQREKLVKREVDVWLPTEFGEFRAIGYTNVLDGKEHVALVKGEIIPDEPILVRVHSECLTGDVFGSYRCDCGPQLHAALRQIEAEGRGVLLYMRQEGRGIGLMNKLRAYKLQEQGYDTVEANEKLGFPADLRDYGIGAQILKDLGVTKMRLLTNNPRKIAGLKGHGLEVVERVPIQMPAKKENEKYLRTKHEKLGHMLHF

SEQ ID NO: 49424 - DNA, 1134 bp, Anaplasma marginale str. St. Maries
  CDS (1)..(1134): transl_table=11
ttggaagttcgagtcttcttaaccgcaccatctcgtgggtctcaagtgaatttgataggcagagttttcggctttggcaacaatctggtagagagggcggtgttggagataaggcgctgcgcgccggttatcctccacaagagcggcaggtatgcgttggttttccctagcgaactgtcggaggaccactccttcgccacattaaccgagttttccagtaagttgcacctactgctaactgtcaggagaatggctgcagtcgcaggtgggcgtgcgctgtccagcgcgctggcaaacggtttcacactagcagatattgcagctgcgctatctactagcacaagtctgccacctggtgtgcaggttacaagcagcagtagcccgttagatggccacgcgatagacctaatgaagctagcaaagttgcttccttccgctctgatcgcagacatggagtttgcgcatgatggggaaatggagcagtggtgcgcgcaaaataacatactgtgtttggcatgcgatgcactgtctggctatcgtaaggagtatagcttgcgcgaggtttgccgctctgatctttgtctgaacaacgcaccggcttctaagatacttgtgtacaggtcaaacttaggagaaccggaacactatgcaattatcataggcgatccaagctttgagaaccccgtggtaaggttgcactcgtcgtgctacacgggagatctactgggcagcatttcgtgcgactgtagaggccaattactgcacaccatacagttcttgggcagtggaagtggcggcatagtgttatatatctctcaagagggaagaggaatagggctagcgaacaaaatacgcgcctataacttgcaaacgcagaacgctctggataccgtagacgcgaataggtttcttggattcgatgatgacgaaagagtcttcctgccagcagcgcgcattcttgacgagctgggaatctcaaagtttcagatgctaaccagcaaccccagcaaggtatctagtatgtgtgatcatggattcactgtcacaaaaatgatacccctttcggtcggaactcacgaacgcaatattgactacataaaaacaaaaatagaacgcctagggcacgttaattga

SEQ ID NO: 49425 - protein, 377 aa, Anaplasma marginale str. St. Maries
MEVRVFLTAPSRGSQVNLIGRVFGFGNNLVERAVLEIRRCAPVILHKSGRYALVFPSELSEDHSFATLTEFSSKLHLLLTVRRMAAVAGGRALSSALANGFTLADIAAALSTSTSLPPGVQVTSSSSPLDGHAIDLMKLAKLLPSALIADMEFAHDGEMEQWCAQNNILCLACDALSGYRKEYSLREVCRSDLCLNNAPASKILVYRSNLGEPEHYAIIIGDPSFENPVVRLHSSCYTGDLLGSISCDCRGQLLHTIQFLGSGSGGIVLYISQEGRGIGLANKIRAYNLQTQNALDTVDANRFLGFDDDERVFLPAARILDELGISKFQMLTSNPSKVSSMCDHGFTVTKMIPLSVGTHERNIDYIKTKIERLGHVN

SEQ ID NO: 49426 - DNA, 654 bp, Azoarcus sp. EbN1
  CDS (1)..(654): transl_table=11
atgcacaccgcggatacccgaaacgccgggccggttgcgagcaccgatgaaaccgaccagcggaacacccgcctggtcgcttcatgccggttgccgaccccctgggcaattttccggatgcacggcttcgaagagccggcgaccgggcgcgagcatgtcgcgctgacgcttggagcagtcgccgatggcaaacccgtgctgacccgcgttcactccgagtgcctcaccggcgacgccctgttcagccggcgctgcgactgcggcccgcaactcgaagcggcgctcgcggcgatcgctgccgaagggcgcggcgtcctgctgtacctgcgacaggaaggccgcggcatcggcctgctgaacaaggtccgcgcctatgcgctgcaggacgaaggggcggacaccgtcgaagccaatcacctcctcggcttcgacgccgacacgcgcgattacgccgtcgccgcctcgatgctgggcgagctcggcatcgcctcgttgcggctgatgacgaacaatccacgcaaggtcgccgcactcgagcagtacggcatcacggtcgccgagcgcgtgccgcacatcatcgagccgaacccgcacaacgcgaactacctgcgcaccaaagcccagcggctcggccacctgctcgccggacactga

SEQ ID NO: 49427 - protein, 217 aa, Azoarcus sp. EbN1
MHTADTRNAGPVASTDETDQRNTRLVASCRLPTPWAIFRMHGFEEPATGREHVALTLGAVADGKPVLTRVHSECLTGDALFSRRCDCGPQLEAALAAIAAEGRGVLLYLRQEGRGIGLLNKVRAYALQDEGADTVEANHLLGFDADTRDYAVAASMLGELGIASLRLMTNNPRKVAALEQYGITVAERVPHIIEPNPHNANYLRTKAQRLGHLLAGH

SEQ ID NO: 49428 - DNA, 1125 bp, Zymomonas mobilis subsp. mobilis ZM4
  CDS (1)..(1125): transl_table=11
atgtgcctttacttacggagttttcttttcatggttgaggatcgtaaagcgatagtcatagcacaggcgatagatgccttgcggcggggttggccgatttcgatctctgatcagggcgagattctaagcctgttggcggtcgaacgtgctgacgaccatcggctcaaggtctttgatcccgatcagacagccgatattttactgtctgcggcaagagcggctatcttgaatctcgccaatgacaaagaggctgctactcccgatcaacctgtcaccttggtaaggacgccttggatagattgtgcttctgccttggccttggctgatccttctatggatcttgaaatgccgatgaaggggccttttaaggttaaaaaaaccgttattaaatcggcagccgcatcggctttggaattggccagaatggcaggattacttccggctttcttcgttcaagaagggcagtccgagcaatccctcttgactattcctgcacaagatattgtcgatttcttccaagggcagggggtttacatcgccgcaagggcgcggttgccgattgccttgggcgatcatggtaaagccattgaaaacagccagatcgttgcgttcagaaatgatgccgatgccgtagagcatgttgcggtgattatcggtcatcctgatggtcaaccacccgttgttcgattgcatagcgaatgtcttaccggcgatgtgtttggttcgctgaaatgtgattgtggcccccagctacatcaggctttaaggattatggatgaatccggctatggcatcctgctttatttgcgacaggaagggcgtggtattgggctgatcaataaattgcgtgcctatagcttgcaagatcagggttttgatacagtagatgccaatgtccgcttgggctttgtcaatgatgcccgcgatttccggctggctgcccagatgctaggtgaattggaaataaagcaaatccgtttgctgaccaataatcctgacaaagtagaagggcttaaaaaagccggcattgatgttgtcgagcggttacccttaaagatcaagccgaacccgcataatcaggcgtatcttgaaaccaagcgagaccgtagcggccaccaattataa

SEQ ID NO: 49429 - protein, 374 aa, Zymomonas mobilis subsp. mobilis ZM4
MCLYLRSFLFMVEDRKAIVIAQAIDALRRGWPISISDQGEILSLLAVERADDHRLKVFDPDQTADILLSAARAAILNLANDKEAATPDQPVTLVRTPWIDCASALALADPSMDLEMPMKGPFKVKKTVIKSAAASALELARMAGLLPAFFVQEGQSEQSLLTIPAQDIVDFFQGQGVYIAARARLPIALGDHGKAIENSQIVAFRNDADAVEHVAVIIGHPDGQPPVVRLHSECLTGDVFGSLKCDCGPQLHQALRIMDESGYGILLYLRQEGRGIGLINKLRAYSLQDQGFDTVDANVRLGFVNDARDFRLAAQMLGELEIKQIRLLTNNPDKVEGLKKAGIDVVERLPLKIKPNPHNQAYLETKRDRSGHQL

SEQ ID NO: 49430 - DNA, 1122 bp, Silicibacter pomeroyi DSS-3
  CDS (1)..(1122): transl_table=11
atgagctttgagacgcccggacccgtcgaggcccgcctgcgcgacgcgatcagcccgatcgaagagatcatcgacgaggcgcgcaagggccggatgtatatcctggtcgatcacgaggatcgcgagaacgagggcgatctgtgcatcgccgccgagtttgccgatgccgccgcgatcaacttcatggccacgcatgggcgcggactgatctgcctgccgatgaccgccgaccggatcgaccgtctgggcctgccgatgatggcggtcaacaactcctcgcgccacgagaccgcctttaccgtctcgatcgaggcgcgcgagggcgtgtcgaccggcatttccgccgccgaccgggcgctgacggttgccaccgcgatcaatgaacagaacaccatggcaagccttgccacccccggacacatcttcccgttgcgcgccaagcggggcggggtgctggtgcgcgccggtcataccgaggcggcggtggatatctcgcgtctggcggggctgaacccttcgggcgtgatctgcgagatcatgaaggaagacggcaccatggcgcggctgcccgatctggtcgatttcgccgagcggcacgggatgaagatcgggaccatcagcgacctgatctcctatcgcgcccgcaacgacaatctggtggacgaaaccgcccgcagcaccgtcacctcggaatatggcggcgactgggagatgcgcatctttaccgaccagacccacggcatcgaacatgtggtgctggtcaagggcgacatctcgacccccgaaccggtgctgacccgcacccatgcgctgcacgaggcctcggacgtgctgggcctcggccccaagccgacccaggaactgccccgcgcgatggagaagatcgccgccgaagggcgtggcgtcgtctgcctgttccgccagccgcgcaacgcgctttacgccagtgacgaggacggcgtgcgcaccatcaagcagaccggtctgggtgcccagatcctgtccaagatgggcctgcacgagctgatcctgctcaccgactcgccgcaaaccagatatctcgggctcgacgcctatggcctgaccattgtcggcacccgccccattctgaaggacgcctga

SEQ ID NO: 49431 - protein, 373 aa, Silicibacter pomeroyi DSS-3
MSFETPGPVEARLRDAISPIEEIIDEARKGRMYILVDHEDRENEGDLCIAAEFADAAAINFMATHGRGLICLPMTADRIDRLGLPMMAVNNSSRHETAFTVSIEAREGVSTGISAADRALTVATAINEQNTMASLATPGHIFPLRAKRGGVLVRAGHTEAAVDISRLAGLNPSGVICEIMKEDGTMARLPDLVDFAERHGMKIGTISDLISYRARNDNLVDETARSTVTSEYGGDWEMRIFTDQTHGIEHVVLVKGDISTPEPVLTRTHALHEASDVLGLGPKPTQELPRAMEKIAAEGRGVVCLFRQPRNALYASDEDGVRTIKQTGLGAQILSKMGLHELILLTDSPQTRYLGLDAYGLTIVGTRPILKDA

SEQ ID NO: 49432 - DNA, 1092 bp, Silicibacter pomeroyi DSS-3
  CDS (1)..(1092): transl_table=11
atgagtctgatcccggatatcaccgagcttttggcccgcgcccgcgccgacctgcgcatgggtgtcccggtcgtgttgcgggacgagggtggcgatagcgcgctggcgctggcggccgagacgctgacagcggcgcggctggcggatctgcggcaattgggcgatccggtcattgccatcacagggcgccgggcggaaacgctcaaggcgcgcgcctatgacggcgatctggcgcgggtgatcctgcccaccggggccgatctgcgctgggttcaggcggtggccgatccatcggacgatctgaacacaccgatgaaggggccactgggcaccatgcggcagggcaaggccgggctgcaccgtctggcgatcagcctgaccaaatccgcccggctgctgccggcggcggtgctggtggcactgcccgaggggcgcacattcgctgccgatcacgggctgaccacgatcgaccacgcgcaggccgcgccacacctgtccgagcgcagcccgctgcacgtggtctcggccgcgcgcctgccgatggaggtgtcggaggccgggcgcctgcatgtgttccgccccgaggacggcggcgaagagcattacgcggtcgagatcggccgccccgaccgggacaaaccggtgcttgcgcggctgcattcggcctgtttcaccggcgacctgatgggcagcctgaaatgcgattgcggcccgcagttgcgcggcgcgctggcgcagatgggcgccgagggtgccggggtcctgctgtatctcaaccaagagggtcgcggcattgggctggccaacaagatgcgcgcctatttccttcaggatcaggggtttgacacggtcgaggccaaccaccgcctgggcttcgaggatgacgagcgtgactttcgcctgggctcggacatcctgaaatcgctggggttcaaatcggtgcggctgttgaccaacaaccccgccaagatcgccatgatggagcgcaccggcatcgcggtgaccgaacgggtgccgctcaaggtgggggaaaccgcacataaccggggctatctggcgaccaaggcggccaaatcgggccatatgctgtga

SEQ ID NO: 49433 - protein, 363 aa, Silicibacter pomeroyi DSS-3
MSLIPDITELLARARADLRMGVPVVLRDEGGDSALALAAETLTAARLADLRQLGDPVIAITGRRAETLKARAYDGDLARVILPTGADLRWVQAVADPSDDLNTPMKGPLGTMRQGKAGLHRLAISLTKSARLLPAAVLVALPEGRTFAADHGLTTIDHAQAAPHLSERSPLHVVSAARLPMEVSEAGRLHVFRPEDGGEEHYAVEIGRPDRDKPVLARLHSACFTGDLMGSLKCDCGPQLRGALAQMGAEGAGVLLYLNQEGRGIGLANKMRAYFLQDQGFDTVEANHRLGFEDDERDFRLGSDILKSLGFKSVRLLTNNPAKIAMMERTGIAVTERVPLKVGETAHNRGYLATKAAKSGHML

SEQ ID NO: 49434 - DNA, 1686 bp, Synechococcus elongatus PCC 6301
  CDS (1)..(1686): transl_table=11
gtgactttgccagaagactttcagtttgatgcgatcgccgacgcgatcgcggaaatcaaagccggtcgctcggtggtggtggttgacgatgaaaaccgcgaaaacgaaggtgacctgatctgtgcggctcagtttgccacccccgaaaagatcaacttcatggcggtggaagccagaggcttaatctgtctggctatgacgggcgatcgcctcgatcaactcgatttgccgctgatggtcgatcgcaacaccgacagcaatcaaactgcctttaccgtcagcattgatgcggccccccatctcggcgtcagcactggtatttctgctgaggatcgggcgcgaacgattcaagccacgatcaatcccctgaccaagccccacgatctgcgccgccccggtcacatttttccgctgcgatcgcgggagggcggtgtcctcaagcgggctggacataccgaagccgctgtcgatctagcacggatggctgggctctatcccgctggggtgatctgtgagatccagaatcccaatggatcgatggcgcggctgccggatttgattgactacgctcgtcagcatcggctgaaactgatcagcattgctgatctgatcagctatcggctgcaacatgagcgcttcgtgattcgcgaaacgatcgcgactttgccgagtgagttcgggcagttcacgatttttgcctaccgcaacagcttggatggctcagagcatgtggcgctggtcaagggcgatcccagccgctttagtcagcagccagtcatggtgcgcgttcactccgaatgtctgaccggtgatgccttcggttcactgcgctgcgattgccggatgcagctgcaggccgcgatgaagatgattgaaaatgctggtcagggcgtgattgtctacctacggcaagaaggtcgtggcattggcctaatcaacaaactcaaggcttattcactacaagatttggggctagataccgtcgaagccaacgcccgccttggctttccggctgacctgcgcaattacggcgtgggggcgcaaatcctcaacgacctaggggtaacgcgcattcgtctgatcaccaacaatccccgcaaaattgccggcctcaagggctatggactagaagtggtcgatcgcgtccccctgctgattgaagccaccccctacaattcgtcttatctggcgactaagggtgaaaaactcggccacttgctcctcaaaacccatctagccgcgatcgctctgcatctcacgccggaattacagaacaatccctatcgccaaacgctgattggtcagattcgcagtctggtgcaaggagagggattattcctgcaagaagagctgcgatcggtggcgtcagcgctctttggcccccaggtcctaaccctgcaggtcggcttggcccagtcagaagcgatcgcagcggactggtaccgctcgcccgattccccactggccgaccagctgcagcattgcttggaacaaatggctgcgatcgatggcttagaagatctggaatttctgctggcggatggtcatgacccgctaactagcttgcaggtgcagctcgatcgccagtcgttaccgctaccggatctgagccgccagttcaaaaccctgaagctgcagcagatctatcacttacagctgcaggaacgaccgagctttgtcagctga

SEQ ID NO: 49435 - protein, 561 aa, Synechococcus elongatus PCC 6301
MTLPEDFQFDAIADAIAEIKAGRSVVVVDDENRENEGDLICAAQFATPEKINFMAVEARGLICLAMTGDRLDQLDLPLMVDRNTDSNQTAFTVSIDAAPHLGVSTGISAEDRARTIQATINPLTKPHDLRRPGHIFPLRSREGGVLKRAGHTEAAVDLARMAGLYPAGVICEIQNPNGSMARLPDLIDYARQHRLKLISIADLISYRLQHERFVIRETIATLPSEFGQFTIFAYRNSLDGSEHVALVKGDPSRFSQQPVMVRVHSECLTGDAFGSLRCDCRMQLQAAMKMIENAGQGVIVYLRQEGRGIGLINKLKAYSLQDLGLDTVEANARLGFPADLRNYGVGAQILNDLGVTRIRLITNNPRKIAGLKGYGLEVVDRVPLLIEATPYNSSYLATKGEKLGHLLLKTHLAAIALHLTPELQNNPYRQTLIGQIRSLVQGEGLFLQEELRSVASALFGPQVLTLQVGLAQSEAIAADWYRSPDSPLADQLQHCLEQMAAIDGLEDLEFLLADGHDPLTSLQVQLDRQSLPLPDLSRQFKTLKLQQIYHLQLQERPSFVS

SEQ ID NO: 49436 - DNA, 1194 bp, Bacillus clausii KSM-K16
  CDS (1)..(1194): transl_table=11
gtgtttgaatcgattgatgaagcgatcacacaattaaaagcggggggaatgatcctcgttgtagatgatgaagaccgggagaatgaaggggattttttggctcttgctgaaacagcgtcccctgaaacaatcaattttatggcaacgcacggacgcggtctcatttgtgtgcctttgacggaagaacaggctgagcgcctgcagcttgggcagatggtgtctcacagcacagacccacatggaacggcatttactgtcagcgtcgaccattcacatacgacaacaggcatctctgcttttgagcgggcagaaacggtccgcgctttagcagatgccaatgcgcagccaagtgattttaaacggccagggcatgtttttccgcttgttgccaaaaacggcggtgtgctgcgccgggctggccataccgaagccgctgttgattttgcaaaactttgtggagcaaaaccggcaggcgttatttgcgaagtgatgaacgaagacggatcgatggctagagtgcctgagttgcgcatcattgccgatcagcacaacctgccactggtgacgattaaagatttgatcgcttaccgccgtaaaacggagaaagttgtgacgagagaagtggctatttcgttgccgactgagtatggcgactttaaagcagttggctatacgaataccatcgacggcaaagaaagtgtcgcccttgttaaaggggacgttggaaatggtgagcctgttctagtccgcgttcattccgaatgtctgactggtgatgtatttggctctaaacgatgcgattgtggtccacaattgcacgcagcgctaaagcaaattgaagctgaaggacgaggcgtactgctctatatgaagcaggaaggccgtgggattgggctaatcaataaattccgcgcctataagctgcaagaagaaggctacgatacagtggaagcgaatgagcgccttgggtttccagcggatttgcgcgaatacgggattggggcgcaaatcctacgtgatttaggcatccgtgacatgcggcttttgacgaataaccctcgaaaaattgcagggctagaaggctatgatttaaacattgttgagcgtgtgccactgcaaatggaagctgtagccgaaaatgaacgttatttgcatacgaaaagagaaaaacttgggcatatgctcaatttatag

SEQ ID NO: 49437 - protein, 397 aa, Bacillus clausii KSM-K16
MFESIDEAITQLKAGGMILVVDDEDRENEGDFLALAETASPETINFMATHGRGLICVPLTEEQAERLQLGQMVSHSTDPHGTAFTVSVDHSHTTTGISAFERAETVRALADANAQPSDFKRPGHVFPLVAKNGGVLRRAGHTEAAVDFAKLCGAKPAGVICEVMNEDGSMARVPELRIIADQHNLPLVTIKDLIAYRRKTEKVVTREVAISLPTEYGDFKAVGYTNTIDGKESVALVKGDVGNGEPVLVRVHSECLTGDVFGSKRCDCGPQLHAALKQIEAEGRGVLLYMKQEGRGIGLINKFRAYKLQEEGYDTVEANERLGFPADLREYGIGAQILRDLGIRDMRLLTNNPRKIAGLEGYDLNIVERVPLQMEAVAENERYLHTKREKLGHMLNL

SEQ ID NO: 49438 - DNA, 561 bp, Campylobacter jejuni RM1221
  CDS (1)..(561): transl_table=11
atggaaataaaaatttcagaaattgcgaatttacctagcaaatggggaaatttccaaatgcaaagtttcaaagaaaacgataaagaacatttatgcatatttaaaaacactccaaaagatacactcaatctaagaattcattcagagtgcttaacaggagatgctttaggaagtttaaaatgcgactgcggagaacagcttgaattttcgctaaaatatatagaaaagaatggcggaatggtgatttatcttagacaagaaggaaggggtatagggctttttaacaaggttaatgcttatgctttacaagataaaggttttgatacgattaaagcaaatcatcagcttggctttaaagccgatgagagaacttatgaaattgtagaatttatactcaaacactatgaaatttctaaggttaatttactcacaaataaccctgaaaagctagattctatcaaagaaaaaatcatcatacgcataccgattttaatagaacctaatcgttttaatgtagagtatttaaacataaaacaaactcaaatgggacatcttaaataa

SEQ ID NO: 49439 - protein, 186 aa, Campylobacter jejuni RM1221
MEIKISEIANLPSKWGNFQMQSFKENDKEHLCIFKNTPKDTLNLRIHSECLTGDALGSLKCDCGEQLEFSLKYIEKNGGMVIYLRQEGRGIGLFNKVNAYALQDKGFDTIKANHQLGFKADERTYEIVEFILKHYEISKVNLLTNNPEKLDSIKEKIIIRIPILIEPNRFNVEYLNIKQTQMGHLK

SEQ ID NO: 49440 - DNA, 1116 bp, Ehrlichia ruminantium str. Welgevonden
  CDS (1)..(1116): transl_table=11
atggaaaatttacttaatagctttaattccaataaacatattataaaaaaatccatagcagaattaaggactggcataccagtactattatacaatcacaaaagtaacctgcttgtctttccaagtgaaatgatagataatcaaatattacataaaatccagaaatattcggataatgcttacatattgatcacaggaaatagattgaattttatacttcaatctccaggaaatcagctttctagaattactttaaaagaatcttacagtatagactatatctcatatctactaataggtaagaaaccacacagttcatttgatcatattgatacaaatcacataactacaagtacaaatcctttagatataacatctatttctttaatcaagttaacaaaattattaccatcagcaattgttactgaaataaaacatcctgatatattacagtggtgtaataagtataatattactcctataaaacaagaaattatcgataatcacaaccaagaatatgaattacatgaagtatgtagttctcctttatttttaaaaaattgctgtaatgccaatgtaaactcaagcataaatatttatcgatcagatataggagaacctgaacattatgcacttattataggagaaccagattatagtaacccacttgttagaattcattcctcatgttacacaggagatctattagatagtctatcctgtgattgccgttcccaattacatctttctataaaactaatggtagaaaataagggtggaataattctatacctagcacaagatggccgtggtattggactaacaaataaaataagaacttaccaattacaaataaagtacaactttgatactgtagatgctaatagattttttgggtttgaagatgacgaaagagcattcattgcagcgataaaaatattagaaaaactaggaatctcaaaattgcagttactaactaacaatcccaataaagctgaagaaattaaaaaatatggaataaatattacaaaaatattacctatttttgttgacataaaccaacataatattaattatatcaataccaaagctaaaagactgggtcacgtaagttag

SEQ ID NO: 49441 - protein, 371 aa, Ehrlichia ruminantium str. Welgevonden
MENLLNSFNSNKHIIKKSIAELRTGIPVLLYNHKSNLLVFPSEMIDNQILHKIQKYSDNAYILITGNRLNFILQSPGNQLSRITLKESYSIDYISYLLIGKKPHSSFDHIDTNHITTSTNPLDITSISLIKLTKLLPSAIVTEIKHPDILQWCNKYNITPIKQEIIDNHNQEYELHEVCSSPLFLKNCCNANVNSSINIYRSDIGEPEHYALIIGEPDYSNPLVRIHSSCYTGDLLDSLSCDCRSQLHLSIKLMVENKGGIILYLAQDGRGIGLTNKIRTYQLQIKYNFDTVDANRFFGFEDDERAFIAAIKILEKLGISKLQLLTNNPNKAEEIKKYGINITKILPIFVDINQHNINYINTKAKRLGHVS

SEQ ID NO: 49442 - DNA, 1212 bp, Dehalococcoides ethenogenes 195
  CDS (1)..(1212): transl_table=11
atgcctaatgcccgtgttgaagatgctattgcagatataaaggccggccgttttgttattgtagtagatgactatgaccgcgaaaatgaaggtgatttggtcatggcctctgaaatggtcacgcctgatgccataaatttcatggcaaaaaatgcccgcggccttatttgtgtttcactcactgccgaaaggcttgaacagctgaaaatacctatgatggttacggaaaatacctcgccttacagcaccgggttcaccgtttcggtggaagcccgtaaaaaagttactaccggtatttcagcggctgaccgggcggctacagtgcaggttttgatagacccggcggctacccgtgaagatattgccatgcccggacatatgttccccctgcgcgcccgcgaaggcggggtgctggtacgggcggggcataccgaagcctctatggatttaacccggatggccgggctgtacccttccggtgtactttgcgagattatgaatgatgacggcactatggcccgtctgccccagcttgaagcgaaagccgccgaatgggctataaagataataagcgttaaggacataatttcctaccgccgccgtaccgaaaaaatggttaaaaagataaccgaagccgaactgcctacttctcacggacagtttaaagcggttgcctataaaagccagtttgatgctgacgaacacattgctctggtaatgggagatatctccggcccggagccggttttggtcagggtacacagcgaatgtatcaccggtgatgtctttggcagcaagcgctgtgattgcggtgagcagctggatatggcgcttaatcaaatagccaaagccgggcggggagtgctgctttatatgcggcaggaaggccgcggcataggcctgcataacaagctgtgcgcatatgccctgcaggacaagggtttggatacggttgaggctaacattgaacttggttttgcacctgacctgcgtgaatacggtataggtgctcagatactggtagatttgggcttaagtaaaatccggatgatgaccaataaccccaaaaaggtggtaggtctggagggttacggtattcaggtagttgagaccgtgcctattatagttgaacctaacagttttaaccgccattatctggaaaccaaacagaaaaaaatgggccatctgttaaacgtagacaaaacaaactaa

SEQ ID NO: 49443 - protein, 403 aa, Dehalococcoides ethenogenes 195
MPNARVEDAIADIKAGRFVIVVDDYDRENEGDLVMASEMVTPDAINFMAKNARGLICVSLTAERLEQLKIPMMVTENTSPYSTGFTVSVEARKKVTTGISAADRAATVQVLIDPAATREDIAMPGHMFPLRAREGGVLVRAGHTEASMDLTRMAGLYPSGVLCEIMNDDGTMARLPQLEAKAAEWAIKIISVKDIISYRRRTEKMVKKITEAELPTSHGQFKAVAYKSQFDADEHIALVMGDISGPEPVLVRVHSECITGDVFGSKRCDCGEQLDMALNQIAKAGRGVLLYMRQEGRGIGLHNKLCAYALQDKGLDTVEANIELGFAPDLREYGIGAQILVDLGLSKIRMMTNNPKKVVGLEGYGIQVVETVPIIVEPNSFNRHYLETKQKKMGHLLNVDKTN

SEQ ID NO: 49444 - DNA, 1161 bp, Thermococcus kodakarensis KOD1
  CDS (1)..(1161): transl_table=11
atgaactgggacagagttaggggtctagtccttgaaggaaagccagttgttctcatagacaatcgaagggagttcgaggctgatctaatttatccagccgagatagcttctcccgagatcgtcaacttcatgctctccatgaaaggcctcctctgcctcacgatggacatggacgaggcgttgaagaggggcttcttcccgcttcccagcaaggaaggagagacgaacttcttggttcccgttgattacaaagaaactttcacgggaataaccgctgaagagagggccttaacggcccggaagattgctgaagggcttggtgtgggggccttccgctatcctggacatctccacctccttggcggcatcggcctcaacaggaggagggggcacacggagagctctcttgagctgatggagatactcggcttcaagaggtacgccctgatggttgagatactcgacgaaaagggcgactctcacaacagggagtacgccttgaagctcgcggaggagcacggccttccagtcctcaccacggacgatgtctggaaggaattcgtgaggagaaaacagctgatgagaatctacgccagcgcgaggctcccgacgaggtacggcgactttagaataatagccttcgacaacgagctggactttaaggagcatgtggcaatagtcaaggagccctatggtgaggtcccacttgtcagggttcactcaaagtgcctcacaggagacacattcgcttcactcaagtgcgactgcgggagccagctcgccaacgccctcaggatgatagcccaggagggcgggatactcctctacatggaccaggaaggcaggggaatcggcctgaaggagaagataaaggcctacgagctccaggacaaaggctttgacaccgttgaggccaacaaagccctcggccgcggtgaggacgagaggacttacgaggccgccttccagatgcttcgtgctctgggagtttcaaagatcaggctgataaccaacaacccgaggaaggcaaaggcccttgaggagttcgggatagaggtcgttgagacggttccggctccgggggaggttactgaacacaacaagccctacctgaaggtcaaagccgagaagctcggtcacaagctcccctttaaagtttag

SEQ ID NO: 49445 - protein, 386 aa, Thermococcus kodakarensis KOD1
MNWDRVRGLVLEGKPVVLIDNRREFEADLIYPAEIASPEIVNFMLSMKGLLCLTMDMDEALKRGFFPLPSKEGETNFLVPVDYKETFTGITAEERALTARKIAEGLGVGAFRYPGHLHLLGGIGLNRRRGHTESSLELMEILGFKRYALMVEILDEKGDSHNREYALKLAEEHGLPVLTTDDVWKEFVRRKQLMRIYASARLPTRYGDFRIIAFDNELDFKEHVAIVKEPYGEVPLVRVHSKCLTGDTFASLKCDCGSQLANALRMIAQEGGILLYMDQEGRGIGLKEKIKAYELQDKGFDTVEANKALGRGEDERTYEAAFQMLRALGVSKIRLITNNPRKAKALEEFGIEVVETVPAPGEVTEHNKPYLKVKAEKLGHKLPFKV

SEQ ID NO: 49446 - DNA, 1182 bp, Staphylococcus aureus subsp. aureus COL
  CDS (1)..(1182): transl_table=11
atgcaattcgataatattgacagtgctttaatggctttaaaaaatggagaaccaattattgtagtagatgatgagaatcgtgaaaatgaaggtgatttagtagcggttactgaatggatgaacgataataccattaattttatggcgaaagaagcaaggggattaatatgcgcaccagtgtctaaagatattgcacaacgtttggatttggtacaaatggttgatgataactccgacatctttggtacgcaatttacagtgagtattgatcatgtagatacaacaacaggaattagtgcttatgaacgtacattgactgccaaaaagctcattgatcctagtagtgaagctaaagattttaatcgtcctggtcatttatttccattagtagcacaagataaaggcgtattagctagaaatggacacacagaagcggctgttgatttagctaaacttactggtgccaagcccgctggtgtcatttgtgagattatgaatgatgacggcacgatggcgaaaggacaagatttacaaaagtttaaagaaaaacatcaattaaagatgattacgattgatgatttaattgaatatcgtaaaaaattagaaccagaaattgaatttaaggcaaaagtgaaaatgcctacagatttcggaacatttgatatgtatggttttaaagcgacatacacagatgaagagatagttgtactgacaaaaggtgcaattcgacaacatgaaaatgtacgcttacattctgcgtgccttacaggcgatattttccatagtcaacgttgtgattgtggtgctcaacttgaatcgtctatgaagtatatcaatgaacatggtggcatgattatttatctacctcaagaaggtcgtggcataggattgttaaacaaattacgcgcatatgaattaattgagcaaggatatgatacagtaactgcaaatttagcattaggttttgatgaagatttgcgagattatcatattgctgcacagattttaaaatattttaacatcgaacatatcaatttattaagtaataatccaagtaaatttgagggattaaaacaatatggcattgatattgcagaaagaattgaagttatcgtaccagaaacggtacataatcatgattatatggaaacgaaaaaaataaaaatgggtcatttaatatag

SEQ ID NO: 49447 - protein, 393 aa, Staphylococcus aureus subsp. aureus COL
MQFDNIDSALMALKNGEPIIVVDDENRENEGDLVAVTEWMNDNTINFMAKEARGLICAPVSKDIAQRLDLVQMVDDNSDIFGTQFTVSIDHVDTTTGISAYERTLTAKKLIDPSSEAKDFNRPGHLFPLVAQDKGVLARNGHTEAAVDLAKLTGAKPAGVICEIMNDDGTMAKGQDLQKFKEKHQLKMITIDDLIEYRKKLEPEIEFKAKVKMPTDFGTFDMYGFKATYTDEEIVVLTKGAIRQHENVRLHSACLTGDIFHSQRCDCGAQLESSMKYINEHGGMIIYLPQEGRGIGLLNKLRAYELIEQGYDTVTANLALGFDEDLRDYHIAAQILKYFNIEHINLLSNNPSKFEGLKQYGIDIAERIEVIVPETVHNHDYMETKKIKMGHLI

SEQ ID NO: 49448 - DNA, 1182 bp, Staphylococcus epidermidis RP62A
  CDS (1)..(1182): transl_table=11
atgcaattcgatacaattgagttggctatagaggctttaagaaatggagagagcattattgtagttgacgatgaagatagagaaaatgaaggagatcttgtagctgttacggaatggatggatgataataccattaattttatggctagagagggtcgtggtctgatttgtgcaccaattgataaatctatagctgaaagattaaaactacaatctatggagcaaaataacactgatatttatggcacacattttactgtaagcattgatcattataaaactactacaggaatcagtgcacatgaacgtacacaaacggctagagcactcatagatgaaaatactaatcctgaagattttcatcgtccggggcacttatttccacttatagcaaaagagaatggtgtgttaacacgtaatggtcatactgaagctgccgtagatttggcacggttaacaggagcacaaccagctggagtaatctgcgaaattatgaatgatgatgggacaatggctaagggtgaagatctccagtcatttaaagaacgccaccatttaaaaatgattactataaaaagtttggttgcttttcgtaaggctgttgaacttaatgttaatcttaaggcaaaggtcaagatgccaacagattttggtcattttgatatgtatggatttacaacgaattatagcgatgaagaaatcgttgctattgttaaaggagatttaaaaagcaatcctaatgtacgtatgcattctgcttgtctgactggggatatttttcatagtcaaagatgtgattgcggggcacaacttgaagcgtcaatgaaatatattgacgaacatggtggaatgattatttatttacctcaagaaggtagaggaatagggttaattaataagttgcgcgcatatgagttgatagaaaaaggttatgatacagttactgcaaatcttgctcttggttttgatgaggatttgagagattatcatgttgcagctgaaatattaaagtattttgatataagtgaaattaacttgctcagcaataatcctaaaaaatttgaaggtttagaagattacggcattgagatcgtagatagaattgaacttatcgttccagaaacacaatataaccatagttatatggaaactaaaaaaaataaaatgggacatttaatatag

SEQ ID NO: 49449 - protein, 393 aa, Staphylococcus epidermidis RP62A
MQFDTIELAIEALRNGESIIVVDDEDRENEGDLVAVTEWMDDNTINFMAREGRGLICAPIDKSIAERLKLQSMEQNNTDIYGTHFTVSIDHYKTTTGISAHERTQTARALIDENTNPEDFHRPGHLFPLIAKENGVLTRNGHTEAAVDLARLTGAQPAGVICEIMNDDGTMAKGEDLQSFKERHHLKMITIKSLVAFRKAVELNVNLKAKVKMPTDFGHFDMYGFTTNYSDEEIVAIVKGDLKSNPNVRMHSACLTGDIFHSQRCDCGAQLEASMKYIDEHGGMIIYLPQEGRGIGLINKLRAYELIEKGYDTVTANLALGFDEDLRDYHVAAEILKYFDISEINLLSNNPKKFEGLEDYGIEIVDRIELIVPETQYNHSYMETKKNKMGHLI

SEQ ID NO: 49450 - DNA, 1254 bp, Gluconobacter oxydans 621H
  CDS (1)..(1254): transl_table=11
atgaagccgtccctgaaagcggccatcgaggccatccgcgctggcggcatggtcgtcatggtcgatgacgagaaccgtgagaacgaaggcgatctggtcatggcggcgcagttcgccacgccggaagccatcaatttcatggtccgcgaggcgcgcgggctggtctgcctgccgctggaagccgaacaggtggaccgcctcggcctgccgcccatggtcacgcgcaaccgcgatccgcgcggcacggccttcacggtctcgatcgaagcggcaacaggtgtgacgaccggcatttccgccgccgaccgcgcgcgcacgatcgtcgtcgcggccaatccggacgcaacaccggacgatgtcgtctcacccggccacatcttcccgctccgcgcccatcccgaaggcgttctgggccgcaacggtcataccgaaggctccatcgacatcgcgcgtctggccgggctggaaccggctggcgtgatctgcgagatcatggccgatgacggcagcatgatgcgcctgccggaacttcggaaatacgcggcaaagcacaacatgcccgtggtcagcatcgcagaccttcaggactggtgccgcgagcatggccgtggccctgtcgcaggtcatgacctgatctgcacgcccgtcccggccgctggcgaaatggtggccgaatccgccctgcccagcatcttcggcggccacgacctgcggatccatgccttccgcgccgtcgatggcgtggagcatgtcgcgctggtgaagggcgatccatccaaaggcgtgcctttagtgcggctgcattcagaatgcgtgacgggcgatgcgctcggctccctgcgctgcgactgcggcgcgcagctccgcgaggcgctggaacggatttcggcgtcggaatccggcgtgctggtctatctgcgcggccatgaaggacgcgggatcggcctggccaacaagatccgcgcctacgagcttcaggatcatggcatggacactgtggaggccaatgaagcccttggactgcccgccgatgcccgtgaatgggatgcggcagccgaccttctgcgccatctgggcgtgagttcactccgccttctgacgaacaatccggacaaggaatccaacctggtccgcttcggctttgacgtgaaatccagcgagcggctggaaatcgaggccaatcctttcaaccgcgcctatcttgcgaccaaacgcacgcggatgggccatttccttcaggaacagccggcatga

SEQ ID NO: 49451 - protein, 417 aa, Gluconobacter oxydans 621H
MKPSLKAAIEAIRAGGMVVMVDDENRENEGDLVMAAQFATPEAINFMVREARGLVCLPLEAEQVDRLGLPPMVTRNRDPRGTAFTVSIEAATGVTTGISAADRARTIVVAANPDATPDDVVSPGHIFPLRAHPEGVLGRNGHTEGSIDIARLAGLEPAGVICEIMADDGSMMRLPELRKYAAKHNMPVVSIADLQDWCREHGRGPVAGHDLICTPVPAAGEMVAESALPSIFGGHDLRIHAFRAVDGVEHVALVKGDPSKGVPLVRLHSECVTGDALGSLRCDCGAQLREALERISASESGVLVYLRGHEGRGIGLANKIRAYELQDHGMDTVEANEALGLPADAREWDAAADLLRHLGVSSLRLLTNNPDKESNLVRFGFDVKSSERLEIEANPFNRAYLATKRTRMGHFLQEQPA

SEQ ID NO: 49452 - DNA, 1116 bp, Ehrlichia ruminantium str. Gardel
  CDS (1)..(1116): transl_table=11
atggaaaatttacttaatagctttaattccaataaacatattataaaaaaatccatagcagaattaaggactggcataccagtactattatacaatcacaaaagtaacctgcttgtctttccaagtgaaatgatagataatcaaatattacataaaatccaaaaatactcggataatgcttacatattgatcacaggaaatagattgaattttatacttcaatctccaggaaatcagctttctagaattactttaaaagaatcttacagtatagactatatctcatatctactaacaggtaagaaaccacacagttcatttgatcatattgatacaaatcatataactacaagtacaaatcctttagatataacatctatttctttaatcaagttaacaaaattattaccatcagcaattgttactgaaataaaacatcccgatatattacagtggtgtaataagtataatattactcctataaaacaagaaattatcgataatcacaatcaagaatatgaattacatgaagtatgtagctctcctttatttttaaaaaattgctgtaatgccaatgtaaactcaagcataaatatttaccgatcagatataggagaacctgaacattatgcacttattataggagaaccagattatagtaacccacttgttagaattcattcttcatgctacacaggagatctattagatagtctatcctgtgattgccgttcccaattacatctttctataaaactaatggtagaaaataagggtggaataattttatacctagcacaagatggccgtggtattggactaacaaataaaataagaacttaccaattacaaataaagtacaactttgatactgtagatgctaatagattttttgggtttgaagacgatgaaagagcatttattgcagccataaaaatattagaaaaactaggaatctcaaaattacagttactaactaacaatcccaataaagctgaagaaattaaaaaatatggaataaatattacaaaaatattacctatttttgttgacataaaccaacataatattaattatatcaataccaaagctaaaagactgggtcacgtaagttag

SEQ ID NO: 49453 - protein, 371 aa, Ehrlichia ruminantium str. Gardel
MENLLNSFNSNKHIIKKSIAELRTGIPVLLYNHKSNLLVFPSEMIDNQILHKIQKYSDNAYILITGNRLNFILQSPGNQLSRITLKESYSIDYISYLLTGKKPHSSFDHIDTNHITTSTNPLDITSISLIKLTKLLPSAIVTEIKHPDILQWCNKYNITPIKQEIIDNHNQEYELHEVCSSPLFLKNCCNANVNSSINIYRSDIGEPEHYALIIGEPDYSNPLVRIHSSCYTGDLLDSLSCDCRSQLHLSIKLMVENKGGIILYLAQDGRGIGLTNKIRTYQLQIKYNFDTVDANRFFGFEDDERAFIAAIKILEKLGISKLQLLTNNPNKAEEIKKYGINITKILPIFVDINQHNINYINTKAKRLGHVS

SEQ ID NO: 49454 - DNA, 1083 bp, Wolbachia endosymbiont strain TRS of Brugia malayi
  CDS (1)..(1083): transl_table=11
atgtttataggaaaccgaaatagaaataaagtagaaagggccatcagcgaaattaggcgcggcctaccaattataatatatgataaaagtaattatctattggttgctgctgccgagactttagaaaaagacttgtttaatcagtacgggcttatctcaggtaagatatatgttattctaccttcaagtaaggtaacgtgcatatctcaaaacgtggagcatagtagcaaacgcttattgataaacaattttgatgaactatttcatttagtaaactgttcaaaagaagatcatacgaaggaattacaacgttcaaaggcaatagatgaatgcgctattactttgctaaaatcttcagaattgttgccatacgcattagtggttgacgtgaacttcaaagatgaatatgaaatgcgaggctggtgtgaaaaaagtgatgtaattgcactagacgtgctatttataaataactttcaacaaaatcaggatatatatgaagtatgcaaaacaccattatttttaaaacagactcaaaaagtaaacatcatatcttataggacctgtaatggcagaaaagaacattacgcaattattattggcaatccaggtaaaaatagtgaaccattagtaagagttcattcttcatgctatacaggcgacttattagatagcttatcatgcgattgcagaagtcagttacatcaagcaattcaaataatgactgactctgggaatggtattatactatacctgatgcaagatggtagaggcattggtttaactaacaagttaagggcatatgatatgcaaagaaaatataaccttgatactgtggatgcaaatagaatattgggttttgaagatgatgagaggagtttcgctgttgcagctgaaatgctcaagaaattaggcatcaaaaaaatccagctacttacaaataatggtagaaagctatcagagttgaaaaataatggtatagaggtcacaagatgtctaccacttattatggaacgtaacaagtataacgattcgtatatagaaacaaaatttagcaggttaggtcacagattaagaactttttag

SEQ ID NO: 49455 - protein, 360 aa, Wolbachia endosymbiont strain TRS of Brugia malayi
MFIGNRNRNKVERAISEIRRGLPIIIYDKSNYLLVAAAETLEKDLFNQYGLISGKIYVILPSSKVTCISQNVEHSSKRLLINNFDELFHLVNCSKEDHTKELQRSKAIDECAITLLKSSELLPYALVVDVNFKDEYEMRGWCEKSDVIALDVLFINNFQQNQDIYEVCKTPLFLKQTQKVNIISYRTCNGRKEHYAIIIGNPGKNSEPLVRVHSSCYTGDLLDSLSCDCRSQLHQAIQIMTDSGNGIILYLMQDGRGIGLTNKLRAYDMQRKYNLDTVDANRILGFEDDERSFAVAAEMLKKLGIKKIQLLTNNGRKLSELKNNGIEVTRCLPLIMERNKYNDSYIETKFSRLGHRLRTF

SEQ ID NO: 49456 - DNA, 1134 bp, Xanthomonas oryzae pv. oryzae KACC10331
  CDS (1)..(1134): transl_table=11
atgagcaggcccatcccctcccccagcgcgcagagcttcggcgacccggcggccatccgctgcgagcgcgccgcctccgagctgcgtgccgggcgcccggtgctgctgacggcggcagatgggcaggcgcgtgcggtgctggcactggatagcagcacggcgcagtcgcacaccgccttcgcccgcgccgcgcaggcccgccactatctgttcgtgacgcccacccgcgcccaggtgctgggcttgcgcgcgccgcagggcgcgcgcgtgcgcttgagcgatcacagctacgaccagatcgccgcgctggcctacctgcgcgacacaacggtgcccacgcagtggacggccggcgatgcgctggatgccggtggcgtggagatcgcacggcttggcctactgctgccggcactgctggcggtggaactgcgcgatgtgcacgaccatgccgcgttcgccggctgccagtcgctggcactgggcgatttgagccgcggctgcgccacgtccgcggccgccggctacgagttggtgacccgcaccccggtgccgttacgcggcctgggcatgagcgaattcgtggtgttccgcggcggcgtggcgcagcgcgaccagctggccatcttggtcggccagccggacctcatgagtgccgtgccggtgcgtgtgcattcgtcgtgcctgaccggcgacctgttcggctcgctcaaatgcgattgcggcgaccagctgcgacacggcctggccaagctgaaagaactcggcggcggtgtgctgctgtacctggatcaggaaggccgcggcaccggcatcgccgccaagatgcgcgcctacggctatcagcatgctggcctggacacgatcgatgccgacgcgcagctgggcttcggcccggacgagcgccgctacggcagtgcggtggcgatgctgcaagggctgggcattggccggatccggctgttgaccaataacccggccaaggccgagcgcctgcgcgcggcaggtattgcggtcgaagaccgcatcgcaatcaccggcgacatcaccgcggaaaacgagcagtacctgcgcaccaaggccgcacgcgcaggccatgcgctggatgtggatgcgttgatcctggccgcgcagtag

SEQ ID NO: 49457 - protein, 377 aa, Xanthomonas oryzae pv. oryzae KACC10331
MSRPIPSPSAQSFGDPAAIRCERAASELRAGRPVLLTAADGQARAVLALDSSTAQSHTAFARAAQARHYLFVTPTRAQVLGLRAPQGARVRLSDHSYDQIAALAYLRDTTVPTQWTAGDALDAGGVEIARLGLLLPALLAVELRDVHDHAAFAGCQSLALGDLSRGCATSAAAGYELVTRTPVPLRGLGMSEFVVFRGGVAQRDQLAILVGQPDLMSAVPVRVHSSCLTGDLFGSLKCDCGDQLRHGLAKLKELGGGVLLYLDQEGRGTGIAAKMRAYGYQHAGLDTIDADAQLGFGPDERRYGSAVAMLQGLGIGRIRLLTNNPAKAERLRAAGIAVEDRIAITGDITAENEQYLRTKAARAGHALDVDALILAAQ

SEQ ID NO: 49458 - DNA, 1110 bp, Vibrio fischeri ES114
  CDS (1)..(1110): transl_table=11
atggcaattagctcagcaaaagacattattgaagatattcgtttaggtaagatggttattcttatggatgacgaagatcgtgagaatgaaggtgatttaattattgccgctgagaaaatcactcctgaagccattaactttatggcaactcatggacgtggtttaatctgtttaacgatgacaaaagatcgttgtgaaaaacttggtctacctcctatggtacaagacaataatgcacaatttacaacgaattttacggtatcaattgaagcggcagaaggcgtaacaaccggtatttcagcagcagaccgttctcgcaccgttgaagcggcagtagctaaaaatgcagttgctgcagatttagttcaaccagggcatattttcccactagcagcacaagaaggcggcgtattaactcgtgctggtcatacagaagctgggtgtgatttagctcgtttagctggctatgagcctgctggtgtgattgttgaaatcttgaatgatgatggaacaatggctcgtcgccctgatttggaaatttttgctgaaaaacacggcattaaattaggtacggttgctgatttaattgaatatcgtaataacaacgaaacgacaattgaacgtgtagctgagtgtaaattaccaacagagtttggtgagtttgatttggtgacttaccgtgacacgattgataatcaactgcactacgctcttaagaaagaaaatacgtcaagtgaagcgccgttagttcgtgttcatttacaagatacatttactgatattttgcattcagaccgttgtgcagaacgcagctggacattgccaacagcaatgcagcgtattgccaatgaaggtggtgtattagtgattcttggtaatgaagaatcaacagatagtatcgtacataaagtgaaagttcttgagcgtcaagacagtggtgaagcaccaacaatggcgaagaagcaaggaacttcacgtcgtgtaggtgttggctctcaaattttggctgatattggtatttctgacatgcgtttactttcatcaacgtcaaagcgttaccatgccttatctggctttggtttgaacgttgttgaatacgtaacgaaataa

SEQ ID NO: 49459 - protein, 369 aa, Vibrio fischeri ES114
MAISSAKDIIEDIRLGKMVILMDDEDRENEGDLIIAAEKITPEAINFMATHGRGLICLTMTKDRCEKLGLPPMVQDNNAQFTTNFTVSIEAAEGVTTGISAADRSRTVEAAVAKNAVAADLVQPGHIFPLAAQEGGVLTRAGHTEAGCDLARLAGYEPAGVIVEILNDDGTMARRPDLEIFAEKHGIKLGTVADLIEYRNNNETTIERVAECKLPTEFGEFDLVTYRDTIDNQLHYALKKENTSSEAPLVRVHLQDTFTDILHSDRCAERSWTLPTAMQRIANEGGVLVILGNEESTDSIVHKVKVLERQDSGEAPTMAKKQGTSRRVGVGSQILADIGISDMRLLSSTSKRYHALSGFGLNVVEYVTK

SEQ ID NO: 49460 - DNA, 594 bp, Neisseria gonorrhoeae FA 1090
  CDS (1)..(594): transl_table=11
atgtctgaattattagaccatgtcgcttcctgccgtctgccgaccgaatggggcgtatttacgatgcacggttttgaagaggcaaacgggcaggaacacgtcgcgctgaccgtcggcaattgttcagacggcaatccggtgttgacgcgcatccactccgaatgtctgacgggcgacgcgctgttctcgagaaaatgcgactgcggaccgcaacttgaagcggcaatgagggcggtacaggcagaggggcgcggcatcatcgtctatctgcgtcaggaaggacgcggcatcgggctgattaacaaaatccgcgcctatcatctgcaagaacaaggtatggataccgttgaagccaatttggcactcgggctgcccgtcgatgcccgcgatttccgtttggcgcaatctatctacgaatatctgggcatccgctcggtcaaactgttgaccaacaaccccgaaaaaatccaaaccctgaaagatgcggggattaacgtggtcgaacgcattcccctgcacgtcggggaaaatctggaaaacgagcgttatctccaaaccaaagcagacaagctggggcatttgatgtcggaataa

SEQ ID NO: 49461 - protein, 197 aa, Neisseria gonorrhoeae FA 1090
MSELLDHVASCRLPTEWGVFTMHGFEEANGQEHVALTVGNCSDGNPVLTRIHSECLTGDALFSRKCDCGPQLEAAMRAVQAEGRGIIVYLRQEGRGIGLINKIRAYHLQEQGMDTVEANLALGLPVDARDFRLAQSIYEYLGIRSVKLLTNNPEKIQTLKDAGINVVERIPLHVGENLENERYLQTKADKLGHLMSE

SEQ ID NO: 49462 - DNA, 1266 bp, Chlamydophila abortus S26/3
  CDS (1)..(1266): transl_table=11
ttggtgataaaattcgatgatgatgctcgtgcctcgtgttttgtccctgtagaaaaggcaattgcagatattgcggaaggtaaatttgttattgttgttgatgagacttcgagagagaatgagggagatcttatcatcgcaggcgagaaaatgaccgtcgagaaaatgacttttcttcttaaatatacgacgggaattatctgtgcttctttagattctgagagaataaaacaattagacctcccccctatggttaaagataaccgctgtcgctatcgtactgcatttacagtgtcggtggatgctgcgaaaggcataactacaggtgtctctgcagccgatagaacaagagtggtggaactcctatccgacccgaatagtgttcctggggattttgtccgtccagggcatttcttccctttaatggctacaccgggaggtgtattaaaacgagccggtcatacagaggctgctttagatctcatgcgtttagccaatatgcagccttgcggggtcctttcagagcttgttaatgaagaccacactatgatgcgtcttccgcaaattatagaatttgctatgcagcataagctctcaataatatctacatcggatttagtagcctaccgcatgttatccgaaaggctcgttgtccctatttcttcggctcgtctgcctacagaatatggggattttactattcatgtttacgagtccgttttggatggtatccaacatatcgctttggtcaaaggtgatgtacgagggaaggagaatgtactggtgcgggtacattctgaatgccttactggtgatattctggggtccatacgttgtgattgtggatgccagttgcattctgctatggaatatattggattagagggtgaaggtgttcttgtttatctacgtggacaagaaggacgtggtattggattaggtcataaagttcgagcctacgctctacaagatcgtgggtacgatactgtcgatgctaacttagaaattggcttccctatagattctagagaatatggaatcggagctcagattttagttgatctgggattgacaaagatcaaattgattacccataatccccacaaatatttcggcctccagggatatgggttagaaattgttgatagaatagctcttccaatcaatctctctgaagaaaatgaatgttacctccgcacaaaaaaagagcgtatgggacattggatagattttccttcttacaaagaagaagtgaacataagataa

SEQ ID NO: 49463 - protein, 421 aa, Chlamydophila abortus S26/3
MVIKFDDDARASCFVPVEKAIADIAEGKFVIVVDETSRENEGDLIIAGEKMTVEKMTFLLKYTTGIICASLDSERIKQLDLPPMVKDNRCRYRTAFTVSVDAAKGITTGVSAADRTRVVELLSDPNSVPGDFVRPGHFFPLMATPGGVLKRAGHTEAALDLMRLANMQPCGVLSELVNEDHTMMRLPQIIEFAMQHKLSIISTSDLVAYRMLSERLVVPISSARLPTEYGDFTIHVYESVLDGIQHIALVKGDVRGKENVLVRVHSECLTGDILGSIRCDCGCQLHSAMEYIGLEGEGVLVYLRGQEGRGIGLGHKVRAYALQDRGYDTVDANLEIGFPIDSREYGIGAQILVDLGLTKIKLITHNPHKYFGLQGYGLEIVDRIALPINLSEENECYLRTKKERMGHWIDFPSYKEEVNIR

SEQ ID NO: 49464 - DNA, 666 bp, Pseudomonas syringae pv. syringae B728a
  CDS (1)..(666): transl_table=11
atgcaaatcttgcgaatttccagtcttcatactgatcaggagcacacggtgcccgtcgtctttgtcgccgcttccaaactgcccactccctttgcagagtttgccatgcacggctttatcgagtcggcaaccggccgtgaacatgtcgtcctgagtctgggcgatgtggcggacggtgagccggttctgggtcgcgtacattccgaatgcctgaccggcgacgccctgttcagtcagcgttgcgattgcggctctcaactggaggctgccctgcgcgccatcgccaccgaagggcggggcgtactgttgtatttgcgccaggaagggcgcggtatcggtctgatgaacaagatccgcgcctacgagctgcaggatggcggtgccgatacggttgaagccaacgagcgtctgggctttgctgccgatcagcgtgactacgcgatctgcctgccgatgcttcagcatctgggcgtgcagtcgctacggcttatgaccaacaacccgcgcaaggtcaaagccttgaccgagatgggcatcagggtcgctgagcgcgtgccgctgcacaccggacaaaacccgcacaaccgcctttatctggcaaccaaggcgggcaagctggggcacatgatgggcaacgaacatcaaagcgaggtcggccccgcgtga

SEQ ID NO: 49465 - protein, 221 aa, Pseudomonas syringae pv. syringae B728a
MQILRISSLHTDQEHTVPVVFVAASKLPTPFAEFAMHGFIESATGREHVVLSLGDVADGEPVLGRVHSECLTGDALFSQRCDCGSQLEAALRAIATEGRGVLLYLRQEGRGIGLMNKIRAYELQDGGADTVEANERLGFAADQRDYAICLPMLQHLGVQSLRLMTNNPRKVKALTEMGIRVAERVPLHTGQNPHNRLYLATKAGKLGHMMGNEHQSEVGPA

SEQ ID NO: 49466 - DNA, 675 bp, Haemophilus influenzae 86-028NP
  CDS (1)..(675): transl_table=11
atgactacgaataaggatcactttatggcaaaaattcagctagttgcgcaagccaatttacccactgaatacggtattttcaaaatggtgggatttgaattcccagatacaaaaaaagaacatgtagccttagtgatgggcgatatttctaatgctgatgaacctgtattagcacgtatccattctgaatgtttaactggcgatgcgcttcacagcttaaaatgcgattgtgggttccaactggcgacagcattaaaacaaattcaagaagaaggtcgcggagtcttaatttatcatcgtgaagaaggtcgcggaattggtttgattaataaaatccgtgcttattctttacaagataaaggaatggataccattgaagctaatcttgctttaggtttcaaagcggatgaacgcaactttgaagtctgtgccgatatgtttgagctacttggtgtaaaaaaagttcgcttaatgaccaacaacccagaaaaagtagaaaccatgaaaaaagcaggtatcaacgtggttgaacgagtaccgcttaatgtaggcgaaaaccgctacaacacaaaatatcttgatacaaaagcgaaaaaaatggggcattacattgtgcataacaatgacgaacaacatttaatgacctgtccacattgccaggaagagattatttaa

SEQ ID NO: 49467 - protein, 224 aa, Haemophilus influenzae 86-028NP
MTTNKDHFMAKIQLVAQANLPTEYGIFKMVGFEFPDTKKEHVALVMGDISNADEPVLARIHSECLTGDALHSLKCDCGFQLATALKQIQEEGRGVLIYHREEGRGIGLINKIRAYSLQDKGMDTIEANLALGFKADERNFEVCADMFELLGVKKVRLMTNNPEKVETMKKAGINVVERVPLNVGENRYNTKYLDTKAKKMGHYIVHNNDEQHLMTCPHCQEEII

SEQ ID NO: 49468 - DNA, 1263 bp, Corynebacterium jeikeium K411
  CDS (1)..(1263): transl_table=11
atgagcacgagcgaaaatagcgaaccccaagacatcaaactggattccgtggagcgcgccatcgccgacatcgcggcgggcaaggccgtggtggtcgtcgacgacgaagaccgggaaaacgagggcgacctcatcttcgccgcggagctggccaccccggagctgatggccttcatggtgcgccacagctctggctatgtctgcgtgggaatggatagcgccgactgcgaccgcctgggtctgccgccgatggtggcccgcaacgaggacgtccgcggtacggcctacaccgtcactgtggacgccgccgagggcgtggacaccggcatcagcgccaccgaccgtgcccgcaccgtgcgcctgctggccgaccctacgtccaccgtcgccacctttaaccgtcccggccacgtggtgccgctgcgcgccaagcgcggaggcgtgctcgtgcgccagggccacaccgaggccgcggtggatctggcccgcgcggcgaacctggcgcccgccggcgcgctgtgcgagatcgtctctaaggaagatcccacgaccatggcccgcctgccggagctgcgccgcttcgcagacgagcacgacctggcgctgatcagcatcgagcagctgcaggactggcgccgccaccacacccagaccctcgagcgcgccgtggaaacccgcctgccgaccgttcacggcaacttccgggccatcggctacgtcaacatcatcgacggcacggagcacgtggctctggtcaagggcgatgtgagcgcagtcagcactggcagcgaggagccagttccggtgcgcgtgcactccgagtgcctgaccggcgacgtcttcggttcccgtcgctgcgactgcggggaccagctttccgccgccctggactacatcgaggccaaggggcggggagtggtcatctacctgcgcggccacgaagggcggggcatcgggctactgccgaagctgcgcgcctacgtgctgcaggacgagggcctggacaccgtcgacgcaaacctggagcagggtcttccggtagacgcccgcgagtacagcgccgccgcgcagatcctcaaggacctgcaggttcattcggtcgcgctgatctctaacaacccggacaagatccacgacctggccagccacggcgtggacgtgaccaagcgcatcccggtggagctcaacgccaacgaggacaatgtggtgtacctgcgcacgaaacgcgaccgcatgggccaccaactcgataccctggactag

SEQ ID NO: 49469 - protein, 420 aa, Corynebacterium jeikeium K411
MSTSENSEPQDIKLDSVERAIADIAAGKAVVVVDDEDRENEGDLIFAAELATPELMAFMVRHSSGYVCVGMDSADCDRLGLPPMVARNEDVRGTAYTVTVDAAEGVDTGISATDRARTVRLLADPTSTVATFNRPGHVVPLRAKRGGVLVRQGHTEAAVDLARAANLAPAGALCEIVSKEDPTTMARLPELRRFADEHDLALISIEQLQDWRRHHTQTLERAVETRLPTVHGNFRAIGYVNIIDGTEHVALVKGDVSAVSTGSEEPVPVRVHSECLTGDVFGSRRCDCGDQLSAALDYIEAKGRGVVIYLRGHEGRGIGLLPKLRAYVLQDEGLDTVDANLEQGLPVDAREYSAAAQILKDLQVHSVALISNNPDKIHDLASHGVDVTKRIPVELNANEDNVVYLRTKRDRMGHQLDTLD

SEQ ID NO: 49470 - DNA, 651 bp, Haemophilus somnus 129PT
  CDS (1)..(651)
atgtccaaaattcagttagttgctgaagctaaattacccaccgagttcggaattttccgtattgtcggctttgagtttccagatactcaaaaagaacatgttgctcttgtaatgggcgatattaatgatgataaacctgttcttgcacgtatccattcagaatgtttaaccggcgacgctttacatagcttaaaatgtgattgcggtttccaactggcgaccgcattacgccaaatcagcgaagcaggacgaggagtattgatttatcatcgtgaagaagggcgtggtattggactaattaataaaattcgagcttacgctttgcaagatcaaggattggatacgattgaggcgaaccttgctttaggttttgctgctgatgaacgcaatttttcggtttgtgccgatatttttgcattactgggggtaaaacaagtacgtctgctcacaaataatccgaataaaattgaaaccatgaaaaaatccggtatcaatattgtggagcgagtaccattgaatgtaggtgaaaaccgctataacacagaatatctagatacgaaagcaaaaaaaatgggacactttattgtgcataataatgaacaacatttaatcgcttgtccgcattgccaagaagaaattccgaaaaaataa

SEQ ID NO: 49471 - protein, 216 aa, Haemophilus somnus 129PT
MSKIQLVAEAKLPTEFGIFRIVGFEFPDTQKEHVALVMGDINDDKPVLARIHSECLTGDALHSLKCDCGFQLATALRQISEAGRGVLIYHREEGRGIGLINKIRAYALQDQGLDTIEANLALGFAADERNFSVCADIFALLGVKQVRLLTNNPNKIETMKKSGINIVERVPLNVGENRYNTEYLDTKAKKMGHFIVHNNEQHLIACPHCQEEIPKK

SEQ ID NO: 49472 - DNA, 1212 bp, Deinococcus geothermalis DSM 11300
  CDS (1)..(1212): transl_table=11
atgaggctcgcttctattcccgaactgcttgccgaactgcgggcgggtcgtcccgtcattttggtcgacgacgagcgccgcgagaacgagggtgacctgctgatgcccgccgccaccgccactccggaatgggtgaacttcatggcgcgcgagggccgcggcctgatctgcgtgactctgaccccggagcgggcgcacacgttggacctgacgccgatggtgggaatgagcaccgatccccacggcacagcctttacggtcagcgtggatcacatcagcaccagcaccggcatcagcgcgtttgaccgtgcggcgaccattcgggccttgctcgaccccgccgcgcgtccagaggacttccggcgtcccggccacatctttccgctggtggcccgccccggcggagtgctgcgccgcgcggggcacaccgaggcagcctgcgacctggcgcggctggcgggcttcgcgcccgtcggcgttatctgcgagatcatgggtgacagcggcgagatgctgcggctgcccgatctcctcgcctttggggagcggcatgggctcaaggttggctccatcgaggccctcatcgcctaccggatggaacatgaccccttcatgcgaatcgccgccgaggcgaagctccccaccgcctacggcgagttccggttggtgggctttgaggataccttgtcgggggccgaacacgtggccctggtgatgggcgaggtgaatgaggaaccgctgctcgtgcgggtgcactccgagtgcctgaccggggacgcctttcacagcctgcgctgcgactgcgggccgcagcgggacgcggcgctgcgggcgattgccgaagaaggccggggcgtcctggtctacctgcggcaggaaggccggggcatcggcctgctcaacaagattcgcgcatacgcccttcaggaccagggcgccgacacggtggaagccaacctccgcctgggctttcccgctgacgcccgcgacttcggcatcggcgcgcagatcctgcacctgctgggcgctcgccgcctgcgggtgctgaccaacaacccccgcaagctgcacgcgctgggaggtttcggcctagaagtcgtagagcgcgttccgctgcacgttggccagaacgtccataacgccgcctacctcgccaccaaggccgagaagctcggccacctggcgttgccttcctcccaggagtccgcatga

SEQ ID NO: 49473 - protein, 403 aa, Deinococcus geothermalis DSM 11300
MRLASIPELLAELRAGRPVILVDDERRENEGDLLMPAATATPEWVNFMAREGRGLICVTLTPERAHTLDLTPMVGMSTDPHGTAFTVSVDHISTSTGISAFDRAATIRALLDPAARPEDFRRPGHIFPLVARPGGVLRRAGHTEAACDLARLAGFAPVGVICEIMGDSGEMLRLPDLLAFGERHGLKVGSIEALIAYRMEHDPFMRIAAEAKLPTAYGEFRLVGFEDTLSGAEHVALVMGEVNEEPLLVRVHSECLTGDAFHSLRCDCGPQRDAALRAIAEEGRGVLVYLRQEGRGIGLLNKIRAYALQDQGADTVEANLRLGFPADARDFGIGAQILHLLGARRLRVLTNNPRKLHALGGFGLEVVERVPLHVGQNVHNAAYLATKAEKLGHLALPSSQESA

SEQ ID NO: 49474 - DNA, 627 bp, Azotobacter vinelandii AvOP
  CDS (1)..(627): transl_table=11
gtgtccgtcgtcttcgtcgccgcatccaagctgcccacgccgttcggcgtcttcaccatgcatggctttctcgacgaagccaccggcaaggagcatgtggcgctcaccctgggcacggtggacgatggcgcgccggtgctcggccgcctgcattccgagtgcctgaccggtgatgcgctgttcagcctgcgctgcgactgcggctttcaactggaagccgcactgcgcgccatcgccgccgagggccgtggcgtgctgctctacctgcgccaggaggggcgcggcatcggcctgctcaacaagatccgcgcctacaagctgcaggacgccggcgccgataccgtcgaggccaacgagcgcctgggttttcgcgccgaccagcgcgactacgggatctgcaaaccgatgctcgagcatctgggcatcaccgcgatcaagctgatgaccaacaatccgcgcaaggtcaaggcgctggagggggccggcatccaggtgaccgaacgggtaccgctgcagaccgggctcaacccccacaaccagaaatacctggcgaccaaggccggcaagctcggtcacctgctcggcagcctgcatcagggcgaggtggaaacgccgaccgggagctga

SEQ ID NO: 49475 - protein, 208 aa, Azotobacter vinelandii AvOP
MSVVFVAASKLPTPFGVFTMHGFLDEATGKEHVALTLGTVDDGAPVLGRLHSECLTGDALFSLRCDCGFQLEAALRAIAAEGRGVLLYLRQEGRGIGLLNKIRAYKLQDAGADTVEANERLGFRADQRDYGICKPMLEHLGITAIKLMTNNPRKVKALEGAGIQVTERVPLQTGLNPHNQKYLATKAGKLGHLLGSLHQGEVETPTGS

SEQ ID NO: 49476 - DNA, 624 bp, Chromohalobacter salexigens DSM 3043
  CDS (1)..(624): transl_table=11
gtgacgattcgcttcatcgccgcctcccaactgcccacgccatgggcgacattcaccatgcacggcttcgaagacgatgccacgggcaaggagcacgtcgccttgaccctgggcgatgtctcgacgtccgagcccgtgctggggcgcgtgcactcggaatgcctgaccggtgacgcactgttctcgatgcgctgcgattgcggctatcagctgcaggaagcgctcaagcgcatcgccgacgaaggacgcggcgtgctgctctacctgcgccaggaagggcgtggcatcggcctgctcaacaagatccgcgcctaccacctgcaggatcagggctacgataccgtggaggccaacgagcatctcgggttcggcgccgacatgcgccgttacgacctgtgcgtgcccatgctcgatcatctgggcgtgcaggcgctcaagctgatgaccaacaacccgcgcaaggtcgaagccttgacgcgcgatggcgtgcgcgtcgccgaacgcctggcgatcaccgccgggcgcaatcctcacaacgagcattatctcgccaccaaggtcggcaagctcggccacatgatggcgctgggcgaccccgccgccagggacgaccgcgagcactga

SEQ ID NO: 49477 - protein, 207 aa, Chromohalobacter salexigens DSM 3043
MTIRFIAASQLPTPWATFTMHGFEDDATGKEHVALTLGDVSTSEPVLGRVHSECLTGDALFSMRCDCGYQLQEALKRIADEGRGVLLYLRQEGRGIGLLNKIRAYHLQDQGYDTVEANEHLGFGADMRRYDLCVPMLDHLGVQALKLMTNNPRKVEALTRDGVRVAERLAITAGRNPHNEHYLATKVGKLGHMMALGDPAARDDREH

SEQ ID NO: 49478 - DNA, 1242 bp, Clostridium thermocellum ATCC 27405
  CDS (1)..(1242): transl_table=11
atgaattttgatacaattgagtccgcgatagaggacatcaggcagggaaaaatgatagttgtggttgacgatgaagacagggaaaacgaaggcgacctgctgatggcggcggagctggttacaccggagcatatcaatttcatggcaacatacggaagaggtatgatttgcgccccgataaccgaggccagggcaaaggaattgggactggaattaatggtaacgaaaaacagtgaacacatgagaaccgcctttacagtgacggtggaccataaaagcacgactaccggtatttcggcttttgaaagagctaaaacaataaaggaactttcaaatcctgatgccaaaccggatgattttgtaaggcctggacatgtttttccattaattgctaaagaaggcggagttctaaaacgtgcaggtcatactgaagccgcagtagactttgcaaaactggcaggactttaccctgccggggtaatatgcgaaattatgaatgatgacggaaccatggccagagttccgcagcttatggaatttgtaaaaaaacacggacttaaacttgttaccatagcagatcttataaaatacagaagaaataatgaaaaattgataagaagggcggcggaggcaaaacttcccactgaatacggggattttaaaatagttgcttatgaaaacgttataaacggagaacatcatgtagcattggtaaagggagatgtggcaaactccgacgagcctgtaatggtgagggtgcattcggagtgccttaccggggatgcgttccattccttaaggtgcgactgcggtgagcagctgcacaaagccatggaaatgataggaaaagaggacaagggagtacttttgtacatgagacaggaaggccgtggaattggccttgtaaacaaaatccgggcgtatgagcttcaggatcagggaaaagataccgttgaggccaatgtgcttttgggatttccccccgatcttagggaatatggcataggagcccagatattatacgacctcggtgtaaggaaaataaggcttcttaccaacaatcccaagaagctgataggacttggcggtcacggactggaaattgttgaaagggtgcccattgagataaagggaaacgaaatcaacagtttctatttgaaaaccaaaaaggaaaaaatggggcatttattaaccagtataaacacaacggaacatcaggagggagaatcaaatggcaattaa

SEQ ID NO: 49479 - protein, 413 aa, Clostridium thermocellum ATCC 27405
MNFDTIESAIEDIRQGKMIVVVDDEDRENEGDLLMAAELVTPEHINFMATYGRGMICAPITEARAKELGLELMVTKNSEHMRTAFTVTVDHKSTTTGISAFERAKTIKELSNPDAKPDDFVRPGHVFPLIAKEGGVLKRAGHTEAAVDFAKLAGLYPAGVICEIMNDDGTMARVPQLMEFVKKHGLKLVTIADLIKYRRNNEKLIRRAAEAKLPTEYGDFKIVAYENVINGEHHVALVKGDVANSDEPVMVRVHSECLTGDAFHSLRCDCGEQLHKAMEMIGKEDKGVLLYMRQEGRGIGLVNKIRAYELQDQGKDTVEANVLLGFPPDLREYGIGAQILYDLGVRKIRLLTNNPKKLIGLGGHGLEIVERVPIEIKGNEINSFYLKTKKEKMGHLLTSINTTEHQEGESNGN

SEQ ID NO: 49480 - DNA, 1119 bp, Solibacter usitatus Ellin6076
  CDS (1)..(1119): transl_table=11
atgcccattgtttcagtgccggacgcgatccaggaaatccgcgccgggcgcatcatcgtcgtggttgacgatgaagaccgggaaaacgagggcgacctcaccattgccgcggaaaaagtcactcccgagatcattaattttatggccgttcagggccgcggactgatctgcctcgcgctcacggccgaacgctgcgactaccttcgcctgccgctcatgagccccaccaacacctccatgttcggcaccgcgttcaccgagtccatcgatgcccttcatggcgtgaccaccggcatttccgccgccgaccgcacccgcaccatcctccaggccatcgaccccgactgccgccccagcgacctggcgcgcccaggccacatgtttcccctgcgcgcccgggagggcggcgtcctggtccgtgccggacagaccgaagccagcgtcgatctggcccgcctggccggcctcacccccgccggagtcatctgcgaaatcatgaatgatgatggcaccatggctcgcgtgccccagctcatcgagttctgcaagcgccacgacatgaaaatgctctccgtggccgagctgatccggtaccggatgaaaaacgagaagttcatccgccgggtggccgaaggtatcatccctaccgaattcggcgatttccgcaccattgcctacgccagcgatctcaaccccgaataccatctggccctggtgcgcggcgatgtctcgggcaaggaaagcgtactggttcgcatgcattcacgctgtgtcttcggggacgtcttccgctccagccagtgcgagtgcggccaactggtgcagaattcgctgcgcgccatcgccaaagaggggcagggcgtgctcgtctacctgcacgaaaccggccccggctttcgcgtagacagtggacagctggtcagccacggccgcgattttatgcacctcaagggtgaggacgggcagcgccagctccagcacgagcacggcctgggcgcccagattctctccgatctcggcctccacaccattcgcctgctcaccaaccatccccgcaaaatcgttgccttggaaggctttggcatcgaagttgaggcccagatcccggttggccactga

SEQ ID NO: 49481 - protein, 372 aa, Solibacter usitatus Ellin6076
MPIVSVPDAIQEIRAGRIIVVVDDEDRENEGDLTIAAEKVTPEIINFMAVQGRGLICLALTAERCDYLRLPLMSPTNTSMFGTAFTESIDALHGVTTGISAADRTRTILQAIDPDCRPSDLARPGHMFPLRAREGGVLVRAGQTEASVDLARLAGLTPAGVICEIMNDDGTMARVPQLIEFCKRHDMKMLSVAELIRYRMKNEKFIRRVAEGIIPTEFGDFRTIAYASDLNPEYHLALVRGDVSGKESVLVRMHSRCVFGDVFRSSQCECGQLVQNSLRAIAKEGQGVLVYLHETGPGFRVDSGQLVSHGRDFMHLKGEDGQRQLQHEHGLGAQILSDLGLHTIRLLTNHPRKIVALEGFGIEVEAQIPVGH

SEQ ID NO: 49482 - DNA, 615 bp, Shewanella baltica OS155
  CDS (1)..(615): transl_table=11
atgtcgataaaatatgtcgcgacgtcaaagttacccactccttggggcgtgtttgccatgcatggttttgaagatacagaatcaggcaaagagcatgttgcgctcacattcggtacgctcagtgcggatgaacctgtgttgggtcgaattcattccgagtgtttaactggcgatgcgttatttagcttgcgttgtgactgtggttttcagttacaagcggcgatgcaaaatattgcggaaacgggcagtggctttatcctctatttgcgccaagaaggccgtggcattggtttattgaataaaatccgcgcctatgagctgcaagataaaggtgccaacacagttgaagccaacgagcaactgggcttcgaagccgatatgcgtaaatacgacatgattaaacctatactggaacagataggcgtgaagcatgtgcgtttgatgaccaataaccctcgtaaagtgaaagcgatgaaggaatttggcatcgaagtggttgagcgcgtaccgctgcaagttggtaagaatcgttacaacgaagcctatttaaaaaccaaatccactgagcttggacacatgatgtctgaatatcattttatggatgaaaataagtag

SEQ ID NO: 49483 - protein, 204 aa, Shewanella baltica OS155
MSIKYVATSKLPTPWGVFAMHGFEDTESGKEHVALTFGTLSADEPVLGRIHSECLTGDALFSLRCDCGFQLQAAMQNIAETGSGFILYLRQEGRGIGLLNKIRAYELQDKGANTVEANEQLGFEADMRKYDMIKPILEQIGVKHVRLMTNNPRKVKAMKEFGIEVVERVPLQVGKNRYNEAYLKTKSTELGHMMSEYHFMDENK

SEQ ID NO: 49484 - DNA, 618 bp, Shewanella amazonensis SB2B
  CDS (1)..(618): transl_table=11
atgtcgataaagtatgtcgccacctccaagttgccaacgccctggggcgtttttgccatgcacggttttgaagacagtgaaaccggaaaggagcatgtggcactgacctttggcgatctcagtggtgatgctcctgtactgggacggatccattctgaatgtttgaccggtgacgccctgttcagcctgcgctgtgactgtggttttcagctgcaaacagccatgcagcgcatcgctgaaaccggccgtggctttattttgtatctgcgtcaggaagggcgcggcattggtctgctaaacaaaatccgtgcctatgagttgcaggataaaggagccaataccgtcgaggccaacgagcagctcggatttgccgccgatatgcgcaagtacgatatgatagcccccatgttggcgcatctgggtatttcccgggtcaagctgatgaccaataatccccgtaaagtcaacgccatgaaagatgtgggtatggatgtggttgagcgagtaccgctgcaggtggggaaaaatcgctacaacgaagcttacctcaaaaccaagtctgataagctcggacacatgatgtctgaagagcacttcaaggctcagcatcaggactga

SEQ ID NO: 49485 - protein, 205 aa, Shewanella amazonensis SB2B
MSIKYVATSKLPTPWGVFAMHGFEDSETGKEHVALTFGDLSGDAPVLGRIHSECLTGDALFSLRCDCGFQLQTAMQRIAETGRGFILYLRQEGRGIGLLNKIRAYELQDKGANTVEANEQLGFAADMRKYDMIAPMLAHLGISRVKLMTNNPRKVNAMKDVGMDVVERVPLQVGKNRYNEAYLKTKSDKLGHMMSEEHFKAQHQD

SEQ ID NO: 49486 - DNA, 609 bp, Shewanella frigidimarina NCIMB 400
  CDS (1)..(609): transl_table=11
atgtcggtaaagtatatcgcaacatctaagttacccactccttggggtgtttttgctatgcacggttttgaagaaaccgccacaggtaaagaacacgttgcattgacatttggtcaactggatcccacggagcccatgttaggtcgtattcattcagaatgtttgaccggtgatgcattatttagtttacgttgtgattgtggttttcaattacaagcggccatgcagagtattgctgaacaagggcaggggtttcttctgtacttgcgccaggaaggccgtggtattgggttacttaataaaataagagcttacgagctgcaagatgctggtgccaatacggttgaagctaatgagcgtttaggctttgaagctgatatgcgtaaatacgacatgattttgccgatgttaacgcaaattggcgtgaccaaagtaaagttgatgaccaataacccgcgtaaagtgatggcgatgcaaaatatgggtatcgaagtcgcagaacgtattccgttacaagtgggtaaaaatcgctataacgaatcatatttaaagaccaaatcaacagagttgggtcatatgatgtcggaataccatttccacgatgaatag

SEQ ID NO: 49487 - protein, 202 aa, Shewanella frigidimarina NCIMB 400
MSVKYIATSKLPTPWGVFAMHGFEETATGKEHVALTFGQLDPTEPMLGRIHSECLTGDALFSLRCDCGFQLQAAMQSIAEQGQGFLLYLRQEGRGIGLLNKIRAYELQDAGANTVEANERLGFEADMRKYDMILPMLTQIGVTKVKLMTNNPRKVMAMQNMGIEVAERIPLQVGKNRYNESYLKTKSTELGHMMSEYHFHDE

SEQ ID NO: 49488 - DNA, 1659 bp, Lycopersicon esculentum
  CDS (1)..(1659)
atggcttccatcaacatttctttcccttcaacaacatttcacagtcgatcacaagcgaacttcaagttgttcagtgggttgcattctggagatgtagtttctcttaatggggtctcgtcagggtcattcatacggcttaatgctagaccacacttaaccatcaagagtgatttcaagattacttctgcattgttatctggtgaaggagacatccgatttcaatccaggggagaaaaaactctgtttagtagcctctctacaggaactgagactcaacctgatgctgtaacctttgcaacgctagaagcagatggtgttcagacaactagtggttttctttcagatgacgatgaatgtgatttggatcgaccgaccgaaggtttttcatctgttcctgaggctattgaggacattcgccaaggaaagatggtgctagttacagatgatgaagacagagaaaatgaaggggatttagttatggctgcatccaaagctacaccagaagcaatggctttctttgtgaagtatggaacagggatagtttgtgtgagcatgacagaagaacacttggagaggctacagcttccgttgatggtaaacgataaaaagaatgaggagaaactttgtacagcattcacagtctcagtggatgcgaaacatggaacgactacaggagtatctgctcatgatagagcaacgacagtattggcacttgcgtccggagattcaaagcctgaggatttcaatcgaccgggacatatctttcctttgaaatacagggaaggcggggttttaaaacgagctggacatactgaggcttctgtggatcttgccgtgttagctggcttagaccctgttggagtaatatgtgaggttgtggatgatgatggttccatggctagattgcctatgcttcgtcaatttgcaaaagaacataacttgaagatcatatcagttgctgacttaatcagatataggagaaaaacagatcagctggtagagcatgcttctgctgcaagaatacctacaatgtggggcccgtttactgcccactgcttcaagtcaataatagatggaattgagcacattgctatggttaagggggatataggagatggacaagatattcttgttcgggtacactcggaatgcctcacaggagatatatttggttcagccagatgtgactgtggatcccagctggcaactgcaatgaagcaaattgaggctgctggcaggggggttttggtttacctccgcggtcatgatggtagaggcattggtttgggtcacaaacttcgtgcttataatttacaagatgctggacgtgatactgttgaagcgaatgaagatcttggtttgcccgttgattcaagaaactatggggttggtgcacagatcttaagggatcttggtgttccaactatgaagtttataacgaacaatcctgcacaatacagctggctaaaaggttatggtttggcaatttctggtatggtccccgttgttactccctttactaaccactacgacacatatttggaaacaacacgagctaaaatgggccatgtatacggcttgaaccttattcgcccggcaaccagcaccagcacaacaaatggtaaaccaaactctgagaatacttctactataagatga

SEQ ID NO: 49489 - protein, 552 aa, Lycopersicon esculentum
MASINISFPSTTFHSRSQANFKLFSGLHSGDVVSLNGVSSGSFIRLNARPHLTIKSDFKITSALLSGEGDIRFQSRGEKTLFSSLSTGTETQPDAVTFATLEADGVQTTSGFLSDDDECDLDRPTEGFSSVPEAIEDIRQGKMVLVTDDEDRENEGDLVMAASKATPEAMAFFVKYGTGIVCVSMTEEHLERLQLPLMVNDKKNEEKLCTAFTVSVDAKHGTTTGVSAHDRATTVLALASGDSKPEDFNRPGHIFPLKYREGGVLKRAGHTEASVDLAVLAGLDPVGVICEVVDDDGSMARLPMLRQFAKEHNLKIISVADLIRYRRKTDQLVEHASAARIPTMWGPFTAHCFKSIIDGIEHIAMVKGDIGDGQDILVRVHSECLTGDIFGSARCDCGSQLATAMKQIEAAGRGVLVYLRGHDGRGIGLGHKLRAYNLQDAGRDTVEANEDLGLPVDSRNYGVGAQILRDLGVPTMKFITNNPAQYSWLKGYGLAISGMVPVVTPFTNHYDTYLETTRAKMGHVYGLNLIRPATSTSTTNGKPNSENTSTIR

SEQ ID NO: 49490 - DNA, 618 bp, Pseudomonas fluorescens
  CDS (1)..(618): transl_table=11
gtgcccgtcgtttttgttgctgcttgcaagctgcctacgccttttgcgcaattcaccatgcatggttttctcgatgaagctaccggccgcgagcatgtggtgctcagcctgggcgatatcgccgacggcgctccggttctcggccgcctgcactccgagtgcctgaccggcgatgcactgttcagccagcgttgcgactgcggctcgcaactggaagccgccctgcaggccatcgcccgcgaaggtcgtggggtgttgctgtacttgcgccaggaaggccggggtatcggcctcttgaacaagatccgcgcctacgaactgcaggacggtggcgccgacaccgtggaggccaacgaacgcctgggctttgccgccgaccagcgcgactacgccatgtgcctgccgatgctggagcacctgggggtcaagtccctgcgcctgatgaccaacaacccgcgcaaggtcaaggccttgaccgagatggggatccaggtcgccgagcgcgtaccgctgcacaccggccataacccgcacaacaaactctacctggcgaccaaggccagcaagctcgaccacatgatgggcaacgagcaccagggcgaggtcgaccgcgcgtga

SEQ ID NO: 49491 - protein, 205 aa, Pseudomonas fluorescens
MPVVFVAACKLPTPFAQFTMHGFLDEATGREHVVLSLGDIADGAPVLGRLHSECLTGDALFSQRCDCGSQLEAALQAIAREGRGVLLYLRQEGRGIGLLNKIRAYELQDGGADTVEANERLGFAADQRDYAMCLPMLEHLGVKSLRLMTNNPRKVKALTEMGIQVAERVPLHTGHNPHNKLYLATKASKLDHMMGNEHQGEVDRA

SEQ ID NO: 49492 - DNA, 759 bp, Burkholderia glumae
  CDS (1)..(759): transl_table=11
atgccaggggcggttcgatccgccccattcgtccagactctgcgcaaatcgccagggcataccagcccgttagcgtgtctatcgatgcgcgcgtatctcccgaacctgagaggccgagccatgaatcaatccgatgatcattccggtgtgagcatccgcacacgcatcaaggtgccgattcgtccgcgttcgagcgcgacggcatttgaaaccgagatggtgaccttcaacggtctttgcgacagcgccgaacatatcgcgctggtgttcggcaagatcggcgaggcgccgctggtgcgcctgcattccgagtgcctgacgggcgacgtgttcggctccgcgcgctgcgactgcggcgagcagctcgacgagtcgatcgcgctgttcggcgagcgcggcggcatcctgctctacctgcgccaggaagggcgcggcatcgggctctacaacaagctcgacgcctatcgcctgcagatctcgcagggactcgacaccttcgctgccaatcgcgcgctcaacttccccgacgacctgcgcgacttccgcgtggcggcccagatgctcaaggcgctcggcgtcggcgaggtctcgctggtcaccaacaaccccgacaagaccgcgcaactgacccgtcacggcatcaaggtgcgccaggtgaagtcgaccggcgtgttcgccaacagcgtcaactttggttatctgcatgcgaaggcgacccagcaccggcatgccatcaagctcaacggagaaatgcaatga

SEQ ID NO: 49493 - protein, 252 aa, Burkholderia glumae
MPGAVRSAPFVQTLRKSPGHTSPLACLSMRAYLPNLRGRAMNQSDDHSGVSIRTRIKVPIRPRSSATAFETEMVTFNGLCDSAEHIALVFGKIGEAPLVRLHSECLTGDVFGSARCDCGEQLDESIALFGERGGILLYLRQEGRGIGLYNKLDAYRLQISQGLDTFAANRALNFPDDLRDFRVAAQMLKALGVGEVSLVTNNPDKTAQLTRHGIKVRQVKSTGVFANSVNFGYLHAKATQHRHAIKLNGEMQ

SEQ ID NO: 49494 - DNA, 1083 bp, Wolbachia endosymbiont of Armadillidium vulgare
  CDS (1)..(1083): transl_table=11
atgtttatagaaaatcggaatagcaataaggtagaaagagctatcagcgaaattagaagtggccggccaattgtaatatatgatgaaagtaattacctattgtttgctgctgttgaggctttagaaagagatttatttaatcaatacaagcttatatcaagtaatgtatatgttactttaacttcaagtaaggtaaaatacatatctcaaaataaagaacataacagcaaacgtctgttggtgaataattttgatgaactgctctatttaataaactgttcaaaggaagattgcataaaagagttgcaatgctcaaagacaatagatgaatgtgctattgccttgcttaaattctcagaattattgccatacgcattagtggctgatatgacttttgagaataaccatgaaatgcaaaattggtgcgagaaaaatgacgttattgcactggacacgtcattcataaataattttcaagaaaatcaggatgtatatgaagtgtgcaaaacatcattatttttaaaacagactcaagaagtagatatcatatcttatagaaccgaaagtggcggaagagaacatcatgcaattatcattggcaatccagataaagatgacgaaccattagtgagaattcattcttcgtgctatacgggtgacttgttagatagcttatcatgcgattgtagaagtcagttacatcaagcaattcaaatgatagctgactttggaagtggtattatattgtatttgatgcaagatggaagaggcattggtttagctaataagttaagagcgtacagtatgcaaagaagacataatcttgatactgttgatgcaaatagagtattgggttttgaagatgatgaaagaagctttgctgttgcagttgaaatactcaagaaattagacatcaaaaagatccaattacttacaaataacggtaggaagttatcggagttgaaaaacaatggtatagaggttacaaagtgtctaccacttattatggaacgtaatgaatataatgattcatatatggaaacaaaatttggtaggctaggccatggattaagggttttttag

SEQ ID NO: 49495 - protein, 360 aa, Wolbachia endosymbiont of Armadillidium vulgare
MFIENRNSNKVERAISEIRSGRPIVIYDESNYLLFAAVEALERDLFNQYKLISSNVYVTLTSSKVKYISQNKEHNSKRLLVNNFDELLYLINCSKEDCIKELQCSKTIDECAIALLKFSELLPYALVADMTFENNHEMQNWCEKNDVIALDTSFINNFQENQDVYEVCKTSLFLKQTQEVDIISYRTESGGREHHAIIIGNPDKDDEPLVRIHSSCYTGDLLDSLSCDCRSQLHQAIQMIADFGSGIILYLMQDGRGIGLANKLRAYSMQRRHNLDTVDANRVLGFEDDERSFAVAVEILKKLDIKKIQLLTNNGRKLSELKNNGIEVTKCLPLIMERNEYNDSYMETKFGRLGHGLRVF

SEQ ID NO: 49496 - DNA, 1197 bp, Lactococcus lactis subsp
  CDS (1)..(1197): transl_table=11
atgtttcaatataatacagtagaagaagccttaacagcccttaaagcaggtgaaataattattgtcactgatgatgagaatagagaaaatgaaggagatctgatttgtgcagccgaaatgattagtccagaaaagataaatttcatggccagtcaggcaaagggattaatttgtagtccgatgagtgaaaaatatgctaagagtctgcatttgtcagcaatgacggagagaaatacagacaaccacgggacagcttttactgtttctgtcgatcatgtagagacaagtacaggggtatcagcctttgaccgttcgctgactattagaaaacttgctgatgaagaaagttcagtcgaagattttcgaagacctggtcatgtctttcctctgattgcaaggaaaaatggagtcttagaacgcaatggacacacagaagcaacagttgatttgttacgacttgctggtctaaaggaagtgggagtttgtgttgaaataatggccgaagatggtagcatgatgcgcacagaagaacttcaagaaaaagcaaaagaatgggacttgaattttatcacaatcaaggccatacaaaaatatcgaaaacaaaatgaacaactggttgagcaagttaccagagcgaaacttccaacaaaatatggttattttgaaatctttggatttgtcaataaaataaatggtgagcatcatgtcgccctagttaagggggacattggagagggagaagcagtgctttgccgagttcattcggaatgtttgactggagatgcttttggctcaatgaaatgtgattgtggtgaacaattagaacaagctctaacacagataaatgtcgagggacgagggattttattatatcttcggcaagaagggcgaggaatcggtttaatcaacaaacttcgtgcatattcacttcaagatgaggggcttgatacaattgaagcaaatttagccctaggttttgaagaagatgcgcgtgaatactccataggtgctcaaattttgaaaacacttggtgtgaagtctttaagattaatgactaataacccacaaaaaatcaatgatttttcaaaatatggactaccagttaaagaaagagttccaattcaaattaaagaaaatgaatttgatcaggattatttaaaagtaaagcaaactaaaatgggacatttgttcgattaa

SEQ ID NO: 49497 - protein, 398 aa, Lactococcus lactis subsp
MFQYNTVEEALTALKAGEIIIVTDDENRENEGDLICAAEMISPEKINFMASQAKGLICSPMSEKYAKSLHLSAMTERNTDNHGTAFTVSVDHVETSTGVSAFDRSLTIRKLADEESSVEDFRRPGHVFPLIARKNGVLERNGHTEATVDLLRLAGLKEVGVCVEIMAEDGSMMRTEELQEKAKEWDLNFITIKAIQKYRKQNEQLVEQVTRAKLPTKYGYFEIFGFVNKINGEHHVALVKGDIGEGEAVLCRVHSECLTGDAFGSMKCDCGEQLEQALTQINVEGRGILLYLRQEGRGIGLINKLRAYSLQDEGLDTIEANLALGFEEDAREYSIGAQILKTLGVKSLRLMTNNPQKINDFSKYGLPVKERVPIQIKENEFDQDYLKVKQTKMGHLFD

SEQ ID NO: 49498 - DNA, 1620 bp, Malus domestica
  CDS (1)..(1620)
atggcttccatcaacccctattgctcctcaacggctctttccccttctccagggcacactattctatatcctgggacttcgcttgcagcaaatgggcgattatccggttttgtcacaccgagtgtatcatggaaattgttctttcattccaagggatcaattaaggcaagagctttgctgggagaagatggtctcctgtcttacccaaatggcaacccaactgggagtgaaatacaacctgatgcattaggtttcggaacagtttcagcagaaacaaccccaacgtttagtgggttctcttctgaaaatgatgaaggtgatctagatcaccctatacatggattttcttccattccagaggccattgaagatatacgtcaaggcaagatggttatcgttgtagatgatgaagatagagaaaatgagggagatcttataatggcagcttccttggcaacaccagaagctatggcatttattgtcaagcacggaactgggattgtttgtgtgagcatgaaaggagaagacttggagaggttgcaacttccacttatggtgacacagaatgaagaaaaactttgtacggcattcactgtctcagtggatgcaaaacgtggtacgacaactggtgtttctgctcgtgatagagctgcaacagtcttggctcttgcatcaagagattcaacacctgaagatttcaaccgcccaggacatatctttcccctaaagtacagagagggaggagttctaaaaagagccggtcacactgaagcttcagttgatcttgctatgttggctgggctggatccagtagcagttttatgtgaaattgtggatgatgacggttctatggctaggttaccaaagcttcttgaatttgcaagggcagaaaacttgaaaattgtttccattgctgatttgataagatatagaaggaaaagagataagttggtggagagggctggagttgcacgcatacccacaatgtgggggccatttgaagcctactgttataaatcattgctcgatgggattgagcacattgctatggttaaaggtgaaattgctgacgggcaagaaatacttgtgagggtacactctgagtgcctcactggtgacatatttgggtcagccagatgtgactgtggaaaccagcttgcacttgcaatgaagcaaattgaagcagctggtaggggtgttttggtgtatctccgtggacatgaaggtagaggaattggtttgggtcacaagctccgagcttatacactgcaggatgctgggcgtgacactgttgaagctaatgaggagctgggattacctgttgattctcgcgagtatggcataggtgcacagatactacgagatctaggtgttcgaacgatgaagctgatgactaacaatcctgcaaaatatattggcctcaagggttatggtttggccattgctggcagagtcccattgttggcaccgataactatggagaatcggaaatacctggagaccaaacgggcaaaaatggggcacatctatggttcaaaatccaatggtcatgtaaatggcacaatcgatgaaagtagttcgaaaattgacaaccaatctaatgatgtgtccgagacatga

SEQ ID NO: 49499 - protein, 539 aa, Malus domestica
MASINPYCSSTALSPSPGHTILYPGTSLAANGRLSGFVTPSVSWKLFFHSKGSIKARALLGEDGLLSYPNGNPTGSEIQPDALGFGTVSAETTPTFSGFSSENDEGDLDHPIHGFSSIPEAIEDIRQGKMVIVVDDEDRENEGDLIMAASLATPEAMAFIVKHGTGIVCVSMKGEDLERLQLPLMVTQNEEKLCTAFTVSVDAKRGTTTGVSARDRAATVLALASRDSTPEDFNRPGHIFPLKYREGGVLKRAGHTEASVDLAMLAGLDPVAVLCEIVDDDGSMARLPKLLEFARAENLKIVSIADLIRYRRKRDKLVERAGVARIPTMWGPFEAYCYKSLLDGIEHIAMVKGEIADGQEILVRVHSECLTGDIFGSARCDCGNQLALAMKQIEAAGRGVLVYLRGHEGRGIGLGHKLRAYTLQDAGRDTVEANEELGLPVDSREYGIGAQILRDLGVRTMKLMTNNPAKYIGLKGYGLAIAGRVPLLAPITMENRKYLETKRAKMGHIYGSKSNGHVNGTIDESSSKIDNQSNDVSET

SEQ ID NO: 49500 - DNA, 1131 bp, Aspergillus fumigatus
  CDS (1)..(1131)
atgacccctgcggttcccgcatcattactctccccatccttcactcctccagcaacccccgggggctcgatcaataccgcggagctgcttcaacagacccaattagctggcgcacggcaagggtcaacacatactaagcccccgaggttgctttctcgtcttcccaatgtcgaatgtatcgtccgcgctcggatacccacgacaactggcgcggagatgtttcttcacctgtaccacaatgacttagacaacaaagagcatttggcgattgtgtttggaaatacaattcgaagcagaagcttggacaagatccggcctggagagacggagatggatcgcatgatccgtggcgcgtatgtcgggaaactccgaccgggccgtgtgagcagctggtatgacgaggagaaagctgaagaggccgccagtccggaagctggcggcgctgtatccagtccgcacacactgccgcgaagtagcctcaaggaggcacctcttgtgagaatccattcggagtgctacactggtgagacggcttggtctgcacgctgcgactgcggcgagcagctcgatgaagcagctcgcctcatgtcgctgcctatggaaacgttggcagaggctgcgtcaccgccggatggggcggtaccgtcaaatgctgctggaggtgtaattgtgtacctgcgccaagaaggacgaggcattgggctgggcgagaaactgaaagcgtacaatcttcaggatctgggatcagacacggtggaagccaatctcctgcttcgccaccctgcggatgcaagaagttatggattagctacggcgatcctggtggatcttggtctagggattgactcgaatccgcacggcatccgactactcacgaataacccggacaagattcgagcggttgagggacccaaccgagaagtggtggtgaaagagcgggtgccgatggtgccattggcatggagatcgggtggaaagatgggaatcaagagttccgaggtcgaagggtatctgagaacgaaggtatgtcgacaatctatctcttgcaagctagcttattttctcatcattcttaaacaatgtctcactctctcctcgcagatatcgaaaatgggccatttgctccaatga

SEQ ID NO: 49501 - protein, 376 aa, Aspergillus fumigatus
MTPAVPASLLSPSFTPPATPGGSINTAELLQQTQLAGARQGSTHTKPPRLLSRLPNVECIVRARIPTTTGAEMFLHLYHNDLDNKEHLAIVFGNTIRSRSLDKIRPGETEMDRMIRGAYVGKLRPGRVSSWYDEEKAEEAASPEAGGAVSSPHTLPRSSLKEAPLVRIHSECYTGETAWSARCDCGEQLDEAARLMSLPMETLAEAASPPDGAVPSNAAGGVIVYLRQEGRGIGLGEKLKAYNLQDLGSDTVEANLLLRHPADARSYGLATAILVDLGLGIDSNPHGIRLLTNNPDKIRAVEGPNREVVVKERVPMVPLAWRSGGKMGIKSSEVEGYLRTKVCRQSISCKLAYFLIILKQCLTLSSQISKMGHLLQ

SEQ ID NO: 49502 - DNA, 1383 bp, Oryza sativa
  CDS (193)..(1383)
gcttcctttcggactgttggtgctaaaatcactcaggaaactggtgatttctttgttagcgatgcagagggtgacccagacaaaccaactgatggtttttcctctattgatgaggctataggcgcattgcatgaaggaaagtttgttattgctgtagatgatgaaagcggtgataatgaaggggatcttgtcatggcagctacgctggcagacccagaatctattgcattcatgatcaggaatggttctgggatcatctcagtgggcatgaaggaagaggacttaacaagattgatgattcctatgatgtctccaattgcagaaattgaggatatttcagctgctgcttccacagtaacagtggatgccagagtgggcatatcaaccggcgtctcggctgcagatagggcaaaaacgatttttactctagcctcccctgattctaagccaactgacctcagaagaccaggccatatattccctctaaaataccgaaacggtggtgtgctaaaaagagctggacatactgaggcatccgtcgatcttgtcgcgttggctggcttgcgccctgtgtctgtcctgtcaaccgtcatcaacccagtggatggttcaatggcaggaatgccagtgctgaaacagatggctttggagcatgatatcccaattgtttcaatcgctgatctcatccggtatagaaggaagagggagaagctggtggaactgattgctgtatctcgtttgccgacgaaatggggccttttccgagcttactgctaccaatccaagcttgatggaaccgagcacattgctgttgcaaagggcgacatcggcgacggcgaggacgtcttggtgagggtccattccgagtgcctgaccggcgacatcctcggctccgcccgctgcgactgcggcaaccagctggacctggcgatgcagctcatcgacaaggccggccgcggcgtcctcgtctacctccgcggccacgagggccgcggcatcggcctcggccagaagctccgcgcctacaacctccaggacgacggccacgacaccgtccaggccaacgtcgagctcggcctcgccgtcgactcccgcgagtacggcatcggcgcccagattctgcgggacatgggggtgcgcacgatgcggctgatgacgaacaacccggcaaagttcgtcgggctcaagggctacgggctcgccgtcgtcggcagggttccggtgatctcccccatcaccaaggagaaccagaggtacctcgagacgaagcgcaccaagatgggccatgtctacggctccgacctccccggcaacgtcccggaggaattcctcaacccggacgacatcgccggagaccaagacgaagacgacacccacaactga

SEQ ID NO: 49503 - protein, 396 aa, Oryza sativa
MAATLADPESIAFMIRNGSGIISVGMKEEDLTRLMIPMMSPIAEIEDISAAASTVTVDARVGISTGVSAADRAKTIFTLASPDSKPTDLRRPGHIFPLKYRNGGVLKRAGHTEASVDLVALAGLRPVSVLSTVINPVDGSMAGMPVLKQMALEHDIPIVSIADLIRYRRKREKLVELIAVSRLPTKWGLFRAYCYQSKLDGTEHIAVAKGDIGDGEDVLVRVHSECLTGDILGSARCDCGNQLDLAMQLIDKAGRGVLVYLRGHEGRGIGLGQKLRAYNLQDDGHDTVQANVELGLAVDSREYGIGAQILRDMGVRTMRLMTNNPAKFVGLKGYGLAVVGRVPVISPITKENQRYLETKRTKMGHVYGSDLPGNVPEEFLNPDDIAGDQDEDDTHN

SEQ ID NO: 49504 - DNA, 639 bp, Burkholderia glumae
  CDS (1)..(639): transl_table=11
atgaatcaatccgatgatcattccggtgtgagcatccgcacacgcatcaaggtgccgattcgtccgcgttcgagcgcgacggcatttgaaaccgagatggtgaccttcaacggtctttgcgacagcgccgaacatatcgcgctggtgttcggcaagatcggcgaggcgccgctggtgcgcctgcattccgagtgcctgacgggcgacgtgttcggctccgcgcgctgcgactgcggcgagcagctcgacgagtcgatcgcgctgttcggcgagcgcggcggcatcctgctctacctgcgccaggaagggcgcggcatcgggctctacaacaagctcgacgcctatcgcctgcagatctcgcagggactcgacaccttcgctgccaatcgcgcgctcaacttccccgacgacctgcgcgacttccgcgtggcggcccagatgctcaaggcgctcggcgtcggcgaggtctcgctggtcaccaacaaccccgacaagaccgcgcaactgacccgtcacggcatcaaggtgcgccaggtgaagtcgaccggcgtgttcgccaacagcgtcaactttggttatctgcatgcgaaggcgacccagcaccggcatgccatcaagctcaacggagaaatgcaatga

SEQ ID NO: 49505 - protein, 212 aa, Burkholderia glumae
MNQSDDHSGVSIRTRIKVPIRPRSSATAFETEMVTFNGLCDSAEHIALVFGKIGEAPLVRLHSECLTGDVFGSARCDCGEQLDESIALFGERGGILLYLRQEGRGIGLYNKLDAYRLQISQGLDTFAANRALNFPDDLRDFRVAAQMLKALGVGEVSLVTNNPDKTAQLTRHGIKVRQVKSTGVFANSVNFGYLHAKATQHRHAIKLNGEMQ

SEQ ID NO: 49506 - DNA, 594 bp, Photobacterium leiognathi
  CDS (1)..(594): transl_table=11
atgatcacggtaagagcccgggtgccttttaaaatcgggcaaaaaagtcagatcccagcggagttattgtcgtttcatggctttaattcaggtaaagagcatatcgcaattatttttaaacaagcagataccacaaccgcccctttagttcgcttacattcagaatgcttaaccggtgatgtctttcattcttcgcgctgtgattgtggcgagcagctcaatgaaacaatagaaaaaatgcatcaattcggtgggatcattttgtatctacgtcaagaaggacgtggcattggtttatacaataaaatcgatgcctatcacttacaaagccaaggcatgaatacctatgaagccaataaccatttaggtttcgctgatgatctacgcgattttagtgaagctgcaaaagcattaatggcattaggcataaacaagatccgcttaatcactaacaacccaaagaaaatcaatgaacttcaacaacatggcattgagatcatagatgtggttaacactcaggtacacatcaaacaagacaacgaagattatctaaaaacaaaagcgttacacggccatcacaacctctctttatga

SEQ ID NO: 49507 - protein, 197 aa, Photobacterium leiognathi
MITVRARVPFKIGQKSQIPAELLSFHGFNSGKEHIAIIFKQADTTTAPLVRLHSECLTGDVFHSSRCDCGEQLNETIEKMHQFGGIILYLRQEGRGIGLYNKIDAYHLQSQGMNTYEANNHLGFADDLRDFSEAAKALMALGINKIRLITNNPKKINELQQHGIEIIDVVNTQVHIKQDNEDYLKTKALHGHHNLSL

SEQ ID NO: 49508 - DNA, 597 bp, Alcaligenes eutrophus
  CDS (1)..(597): transl_table=11
atgaatgacacagaaattgagctgatcgactcggcgcgcctgccgacgcgattcggcgactttacggcgcacgccttcaagggcgccgattcaggcatcgaacacctggccctcagcgtgggcgatgtgacgggcgatggcgtcctgatccgcatgcattccgaatgcctgaccggcgacgtcttcggttcctgccggtgcgactgcggtccgcagctcgagctcgccatggaaaagattgccgccgaaggtcgcggcatcctgctgtacctgcgcgggcatgaaagccgcggcattggcctggccgagaagatccgcgcctaccgcctgcaagacggcgggctcgacacggtcgacgccaacctggccctgggccaggcgatcgacgcacgcaactacgccttcgccgccgacctgctgcaccagtggggcgtcaagtccgtgcgcctgatgagcaacaatccgctcaaggccgcagcgctcgagaaggccggcatcacggttaccgagcagttgcgccacatcgtgccgtccaacgccgagaacgagaagtacctggctacgaagcgcacgcgcatggggcacctgctcgattga

SEQ ID NO: 49509 - protein, 198 aa, Alcaligenes eutrophus
MNDTEIELIDSARLPTRFGDFTAHAFKGADSGIEHLALSVGDVTGDGVLIRMHSECLTGDVFGSCRCDCGPQLELAMEKIAAEGRGILLYLRGHESRGIGLAEKIRAYRLQDGGLDTVDANLALGQAIDARNYAFAADLLHQWGVKSVRLMSNNPLKAAALEKAGITVTEQLRHIVPSNAENEKYLATKRTRMGHLLD

SEQ ID NO: 49510 - DNA, 561 bp, Thermoplasma acidophilum
  CDS (1)..(561): transl_table=11
ttgccaactgaatttgggcttttcaggatatatacatttgtaaatgatgaaaacaaggaccatgccgttatcgtacggggagatccgaggggaaaggaggatgtacctgtaagaatacattccgaatgcctcaccggtgacgttctcggatcgctgagatgcgactgcagggatcagctgatacagtccctgagatacctcggcaggcaggattacggtatgctgatttatctgaggcaggagggcagaggcatcggactcctcaacaagatcaaggcatacagcctccaggacagcggtgctgacactgtcgaagcgaatctgaaactcggcctgccggtagacagcagggattattcatttgcttcagaggtgataaagttcttcgaaataaagtccatatacataatgacaaacaacccggaaaagatgaaggcgcttatcgaaagcggcattaacgtcaagggtagaataccgattttcagcgatccaacgccatacgacaaattctatcttgaaaccaagaagataaagcttgggcacgagatagagaacatatga

SEQ ID NO: 49511 - protein, 186 aa, Thermoplasma acidophilum
MPTEFGLFRIYTFVNDENKDHAVIVRGDPRGKEDVPVRIHSECLTGDVLGSLRCDCRDQLIQSLRYLGRQDYGMLIYLRQEGRGIGLLNKIKAYSLQDSGADTVEANLKLGLPVDSRDYSFASEVIKFFEIKSIYIMTNNPEKMKALIESGINVKGRIPIFSDPTPYDKFYLETKKIKLGHEIENI

SEQ ID NO: 49512 - DNA, 654 bp, Actinobacillus actinomycetemcomitans
  CDS (1)..(654): transl_table=11
atgacaaaaattgaattagttgcccaagcgaatttaccgacagaattcggtctgtttaaaatcgtgggctttgaatttcccgacaccaaaaaagaacacgttgcgttggttttaggcgacatccgcaattcggacgaaccggtattagcgcgtattcattccgaatgcttaaccggcgacgcattacacagcctaaaatgcgactgcggtttccaactggcggcggcgttacgtcaaattcaacaggaagggctcggcgtattaatttaccaccgcgaagaaggcagaggcatcggcttaattaacaaaatccgcgcgtattccctccaagatcagggcatggacaccattgaagccaacctggctttaggctttgccgccgatgaacgcaattttggcgtatgtgcggatatttttgatttattgggcgtaacacaaattcgtctgctcaccaataatccgaacaaaatcaaaactatgaaacaggcaggaatcaacgtagttgcgcgggtaccgttaaatgtgggtgagaatcgttataacactgcctatttggacaccaaagcgaaaaaaatggggcattttatcgtgcataacggcgaacagcatttaatggaatgcccgtattgtcaggaagaagtgccgaaaaaataa

SEQ ID NO: 49513 - protein, 217 aa, Actinobacillus actinomycetemcomitans
MTKIELVAQANLPTEFGLFKIVGFEFPDTKKEHVALVLGDIRNSDEPVLARIHSECLTGDALHSLKCDCGFQLAAALRQIQQEGLGVLIYHREEGRGIGLINKIRAYSLQDQGMDTIEANLALGFAADERNFGVCADIFDLLGVTQIRLLTNNPNKIKTMKQAGINVVARVPLNVGENRYNTAYLDTKAKKMGHFIVHNGEQHLMECPYCQEEVPKK

SEQ ID NO: 49514 - DNA, 1092 bp, Wolbachia sp
  CDS (1)..(1092): transl_table=11
atgggtaaaaatgttataggaaatcagagtagcaataaggtagaaagagctatcagcgaaatcaggcgcggtcggccaattgtaatatatgatgaaagtaattacctattgtttgctgctgctgaggctttagaaagagatttatttaatcaatacaagcttacatcaagtaatgtatatgttactttaacttcaagtaaggtaaaatacatatctcagaataaagaacataacagcaaacgtctgttggtgaataattttgatgaactgctctatttaataaactgttcaaaggaagattgcataaaagagttgcaatgctcaaagacaatagatgaatgtgctattgccttgcttaagttctcagaattattgccatacgcgttagtggctgatatgacttttgagaataaccatgaaatgcgaaattggtgcgagaaaaatgacgttattgcactggacacgtcattcataaataattttcaagaaaatcaggatgtatatgaagtgtgcaaaacatcattatttttaaaacagactcaagaagtaaatatcatatcttatagaaccgaaagtggtggaagagaacatcatgcaattatcattggcaatccagataaagatgacgaaccattagtgagaattcattcttcgtgctatacgggtgacttgttagatagcttgtcatgcgattgcagaagtcagttacatcaagcaattcaaatgatagctgactctggaagtggtattatattgtatttgatgcaagatggaagaggcattggtttaactaataagttaagagcgtacagtatgcaaagaggacataatcttgatactgttgatgcaaatagaatattgggttttgaagatgatgaaaggagttttgctgttgcagctaaaatgcttaagaaattgaacattaacaaaatccaattacttacaaacaatgataggaaattgtcagaattggaaagtagtggtataggagttacaaagtgtctaccacttattgtggaacgtaataaatataacgattcatatatggagacaaagtttggtaaattaggccatagattaagagttttttag

SEQ ID NO: 49515 - protein, 363 aa, Wolbachia sp
MGKNVIGNQSSNKVERAISEIRRGRPIVIYDESNYLLFAAAEALERDLFNQYKLTSSNVYVTLTSSKVKYISQNKEHNSKRLLVNNFDELLYLINCSKEDCIKELQCSKTIDECAIALLKFSELLPYALVADMTFENNHEMRNWCEKNDVIALDTSFINNFQENQDVYEVCKTSLFLKQTQEVNIISYRTESGGREHHAIIIGNPDKDDEPLVRIHSSCYTGDLLDSLSCDCRSQLHQAIQMIADSGSGIILYLMQDGRGIGLTNKLRAYSMQRGHNLDTVDANRILGFEDDERSFAVAAKMLKKLNINKIQLLTNNDRKLSELESSGIGVTKCLPLIVERNKYNDSYMETKFGKLGHRLRVF

SEQ ID NO: 49516 - DNA, 1086 bp, Wolbachia sp
  CDS (1)..(1086): transl_table=11
atgtttataggaaatcaaagtagaaataaagtagaaagggccatcagtgaagtcaggcgtggtcttccaattttaatatatgatgataaaaataactatctattgtttgctgctgctgaaactttagaaaaaaatttgtttagtcaatataagcttatatcaggtaatgtatatgttactttgactgcaagtaaggtaaaatacatatgtcagagtaaagaacatagtagcaaacgtctgttggtaaacaattttgatgaactgctccatttaatagactgttcaaaggaagatcacataaaagaattgcaatgctcaaagacaatagatgaatatgctattgccttgcttaaattctcagaattattgccatacgcattagtggctgatatgacgtttgagaataaacatgaaatgcgaaattggtgtgaagaaaatgacattattgcactaaatacgttacttgtgaatgattttcaacgaaatcatagtgtgtatgaagtgtgcaaaacatcattatttttaaagcagactcaagaagtagatatcatatcttatagaaccaaaagtggcggaagagaacattatgcaattatcattggcaatccagataaagataatgagccattagtgagaattcattcttcatgctatacaggagacttattagacagcttatcatgtgattgcagaagccagttacatcaagcgattcaaataatgaccgactttgggaatggcattatattatacttgatgcaagatgggagaggcattggtttaactaataagttaagagcatacagtatgcaaagaaaatataatcttgatactgttgatgcaaatagagtattgggttttgaagatgatgaaaggagctttgctgttgcagctaaaatacttaagaaattgaacattaacaaaatacaattacttacaaacaatggtagaaagttatcagagttgaaaaataacggtatagaagttacaaagtgtgtaccacttattatggaacgcaatgaatataatgattcatatatggaaacaaaatttgacaagttaggccatggattaagggtttattag

SEQ ID NO: 49517 - protein, 361 aa, Wolbachia sp
MFIGNQSRNKVERAISEVRRGLPILIYDDKNNYLLFAAAETLEKNLFSQYKLISGNVYVTLTASKVKYICQSKEHSSKRLLVNNFDELLHLIDCSKEDHIKELQCSKTIDEYAIALLKFSELLPYALVADMTFENKHEMRNWCEENDIIALNTLLVNDFQRNHSVYEVCKTSLFLKQTQEVDIISYRTKSGGREHYAIIIGNPDKDNEPLVRIHSSCYTGDLLDSLSCDCRSQLHQAIQIMTDFGNGIILYLMQDGRGIGLTNKLRAYSMQRKYNLDTVDANRVLGFEDDERSFAVAAKILKKLNINKIQLLTNNGRKLSELKNNGIEVTKCVPLIMERNEYNDSYMETKFDKLGHGLRVY

SEQ ID NO: 49518 - DNA, 1302 bp, Arabidopsis thaliana
  CDS (1)..(1302)
atgagagtgatacctgaggaaggagatgtgttctcttcttctaagagtaatggatcatcaatggggattgagttacagccagatttggtttcgtttggaacattagcagctgaaatgattcctacaacaatggattctcctgaagttgaggatgaagagtttgatttagatcgacctactgatggatttgcgtctattcctcaagctattgaagatattcgacatggcaagatggtagttgttgtagatgatgaagatagagaaaacgaaggagatttgataatggcggcatctttggctacacctgaagctatggcttttgttgtaaagcatgggactggaatcgtgtgtgtgagcatgaaaggcgaagacttggagaggttagagcttcctttaatggtaacgcgtaaggataacgaggaaaaactccgcacggccttcacggtttcagtggacgcaaaaaagggaacatccacaggtgtctcagctcgtgatagggcgcaaacaatattaacccttgcatcaaaagattcaaaacctgaagatttcaatcgtcctggtcatatttttcctttgagatacagagaaggtggtgttcttaaaagagcagggcatacagaagcctctgttgacttgactgtgttggccggtttagaaccagtatctgttttatgtgagattgtagatgatgatggttccatggctagattaccaagactccgccaattcgctcaagagaacaacttgaaattaatttcaatcgctgatttaatcagataccgaaggaaaagagagagactggttgagtttactgcggttgcgcctataccgacaatgtggggaccattcaaagcacattgctttaagtcattacttgatggagttgagcacattgcaatggtcaagggagaaatcggagatgggaaggatattctcgtgagagtacacgcggagtgtatcacagatgatatattcggaaatagctctggtggaaaacagttagcgattgcaatgagactgattgaagaaaatgggagaggtgtttttgtctacttacgtggtcctgaaagtaaaggcattgatctaagccacaagcctcgtacttacaacaccaattcagatcaagccgagggtgtttcatttcccgttgcttcacgggaatacggcattggagcacaaattctaagggatcttggagttagagagatgaaggtgatgacgaataatccagcacattacgttggtcttaaaggctatggtttatcaatttctggtaaggttccactcattactactccttaa

SEQ ID NO: 49519 - protein, 433 aa, Arabidopsis thaliana
MRVIPEEGDVFSSSKSNGSSMGIELQPDLVSFGTLAAEMIPTTMDSPEVEDEEFDLDRPTDGFASIPQAIEDIRHGKMVVVVDDEDRENEGDLIMAASLATPEAMAFVVKHGTGIVCVSMKGEDLERLELPLMVTRKDNEEKLRTAFTVSVDAKKGTSTGVSARDRAQTILTLASKDSKPEDFNRPGHIFPLRYREGGVLKRAGHTEASVDLTVLAGLEPVSVLCEIVDDDGSMARLPRLRQFAQENNLKLISIADLIRYRRKRERLVEFTAVAPIPTMWGPFKAHCFKSLLDGVEHIAMVKGEIGDGKDILVRVHAECITDDIFGNSSGGKQLAIAMRLIEENGRGVFVYLRGPESKGIDLSHKPRTYNTNSDQAEGVSFPVASREYGIGAQILRDLGVREMKVMTNNPAHYVGLKGYGLSISGKVPLITTP

SEQ ID NO: 49520 - DNA, 1137 bp, Archaeoglobus fulgidus
  CDS (1)..(1137): transl_table=11
atggaagaggtttcatctcacgtaaaatccggaaagcctgtaatgattcttgattcggaaaaaagcgccatctgcattcccgcagaggttgtcagcggagaaatactcaacttcatgatgaagaactgcgatgagattcgtttggccttaacctggaagcagattcttaacctcggccttaacaggttcaggttccagaacgggaacttaattccaatcgacccaaatcttgagaaaatttcggcagaggaaagggcaaaattcatcagagagttggttagcggtaatgctggcgacatcaagtatcccggcagaatattcgtagaagagaccaaggagatgggagtgctggagaggccggggatagccgaagcttgcgttgatctggcgaggatggcagggttcgccccctctgccgtttacgctcctctcatgacggcagaaggtggcgttgctggggaggattatgctctaaaatttgccaaagagcactcaatgcccgttttcaggataaaagacatgattgagttcaggataaagtcagaaaagattgttgagagggttattgaagccactctcccgacaaagttctacggcaccttcagggctgtgggctacaaaacacctttgggggagatagtcgccctcgttaagggtagggttgatgagggagacgttctggttagaatccactcggagtgcctgacgggcgacgtttttcactcactgcggtgtgattgcggagaccagcttgagaacgctctgaaaatgattgacagagagggtaagggcgtggcaatctacatgaggggccatgagggcagagggatagggctcataaacaagcttatggcctacaagcttcaggaagagggaaaggataccgtagatgcaaacatcgagctcggatttcctcccgacatgaggagctacggaatcgccgcccagattctcatggatttgaaggtcaagagcatcaggctgctcaccaacaatcccctcaaaatagaggagcttaagaagtacggattcaaaatcgttagagagccgattgaggtagaaccctgcgaggtcaatctgccctatcttaaagcgaagaaggacaagatgggacacttgatatgcttcaacgactga

SEQ ID NO: 49521 - protein, 378 aa, Archaeoglobus fulgidus
MEEVSSHVKSGKPVMILDSEKSAICIPAEVVSGEILNFMMKNCDEIRLALTWKQILNLGLNRFRFQNGNLIPIDPNLEKISAEERAKFIRELVSGNAGDIKYPGRIFVEETKEMGVLERPGIAEACVDLARMAGFAPSAVYAPLMTAEGGVAGEDYALKFAKEHSMPVFRIKDMIEFRIKSEKIVERVIEATLPTKFYGTFRAVGYKTPLGEIVALVKGRVDEGDVLVRIHSECLTGDVFHSLRCDCGDQLENALKMIDREGKGVAIYMRGHEGRGIGLINKLMAYKLQEEGKDTVDANIELGFPPDMRSYGIAAQILMDLKVKSIRLLTNNPLKIEELKKYGFKIVREPIEVEPCEVNLPYLKAKKDKMGHLICFND

SEQ ID NO: 49522 - DNA, 1158 bp, Azospirillum brasilense
  CDS (1)..(1158): transl_table=11
atgtacgccgacgccccgtccgactccgccccgcccgaagccgtcctgcccatggacgaagccgccatgcgcgcggtggaccgggccacggccgccctgcgccggggcgaggccgtcgccatcgagaccgccgacggcagcgtcggcgccgcggtgtcggtggaatccgtggcgatcgacgccgtgcagcggctggtgcagttgaccggcgccgcgccggtcctggcggtcacccgccgccgcgccacggtgctgaagctgatgggggaggggacgggcgtcgtcgccctgtcgcttccccgctgcctgaccgcggacgaggcccacgcgctggccgatcccgaacaccgcccggacggcgacatgcccgacggcctgaccgccacggccatggaccccggatcgcgcgagaccgcggcggtcgacctcgcccggctggcgcggctgctgccggcggccatcgtcgccccggccaccgatcacaccggcagcgccgcggaatgggcggcggagcacgacctgctgctggtccgcgcccgcgacatcgccgactaccgcgtccatgtcgtgcgtacgctgcgtcgggtggccgaggcccgcgtcccgctgtccggcgccgagaacaccagcatcgccgccttccgtcccatcgacggcgggccggagcatctggcgatcatcgtcggcaacccggtggcgggcgagccggtgctggcccgcctgcattcggaatgcttcaccggcgaccttctggcaggcttgcgctgcgactgcggtcagcagctgcgcggcgccatcgcggagatcgcccggcacggcagcggagtcctgctctatctggcgcaggaagggcgggggatcggcctcgtcaacaagctgcgcgcctaccgcattcaggaccgcggcttcgacacggtggacgccaacgagatcctgggtttcgaggccgacgagcgggtctatctgccggcggcggagatgctgcggcaactgggcttcaccgccgtgcggctgatgaccaacaacccggagaagctgcgccagctcgcccgctgcgggatcgaggtggtcgagcgcgttccccacatcttcccggccaacggccacaacgaaggctatctgcgcaccaaggcggagcgcagcggccacatgttctga

SEQ ID NO: 49523 - protein, 385 aa, Azospirillum brasilense
MYADAPSDSAPPEAVLPMDEAAMRAVDRATAALRRGEAVAIETADGSVGAAVSVESVAIDAVQRLVQLTGAAPVLAVTRRRATVLKLMGEGTGVVALSLPRCLTADEAHALADPEHRPDGDMPDGLTATAMDPGSRETAAVDLARLARLLPAAIVAPATDHTGSAAEWAAEHDLLLVRARDIADYRVHVVRTLRRVAEARVPLSGAENTSIAAFRPIDGGPEHLAIIVGNPVAGEPVLARLHSECFTGDLLAGLRCDCGQQLRGAIAEIARHGSGVLLYLAQEGRGIGLVNKLRAYRIQDRGFDTVDANEILGFEADERVYLPAAEMLRQLGFTAVRLMTNNPEKLRQLARCGIEVVERVPHIFPANGHNEGYLRTKAERSGHMF

SEQ ID NO: 49524 - DNA, 585 bp, Buchnera aphidicola subsp
  CDS (1)..(585): transl_table=11
atgcaattaatagaaaaagccatgttacctactccttggggaaattttcttatctttggttttgaagaaaagaaaaatgggaaaaatcatgttgctcttgtatatggtgatataaaaacaaacactcctactctttctagagtacattcagaatgtctaacaggagatgctttttttagtttacgttgtgattgcggtagtcaactagaaatgtctatgaaaagaatttctcaggaaggcagtggtgtattaatttatcatcgtcaggaagggaggaatattggtcttcttaacaaaataaaagcatacgctttacaagatagaggcttagacacggttcaagcaaatcaaaaacttggtttttctgcagatgagagagatttttcattatgcgctgatatatttaatatattaaatattaaaaaaattcgtttattaacaaataatccatttaaagtgcagatgctgagtgatgccggaataaatattgtagaacgtgttcctcttattgtaaaaaaaaatcctaaaaatgcttattatttaaaaactaaagctgaaaaaatgggtcacttgttgtctgaataa

SEQ ID NO: 49525 - protein, 194 aa, Buchnera aphidicola subsp
MQLIEKAMLPTPWGNFLIFGFEEKKNGKNHVALVYGDIKTNTPTLSRVHSECLTGDAFFSLRCDCGSQLEMSMKRISQEGSGVLIYHRQEGRNIGLLNKIKAYALQDRGLDTVQANQKLGFSADERDFSLCADIFNILNIKKIRLLTNNPFKVQMLSDAGINIVERVPLIVKKNPKNAYYLKTKAEKMGHLLSE

SEQ ID NO: 49526 - DNA, 600 bp, Buchnera aphidicola subsp
  CDS (1)..(600): transl_table=11
atgaaactgacaaaaatttctgaagcgaaattacctacttcttttggtgaatttttaatgattgtttttgaagaaagtaaaacagataaaaatcatattgcattggtatatggagatataaaagacacaaataattcagtgttgtctaggattcattctgaatgtttaacaggtgatgcattatttagtatacgctgtgattgtggttttcaattaaaatctgcgttgatggaaattgttaaagaaggtagtggaattcttatatatcatcgccaagaaggacgtaacattggtttatctaataaaatacgtgcatacgcattgcaagatatcggattagatactgttgaagcgaatcatcatttaggtttttctgctgacgaaagggatttttccgtttgcatagatatatttaatacattgaatattaaaaaaataaaattattaactaataacccttcaaaagtaacagttttaaataatgcaggaattcaaattactgaaagaatatcattaattgtaggtagaaatgctaaaaattctaaatatttgaatacaaaagctcataaaatgggacattttttaccaattgaatattaa

SEQ ID NO: 49527 - protein, 199 aa, Buchnera aphidicola subsp
MKLTKISEAKLPTSFGEFLMIVFEESKTDKNHIALVYGDIKDTNNSVLSRIHSECLTGDALFSIRCDCGFQLKSALMEIVKEGSGILIYHRQEGRNIGLSNKIRAYALQDIGLDTVEANHHLGFSADERDFSVCIDIFNTLNIKKIKLLTNNPSKVTVLNNAGIQITERISLIVGRNAKNSKYLNTKAHKMGHFLPIEY

SEQ ID NO: 49528 - DNA, 579 bp, Helicobacter pylori J99
  CDS (1)..(579): transl_table=11
ttgaaacgattagaagtttctaaccaagccaaattacccactcaatttggggagttttgtatccagtgttttagagaaaagggttctaatggctctaaagatcatttagtcattttcacccctaattttcctcaaaaccccttagtgcgtttgcattcagaatgcttaaccggtgatgctctaggctctcaaaaatgcgattgcggaggggcgttgcaaatggcgttagaaaggatttctaaagaaggggggctagtgatttatttgcgccaagaagggcgtgggatagggctatttaacaaagtcaatgcctacgctttacaggataaaggttatgataccattcaagccaatgaaatgatagggtttaaagacgatgaaagggattatagtattgcgggtgagattttagaatattaccgcattaaaaaaatgcgcttgctcacgaataaccctctaaaaatcgccgctttagaaaaatacgctgaggtaacaagggagagcttgatcgtgtgcgctaatgagcataatcaagggtatttggaagttaaaaagctcaaaatggggcatttattgtga

SEQ ID NO: 49529 - protein, 192 aa, Helicobacter pylori J99
MKRLEVSNQAKLPTQFGEFCIQCFREKGSNGSKDHLVIFTPNFPQNPLVRLHSECLTGDALGSQKCDCGGALQMALERISKEGGLVIYLRQEGRGIGLFNKVNAYALQDKGYDTIQANEMIGFKDDERDYSIAGEILEYYRIKKMRLLTNNPLKIAALEKYAEVTRESLIVCANEHNQGYLEVKKLKMGHLL

SEQ ID NO: 49530 - DNA, 579 bp, Helicobacter pylori
  CDS (1)..(579): transl_table=11
ttgaaacgattagaagtttctaaccaagccaaattacccactcaatttggggagttttatatccagtgttttagagaaaagggttctaatggctctaaagatcatttagtggttttcacccctaatttttctcaaaaccccttagtgcgtttgcattcagaatgcttaacgggtgatgctctaggctctcaaaaatgcgattgcgggggggcgttgcaaatggcgttagaaaggatttctaaagaaggggggcttgtgatttatttgcgccaagaagggcgtgggatagggctatttaataaagtcaatgcctacgctttacaggataaaggctatgataccattcaagccaatgaaatgatagggtttaaagacgatgaaagggattatagtgttgcgggtgaaattttagaatactaccgcattaaaaaaatgcgcttactcacaaacaaccctaaaaaaatcgccgctttagaaaaatacgctgaagtaacaagggagagcttgatcgtgtgcgctaatgagcacaatcaagggtatttggaagtcaaaaagctcaaaatggggcatttattgtga

SEQ ID NO: 49531 - protein, 192 aa, Helicobacter pylori
MKRLEVSNQAKLPTQFGEFYIQCFREKGSNGSKDHLVVFTPNFSQNPLVRLHSECLTGDALGSQKCDCGGALQMALERISKEGGLVIYLRQEGRGIGLFNKVNAYALQDKGYDTIQANEMIGFKDDERDYSVAGEILEYYRIKKMRLLTNNPKKIAALEKYAEVTRESLIVCANEHNQGYLEVKKLKMGHLL

SEQ ID NO: 49532 - DNA, 594 bp, Neisseria meningitidis serogroup A
  CDS (1)..(594): transl_table=11
atgtctgaattattaaactatgtcgcttcgtgccgcctgccgaccgaatggggcgtgtttacgatgcacggttttgaagaagcaggcgggcaggaacacgtcgcgctgaccgtcggcgattgttcagacggcaatccggttctgacgcgcatccactccgaatgcctgacgggcgacgcgctgttctcaaaaaaatgcgactgcgggccgcaactggaagcggcaatgaaagcggttcaggcggaagggcgcggcatcatcgtctatctgcgtcaggaaggacgcggcatcgggctgattaacaaaatccgcgcctatcatttgcaggatcagggtatggatacggttgaggcgaacgtggcactcggtctgcccgtcgatgcccgcgatttccgtttggcgcaatctatctacgaatatctgggcatccgctcggtcaaactgctgaccaacaaccccgaaaaaatccaaaccctgaaagatgcggggattaacgtggtcgaacgcatccccctgcacgtcggggaaaaccttgaaaacaaacgctacctccaaaccaaagcagacaagctggggcatctgatgtcggaataa

SEQ ID NO: 49533 - protein, 197 aa, Neisseria meningitidis serogroup A
MSELLNYVASCRLPTEWGVFTMHGFEEAGGQEHVALTVGDCSDGNPVLTRIHSECLTGDALFSKKCDCGPQLEAAMKAVQAEGRGIIVYLRQEGRGIGLINKIRAYHLQDQGMDTVEANVALGLPVDARDFRLAQSIYEYLGIRSVKLLTNNPEKIQTLKDAGINVVERIPLHVGENLENKRYLQTKADKLGHLMSE

SEQ ID NO: 49534 - DNA, 594 bp, Neisseria meningitidis serogroup B
  CDS (1)..(594): transl_table=11
atgtctgaaatgttgaaccatgtggcatcctgccgcctgccgaccgaatggggcgtatttacgatgcacggctttgaagaggcaaacgggcaggaacacgtcgcgctgaccgtcggtaatttttcagacggcaatccggttctgacgcgcatccactccgaatgcctgacgggcgatgcgctgttctcgagaaaatgcgactgcggacctcaacttgaagcggccatgagggcggtacagacagaggggcgcggcatcatcgtctatctgcgtcaggaaggacgcggcatcgggctgattaacaaaatccgcgcctatcatctgcaagaccaaggtatggatacggttgaagccaatttggcactcgggctgcccgtcgatgcccgcgatttccgtttggcgcaatctatctacgaatatctgggcatccgctcggtcaaactgctgaccaacaaccccgaaaaaatccaaaccctgaaagatgcggggattaacgtggtcgaacgcatccccctgcacgtcggggaaaaccttgaaaacaaacgctacctccaaaccaaagcagacaagctgggacatctgatgtcggaataa

SEQ ID NO: 49535 - protein, 197 aa, Neisseria meningitidis serogroup B
MSEMLNHVASCRLPTEWGVFTMHGFEEANGQEHVALTVGNFSDGNPVLTRIHSECLTGDALFSRKCDCGPQLEAAMRAVQTEGRGIIVYLRQEGRGIGLINKIRAYHLQDQGMDTVEANLALGLPVDARDFRLAQSIYEYLGIRSVKLLTNNPEKIQTLKDAGINVVERIPLHVGENLENKRYLQTKADKLGHLMSE

SEQ ID NO: 49536 - DNA, 660 bp, Pasteurella multocida
  CDS (1)..(660): transl_table=11
atggcaaaaattcaacgcgttaccgaggctaatttgccaacggaatttggcatgtttagaattgtcggttttgaatttccagacaccaaaaaagaacatgtggcattagtattgggagaggtagaaaacaccgacgagccaattttagcccgcatccattctgaatgcttaacgggtgatgccctttacagcttaaaatgcgattgtggctttcaactggccgctgccttacgtcaaattagccaagaaggtcgtggtgtattaatttatcaccgcgaggaaggacgtggtatcggtttaattaataaaatccgcgcctattcccttcaagacaaaggcatggatacgattgaagcaaatcttgcattaggctttgcggcagatgaacgaaattttgaagtgtgtgccgatatttttgcgttgttaggcattaataaagttcgcttattaaccaataacccaaacaaaattgacaccatgaaaaaggcagggatcaatattgtagaacgtgtcgcattaaatgtaggcgaaaaccgctataacacggaatatttagacacaaaagccaaaaaaatggggcattttattattcataatcagcaaaaatacccacttgagtgcccttattgctcagaagaagttcctgtgcaagagaaataa

SEQ ID NO: 49537 - protein, 219 aa, Pasteurella multocida
MAKIQRVTEANLPTEFGMFRIVGFEFPDTKKEHVALVLGEVENTDEPILARIHSECLTGDALYSLKCDCGFQLAAALRQISQEGRGVLIYHREEGRGIGLINKIRAYSLQDKGMDTIEANLALGFAADERNFEVCADIFALLGINKVRLLTNNPNKIDTMKKAGINIVERVALNVGENRYNTEYLDTKAKKMGHFIIHNQQKYPLECPYCSEEVPVQEK

SEQ ID NO: 49538 - DNA, 1035 bp, Pichia guilliermondii
  CDS (1)..(1035)
atggcatcgaaggacatagtacatccgcaaccagagcgccggcacgggtcggaaactcacgaatttaccatgcctctcttatctcctacattgacaccatcccatattccatcgcaaacgcctcaaattcctccggaagtgccagcagaagtcagggatcgcttgccccttcctgaaacgttgcctgtggtgaaatgcatggcgagagctcgtataccgaccactcaggggccggagatatttctccatttgtacgagaataacgttgacaataaagagcatttggctattgtttttggggaagatgtgcggtcgaaaacgctctatcagaaacgtcccaatgagacccagcaagatagaatgactcgtggtgcttatgtgggcagattgtttcctggaagaaccgaggcagactatgacagtgagtctaatttgagagtgaatttcgatgtaaatggccaacttatcagagatccgagtaccacctgtagtggtgagcccattttgtcccgtattcattcggaatgttatacgggggaaaccccatggagtgctcgttgcgattgtggagaacaattcgatgaagctggtcggttaatgggtgaagctgggcacgggtgtatcgtgtaccttcgtcaggaaggtcgtggaattggacttggggaaaagttgaaggcttataatttgcaagacttgggagcggataccgtccaggccaatttgatgttacgacatcctgctgatgcgagatctttttcgctcgctacagccatactcttggacttggggctcaacgagatcaagttgttgaccaacaatcccgataaaattgctgcagttgagggaagaaacagagaggtcaaggtagtggaacgggtgcctatggtgccgttggcatggagaagtgagaatggaatcaagtcaaaagagatagagggctacttgactgctaagattgaaaggatggggcacttgcttgtaagccactcaagatatgatagaagagatgaagttaaggacttaagaaataaatga

SEQ ID NO: 49539 - protein, 344 aa, Pichia guilliermondii
MASKDIVHPQPERRHGSETHEFTMPLLSPTLTPSHIPSQTPQIPPEVPAEVRDRLPLPETLPVVKCMARARIPTTQGPEIFLHLYENNVDNKEHLAIVFGEDVRSKTLYQKRPNETQQDRMTRGAYVGRLFPGRTEADYDSESNLRVNFDVNGQLIRDPSTTCSGEPILSRIHSECYTGETPWSARCDCGEQFDEAGRLMGEAGHGCIVYLRQEGRGIGLGEKLKAYNLQDLGADTVQANLMLRHPADARSFSLATAILLDLGLNEIKLLTNNPDKIAAVEGRNREVKVVERVPMVPLAWRSENGIKSKEIEGYLTAKIERMGHLLVSHSRYDRRDEVKDLRNK

SEQ ID NO: 49540 - DNA, 618 bp, Pseudomonas aeruginosa
  CDS (1)..(618): transl_table=11
gtgtccgtcgtgttcgtcgccgcctccaaactgccgactcccttcggcgaattcaccatgcatggtttcctcgacgaggagagcggcaaggaacatgtagccctgagcatgggcgacatcgccgatggcgcgccggtgcttggtcgcctgcattccgaatgcctgaccggcgacgcgctgttcagcctgcgctgcgattgcggtttccagctggaaggcgcgcttgccgccatcgccgaggagggccgcggcgtgctcctctacctgcgccaggaaggtcgcggcatcggcctgctgaacaagatccgtgcctatgaattgcaggatggcggtgccgacaccgtcgaggcgaacctgcaactgggttttggcgccgaccagcgcgactacgccatgtgccagccgatgctcgcgcacctgggcgtctcctccctgcgcctgatgaccaacaatccgcgcaaggtcaaggcgctggaaagctacgccatcaccgtggcggagcgcgtgccgctgcaaaagggcctgaacaagcacaacaggcgctacctggcgaccaaggccggcaagctcgggcacatgctcggcagcctgcaccagggcgaggcggaaaccacgtga

SEQ ID NO: 49541 - protein, 205 aa, Pseudomonas aeruginosa
MSVVFVAASKLPTPFGEFTMHGFLDEESGKEHVALSMGDIADGAPVLGRLHSECLTGDALFSLRCDCGFQLEGALAAIAEEGRGVLLYLRQEGRGIGLLNKIRAYELQDGGADTVEANLQLGFGADQRDYAMCQPMLAHLGVSSLRLMTNNPRKVKALESYAITVAERVPLQKGLNKHNRRYLATKAGKLGHMLGSLHQGEAETT

SEQ ID NO: 49542 - DNA, 618 bp, Pseudomonas putida
  CDS (1)..(618): transl_table=11
gtgcccgtcgtctttgttgccgcctcaaaactcccgacgcccttcgcgaccttcaccatgcatggctttctcgacgaagccacaggccgtgagcatgtggtgctcagcctgggtgatatcgcggacggccagccggtactggggcgcctgcattccgagtgcctgaccggcgatgcactgttcagccagcgctgcgactgcggctcgcagttggaagccgcgctgcaggccatcgcccgcgaaggccgtggggtgttgttgtacctgcgtcaggaaggccgtggcatcggcctgctgaacaagatccgcgcctacgagctgcaggatggcggcgccgacaccgtcgaagccaacgagcgcctgggcttcgctgccgaccagcgtgactacgccatatgcctgccgatgctcgagcacctgggcgtcaagtcgctgcgcctgatgaccaacaatccgcgcaaggtcaaagccctgaccgacatgaacatcgtggttgccgagcgtgtgccgctgcacaccgggcataacccgcacaaccgctactacctggcgaccaaggccggcaagttgggccacatgctgggcaacgaacaccagggcgaggtgccccaggcgtga

SEQ ID NO: 49543 - protein, 205 aa, Pseudomonas putida
MPVVFVAASKLPTPFATFTMHGFLDEATGREHVVLSLGDIADGQPVLGRLHSECLTGDALFSQRCDCGSQLEAALQAIAREGRGVLLYLRQEGRGIGLLNKIRAYELQDGGADTVEANERLGFAADQRDYAICLPMLEHLGVKSLRLMTNNPRKVKALTDMNIVVAERVPLHTGHNPHNRYYLATKAGKLGHMLGNEHQGEVPQA

SEQ ID NO: 49544 - DNA, 591 bp, Salmonella typhi
  CDS (1)..(591): transl_table=11
atgcagcttaaacgtgtggcagaagccaaactgccaaccccattgggtgactttctgatggtgggatttgaagaactggcaaccggacacgaccatgccgcgctggtttttggcgatatttcaggtaaaacgccagtactggctcgcgttcattccgaatgtcttaccggggacgcgctttttagtctgcgctgtgattgtggttttcaactggaagccgcgctgacgcatattgcggaagaaggacgcggtattctgatttaccaccgtcaggaaggccgcaatatcggcctgcttaataaaattcgcgcttatgcgttacaggatcaaggctatgacacggtggaggccaatcatcagctcggctttgccgccgatgagcgtgatttcaccctgtgcgcggatatgttcaaattactcggcgtggatgaagttcgcctactgaccaataatccgaagaaagtcgaaatactgaccgaggcgggaattaatatcgtggaacgcgttccgctcattgtgggtcgtaatccaaataatgagcattatctcgatactaaagcggccaaaatgggccacctgctaagcaagtaa

SEQ ID NO: 49545 - protein, 196 aa, Salmonella typhi
MQLKRVAEAKLPTPLGDFLMVGFEELATGHDHAALVFGDISGKTPVLARVHSECLTGDALFSLRCDCGFQLEAALTHIAEEGRGILIYHRQEGRNIGLLNKIRAYALQDQGYDTVEANHQLGFAADERDFTLCADMFKLLGVDEVRLLTNNPKKVEILTEAGINIVERVPLIVGRNPNNEHYLDTKAAKMGHLLSK

SEQ ID NO: 49546 - DNA, 612 bp, Shewanella oneidensis
  CDS (1)..(612): transl_table=11
atgtcgataaaatatgtcgcgacgtcaaaattacccactccttggggcgtttttgccatgcacggttttgaagatactgaaacaggcaaagagcatgttgcccttacgtttggctccctaagtagcgatgaacctgtattaggtcgtattcactcagaatgtctcaccggcgatgccttgttcagtttacgctgtgattgtggattccagctacaaaccgcaatgcagaacattgctgaaacgggaagtggttttattttgtatttacgccaagaaggccgtggtattggtttgctaaacaagatccgcgcctatgagttgcaggataaaggtgccaatacggttgaggcgaatgagcagttaggttttccggcggatatgcgtaaatacgatatgatccagcctatgcttgaaaaaattggtgtgaagcacgtacgcttaatgaccaataatcctcgcaaagtcaaagcgatgaaagaaattggtattgaggtagttgaacgagtaccgctacaagtgggtaaaaaccgttacaatgaagcttacctaaagacgaaatccactgagcttgggcatatgatgtctgagtatcattttacggatgaagagtag

SEQ ID NO: 49547 - protein, 203 aa, Shewanella oneidensis
MSIKYVATSKLPTPWGVFAMHGFEDTETGKEHVALTFGSLSSDEPVLGRIHSECLTGDALFSLRCDCGFQLQTAMQNIAETGSGFILYLRQEGRGIGLLNKIRAYELQDKGANTVEANEQLGFPADMRKYDMIQPMLEKIGVKHVRLMTNNPRKVKAMKEIGIEVVERVPLQVGKNRYNEAYLKTKSTELGHMMSEYHFTDEE

SEQ ID NO: 49548 - DNA, 666 bp, Streptomyces coelicolor
  CDS (1)..(666): transl_table=11
atgacagaaaaaatcggtgtactcggcaagaagacgacccagcgcacggacgtggagcggatcgtggtgacgccgcttcccaccgtgtacgggaaattccgggcgttcggctatttcgaccacgaacgcggcgacgagcaagtggccctcgtgcacggcgacctcggcgccgaagacgtgctcacccggctccactcggaatgcctgaccggcgacgccttcggctcccagcactgcgagtgcggcgcccaactcgccagcgcgctccggcaggtggccgacgcgggcagcggcatcgtggtctacctgcgcgggcacgaggggcgcggcatcggcctgctcgccaaactgcgcgcgatggcgttgcaggcggagggcctggacacggtggaggcgaacctcgccctcggcctgccggtggacgcccgggactacggcgtcgccgcgcgaatcctcgacgacctcggggtgcggtcggtgcggctgatgtccaacaacccgcgcaagcgcgaggcgttggtgcggcacggcatccgggtcgccgagcaggtgccgctgctgataccgccgtgcgagtcgaacatcacctacctgcgcaccaagcgggagcggctcgaccaccacctgccgcacctggacgccgcgatggcacacgtctcgtcctga

SEQ ID NO: 49549 - protein, 221 aa, Streptomyces coelicolor
MTEKIGVLGKKTTQRTDVERIVVTPLPTVYGKFRAFGYFDHERGDEQVALVHGDLGAEDVLTRLHSECLTGDAFGSQHCECGAQLASALRQVADAGSGIVVYLRGHEGRGIGLLAKLRAMALQAEGLDTVEANLALGLPVDARDYGVAARILDDLGVRSVRLMSNNPRKREALVRHGIRVAEQVPLLIPPCESNITYLRTKRERLDHHLPHLDAAMAHVSS

SEQ ID NO: 49550 - DNA, 597 bp, Vibrio parahaemolyticus
  CDS (1)..(597): transl_table=11
atggcggaagtacgtgccagagtagattttaaagtcggggctaaaagtaatatcgatgctgagatcctgtctttccgtggccttaagacagataaagagcatgtggcagttatttttaaacaagcggatcaaacgcaagacacgccgctagtgcgtatgcattccgagtgtctgactggcgatgttttccactcatctcgctgtgactgcggtgagcagttagaagaaacgatccaacgtatgggcgaatctggcggcgtgatcctttaccttcgccaagagggccgtggtatcggtttgtacaacaagattgatgcgtatcgtctgcaaagccaggggatgaacacttacgaagcaaacaaccatttaggctttgatgatgatttaagagacttcaccgaagcggcacaaatgttagaagcgttaggtatcaagaaaattcgtcttgtgaccaataaccctaagaaaatccgtgaattagcggaatacggaattgagattgtcgaagttgtcaatacttcggcgcacattaaagatggtaatgaaaactatcttagagcgaaagtttctcacggaaaacataacctaaaggtctaa

SEQ ID NO: 49551 - protein, 198 aa, Vibrio parahaemolyticus
MAEVRARVDFKVGAKSNIDAEILSFRGLKTDKEHVAVIFKQADQTQDTPLVRMHSECLTGDVFHSSRCDCGEQLEETIQRMGESGGVILYLRQEGRGIGLYNKIDAYRLQSQGMNTYEANNHLGFDDDLRDFTEAAQMLEALGIKKIRLVTNNPKKIRELAEYGIEIVEVVNTSAHIKDGNENYLRAKVSHGKHNLKV

SEQ ID NO: 49552 - DNA, 594 bp, Wigglesworthia glossinidia brevipalpis
  CDS (1)..(594): transl_table=11
atgcaaattaaacgtattacagaagctaatcttccaactccatggacaaattttttgatgataggttttgaagaaattaaaacaaaatgtaatcatatagcattattacatggaaatatgtcaaaaaatacatcaattttaacgaggattcattctgaatgtttaactggagatgctttatttagtttaaggtgtgattgcggatttcaattacaatctgcattgtcacatatagctaacgaaaaatgcggaatattaatttatcatagacaagaaggaagaaatattggacttataaataaaataaaagcatattctttacaagacaaaggaatcgacacagtagatgctaattatcatttaggatttgaagcagatgaaagagattttacagtttgtgttgaaatattaaatttattacaaataaaatcaattagactgctaacaaataatccaaataaagtaaacgtattgacttcggcaggcattttaataactgaaagagttcctttaatcgttggaagtaacccaagtaatacaaagtacttatatactaaagcaaaaaaaatgggtcatttattaaataataaataa

SEQ ID NO: 49553 - protein, 197 aa, Wigglesworthia glossinidia brevipalpis
MQIKRITEANLPTPWTNFLMIGFEEIKTKCNHIALLHGNMSKNTSILTRIHSECLTGDALFSLRCDCGFQLQSALSHIANEKCGILIYHRQEGRNIGLINKIKAYSLQDKGIDTVDANYHLGFEADERDFTVCVEILNLLQIKSIRLLTNNPNKVNVLTSAGILITERVPLIVGSNPSNTKYLYTKAKKMGHLLNNK

SEQ ID NO: 49554 - DNA, 1098 bp, Pseudomonas aeruginosa
  CDS (1)..(1098): transl_table=11
atggcactcaacacgatcgacgaactgatcgaagacatccgccaaggcaagatggtcatcctgatggatgacgaggaccgcgagaacgaaggcgacctgatcatggccgccgaatgcgtccgcaccgaagacatcaacttcatggtcaagcatgcccgcggcctggtctgcatgccgatgacccgcgagcgttgcgagcgcctcggcctgccgctgatggtgcagcgcaacggctccggcttcggcaccaagttcactgtctccatcgaggccgccgagggcgtcaccaccggcatctccgccgcggaccgcgcccgcaccgtgcaggctgcggcggcgaagaacgccgtggccgccgacatcgtcagccccggccacatcttcccgctgatggcccagccgggcggtaccctggctcgcgccgggcacaccgaggcggcctgcgacctggcgcggatggccgggttcgagccgtccggggtgatctgcgaggtgatgaacgacgacggcagcatggctcgccggcccgaactggaggcgttcgccgccgagcacgggatcaagatcggcaccatcgccgacctgatccactaccggctgatccacgagcgcaccgtcgagcgcatcgccgagcagccgctcgacagcgaactgggccacttcaacctgatcacctaccgcgactcggtggagggcgacgtgcacctggcgctgaccctcggcaaggtctgcgcggaagagccgaccttggtccgcgtgcataacatggacccgctgcgcgacctgctgcaggtcaaccaaccgggccgctggagcctgcgcgcggcgatgaccaaggtcgccgaggcgggcagcggcgtggtgctgctgctcggtcaccagatcggcggcgacgacctgctcgcccatgtccgcgagatcgcttcggcgccggctccggcgcccaaggccaccaccacctacagcaccgtcggtgccggttcgcagatcctgcgcgacctcggcgtgcgcaagatgcgcctgctgagtgcgccgatgcgcttcaatgcgatatccggtttcgacctggaagttgtagaatacctgcccgccgaataa

SEQ ID NO: 49555 - protein, 365 aa, Pseudomonas aeruginosa
MALNTIDELIEDIRQGKMVILMDDEDRENEGDLIMAAECVRTEDINFMVKHARGLVCMPMTRERCERLGLPLMVQRNGSGFGTKFTVSIEAAEGVTTGISAADRARTVQAAAAKNAVAADIVSPGHIFPLMAQPGGTLARAGHTEAACDLARMAGFEPSGVICEVMNDDGSMARRPELEAFAAEHGIKIGTIADLIHYRLIHERTVERIAEQPLDSELGHFNLITYRDSVEGDVHLALTLGKVCAEEPTLVRVHNMDPLRDLLQVNQPGRWSLRAAMTKVAEAGSGVVLLLGHQIGGDDLLAHVREIASAPAPAPKATTTYSTVGAGSQILRDLGVRKMRLLSAPMRFNAISGFDLEVVEYLPAE

SEQ ID NO: 49556 - DNA, 1110 bp, Pseudomonas syringae pv
  CDS (1)..(1110): transl_table=11
atggcattcgatcgcatcgaagacatcattgaagactatcgccaaggcaagatggtgttgctggtcgatgatgaggaccgtgaaaacgaaggtgatctgctgcttgccgccgattgctgcacagcccaggcgatcagtttcatggcccgcgaagcacgcgggctgatctgcctgacgctgaccgacgagcactgtaaaagcctcgggctggaacagatggtgccgagcaacggcagcgttttcgccaccgcgttcactgtgtccatcgaagcgacgacgggcgtgaccaccggcatcagcgcagcagatcgcgcgcgcaccgtgcaggcggcggtcaatccgggggcagtgcctgacgacttggtgcagccgggccatattttcccgttacgcgctcgcgacggcggcgtgctgacccgcgccgggcacaccgaagcgggttgcgacctggcacgcatggcaggttttacccccgcctcggtgattgtcgaagtcatgaatgacgacggcacaatggcgcgtcgccctgacctggagctgttcgccgaaaaacacggcatccgtatcggcaccatcgccgacctgatccattaccggctgagcaccgagcacaccatcgtcagaatcggcgagcgcgagctgcccacggtgcacggcaccttccgcctgttcagctacgaagaccgcatcgaaggcggcgtgcacatggccatggtgatgggcgatatccgtcgcgaagacccgacgctggtgcgcgtgcacgtggttgacccgctgcgtgatctggtcggcgccgagtacaccggtccggccaactggacgctctgggccgccttgcagcgcgtcgcagaagaaggctgcggcgtggtcgtggtgctggccaatcacgaatcgtcacaagcgttgctggagcgcattccgcagttgacccagccaccgcgccagtacacccgctcgcaatcacgtatctattccgaggtcggcaccggcgcgcagattttgcaggacctggggatcggcaagctgcgccacctcggccctccgctcaaatatgccggcctgaccggctacgatctggaagtgattgaaagtattccatttcccggctga

SEQ ID NO: 49557 - protein, 369 aa, Pseudomonas syringae pv
MAFDRIEDIIEDYRQGKMVLLVDDEDRENEGDLLLAADCCTAQAISFMAREARGLICLTLTDEHCKSLGLEQMVPSNGSVFATAFTVSIEATTGVTTGISAADRARTVQAAVNPGAVPDDLVQPGHIFPLRARDGGVLTRAGHTEAGCDLARMAGFTPASVIVEVMNDDGTMARRPDLELFAEKHGIRIGTIADLIHYRLSTEHTIVRIGERELPTVHGTFRLFSYEDRIEGGVHMAMVMGDIRREDPTLVRVHVVDPLRDLVGAEYTGPANWTLWAALQRVAEEGCGVVVVLANHESSQALLERIPQLTQPPRQYTRSQSRIYSEVGTGAQILQDLGIGKLRHLGPPLKYAGLTGYDLEVIESIPFPG

SEQ ID NO: 49558 - DNA, 22 bp, Artificial sequence
  (1)..(22): primer
atgcagcttaaacgtgtggcag

SEQ ID NO: 49559 - DNA, 23 bp, Artificial sequence
  (1)..(23): primer
ttatttgttcagcaaatggccca

SEQ ID NO: 49560 - protein, 249 aa, Artificial sequence
  Variant (2)..(4): xaa in position 2 to 4 is any amino acid
  Variant (5)..(11): xaa in position 5 to 11 is any or no amino acid
  Variant (13)..(24): xaa in position 13 to 24 is any amino acid
  Variant (25)..(32): xaa in position 25 to 32 is any or no amino acid
  Variant (34)..(34): xaa in position 34 is any amino acid
  Variant (36)..(38): xaa in position 36 to 38 is any amino acid
  Variant (40)..(45): xaa in position 40 to 45 is any amino acid
  Variant (46)..(60): xaa in position 46 to 60 is any or no amino acid
  Variant (62)..(62): xaa in position 62 is any amino acid
  Variant (64)..(64): xaa in position 64 is any amino acid
  Variant (67)..(67): xaa in position 67 is any amino acid
  Variant (69)..(69): xaa in position 69 is any amino acid
  Variant (73)..(75): xaa in position 73 to 75 is any amino acid
  Variant (77)..(77): xaa in position 77 is any amino acid
  Variant (78)..(79): xaa in position 78 to 79 is any or no amino acid
  Variant (83)..(84): xaa in position 83 to 84 is any amino acid
  Variant (87)..(96): xaa in position 87 to 96 is any amino acid
  Variant (98)..(98): xaa in position 98 is any amino acid
  Variant (99)..(117): xaa in position 99 to 117 is any or no amino acid
  Variant (119)..(121): xaa in position 119 to 121 is any amino acid
  Variant (123)..(124): xaa in position 123 to 124 is any amino acid
  Variant (125)..(126): xaa in position 125 to 126 is any or no amino acid
  Variant (134)..(134): xaa in position 134 is any amino acid
  Variant (135)..(135): xaa in position 135 is any or no amino acid
  Variant (137)..(138): xaa in position 137 to 138 is any amino acid
  Variant (141)..(141): xaa in position 141 is any amino acid
  Variant (144)..(144): xaa in position 144 is any amino acid
  Variant (145)..(151): xaa in position 145 to 151 is any or no amino acid
  Variant (153)..(153): xaa in position 153 is any amino acid
  Variant (156)..(156): xaa in position 156 is any amino acid
  Variant (157)..(157): xaa in position 157 is any or no amino acid
  Variant (160)..(160): xaa in position 160 is any amino acid
  Variant (161)..(161): xaa in position 161 is any or no amino acid
  Variant (164)..(165): xaa in position 164 to 165 is any amino acid
  Variant (166)..(166): xaa in position 166 is any or no amino acid
  Variant (168)..(168): xaa in position 168 is any amino acid
  Variant (170)..(177): xaa in position 170 to 177 is any amino acid
  Variant (179)..(180): xaa in position 179 to 180 is any amino acid
  Variant (183)..(187): xaa in position 183 to 187 is any amino acid
  Variant (188)..(193): xaa in position 188 to 193 is any or no amino acid
  Variant (195)..(196): xaa in position 195 to 196 is any amino acid
  Variant (200)..(200): xaa in position 200 is any amino acid
  Variant (201)..(210): xaa in position 201 to 210 is any or no amino acid
  Variant (212)..(212): xaa in position 212 is any amino acid
  Variant (213)..(214): xaa in position 213 to 214 is any or no amino acid
  Variant (216)..(218): xaa in position 216 to 218 is any amino acid
  Variant (220)..(228): xaa in position 220 to 228 is any amino acid
  Variant (229)..(238): xaa in position 229 to 238 is any or no amino acid
  Variant (240)..(240): xaa in position 240 is any amino acid
  Variant (241)..(242): xaa in position 241 to 242 is any or no amino acid
  Variant (244)..(248): xaa in position 244 to 248 is any amino acid
PXXXXXXXXXXGXXXXXXXXXXXXXXXXXXXXHXAXXXGXXXXXXXXXXXXXXXXXXXXXLXRXHSXCXTGDXXXSXXXCDCXXQLXXXXXXXXXXGXXXXXXXXXXXXXXXXXXXXGXXXYXXXXEGRGIGLXXKXXAYXLQXXXXXXXXGXDTXXANXXLGXXXDXRXXXXXXXXLXXLGXXXXXXXXXXXLXXNNPXXXXXXXXXXXKXXXLXXXGXXXXXXXXXXXXXXXXXXXYXXXKXXXXXH

SEQ ID NO: 49561 - protein, 26 aa, Artificial sequence
  Variant (2)..(2): xaa in position 2 is Ile, Leu, Met or Val
  Variant (5)..(5): xaa in position 5 is any amino acid
  Variant (7)..(7): xaa in position 7 is any amino acid
  Variant (11)..(11): xaa in position 11 is any amino acid
  Variant (12)..(12): xaa in position 12 is Phe, Ile, Leu or Met
  Variant (13)..(13): xaa in position 13 is any amino acid
  Variant (15)..(16): xaa in position 15 to 16 is any amino acid
  Variant (20)..(21): xaa in position 20 to 21 is any amino acid
  Variant (22)..(22): xaa in position 22 is Ala, Glu or Gln
  Variant (23)..(25): xaa in position 23 to 25 is any amino acid
  Variant (26)..(26): xaa in position 26 is Ala, Gly, Ser or Thr
RXHSXCXTGDXXXSXXCDCXXXXXXX

SEQ ID NO: 49562 - protein, 23 aa, Artificial sequence
  Variant (2)..(4): xaa in position 2 to 4 is any amino acid
  Variant (6)..(8): xaa in position 6 to 8 is any amino acid
  Variant (9)..(9): xaa in position 9 is any or no amino acid
  Variant (13)..(13): xaa in position 13 is Asp, Gly or Asn
  Variant (14)..(14): xaa in position 14 is any amino acid
  Variant (16)..(16): xaa in position 16 is Ile or Leu
  Variant (17)..(18): xaa in position 17 to 18 is any amino acid
  Variant (20)..(21): xaa in position 20 to 21 is any amino acid
GXXXYXXXXEGRXXGXXXKXXAY

SEQ ID NO: 49563 - protein, 24 aa, Artificial sequence
  Variant (3)..(4): xaa in position 3 to 4 is any amino acid
  Variant (6)..(6): xaa in position 6 is Asp or Asn
  Variant (7)..(8): xaa in position 7 to 8 is any amino acid
  Variant (9)..(9): xaa in position 9 is Phe, Ile or Leu
  Variant (10)..(13): xaa in position 10 to 13 is any amino acid
  Variant (15)..(15): xaa in position 15 is any amino acid
  Variant (17)..(17): xaa in position 17 is any amino acid
  Variant (18)..(18): xaa in position 18 is Phe or Tyr
  Variant (19)..(20): xaa in position 19 to 20 is any amino acid
  Variant (21)..(21): xaa in position 21 is Ala, Cys, Gly, Ser, Thr or Val
  Variant (22)..(23): xaa in position 22 to 23 is any amino acid
  Variant (24)..(24): xaa in position 24 is Ile, Leu, Met or Val
DTXXAXXXXXXXXDXRXXXXXXXX

SEQ ID NO: 49564 - DNA, 900 bp, Escherichia coli
  CDS (1)..(900)
atgaatatcctcctttttggcaaaacagggcaggtaggttgggaactacagcgtgctctggcacctttgggtaatttgattgcttttgatgttcactctactgattattgcggtgattttagtaatcctgaaggtgtagctgaaaccgtaagaagcattcggccggatattattgtcaatgcagccgctcacaccgcagtagacaaagcagaatcagaaccggagtttgcacaattaattaacgcaacaagtgtcgaagcgattgcgaaagcagcaaatgaagttggagcctgggttatccattactcgactgattacgtcttccctggaaatggcgatatgccatggctggagacggatgcaaccgcaccactaaatgtttacggtgaaaccaagttagccggagaaaaagcgttacaggaatattgcgcgaagcatcttattttccggaccagctgggtctatgcaggaaaaggaaataacttcgccaaaacgatgttacgtctggcaaaagagcgtgaagaattagcggttattaacgatcagtttggtgcgccaacaggtgctgaactgctggctgattgtacagcacatgccattcgtgtcgcactgaataaaccggatgtcgcaggcttgtaccatttggtagccagtggtaccacaacctggtacgattatgctgcgctggtttttgaagaggcgcgcaaagcaggcattccccttgcactcaacaagctcaacgcagtaccaacaacagcctatcctacaccagctcgtcgtccacataactctcgccttaatacagaaaaatttcagcagaactttgcgcttgtcttgcctgactggcaggttggcgtgaaacgaatgctcaatgaattatttacgactacagcaatttaa

SEQ ID NO: 49565 - protein, 299 aa, Escherichia coli
MNILLFGKTGQVGWELQRALAPLGNLIAFDVHSTDYCGDFSNPEGVAETVRSIRPDIIVNAAAHTAVDKAESEPEFAQLINATSVEAIAKAANEVGAWVIHYSTDYVFPGNGDMPWLETDATAPLNVYGETKLAGEKALQEYCAKHLIFRTSWVYAGKGNNFAKTMLRLAKEREELAVINDQFGAPTGAELLADCTAHAIRVALNKPDVAGLYHLVASGTTTWYDYAALVFEEARKAGIPLALNKLNAVPTTAYPTPARRPHNSRLNTEKFQQNFALVLPDWQVGVKRMLNELFTTTAI

SEQ ID NO: 49566 - DNA, 1005 bp, Xenopus tropicalis
  CDS (1)..(1005)
atggaaggaaggcacaaggagtacaggatccgtttctcccccggctgggttgaggttgtgcaggatgatgttactattcctggtagaagggctctgataaccggtgcaactggacttcttggtcgagctgtatataaagagtttaaggagaacaattggcatgtgctgggctgtgggtacagtcgtgctcggcccagatttgaatacctcaacctattagatgcagcagcagtgaaagcactcatccaagactttaagcctcatgtgatcattcattgtgcagcagaaaggagacccgatattgtggaaagtcaaccagagtttgcctcactgctaaacgtagtggcatctgagaatttagcaaaagaagctgctggagtcggagcatttcttatttatgttagctcagattatgtttttgatggaacaagcccaccttacagggaagattccataccaaatcccttgaacctttatggcaaaacaaaacttgaaggagagagagcagtattgcacaataatgaaggtgctgcagttcttcgagtgccagtgctatatggagacgtggaaaaacttagtgaaagcgcagtcacaattctgttcgataaggtgcagtttagcaacaagtcagcaaatatggaccattggcagcaaaggtttccaacatatgtcaaagatgttgctagtgtttgccttcaattaacagagcgtagacttcaggatccatctattaagggtatataccactggtctggaaatgaacagatgaccaaatatgaaatgacttgtgccatggcagatgccttcaaccttcccagcagccatctgcgtccaatcacagatgagcctgttggggcaactcctcggccatggaatccccagcttgactgttccaaattggagaaaataggcattggtcagagaacaccattcagagtgggcattagggaaagcctttggccattcttagtggacaagagatggagacaaacagtcttccattag

SEQ ID NO: 49567 - protein, 334 aa, Xenopus tropicalis
MEGRHKEYRIRFSPGWVEVVQDDVTIPGRRALITGATGLLGRAVYKEFKENNWHVLGCGYSRARPRFEYLNLLDAAAVKALIQDFKPHVIIHCAAERRPDIVESQPEFASLLNVVASENLAKEAAGVGAFLIYVSSDYVFDGTSPPYREDSIPNPLNLYGKTKLEGERAVLHNNEGAAVLRVPVLYGDVEKLSESAVTILFDKVQFSNKSANMDHWQQRFPTYVKDVASVCLQLTERRLQDPSIKGIYHWSGNEQMTKYEMTCAMADAFNLPSSHLRPITDEPVGATPRPWNPQLDCSKLEKIGIGQRTPFRVGIRESLWPFLVDKRWRQTVFH

SEQ ID NO: 49568 - DNA, 858 bp, Archaeoglobus fulgidus DSM 4304
  CDS (1)..(858): transl_table=11
atgaaggtagcggtaataggagccaaaggccagcttggaacggaccttgttgacgttcttaaggaggagttcacagtttatccgcttactcatgaggatgttgatgttgcagtgtctgaaagccttgaagtgctgagagacatccaccccgacgttatcataaacaccgctgcctatgtcagagttgatgatgcggagaatcatgcggaaaaggcctttgcggtcaacgccatcggggcgcttaatgtggccagaatctcttcggaaattgatgcggttaacatttacatcagtacagactacgttttcgatggtgagaagggagagccctatgtcgagacagataagccaaatcctataaacgtttacggagcgagcaagtatgccggagaaattctcacgaaaaactactcggaaaaacactacgtgatcagggttgcaagtctatacgggaaggccggggcgagcggaaagggcggtaacttcgtaaactgggtggtggatatggcgagaaaggggcaggagctgaggattgttgcggaccagtttatgagccccacctataccaaggacgtggccctcgctgttagagagtttctcaaactccgccccgactacggaatttaccacatggtaaacgacggatactgctcgtggtttgagtttacgaaggcaatattcgaaattctcgactgggatgtggaaattcagccaataaagtcgagcgagcttaacagattggcgagaaggccagctttctctgccctgcaaaactacaaactcgaaagaattggcattaagatgaggcactggagggaagctttaagagattatttagctgagaagggtttggtttga

SEQ ID NO: 49569 - protein, 285 aa, Archaeoglobus fulgidus DSM 4304
MKVAVIGAKGQLGTDLVDVLKEEFTVYPLTHEDVDVAVSESLEVLRDIHPDVIINTAAYVRVDDAENHAEKAFAVNAIGALNVARISSEIDAVNIYISTDYVFDGEKGEPYVETDKPNPINVYGASKYAGEILTKNYSEKHYVIRVASLYGKAGASGKGGNFVNWVVDMARKGQELRIVADQFMSPTYTKDVALAVREFLKLRPDYGIYHMVNDGYCSWFEFTKAIFEILDWDVEIQPIKSSELNRLARRPAFSALQNYKLERIGIKMRHWREALRDYLAEKGLV

SEQ ID NO: 49570 - DNA, 879 bp, Mesorhizobium loti MAFF303099
  CDS (1)..(879): transl_table=11
gtgaggctcgctgtcaccggacgcgacggccaggttgtgtcgagccttctggaggcaggccagtttgccggtgtagacgtcatcgccattggccgtccgcagctcgacttggcaaaccccgataccgtgatcgaagccattgcagcggccaggcctgacatcgtcgtgtcagctgccgcttacacggccgtggatcaggccgaggatgagcccgatctggcattcagggtgaatgccgtcggcgccggcaaggtggcgcaagccgcggcgcggcttggcgttcccgtcatccacctttcgaccgactacgtcttcgacggcagcgcttccggcgcttacgtcgaaaccgatgcgaccgcgccagccagcgtttacggcgcctccaagctcgccggcgaacagacggtggccgccgccggcccgcgccacctgatcctgcgcaccgcctgggtctacagcccgttcggcaagaatttcgtcaaaaccatgctgcggctggccgccgaccgtgacgagatttccgtggtggccgatcaatggggaaatcccagctcagcgctggatatcgccgatgcgatcctgcatgccgcggccacgctgcaccgcaacaaggacttcggcgcgttcggcacctatcatctggccggcacgggcgagaccaactggagcggctttgcccgccatatcctcgacacgagccgcgtgtctggcggtccttcagcgcgggtccacgacattatgacgacggactacccgaccaaggcgcgacgccctgccaattcccggctttcgagcgcgaagttcgcgtcagcctttggctggaccgcgccggactggcggcaatcgacggaagccgtggtgcgtcgggtcctgttctga

SEQ ID NO: 49571 - protein, 292 aa, Mesorhizobium loti MAFF303099
MRLAVTGRDGQVVSSLLEAGQFAGVDVIAIGRPQLDLANPDTVIEAIAAARPDIVVSAAAYTAVDQAEDEPDLAFRVNAVGAGKVAQAAARLGVPVIHLSTDYVFDGSASGAYVETDATAPASVYGASKLAGEQTVAAAGPRHLILRTAWVYSPFGKNFVKTMLRLAADRDEISVVADQWGNPSSALDIADAILHAAATLHRNKDFGAFGTYHLAGTGETNWSGFARHILDTSRVSGGPSARVHDIMTTDYPTKARRPANSRLSSAKFASAFGWTAPDWRQSTEAVVRRVLF

SEQ ID NO: 49572 - DNA, 843 bp, Thermoplasma volcanium GSS1
  CDS (1)..(843): transl_table=11
ttgccaaacatacttatatttgggcatacagggcagttaggaagagagctcctcaaacttgttcctaacgctatttctggatctatcaatggaaaacgagtagatattacggattattcagagatagctttgctgttctctcaagcaagcccagacatagtaataaattccgctgcttttactaatgtggacagatgcgaaaaagaaagagaaaaggcttatttggtcaatgcaataggcgttaggaacatcgtaaagctctgtgacaagtataattctaaattaattcaaatatctactgattatgtattcaatggagagagaggaaattacaaagaagacgatatacccgacccgatcaattactatggttatacaaaatcaataggagatgcatatgcactatcaagtgacaatacaattgtcgtaagaacatctggagttttcggaaatgccaataattttcctttgtttgtatacaataggcttaaggctggcctcgaagtcgatgttattaagggttattattctccaattcatgccaatcttctttctaaggccttatacgtattaatatccaaaggaacgcataggggcattatcaacattgctggacagaggatatcgcgatttgacctagcgactgccatagcaaacagatttggatttgatcaaaagttaattagggaagttccggatctaaaagaaatggttgcaaggaggccttttgattcatctctcgatatatcttatgcaaaaaagttgatcgactttgatttctacacactcgagagtaatctaaatagttttgaaagatcactaaagaaggatggtgaagaatga

SEQ ID NO: 49573 - protein, 280 aa, Thermoplasma volcanium GSS1
MPNILIFGHTGQLGRELLKLVPNAISGSINGKRVDITDYSEIALLFSQASPDIVINSAAFTNVDRCEKEREKAYLVNAIGVRNIVKLCDKYNSKLIQISTDYVFNGERGNYKEDDIPDPINYYGYTKSIGDAYALSSDNTIVVRTSGVFGNANNFPLFVYNRLKAGLEVDVIKGYYSPIHANLLSKALYVLISKGTHRGIINIAGQRISRFDLATAIANRFGFDQKLIREVPDLKEMVARRPFDSSLDISYAKKLIDFDFYTLESNLNSFERSLKKDGEE

SEQ ID NO: 49574 - DNA, 852 bp, Pyrococcus abyssi GE5
  CDS (1)..(852): transl_table=11
atgagagttgcagtaattggggcaaacggccagttgggaactgatttggttgaagtctttggggaagaagcaattcctttgactcgcaaagatttagacgtaacagatttcgagagcttgaagattttgaaggagcttaagcccgaggtgataatcaatacagcagcttacgttagggttgatgatgctgaactttaccctgaggaggcctttaaggtgaacgccattggagcgttgaacgtcgcgaggattgccaatgaaatcggagcaataaacgtctacatcagcactgattacgtttttgacggggccaaaggtgagccctataccgaagaagatatcccaaacccaatcaacgtctacggggcgagcaagtacataggtgagattttcacgaggaattattctaagaagtactacataatcagggttgcaagcttgtatggaaaagctggggcgaggggaaagggcgggaacttcgtcgagtgggttatcaagaaggccaataagggagaggagcttaggattgttaatgatcagtttatgagcccaacttatactaaggacgtcgcgagaactttgagggagcttttaaggctgaggccaagctttggcgtctaccacatggtgaatgaaggatattgtagttggtatgaattcactagggcaatatttgagattctgggctgggatgttagagtgaagcctataaactcaagtgagctgaagaggctagcaaagaggccgaagttttcagcgttaaagaatgagaagctcgaaaaaattgggctgaagatgaaacactggaaagaagctttgggagagtatttgaaggagaaaggatatctctaa

SEQ ID NO: 49575 - protein, 283 aa, Pyrococcus abyssi GE5
MRVAVIGANGQLGTDLVEVFGEEAIPLTRKDLDVTDFESLKILKELKPEVIINTAAYVRVDDAELYPEEAFKVNAIGALNVARIANEIGAINVYISTDYVFDGAKGEPYTEEDIPNPINVYGASKYIGEIFTRNYSKKYYIIRVASLYGKAGARGKGGNFVEWVIKKANKGEELRIVNDQFMSPTYTKDVARTLRELLRLRPSFGVYHMVNEGYCSWYEFTRAIFEILGWDVRVKPINSSELKRLAKRPKFSALKNEKLEKIGLKMKHWKEALGEYLKEKGYL

SEQ ID NO: 49576 - DNA, 873 bp, Pyrococcus horikoshii OT3
  CDS (1)..(873): transl_table=11
gtggttgcaatgagaattgcaataataggggcaaatgggcaattaggaactgatctcgtggaggtttttggtaatgatccagaattcgaagttgttccattaacgcataaagaccttgacgttacaattccggagagtttgaaagtgctaaaagaaattaagccagatgtccttattaatactgctgcttacgttagggttgatgatgcagagctttatcccgaaaaagcctttgccgtgaatgcaattggtgctttgaatgttgcaaggattgccaatgagattgatgccgttaatgtttatatcagcacggattacgttttcgatggcgaaaagggggagccatataccgaagaagatgtgccgaacccgataaatgtttatggtgtgagtaagtatacgggagaaattttcaccaggaattattctcccaagcattacataattagggtggcgagcctctacgggaaggccggggcgagcggtaagggcgggaactttgtggagtgggtgattgagaaggcaaagcatggagaagagctcaaaattgtggacgaccagttcatgagtccaacctataccaaagacgttgccagaactttgaaagagtttttaaagctgaggtcggagtttggggtttaccatatggttaatgagggcttttgctcgtggtacgagtttaccgaggcaatatttgatgttttaggctggaatgtcgagataaagcccataaagtcaaacgagctcaacaggctggcgaagaggccaaggttctctgcgctgaagaatgaaaagctggaaaaaattgggctaagaatgagacattggagagaagccttggaagagtatttaaaggagaagggttacgtgtag

SEQ ID NO: 49577 - protein, 290 aa, Pyrococcus horikoshii OT3
MVAMRIAIIGANGQLGTDLVEVFGNDPEFEVVPLTHKDLDVTIPESLKVLKEIKPDVLINTAAYVRVDDAELYPEKAFAVNAIGALNVARIANEIDAVNVYISTDYVFDGEKGEPYTEEDVPNPINVYGVSKYTGEIFTRNYSPKHYIIRVASLYGKAGASGKGGNFVEWVIEKAKHGEELKIVDDQFMSPTYTKDVARTLKEFLKLRSEFGVYHMVNEGFCSWYEFTEAIFDVLGWNVEIKPIKSNELNRLAKRPRFSALKNEKLEKIGLRMRHWREALEEYLKEKGYV

SEQ ID NO: 49578 - DNA, 918 bp, Aeropyrum pernix K1
  CDS (1)..(918): transl_table=11
atggtgaataatgccttgaagttactagtgactggtggaactgggcttctcggctacaaccttgtccagcaactactaaagaagggttacagcgtgtaccccacttataacaaaaacaccccctttaagcttgctggagcaagatggtctaaggtcaacctagaggatcctagccaactaacccaactatttagggatattaagccagatgcagttatccacaccgccgcgtatactgatgttgatggttgcgagttgcatagggaaagagcctaccggataaactttttagcttcaatgacagtagctagactagcagccaggcatggtagccttctaatatacgtgtcaacagattatgtgttcgatggagataaaggtatgtacagggaagaggaggctccaaaccccatcaactattacggcttatctaagctactaggagaagtagcaactttgtcagcgatggataaggaaaatgtgcttgtcgttagggttagtggcctttatggatatagccctacggggaaacgaaatttcggcattaatgtgttagagaagttacttaggggggaagaggtaagggcgttctatgaccaatatctatcgccaacatacacatatttcttatcaagaaggctgatagatgtcctcgaaagagagattcgtggagtactccacctagctggcgagcgcctgtcgagacttgagttcgcccaactaatagccaaggttctcggtgctgacgcggaacttatcaagccaatatcaatgaaggaggctaacttgcccgcgaggagacctcgggactcaagcctagacaccactatggctaagaagctaggactcgaattacctagccaagaggagagtgtaaaacattttgtcaatatctatagaaacgctataggggtctaa

SEQ ID NO: 49579 - protein, 305 aa, Aeropyrum pernix K1
MVNNALKLLVTGGTGLLGYNLVQQLLKKGYSVYPTYNKNTPFKLAGARWSKVNLEDPSQLTQLFRDIKPDAVIHTAAYTDVDGCELHRERAYRINFLASMTVARLAARHGSLLIYVSTDYVFDGDKGMYREEEAPNPINYYGLSKLLGEVATLSAMDKENVLVVRVSGLYGYSPTGKRNFGINVLEKLLRGEEVRAFYDQYLSPTYTYFLSRRLIDVLEREIRGVLHLAGERLSRLEFAQLIAKVLGADAELIKPISMKEANLPARRPRDSSLDTTMAKKLGLELPSQEESVKHFVNIYRNAIGV

SEQ ID NO: 49580 - DNA, 720 bp, Clostridium acetobutylicum ATCC 824
  CDS (1)..(720): transl_table=11
gtggtaaaaagtgttataagtaaaattagacctgacgtagttgtaaatgctgctgcctacacaaatgtagatgcctgtgaaacaaacgaaaagaaagcgtttgaggtaaatgcttttggagctaaaaatttggctattgcagcagaagagataggagctaaattagtacatatttcatcagattatgttttcagcggtgaaggaaatacaccttttaaggatgaggacaaagcatcgcctcaaagtgtctatggtaaaagtaaaaaaatgggtgatgattttgtaaaagagttttcttcaaaatatttcatagtaaggccagcttgggtatatgggtataagggtaaaaattttgtgtacacaataatggagctggcgaaagaaaaagaagttgtaactgttgtgaatgatcaaagaggaaatccaacaaatgttgaggatatagtttatcatatattaaaattgatagttacagataagtatggagtttacaattgttcggggcatggagagtgttcatggtacgattttgcatgtgaaataataaaattaagtaatatacctagtgttataaagccatgctcttcaaatgaatataaaagacaagctaaaagaccatcctattcatctttagaaaataaaaatttaagtttagcagttggagatgatatgaggtattggaaagatgcattaaaggtttttatagaaaaagtaatgtaa

SEQ ID NO: 49581 - protein, 239 aa, Clostridium acetobutylicum ATCC 824
MVKSVISKIRPDVVVNAAAYTNVDACETNEKKAFEVNAFGAKNLAIAAEEIGAKLVHISSDYVFSGEGNTPFKDEDKASPQSVYGKSKKMGDDFVKEFSSKYFIVRPAWVYGYKGKNFVYTIMELAKEKEVVTVVNDQRGNPTNVEDIVYHILKLIVTDKYGVYNCSGHGECSWYDFACEIIKLSNIPSVIKPCSSNEYKRQAKRPSYSSLENKNLSLAVGDDMRYWKDALKVFIEKVM

SEQ ID NO: 49582 - DNA, 852 bp, Bacillus halodurans C-125
  CDS (1)..(852): transl_table=11
atgacacaccttctcatcacgggagccaatggccaagtaggcatggagttaagcaaacaggggaagcagcattttcaagtaacggctcttacgaagcaagagttaaatatacttgatcgaaacacggtgatgaacaagattaaaggcgtgaacccggattggattattcatgtagccgcttttaccgctgttgaccaatgtgaggacgaacaacgcaaagcctatcacgtgaacgggctaggcgctgcgaatgtggccagagctgcacgggagacgggagcgaaattaatttatattagcaccgactacgtctttgacgggaacaaaaacagtccctatgaaacgtgtgacctgccaaacccattgaatgtgtatggaaatagtaagtggctaggggaacggctcgtccaaaaatatgtaaaaacgtgtacaatcgcccgaacctcttggttatatggccactacggaggcaatttcgtcaaaaccatgcttcgcctcttacgtaaaggagaaccgatcgaagtcgtagcagaccaagtcggctgtccaacctatgtgaacgatcttgtttattatttatttgcgttaatggaaaaacctagcggaatctatcatattagcaaccgcgggtcatgcaattggtttgagtttgctagagcgattgctaaaaatgcaggttatgatccaagcttaattagggcgacaacaacgaaagcctttgcagcaaaagcccgccgcccgaaatattcggtcatgagccatcaacagctggaattagcaggtttgcaacccccaagggaatgggagctggctctaaaagagtttatacaggaggagacatgtcatgattga

SEQ ID NO: 49583 - protein, 283 aa, Bacillus halodurans C-125
MTHLLITGANGQVGMELSKQGKQHFQVTALTKQELNILDRNTVMNKIKGVNPDWIIHVAAFTAVDQCEDEQRKAYHVNGLGAANVARAARETGAKLIYISTDYVFDGNKNSPYETCDLPNPLNVYGNSKWLGERLVQKYVKTCTIARTSWLYGHYGGNFVKTMLRLLRKGEPIEVVADQVGCPTYVNDLVYYLFALMEKPSGIYHISNRGSCNWFEFARAIAKNAGYDPSLIRATTTKAFAAKARRPKYSVMSHQQLELAGLQPPREWELALKEFIQEETCHD

SEQ ID NO: 49584 - DNA, 909 bp, Pseudomonas aeruginosa PAO1
  CDS (1)..(909): transl_table=11
atgaaccggatccttctcctcggcgccaacggccaggtcggctgggagctgcagcgcgccctggcgccgctgggcgaactgctggtctgtgaccgtcggcgcgccgatctcgccgaccccgaaggcctggcgcgactggttcgcgccgagcggccgcagttcatcgtcaacgccggtgcctacaccgcggtggacaaggccgagagcgatgccgacaacgcccgcctgatcaatgcccgcgccgtcgcggtactggccgaggaggccgcggcctgcggcgcctggctggtgcattactccaccgactacgtgttcgacggcgcgggcagcgtgcctttcgccgaggacgcgccgaccggcccgctgagcgtctacgggcagaccaagctggaaggcgagcaggccatccgcgccagcggctgccgccacctgatcttccgcaccagctgggtctacgccgcgcgcggcggaaacttcgccaagaccatgctgcgcctggccgggcaacgcgacgaactcaaggtcgtggccgaccagttcggcgcgcccaccagcgccgagctgatcgccgacgtcaccgcccaggccctgcagcgcctgtgctgggatgtcgagctggcagcacgggccagcggcacctaccacctggtcgccagcggcgagacgtcctggcacctctatgcgcgcttcgtcatcgaacaggcgctggagcggggctgggagttgcaggcgacgccgcagcgggtcctgccgatcgccaccgaggactacccggtgccggcgaagcgtccggccaattcgcgcctcgacaaccgcaagctgcaacaggtcttcggcctggtactgccagactggcgctaccatgccggacgcatgatccaggaactgagcgagcagggaccactatga

SEQ ID NO: 49585 - protein, 302 aa, Pseudomonas aeruginosa PAO1
MNRILLLGANGQVGWELQRALAPLGELLVCDRRRADLADPEGLARLVRAERPQFIVNAGAYTAVDKAESDADNARLINARAVAVLAEEAAACGAWLVHYSTDYVFDGAGSVPFAEDAPTGPLSVYGQTKLEGEQAIRASGCRHLIFRTSWVYAARGGNFAKTMLRLAGQRDELKVVADQFGAPTSAELIADVTAQALQRLCWDVELAARASGTYHLVASGETSWHLYARFVIEQALERGWELQATPQRVLPIATEDYPVPAKRPANSRLDNRKLQQVFGLVLPDWRYHAGRMIQELSEQGPL

SEQ ID NO: 49586 - DNA, 900 bp, Lactococcus lactis subsp. lactis Il1403
  CDS (1)..(900): transl_table=11
atgattttaataacaggtggaaatggacaacttggaacagagttgcgtcatttacttgatgaacgtggcatggcttatacagcaacagatgctaaagaactcgatattactgacggcgtcgctgttgataaattctttgatgaaaataaacctgaacttgtctatcattgtgcggcttatacagctgttgataaagctgaagacgaaggtcgtgaacttgatgaaaaaatcaatgttgatggaactaaaaatgtagccgaagcggcagcacgtgttggggcaacacttgtttatatttcaactgactatgtttttggcggaactttgccaattggccaagagtggccggttgatgcaccaaaagctcctgaatctgaatatggacggactaaacatcttggtgaagaagcagttgtggcttctggtgtaaaacattacatcatccgtactgcttgggtttttggttcttatggaccaaactttgtcttcacaatgcaaaacttggcgacacgttttccagaattaaccgttgttaatgatcaacacggcagaccaacttggacacgtacacttgcagaatttatggtttatttggttagtgaaaaagctgattttggtttttatcatctaacaaacgatgctgcgcctggtgaagatgtgacttggtttgattttgccaaagaaatcttgaaagacacagatgtgcttgttaaacctgtggattcaagcaaattcccggcaaaagcaaaacgtccatttaattcaacaatgagtcttgaaaaagcaaaagcgacaggttttgtcattccaacatggcaagaagctttagcaagtatgcttgaaaaaggcgatttgcgtgaaaataaagatggcgtaaaaggcgaaattaacaaaaaataa

SEQ ID NO: 49587 - protein, 299 aa, Lactococcus lactis subsp. lactis Il1403
MILITGGNGQLGTELRHLLDERGMAYTATDAKELDITDGVAVDKFFDENKPELVYHCAAYTAVDKAEDEGRELDEKINVDGTKNVAEAAARVGATLVYISTDYVFGGTLPIGQEWPVDAPKAPESEYGRTKHLGEEAVVASGVKHYIIRTAWVFGSYGPNFVFTMQNLATRFPELTVVNDQHGRPTWTRTLAEFMVYLVSEKADFGFYHLTNDAAPGEDVTWFDFAKEILKDTDVLVKPVDSSKFPAKAKRPFNSTMSLEKAKATGFVIPTWQEALASMLEKGDLRENKDGVKGEINKK

SEQ ID NO: 49588 - DNA, 921 bp, Neisseria meningitidis MC58
  CDS (1)..(921): transl_table=11
atgagaatcctattgacaggctcgaaaagccaactggcacgctgcctgcgcgaccgtcttccggaagactgggaaaccattgcgacggattccgcatccctagacattaccgatgccgatgccgtctgcaacatggtcaaaagtttccaacccgacgccattgtcaacacggctgcctatactgccgtcgacaaggcggaaggcgatgcggcagcggcatttgccgtcaatgcttccgccgtttacaaccttgccttggcagcacatcgcgcccatgcccgattcatccacatctcaaccgactatgtctttgacggtaaagggaaaagaccctatcaggaaagcgactttaccaatccttccaatgtatacggacaatccaaaaccgcaggcgagctgctcgcactgtctgccaatcccgacagccttatcctgcggacttcttggctgtttagcgaatacggggacaactttatccgcacgatgctgaaccttgcgcgggaacgttccccgctgtccgccgtccacaaccaaatcggctgcccgacctatgccggcgacttgtccgccaccatcatccgcctgttgcagcactccaatcccgttcgcggcatttaccactacgccggcagcaaatccgtatcctggtacgaatttgcccaacatattttccaagcggcatcgcaacagcagacatccttccccgttcccgaattgactgccgtttcagacaaggaatatccgaccgccgcccccaggcccgcatacagcattttggactgccgcaaaatcgaaaacgacttcggcatcaaaccgtcagactggcaaaaagccttgcacaggtcgtttccaagctgctctgatgccgcccgcccctctgtttccgccgtcaagcaccgccttggcggttttcttatatag

SEQ ID NO: 49589 - protein, 306 aa, Neisseria meningitidis MC58
MRILLTGSKSQLARCLRDRLPEDWETIATDSASLDITDADAVCNMVKSFQPDAIVNTAAYTAVDKAEGDAAAAFAVNASAVYNLALAAHRAHARFIHISTDYVFDGKGKRPYQESDFTNPSNVYGQSKTAGELLALSANPDSLILRTSWLFSEYGDNFIRTMLNLARERSPLSAVHNQIGCPTYAGDLSATIIRLLQHSNPVRGIYHYAGSKSVSWYEFAQHIFQAASQQQTSFPVPELTAVSDKEYPTAAPRPAYSILDCRKIENDFGIKPSDWQKALHRSFPSCSDAARPSVSAVKHRLGGFLI

SEQ ID NO: 49590 - DNA, 843 bp, Methanothermobacter thermautotrophicus str. Delta H
  CDS (1)..(843)
atgaagatccttataaccggttcctcgggcatgctgggaagcgacctcgtggacatcctatcccggaggcatgaggttgtaacatcaggctcccttgacatccgtgaccttgagggtgttatggaactcctcagggagacccggcccgacgccgttgtacatgccgcggcattcacagacgttgactgtgcagaaacagagagggataaagcataccaggtgaacgtgcttggcaccaggaacattgcagctgcggcatcagctgtggggtcatccatcctgtacatatcaacggattacgtctttgatggagaaaaaggtgatggataccttgaatttgatgaaccaaatccccttaacttctatggtaaaacaaagtacctcggcgaggtttcggtgcgtcagctttcagagaggttctacattgtcagaacatcatggttgttcggaaggaacgggagaaacttcgtggggaccatggttgaactcgctgagaggggtcatgaaataagcgttgtggatgaccagtacggatccccgacctacacccgtgaccttgcagcagccatcgggaacctgctggagagaccggcctacggggtctatcacctcacaaattctggtcagtgctcgtggtatgaatttgccattgatatattcaatgaactcggcatggaagtgtgcctgaaacccgtgaaaagccatgaattccccagacccgcccggaggccctcattctctgttctcagaaactataactggtccatggagggtttcaaacccctgaggaactacagggacgccctgagggattacctcaaagatgcgggttttgtaaaatga

SEQ ID NO: 49591 - protein, 280 aa, Methanothermobacter thermautotrophicus str. Delta H
MKILITGSSGMLGSDLVDILSRRHEVVTSGSLDIRDLEGVMELLRETRPDAVVHAAAFTDVDCAETERDKAYQVNVLGTRNIAAAASAVGSSILYISTDYVFDGEKGDGYLEFDEPNPLNFYGKTKYLGEVSVRQLSERFYIVRTSWLFGRNGRNFVGTMVELAERGHEISVVDDQYGSPTYTRDLAAAIGNLLERPAYGVYHLTNSGQCSWYEFAIDIFNELGMEVCLKPVKSHEFPRPARRPSFSVLRNYNWSMEGFKPLRNYRDALRDYLKDAGFVK

SEQ ID NO: 49592 - DNA, 864 bp, Neisseria meningitidis Z2491
  CDS (1)..(864): transl_table=11
atgagaatcctattgacaggctcgaaaagccaactggcacgctgcctgcgcgaccgtcttccggaagactgggaaaccattgcgacggattccgcatccctagacattaccgatgccgatgccgtctgcaacatggtcaaaagtttccaacccgacgccattgtcaacacggctgcctatactgccgtcgacaaagcggaaggcgatgcggcagcggcatttgccgtcaatgcttccgccgtttacaaccttgccttggcagcacatcgcgcccatgcccgattcatccacatctcaaccgactatatctttgacggaaaagggaaaagaccctaccaggaaagcgactttaccaacccttccaatgtatacggacaatccaaaaccgccggcgaactgctcgcactgtctgccaatcccgacagccttatcctgcggacttcttggctgtttagcgaatacggggacaactttgtccgcaccatgctgaaccttgcgcgggaacgttccccgctgtccgccgtccacaaccaaatcggctgcccgacctatgccggcgacttgtccgccgccatcatccgcctgttgcagcagtccaatcccgttcgcggcatttaccactacgtcggcggcaaatccgtatcctggtacgaatttgcccaacatattttccaagcggcatcgcaacagcagacatccttccccgttcccgaattgactgccgtttcagacaaggaatatccgaccgccgcccccaggcccgcatacagcattttggactgccgcaaaatcgaaaacgacttcagcatcaaaccgtcagactggcaaaaagcccttgcacaggtcgtttccaagctgctctga

SEQ ID NO: 49593 - protein, 287 aa, Neisseria meningitidis Z2491
MRILLTGSKSQLARCLRDRLPEDWETIATDSASLDITDADAVCNMVKSFQPDAIVNTAAYTAVDKAEGDAAAAFAVNASAVYNLALAAHRAHARFIHISTDYIFDGKGKRPYQESDFTNPSNVYGQSKTAGELLALSANPDSLILRTSWLFSEYGDNFVRTMLNLARERSPLSAVHNQIGCPTYAGDLSAAIIRLLQQSNPVRGIYHYVGGKSVSWYEFAQHIFQAASQQQTSFPVPELTAVSDKEYPTAAPRPAYSILDCRKIENDFSIKPSDWQKALAQVVSKLL

SEQ ID NO: 49594 - DNA, 909 bp, Xylella fastidiosa 9a5c
  CDS (1)..(909): transl_table=11
gtgacggtgttggtctttggggcgggtggtcagattggtcaggagttgctgcggtcactgagtgggcgtgtggtgtgtgccgtcacgcgcagtggacggttgccgaatgggagggagtgtgtgcaggcggattttgataggcctgagacattgcgcccgttgctcgacgcgcagcggccagcacaggtggtgaacgcggctgcttatacggcggttgaccgtgcggaatctgagcctgatgtggtgttccgtatcaatgcgcaggcaccaggtgtaatcgcgcattggtgtgcgaggcatggggtgccgttggtgcattattccactgactatgtgtttgatgggcagggtacgtctccgtacggtgtggatgatcctgtcgcgccgttaaatatttatggtgcgagtaagctggctggggagcgtgcggtccgggcggcgggcgggtgttctctgatcttgcgtacgtcctgggtttacgcggcgcatggccacaattttttacgcactatgctgcgtttgggtgcgacatccgagcgcttgccggtggtggcggatcagatcggcacgccgactgcagcggggttgattgcggatgtcactgcgcagttgctggcggggggggggcaaagtcggcatgcgggtatttggcatctgacggcgaccggtcaaacgagttggcatggttttgctgaggagattttcgcgcaggcgcaggcatgcggtttgatgatgcgggtcccgcaggtacaggccattgcgagtgttgggtatccgactgcggcgcggcgtccggcgtattcgtgtctggatacgacggcgttggtggaaacgtttgggatcgtgctaccggattggcgtcagggcgtgcggggtgtgttggacgacatcgtcaacaggtcgcgttaa

SEQ ID NO: 49595 - protein, 302 aa, Xylella fastidiosa 9a5c
MTVLVFGAGGQIGQELLRSLSGRVVCAVTRSGRLPNGRECVQADFDRPETLRPLLDAQRPAQVVNAAAYTAVDRAESEPDVVFRINAQAPGVIAHWCARHGVPLVHYSTDYVFDGQGTSPYGVDDPVAPLNIYGASKLAGERAVRAAGGCSLILRTSWVYAAHGHNFLRTMLRLGATSERLPVVADQIGTPTAAGLIADVTAQLLAGGGQSRHAGIWHLTATGQTSWHGFAEEIFAQAQACGLMMRVPQVQAIASVGYPTAARRPAYSCLDTTALVETFGIVLPDWRQGVRGVLDDIVNRSR

SEQ ID NO: 49596 - DNA, 915 bp, Mycobacterium tuberculosis CDC1551
  CDS (1)..(915): transl_table=11
atggcgggcaggtcagaaaggctagtcatcaccggtgcgggcgggcagctgggcagccatctgacggcacaggccgcccgggaaggccgcgatatgctggcgctgacttcctcgcagtgggatatcaccgaccccgctgcggccgagcggatcatccgacacggtgacgtggtgatcaattgcgccgcctacaccgacgtcgacggcgccgagagcaatgaggcagtcgcctatgcggtcaatgccactggcccgcaacacctcgcccgtgcgtgcgctcgtgtgggtgctcggttaatccacgtctccaccgactacgtattcgatggcgacttcggcggcgccgagccccggccctacgagcccaccgatgaaaccgcgccgcagggcgtgtatgcccgcagcaaactcgccggcgagcaggctgtgctggcagcgttcccggaggctgccgtggtacggaccgcctgggtctacaccggcgggaccggcaaggatttcgtcgccgtcatgcgccggctggccgccggacacggtcgggtggatgtggtcgacgaccagaccgggtcgccgacctacgtcgccgacctggccgaggcgctgctggcgttggccgacgcgggcgtgcgcggacgcgtgttgcacgccgctaacgagggcgtggtctcccggttcggtcaagcccgcgcggtgttcgaagaatgcggtgccgacccacagcgggtgcgtccggtcagcagcgcgcagtttccgcggcccgcgccgcgttcgagctattccgcgctgtcgagcaggcagtgggcgctggcgggcttgacgccgctacggcactggcgcagcgcactggccacggcgctggcagcacctgcgaactcaacttcgatcgatcgacggttaccctcaacgcgtgactga

SEQ ID NO: 49597 - protein, 304 aa, Mycobacterium tuberculosis CDC1551
MAGRSERLVITGAGGQLGSHLTAQAAREGRDMLALTSSQWDITDPAAAERIIRHGDVVINCAAYTDVDGAESNEAVAYAVNATGPQHLARACARVGARLIHVSTDYVFDGDFGGAEPRPYEPTDETAPQGVYARSKLAGEQAVLAAFPEAAVVRTAWVYTGGTGKDFVAVMRRLAAGHGRVDVVDDQTGSPTYVADLAEALLALADAGVRGRVLHAANEGVVSRFGQARAVFEECGADPQRVRPVSSAQFPRPAPRSSYSALSSRQWALAGLTPLRHWRSALATALAAPANSTSIDRRLPSTRD

SEQ ID NO: 49598 - DNA, 681 bp, Sulfolobus solfataricus P2
  CDS (1)..(681): transl_table=11
ttggaggatttcataattaagactaggcctgatgttataataaacactgcagctatgactgacgtagacaagtgcgaggtagaaagagaaaaggcttataaaataaatgccgaagcagtaaaacacatggtaagagctagtagggtagtggaagcttactttattcacgtgagtacggactacgtttttgacggcacgaaggggaattacaaagaggatgacttaccaaatccaataaactactatgggctgacaaagttattaggagagacctttgccttatcatacgacgacagcctcgttataaggacttctggggtattcagacacaaggggtttccagtatatgtgtacaaaacgttaaaggaagggaagacagtcttcgcgtataaaggttattactcgcccatttcagcgaggaaactagcatcagcaatagaagagttactggcccttaggaaaactggtttactaaatgttgcaggagagagaatatcgcgttacgagctggctctaaagattaaggaaaagttcaatttgccaggagaagtgaaggaagtagatgaggttaaaggatggacagctaggaggccctttgactcctctttggactactcaaaagctaagaaaatcttatccgtcgatttttacagtttagacctagaaggtatggtgttgtga

SEQ ID NO: 49599 - protein, 226 aa, Sulfolobus solfataricus P2
MEDFIIKTRPDVIINTAAMTDVDKCEVEREKAYKINAEAVKHMVRASRVVEAYFIHVSTDYVFDGTKGNYKEDDLPNPINYYGLTKLLGETFALSYDDSLVIRTSGVFRHKGFPVYVYKTLKEGKTVFAYKGYYSPISARKLASAIEELLALRKTGLLNVAGERISRYELALKIKEKFNLPGEVKEVDEVKGWTARRPFDSSLDYSKAKKILSVDFYSLDLEGMVL

SEQ ID NO: 49600 - DNA, 843 bp, Clostridium acetobutylicum ATCC 824
  CDS (1)..(843): transl_table=11
atgaaaatacttataacaggagcaaatggacaattaggaagagaaattcaaaaacagctaaaaggaaaaaatgtagaggttatacctacagatgtacaagatttagatataactaatgttttagctgtaaataaattttttaatgaaaagaaaccaaatgtggtaattaattgtgcagcacatacagcagttgataaatgtgaggaacagtatgatttagcttataaaataaatgctataggacctaaaaatcttgcagcagcagcatacagtgttggagctgaaattgttcagatttcaacagattatgtttttgatggagaggcgaaggaacctataacagaatttgatgaagtgaatcctcaatcagcttatggaaaaacaaagcttgaaggagaaaactttgtaaaagcattaaatcctaaatattacatagttagaacagcgtggctttatggagatggaaataattttgtaaaaaccatgataaatttaggcaaaactcatgatgaattaaaagttgtgcatgaccaggttggaacacctacaagtacagttgatttagctagagtagttctcaaagtaatagacgaaaaaaattatggaacatttcattgtacatgtaaaggaatatgttcttggtatgattttgctgtagagatattcagacttacaggaattgatgtaaaggtaactccatgtactactgaagaatttccaagaccagctaaaagaccaaaatattcagtacttagaaactatatgttagaacttacaacaggtgatattacaagagagtggaaagagtctctaaaagaatatatagacttacttcaaatgtag

SEQ ID NO: 49601 - protein, 280 aa, Clostridium acetobutylicum ATCC 824
MKILITGANGQLGREIQKQLKGKNVEVIPTDVQDLDITNVLAVNKFFNEKKPNVVINCAAHTAVDKCEEQYDLAYKINAIGPKNLAAAAYSVGAEIVQISTDYVFDGEAKEPITEFDEVNPQSAYGKTKLEGENFVKALNPKYYIVRTAWLYGDGNNFVKTMINLGKTHDELKVVHDQVGTPTSTVDLARVVLKVIDEKNYGTFHCTCKGICSWYDFAVEIFRLTGIDVKVTPCTTEEFPRPAKRPKYSVLRNYMLELTTGDITREWKESLKEYIDLLQM

SEQ ID NO: 49602 - DNA, 822 bp, Sulfolobus tokodaii str. 7
  CDS (1)..(822): transl_table=11
atgcgaacactaataactggtgcatcgggacagttaggcatagaactctcacgcttactctcagaaagacatgaagtaataaaagtctacaattcttcagaaattcaaggaggttacaaactcgaccttaccgatttcccgcgactagaggacttcataataaagaaaagaccagacgtaataattaatgcagcagcaatgactgacgtagacaaatgcgaaatagagaaggagaaggcatataaaataaacgctgaggcagttagacacatagttagagcgggaaaagtaatagattcctacatagtccacatcagtaccgattacgtgtttgacggagaaaaaggtaactataaagaagaagatatacctaatcccataaattattacggtttaagcaagcttttaggggaaacatttgctctacaagatgatagtttaataatcagaacttctggtatttttaggaataaggggtttccaatttacgtttataaaactcttaaggaagggaagactgtattcgcttttaagggctattactctcctatctcagcaagaaaacttgcttctgcaatacttgaacttttagaattaagaaagactgggatcattcacgttgccggtgagaggatttcacgttttgaattagctttaaagattaaggagaagtttaatttaccgggagaagttaaagaagttgatgaagttagggggtggatagctaaaaggccttacgattcctctctcgattcttcaagggctaggaaaatactttcaacagatttttacacattggatctagacggtatggtggtgtga

SEQ ID NO: 49603 - protein, 273 aa, Sulfolobus tokodaii str. 7
MRTLITGASGQLGIELSRLLSERHEVIKVYNSSEIQGGYKLDLTDFPRLEDFIIKKRPDVIINAAAMTDVDKCEIEKEKAYKINAEAVRHIVRAGKVIDSYIVHISTDYVFDGEKGNYKEEDIPNPINYYGLSKLLGETFALQDDSLIIRTSGIFRNKGFPIYVYKTLKEGKTVFAFKGYYSPISARKLASAILELLELRKTGIIHVAGERISRFELALKIKEKFNLPGEVKEVDEVRGWIAKRPYDSSLDSSRARKILSTDFYTLDLDGMVV

SEQ ID NO: 49604 - DNA, 903 bp, Caulobacter crescentus CB15
  CDS (1)..(903): transl_table=11
atgaccgacaagacgcatattctcgtcaccggcggcgccggacaggtggggttggagcttttgggcgccgcatggccggacgggatcgtgctgcatgcgccgtcccgcgccgcgttggacctgacgaacgagacgtcgatccgggccgccttcgaggcgaggcccttcgccgcggtgatcaattcggccgcctggacggccgtggacaaggccgagagcgaggtcgcggccgccttcgccgccaacgccatcggaccagccctgctggctgaggtgacgcgggcgaggggcgttccgctgattcaggtctccaccgactatgtgttcgacggcgacaagccgggaccctatacagaggatgacccggtcggtccgatcgggatctatggcgcctcgaagctggccggcgagatggccgtgcgcctgggcaatccgcgctcggtcgtgctgcggaccgcctgggtgctcagcgcccatcgcgccaactttctgaagaccatgctccgcctcgccgccgaccgcccggtcgtgcgcgtcgtcgaagaccagctgggctgtccgacctcggcgcgcgacatcgccgaggcgctgcaaaccatcacgctggggatgatcgccgacccacaagcgccgaacggcgtctatcatttcgtcaattcgggcgaggccagctgggcggatctggcgcgggaaatctttcgtctcagccacgcccacggaggcgttcatgccgaggtcgagggcattccgagtagtgaatatccaacgccggcccgtcgtccgcgtaactcacgcctgttgaccaaccggatcgcagcggactacgccatccacccccggccctggacagaggccgtggcggacatcatcgcggacttgcgcgtacagggagcccctgcatga

SEQ ID NO: 49605 - protein, 300 aa, Caulobacter crescentus CB15
MTDKTHILVTGGAGQVGLELLGAAWPDGIVLHAPSRAALDLTNETSIRAAFEARPFAAVINSAAWTAVDKAESEVAAAFAANAIGPALLAEVTRARGVPLIQVSTDYVFDGDKPGPYTEDDPVGPIGIYGASKLAGEMAVRLGNPRSVVLRTAWVLSAHRANFLKTMLRLAADRPVVRVVEDQLGCPTSARDIAEALQTITLGMIADPQAPNGVYHFVNSGEASWADLAREIFRLSHAHGGVHAEVEGIPSSEYPTPARRPRNSRLLTNRIAADYAIHPRPWTEAVADIIADLRVQGAPA

SEQ ID NO: 49606 - DNA, 882 bp, Caulobacter crescentus CB15
  CDS (1)..(882): transl_table=11
atgaagatcctgcagtttggccgaaccggccaggtcgccaccgccctgcgggcggcggcgcagggacggtcggagatcatcgccctgtctcgcgccgactgcgatcttgccgatcccgagcgcttgcgcgcgacgatcctggccgccgactgcgatcttgtcgtcaacgccgccgcatttactcaggtggacccggccgaggccgcgccggaggcggccttcgccgtcaatgcgcgcgcgcccgccgccatggccgcagcctgcgccgaacgggggctgccgttcgcgcacctgtcgaccgacgcggtgttcgacggccgaaccgaccgcgcctatgttgagaccgatcgcgccgagccgatcaatgtttatggccgctccaagctggccggcgagcaggcggttctggctcaccccagaaccgtcgtgctgcggatctcgtgggtcttctcgcgatatgggcgcaactatgtgagcttcatgctcaagctcgcccgcgagcgcgagacgctgaaggtggtggccgaccagttcggcacgccgaccgatggcgaggccttggctgactttctggtcgcgaccgcgccgcgctgggcggctgcgcccgccgatgatccggccttcggcctgttccatttcgccaatgcgggcgagaccagccggttcgacttcgccaaggccgccattgaccgcgacccgatgacgaaggcccggctggagccgacgacccaggccgccttcgccgagcccgcgccgcgcccgccgcgctcgccgctcgataccgccaagctgcgcgcggtgttcggtttctcacccgaggcgtggcgaccggcggtggagcgcaccgctgaccggttggtctccacgggcctcgccggctaa

SEQ ID NO: 49607 - protein, 293 aa, Caulobacter crescentus CB15
MKILQFGRTGQVATALRAAAQGRSEIIALSRADCDLADPERLRATILAADCDLVVNAAAFTQVDPAEAAPEAAFAVNARAPAAMAAACAERGLPFAHLSTDAVFDGRTDRAYVETDRAEPINVYGRSKLAGEQAVLAHPRTVVLRISWVFSRYGRNYVSFMLKLARERETLKVVADQFGTPTDGEALADFLVATAPRWAAAPADDPAFGLFHFANAGETSRFDFAKAAIDRDPMTKARLEPTTQAAFAEPAPRPPRSPLDTAKLRAVFGFSPEAWRPAVERTADRLVSTGLAG

SEQ ID NO: 49608 - DNA, 903 bp, Sinorhizobium meliloti 1021
  CDS (1)..(903): transl_table=11
gtgagaattgccgtgaccggctgcgagggccaattggccctcggcctcgtggaacggtctcataggcggtcgggaatggaggtcgttacgatcgggcggccgcacctcgatctcacagagccggcaacgatcctgccggcgatcgagcgatgccggccggacctcgtcgtctcggcggcagcttacacggccgtcgaccaggccgaaagcgagccggaggcggctttcgcggtcaacgcgttcggggctggcgcggtcgctgaggcggccgcctgcctcgaagtgcccatcgtccatatttcgacggattatgtcttcgacgggagcaaaccgcggagctatgcagagggcgacacaccggctccgcttagcgtctacggcgcttccaagcttgccggagaaagcgcggttgccgaggcaactccccgccatctcatcctgcgcacgggctgggtctacagccccttcgggaagaatttcgtcaagaccatcctgcggctcgcagaggagcgcgaagatatcgccgtcgttgcggatcaacggggaaatccgtcatcggcgatcgaccttgcggacgcgatcctcgatatttccgcgcggctcacgaaatcccgtcaggacgccgcttttggcctctaccacctcgctggctcgggcgtcgtaagccgggccgatttcgcgcggcatgctcttgcggcgagccgtgccgcaggcggtccctgggcgcatgttcgggacatcgcgacgggtgggtttccgacacctgcaagccgccctgcaaactcgtcgctgtcgagcgccaaattcaacgcgaccttcggccaggccatgcctgcctggcagggttccgtggagcgaaccgtgaggcggcttgtcgagagcatttcgagtgaaaccagttag

SEQ ID NO: 49609 - protein, 300 aa, Sinorhizobium meliloti 1021
MRIAVTGCEGQLALGLVERSHRRSGMEVVTIGRPHLDLTEPATILPAIERCRPDLVVSAAAYTAVDQAESEPEAAFAVNAFGAGAVAEAAACLEVPIVHISTDYVFDGSKPRSYAEGDTPAPLSVYGASKLAGESAVAEATPRHLILRTGWVYSPFGKNFVKTILRLAEEREDIAVVADQRGNPSSAIDLADAILDISARLTKSRQDAAFGLYHLAGSGVVSRADFARHALAASRAAGGPWAHVRDIATGGFPTPASRPANSSLSSAKFNATFGQAMPAWQGSVERTVRRLVESISSETS

SEQ ID NO: 49610 - DNA, 843 bp, Synechocystis sp. PCC 6803
  CDS (1)..(843): transl_table=11
gtgggacgagaattagccattcctttgtcctgttttggttcagtgcaagaagcaactagggctagctttgatttggcccagccggatgtcttaggggagaaaattcgtgcttttgccccggacattattgtcaactccgcggcctatactgctgtggacagggccgaaacagaaccggaattagcctacgcagttaacgcccttgctccccaggcgatcgccaaagtggccaaggaaatcggtgcctatgtggtgcatatttccactgactatgtgtttgatggtagccagagttctccctaccgagaaacggatgccaccaatcccctcggggtttatggccaaagcaaattccagggggaaatagccattgccgacagtggttgtaattttcttattgtccgcactgcctgggtttatggagtccatggatcgggcaattttgtcaaaaccatggtgcgtttaggcaaagaacggcaaaaagtcagggtggtggcggatcaaattggtgggcccacctgggcaaaggatctggccgaggcgatcgccgctttgacggaacaacgggcccagggcatttaccactacagcaacagtggggtggccagttggtacgattttgccgtggctatttttgaggaagttgaaaatctaggtattccccttaaggtgcgtcaggtggtgcccattgccacagctgcctatcccaccccggcccgacggccagcctattctgttttatcccatcaaaaaatagtagaaactttgggttctgcccctccccattggcgggcttcgttacgggccatgctccaccaagctatcagtgaggggattgtctga

SEQ ID NO: 49611 - protein, 280 aa, Synechocystis sp. PCC 6803
MGRELAIPLSCFGSVQEATRASFDLAQPDVLGEKIRAFAPDIIVNSAAYTAVDRAETEPELAYAVNALAPQAIAKVAKEIGAYVVHISTDYVFDGSQSSPYRETDATNPLGVYGQSKFQGEIAIADSGCNFLIVRTAWVYGVHGSGNFVKTMVRLGKERQKVRVVADQIGGPTWAKDLAEAIAALTEQRAQGIYHYSNSGVASWYDFAVAIFEEVENLGIPLKVRQVVPIATAAYPTPARRPAYSVLSHQKIVETLGSAPPHWRASLRAMLHQAISEGIV

SEQ ID NO: 49612 - DNA, 831 bp, Listeria monocytogenes EGD-e
  CDS (1)..(831): transl_table=11
atgagtattttagtaacaggagcaaatgggcagctcggaacggagctagttcaattattaaaagaacataatttaaccgtgactgagtgggacaaagattctgtagatattgtggataaagcagctgtaaaaaaagcaatgcttgatttaaagcctgaatggattatccattgtgccgcttttactaatgtagaagcagcagaagatgaattaaaaaacgttaactgggaagtaaacgtggatgggactgaaaatatcagtgaagctgcagaaatagttggagctaaacttgtatatatcagtacagattatgttttcgatggtactaaaaaagaagcatatttaccagatgataaaacaaatccacttaatcaatatggaattgctaaattagcaggagaaaaagttgctttagaaaaaaatagccaaacttatgttattcgtacttcatgggtgtttggtaaatatggtaataattttgtatacagtatgcttaaactagctgaaacgcataaagaactaaaagtagtaaatgatcaattaggtcgcccaacatacacatatgatttagctgacttcattcgttttgttattgagaagaatccggcatatggtatttaccaattctctaatagtggaactgcgacatggtttgagtttgcaacagaaattttgaaagataaagatgttactgtgaatccatgtacttcagatgaatttccacaaaaagctgaacgtccaaaaacatctattatgagtttggaaaaagtagagaaactaggttttaacattccaacttggcaagatgctttagttcgttttaaaaaataa

SEQ ID NO: 49613 - protein, 276 aa, Listeria monocytogenes EGD-e
MSILVTGANGQLGTELVQLLKEHNLTVTEWDKDSVDIVDKAAVKKAMLDLKPEWIIHCAAFTNVEAAEDELKNVNWEVNVDGTENISEAAEIVGAKLVYISTDYVFDGTKKEAYLPDDKTNPLNQYGIAKLAGEKVALEKNSQTYVIRTSWVFGKYGNNFVYSMLKLAETHKELKVVNDQLGRPTYTYDLADFIRFVIEKNPAYGIYQFSNSGTATWFEFATEILKDKDVTVNPCTSDEFPQKAERPKTSIMSLEKVEKLGFNIPTWQDALVRFKK

SEQ ID NO: 49614 - DNA, 885 bp, Nostoc sp. PCC 7120
  CDS (1)..(885): transl_table=11
atgaatgaaccaatcctactactaggtagcaacggtcaagtaggtcaagaaatccaaaatctccttgcacctagatacaaaattatctcagtcgcacgaccaaggatagacctgactcaagccgatagtctgcgtcaaatcatcagagaagtccaaccacagataattattaacgccgccgcttacactgctgtagacaaagccgaaactgaacccgaaatagctacagctatcaatgctacagcaccccaaattatcgccgaagaaagccaaaaactcggctcgttcttaattcacatatccacagattacgtttttgatggtcagcaaagtcacccttaccaagaaactgaccccactaaccccttaagtgtttatggtaagaccaaactagccggagaaatagccattcaacaaactcaccctcatcacattattctgcgtacagcttgggtttatggcagttttggtaaaagtaactttgtcaaaaccatgctgcgactgggtgcagaacgccaagaaattcgggtagtaaaagatcaaattggctcccctacttgggcgcaagatatcgctgacaccatagcccaagtgataccccaaataccagaaatttctgggacttaccactacacaaatactggtgtaattagctggtacgaatttgctgttgctatttttgcagaatctcaaaaactaggttttcctctcacagtccaacaaattattcctattaccaccgccgaatatccgactttagctccccgtcctgcctattctgtcctggcttgtgagaagatgtcacaagttctgggaactgctccccctcattggcaacaaagactgcggttgatgctgcaagactggctctccaaatattcttga

SEQ ID NO: 49615 - protein, 294 aa, Nostoc sp. PCC 7120
MNEPILLLGSNGQVGQEIQNLLAPRYKIISVARPRIDLTQADSLRQIIREVQPQIIINAAAYTAVDKAETEPEIATAINATAPQIIAEESQKLGSFLIHISTDYVFDGQQSHPYQETDPTNPLSVYGKTKLAGEIAIQQTHPHHIILRTAWVYGSFGKSNFVKTMLRLGAERQEIRVVKDQIGSPTWAQDIADTIAQVIPQIPEISGTYHYTNTGVISWYEFAVAIFAESQKLGFPLTVQQIIPITTAEYPTLAPRPAYSVLACEKMSQVLGTAPPHWQQRLRLMLQDWLSKYS

SEQ ID NO: 49616 - DNA, 918 bp, Ralstonia solanacearum GMI1000
  CDS (1)..(918): transl_table=11
atgcagcataaggcgcaccctgttccgaagctgctggtcacgggaagcaacggccaggtcggctttgagctgcgccgcagcctggcgcccctgggcgaggtgatcgcgctggaccgggccgcctgcgacctgacccggcccgatgcgctgcgccggctggtgcgcgagcaccgccccgacgtgatcgtcaacccggcggcctacactgctgtcgacaaggccgagaccgatgccgaaacggcattcgccgtcaacggcatggcggccggtgtcctggccgaggaagcccgcgcgctgggcagcctgctggtgcactacagcaccgattacgttttcgacggcagcaaggccgccgcctacgtcgagaccgatgcggtcaacccgcagtccgtctacggcaagagcaagctcgcgggcgagcaggcgatcgccgcctcgggcgcggcggcgctggtgctgcgtacctgctgggtggccggcgcgcacggcggcaatttcgccaagacgatgctcaagctgggccgcgagcgggacagcctgcgcgtgatcgccgaccagttcggcgcgcccaccacggccgcgctgatcgccgacgtgaccgcgcagatcgtcgcgcgcttctggctgtcgggcgatcgcgccgcatttccgggcggcctgtatcacctggccgcggcgggcgagacgacctggcacggctatgccacggccgtgctgcgctatgccaaggtgcgcggactggagctgaaggtcgaccccgagcgcatcgaagccattccggcgacggcgtatccgctgcccgcgccgcggcccgccaactcccgcatggacaccggcaagctcactgaaacgttcggcatccacctgccggactggcagcagggtgtccatctcctgctggaccagatcttttcctga

SEQ ID NO: 49617 - protein, 305 aa, Ralstonia solanacearum GMI1000
MQHKAHPVPKLLVTGSNGQVGFELRRSLAPLGEVIALDRAACDLTRPDALRRLVREHRPDVIVNPAAYTAVDKAETDAETAFAVNGMAAGVLAEEARALGSLLVHYSTDYVFDGSKAAAYVETDAVNPQSVYGKSKLAGEQAIAASGAAALVLRTCWVAGAHGGNFAKTMLKLGRERDSLRVIADQFGAPTTAALIADVTAQIVARFWLSGDRAAFPGGLYHLAAAGETTWHGYATAVLRYAKVRGLELKVDPERIEAIPATAYPLPAPRPANSRMDTGKLTETFGIHLPDWQQGVHLLLDQIFS

SEQ ID NO: 49618 - DNA, 894 bp, Agrobacterium tumefaciens str. C58
  CDS (1)..(894): transl_table=11
atgcggctggcagttaccggcagaaacggacaggtcgtgagcgcccttcaagctttggcgggcgcagatcttgaaatcgtgaccttaggaagacccgaactcgatctcgtgcggccggagaatgtcctgcaggcgcttcgtgaggccaagccagatgtcgtggtatcggctgccgcctacaccgccgtcgacaaggcagaaagcgagccggacatcgcttttgccgtcaatcgggatggagcaaaggcggtcgcgcaggcggcaaaagaacttggcgttcccgtcattcatctttccacggactatgttttcgacggcagcaaggccacggcttatgtggaaagtgatccgacaggtcctacttctatttacggacgctcaaagctcaagggcgaaagagccgtttcggaggcaaccgacaattatgtggtattgcggacggcatgggtctactcggaatatggcaataacttcgtgaaaaccatgctcaaactgagcgagagtcgcgacgagattaatgtggtcgcggaccagttcggatgccctacctcagccaccgatattgctgctgcggtggtagcaattgcaagaaagctcgtggaagattcctccgcttctcttcgtgggatttttcatctgtctggaacaggcgaaacgacctgggcgaattttgcgaaacagatattcgcattttcagcggaaaacggcggaaagtcgatgatcgtcaacgacatcacgactaagcaatacccaactccggccccacgcccggcaaactcgcggcttaactgtaggaagctagaagagatttacggactaaagcttcccagttggcaaacatcaactcgcgaggtggtcaccgctcttgcgcagaccaaaaaggaaaagtcatga

SEQ ID NO: 49619 - protein, 297 aa, Agrobacterium tumefaciens str. C58
MRLAVTGRNGQVVSALQALAGADLEIVTLGRPELDLVRPENVLQALREAKPDVVVSAAAYTAVDKAESEPDIAFAVNRDGAKAVAQAAKELGVPVIHLSTDYVFDGSKATAYVESDPTGPTSIYGRSKLKGERAVSEATDNYVVLRTAWVYSEYGNNFVKTMLKLSESRDEINVVADQFGCPTSATDIAAAVVAIARKLVEDSSASLRGIFHLSGTGETTWANFAKQIFAFSAENGGKSMIVNDITTKQYPTPAPRPANSRLNCRKLEEIYGLKLPSWQTSTREVVTALAQTKKEKS

SEQ ID NO: 49620 - DNA, 885 bp, Clostridium perfringens str. 13
  CDS (1)..(885): transl_table=11
atgaaaatattaataacaggttcaaatggacaattaggaaatgaacttcaatcaataataaaaagtggaaaagcagaaataggttcagttagtgaaaatataaaaaactcagaagttattgctttagatgttgataaattagatataactagcttagaaaatgttaaaaatgtacttaatgaagaaaaaccagatgtagtaataaactgtgcagcggcaacaaatgttgacggatgtgaaagtaatgaagattttgcatttaaagttaattctttaggagcaagaaatttagctatggtttgtgaagaaattggagctaaattagttcaagtttcaacagattatgtatttagtggttttggtgaaaaaccattaactgagtttgatttaactgcaccttatagtgtttatggaaaaacaaaacttttaggtgaaaattatgttaaagagttttgttcaaaatattatatagttagaaccgcttggttatatggatatgtgggacataactttgtttacacaatgatgagacttggaaaagaaaaagaatcattaaatgtagttaatgatcaaaaaggaaatccaactcacgcaaatgatttagcatatcatatattaaagcttatagaaacagaagaatacggaatataccattgtacaggaaaaggggaatgtacttggtatgattttgctaaagaaataatggagttagctggcaataagtgcattgttaacccatgtacttcagaagaatataaaacaccagctaaaagaccagaatattcatcattagataatatgatgcttagatgtacaattggtgatgaaatgagagattggaaggaagctttaaaaagcttttttgaaaatcaacaaaatcaataa

SEQ ID NO: 49621 - protein, 294 aa, Clostridium perfringens str. 13
MKILITGSNGQLGNELQSIIKSGKAEIGSVSENIKNSEVIALDVDKLDITSLENVKNVLNEEKPDVVINCAAATNVDGCESNEDFAFKVNSLGARNLAMVCEEIGAKLVQVSTDYVFSGFGEKPLTEFDLTAPYSVYGKTKLLGENYVKEFCSKYYIVRTAWLYGYVGHNFVYTMMRLGKEKESLNVVNDQKGNPTHANDLAYHILKLIETEEYGIYHCTGKGECTWYDFAKEIMELAGNKCIVNPCTSEEYKTPAKRPEYSSLDNMMLRCTIGDEMRDWKEALKSFFENQQNQ

SEQ ID NO: 49622 - DNA, 1362 bp, Corynebacterium glutamicum ATCC 13032
  CDS (1)..(1362): transl_table=11
atggaatacggtaaacaactcacctcccacaccaccgacatcgaaggcctactggttttcgatttccccgtccacggcgacaaccgcggctggttcaaggaaaattggcagcgcaccaagatgaccaacctggggctgcccgattttggccccgtccaaaacaacatgagtttcaacgccaccgccggcacgactcgcggcatgcacgctgagccgtgggataaatttgtgtccgtcgcggtgggttccgttttcggagcttgggtggatctgcgcgcgggctcgagcacgtacggtaacgtcgtaacgcaaaaaattacccctgacgtgggagtttacgtcccgcgtggtgtggcaaacggcttccaggcgctcgaggacggcacgctgtacacctacctcgtcaacgatcattggtcccccgacgcgcattacgccaacgtcaacctcaacatgatcgactggccgctgcccatcaccgagatctccgaaaaagataaaaaacatccagcgcttatcgacgccacccccctgcccgcccgcaaggttctcgtggtcggcgccggcggacaactgggaaccgcgctacgcgcgcagttcccagacgcggaatttgtcacgcgccaagaactcgatatcacctcagatctcaccgaggctcgcgcgtggaaacaatactccaccatcataaacgccgccgcctacactgccgttgaccaggcagaacacgaccgcgcagcagcgtgggacatcaacgcagcggcagtggctaacctcgcgaccatcgcgcgcgacaacaacctcaccctcgtgcacgtgtcctcagattatgtcttcgacggtgcggccgaatcctacgatgaaaacgcaccgttttccccactcggcgtgtacggccaatccaaagcagccggcgacatcgcagccaccaccgcaccgcgccactacattgtgcgcaccagctgggtgattggcgatggcaataattttgtccgcaccatgaaatccctcgacgaacgcggcatcgcaccatcagtagttgatgatcaaatcggccgcctatccttcaccgaagacatcgcagccggcatcgcgcaccttttggaagtgggtgcagcatatggcacctacaacctcaccaacaccggcgaacccgcaagctgggccgatgttgcccgcgcagtattttccgaccccaccaaagttaccggcgtgagcaccgccgagtacttcgccaacaaagacgcagcgccccgcccactgaactccgttttggatctcggcaaaatcgaagccaccggatttagcgcaccgacctggcagacccgcctcaacgactacctcaaggaactctcaaagtga

SEQ ID NO: 49623 - protein, 453 aa, Corynebacterium glutamicum ATCC 13032
MEYGKQLTSHTTDIEGLLVFDFPVHGDNRGWFKENWQRTKMTNLGLPDFGPVQNNMSFNATAGTTRGMHAEPWDKFVSVAVGSVFGAWVDLRAGSSTYGNVVTQKITPDVGVYVPRGVANGFQALEDGTLYTYLVNDHWSPDAHYANVNLNMIDWPLPITEISEKDKKHPALIDATPLPARKVLVVGAGGQLGTALRAQFPDAEFVTRQELDITSDLTEARAWKQYSTIINAAAYTAVDQAEHDRAAAWDINAAAVANLATIARDNNLTLVHVSSDYVFDGAAESYDENAPFSPLGVYGQSKAAGDIAATTAPRHYIVRTSWVIGDGNNFVRTMKSLDERGIAPSVVDDQIGRLSFTEDIAAGIAHLLEVGAAYGTYNLTNTGEPASWADVARAVFSDPTKVTGVSTAEYFANKDAAPRPLNSVLDLGKIEATGFSAPTWQTRLNDYLKELSK

SEQ ID NO: 49624 - DNA, 855 bp, Streptococcus pyogenes MGAS8232
  CDS (1)..(855): transl_table=11
atgattttaattacaggaagcaatggtcaattagggacagaacttcgatacttattagatgaacgaagtgttgattatgtagccgttgatgtcgcagaaatggacatcacaaatgaagacaaagtcgaagctgtttttgcgcaggtcaagccaacattggtctatcattgtgctgcttatacggcagttgatgcagcagaagacgaaggaaaagccttgaatgaggctattaatgtaacaggctcagaaaatattgccaaggcttgtggaaaatatggggctacccttgtttatatttcaacagactacgtatttgatggcaataaaccagtcggtcaagaatgggtagaaacagatcgtccagaccctaagacagaatatggccgtacaaaacgtttaggagaactagctgttgaaggatacgcagagcatttttatattatccgtactgcttgggtatttggaaattatggtaaaaactttgtctttaccatggagcagttagcagaaaatcactcccgtttgactgttgtcaatgaccaacacggtcggccaacgtggacaagaaccttggcagaattcatgtgttatttgacagagaatcaaaaagcctttggttactatcacttgtcaaatgatgctaaggaagacaccacttggtatgattttgccaaagaaatcttaaaagacaaggctgttgaagtggtgccagttgattcatcagctttcccagcaaaagccaaacgtcctttaaattcaaccatgaatcttgataaggcaaaagcaacagggtttgttattccaacatggcaagaagccttgaaggcattttaccaacaaggactgaaaaagtaa

SEQ ID NO: 49625 - protein, 284 aa, Streptococcus pyogenes MGAS8232
MILITGSNGQLGTELRYLLDERSVDYVAVDVAEMDITNEDKVEAVFAQVKPTLVYHCAAYTAVDAAEDEGKALNEAINVTGSENIAKACGKYGATLVYISTDYVFDGNKPVGQEWVETDRPDPKTEYGRTKRLGELAVEGYAEHFYIIRTAWVFGNYGKNFVFTMEQLAENHSRLTVVNDQHGRPTWTRTLAEFMCYLTENQKAFGYYHLSNDAKEDTTWYDFAKEILKDKAVEVVPVDSSAFPAKAKRPLNSTMNLDKAKATGFVIPTWQEALKAFYQQGLKK

SEQ ID NO: 49626 - DNA, 810 bp, Methanosarcina mazei Go1
  CDS (1)..(810): transl_table=11
atggtggtgggaaccattaaaacgctgatcatcggctccagcgggatgctcgggtcagacctgtgcaaagtctttcccgatgctgttaaactgacacaccatgacctcgacatcacagacagagagcaggttattgaatccattttaaaaataaaacctgatgttgtaataaacgcagcagcctacaccaatgtggacggctgtgaagacaacaaggaacttgcgttccaggtcaacggatccggacccggatacattgcagaagcctgcgccagagcaggtgcaaaactcgttcatttcagtactgattatgtttttgacggctccaaaaaagagtatgtggagtctgacatcccggatccgattaatgtatacggtgattcaaaacttctcggtgaaaagaagatcatcgagaatatggatgattacaggattgtaagaatttcctggctttttggaatacatgggaaaaatttcgttgaaaccatgctgaaactatcaggagaaatggataccgtaaaggttgtcaatgaccagttcggcaaacccacctacacaatggaccttgccagaaaagtaaaggaaataattgaactcgaacccggaatttatcatattacaaatgatggaatctgttcctggtacgaatttgcctcttctattatcgataatgttattccgtgcaccagtgaagaatttcaaaggaaagcaaaacgtccaatgtattcagttcttgtgaatactaaaaccggacccatgagacactggagagaagcacttaaggactatttgcaggggagaaatatatga

SEQ ID NO: 49627 - protein, 269 aa, Methanosarcina mazei Go1
MVVGTIKTLIIGSSGMLGSDLCKVFPDAVKLTHHDLDITDREQVIESILKIKPDVVINAAAYTNVDGCEDNKELAFQVNGSGPGYIAEACARAGAKLVHFSTDYVFDGSKKEYVESDIPDPINVYGDSKLLGEKKIIENMDDYRIVRISWLFGIHGKNFVETMLKLSGEMDTVKVVNDQFGKPTYTMDLARKVKEIIELEPGIYHITNDGICSWYEFASSIIDNVIPCTSEEFQRKAKRPMYSVLVNTKTGPMRHWREALKDYLQGRNI

SEQ ID NO: 49628 - DNA, 909 bp, Xanthomonas campestris pv. campestris str. ATCC 33913
  CDS (1)..(909): transl_table=11
gtgaccacgctggtgttcggtgcgaacgggcaggtaggggcggaactgctacgcgcattggctgccgatggcgcggtgcaggcgacgacacgcagtggccgattgcctgatggtagcgcgtgcgagaccgcagacttcgacgcaccggaaactttgccagccttgctggaccagattggcccgtcgcttgtcgtcaatgctgcggcctacacggcagtggatcgcgccgagcaggatcgcgtcagcgcgatgcgggcgaatgcgcaggcacctttgaccattgcggcatggtgtgccgcccgtgacgtgccgctggtgcattactcgaccgattacgtcttcgacggccagggcaccgccccctatcttgaggatgcccaaacctcgccgctaggcgtgtatggcgaaaccaagctcgctggtgagaacgccatccgtgcttccggcgcgcagcatctgatcctgcgtacggcatgggtgtacgcatcgcacggcgggaatttcctgcgcaccatgttgcgtgtcggcgccgagcgcgacgagctacgcgtggtggccgatcagatcggaacgccgacgccggcggcgttgatcgccgatatcactgcacagttgcttcggcaacgcaccgccgaaacatcgggtacctggcatctcactgctgcagggcagaccagctggcatggctttgccgaggcgatcttcgaagaggctgtgagcgcaggactgctgccgcgtgcgccgcgcgtggtaccgatcaccaccgcagactatccgacccctgcgaagcggccggcgtattcgcggttgtcgatcgagaaactgcagcgcgatttcgacatcgtgctgccggaatggcgacctggcttgcagcgcgtgattgccgaagtcgccgctgccagacagtaa

SEQ ID NO: 49629 - protein, 302 aa, Xanthomonas campestris pv. campestris str. ATCC 33913
MTTLVFGANGQVGAELLRALAADGAVQATTRSGRLPDGSACETADFDAPETLPALLDQIGPSLVVNAAAYTAVDRAEQDRVSAMRANAQAPLTIAAWCAARDVPLVHYSTDYVFDGQGTAPYLEDAQTSPLGVYGETKLAGENAIRASGAQHLILRTAWVYASHGGNFLRTMLRVGAERDELRVVADQIGTPTPAALIADITAQLLRQRTAETSGTWHLTAAGQTSWHGFAEAIFEEAVSAGLLPRAPRVVPITTADYPTPAKRPAYSRLSIEKLQRDFDIVLPEWRPGLQRVIAEVAAARQ

SEQ ID NO: 49630 - DNA, 900 bp, Xanthomonas axonopodis pv. citri str. 306
  CDS (1)..(900): transl_table=11
atgaccacgctggtactgggagccaatggacaggtcggcacggaattgctgcgggcattggcagccaatggcccgatcctgggtagcacccgcagtggtcggttgccggatggtgcagcgtgtgaggtagccgactttgacgcaccgcatcgcctgagcgaattgctggatcgcttgcagccaagttgcgtcgtcaacgcagccgcctacacggccgtcgatcgtgccgagcaggagcgtgatgcggccttccgcgccaatgccgaagcgcctggcgtgatagcgcaatggtgcgcgcgcgccgatgtgcccctggtccattactcgaccgactatgtcttcgatgggcagggcacgcgcccctatcggccggacgatgccaccgcgccgctcggcgtgtacgggcaaagcaaactggcgggcgagcaggcagtgcaggcggccggcggccgtcatctgatcttccgcactgcctgggtctacgcggcgcatggacacaatttcctgcgcacgatgctgcgcgtgggcgccgagcgcgatgtgctgcgcgtggtcgccgaccagatcggcacgccaacgccagcggcgttaatcgccgacatcacggcgcacgcgctccgccagccgggcgaaccctccggcttgtggcatctgactgccgccgggcagaccacctggcacggtttcgccgaagccatcttcgcgcaggcgcgcgcgcgcggcctgctcgcccgcacgccgcgcgtggaggcgatcggcaccgccgactatcccacgccggccacgcgcccggcctattcgcgactggatacccacagcctgcaggacaccttcggcgtccgcctgccggactggcaggatggactgagccaggtgctggacacgctcgcccaacggtga

SEQ ID NO: 49631 - protein, 299 aa, Xanthomonas axonopodis pv. citri str. 306
MTTLVLGANGQVGTELLRALAANGPILGSTRSGRLPDGAACEVADFDAPHRLSELLDRLQPSCVVNAAAYTAVDRAEQERDAAFRANAEAPGVIAQWCARADVPLVHYSTDYVFDGQGTRPYRPDDATAPLGVYGQSKLAGEQAVQAAGGRHLIFRTAWVYAAHGHNFLRTMLRVGAERDVLRVVADQIGTPTPAALIADITAHALRQPGEPSGLWHLTAAGQTTWHGFAEAIFAQARARGLLARTPRVEAIGTADYPTPATRPAYSRLDTHSLQDTFGVRLPDWQDGLSQVLDTLAQR

SEQ ID NO: 49632 - DNA, 879 bp, Chlorobium tepidum TLS
  CDS (1)..(879): transl_table=11
atgaatattcttgtcaccgggagccgtgggcagcttggttccgaactgcaaaaactgcaagaagtgcatggctggcaggagtggtttttcatggatctgccggaactcgacattaccgatgcgctggcggtggagcgtgtttgccgggatcgacggattggcgcgattgtcaactgtgcggcctatacggcggtggacagggctgagagcgatgcggaagcagcgttcagagtgaaccgtgacggcgcggcggtgctggccgcggttgcaatggaggttggcgcactgttgctgcatgtttcgaccgattatgttttcgatggcagctcgaaccgaccttattgcgaggatgacccggttgcgccttgcggtgtttatggcctgtccaaatgggagggtgaagaggcgatccgggcgagcggctgctcgtatatcattctacgcaccgcctggctctactcggtttacgggcagaacttcgtgaagactatgcttcgtcttggtagcgagcgccagtcgctcggcgttgtgtttgatcaggtgggcagtccgacatgggcggcggatctggccgggacgatcgtttcgatactcgaccaatgcgatccggttcggagctacagcgagacttttcactactcgaatgaaggagtctgttcctggtacgactttgccaaatcgattatggatgccgaagggctttcgtgcaaggtgttgccaatcgagagcagtaactatccgacgccagccagaaggccgcatttcagtgtgctgaacaaacgaaaaatcaagagtacattggggcttgaaatcccgtactggcacgacagtctgttgcggatgctgacagagttgcggaagacggctggcaaatcgtaa

SEQ ID NO: 49633 - protein, 292 aa, Chlorobium tepidum TLS
MNILVTGSRGQLGSELQKLQEVHGWQEWFFMDLPELDITDALAVERVCRDRRIGAIVNCAAYTAVDRAESDAEAAFRVNRDGAAVLAAVAMEVGALLLHVSTDYVFDGSSNRPYCEDDPVAPCGVYGLSKWEGEEAIRASGCSYIILRTAWLYSVYGQNFVKTMLRLGSERQSLGVVFDQVGSPTWAADLAGTIVSILDQCDPVRSYSETFHYSNEGVCSWYDFAKSIMDAEGLSCKVLPIESSNYPTPARRPHFSVLNKRKIKSTLGLEIPYWHDSLLRMLTELRKTAGKS

SEQ ID NO: 49634 - DNA, 915 bp, Thermosynechococcus elongatus BP-1
  CDS (1)..(915): transl_table=11
gtgaatcaaggagggcaaaagatgcgcctactcattttgggggcaacgggacaggtgggctggcaattggtgcagcaggcaccccctagggttgaagtgattcccgttgctcgccaaggcaccgccgtcaccctggacctggaagatttagatgctatttctcccttgctgaaaacccttcgccccgatgtggtcatcaatgcggcagcctatactgcggtggatcaggcggaacaggaaaccgagcgggcacaacggattaatagcaccgccgttggcctcttggcagcaaccatggctgagctaggagggttgctgattcactactccacagactatgtctttgcgggcaatcaatccctgccctatcgcgaaaccgatgcccctgcccccctcaatgcctatggctacactaagtggctaggggagcaggcgatcgcccgccatcaccccgcccacctgattttgcgcaccagttgggtttatgacctgcgggggaagaactttctgcggacaatggttcgccttgcccaaacccgtcctttggtgcgggtggttgccgatcaaatcggtacgcccacggctgctcccttcattgcccaagtcacctatcaactgctggaacactggcaggcgactccctccctcagtggcctctatcacctgacaccccgaggcagcacgagttggtatggcttcgcagcaaaaattttcgatcacctgcgggccaagggctatgccgccgccaccctggaggcgattcccagcagtgagtatcccacacgggccaagcgacccgccttttccaccctcaactgcgagaagttggagaccgttcttgggactcccctccccccttgggaagcggtccttgaaccacttttgcagcaattggatcctcaatccgttctttag

SEQ ID NO: 49635 - protein, 304 aa, Thermosynechococcus elongatus BP-1
MNQGGQKMRLLILGATGQVGWQLVQQAPPRVEVIPVARQGTAVTLDLEDLDAISPLLKTLRPDVVINAAAYTAVDQAEQETERAQRINSTAVGLLAATMAELGGLLIHYSTDYVFAGNQSLPYRETDAPAPLNAYGYTKWLGEQAIARHHPAHLILRTSWVYDLRGKNFLRTMVRLAQTRPLVRVVADQIGTPTAAPFIAQVTYQLLEHWQATPSLSGLYHLTPRGSTSWYGFAAKIFDHLRAKGYAAATLEAIPSSEYPTRAKRPAFSTLNCEKLETVLGTPLPPWEAVLEPLLQQLDPQSVL

SEQ ID NO: 49636 - DNA, 855 bp, Streptococcus agalactiae 2603V/R
  CDS (1)..(855): transl_table=11
atgattttaattacaggggcaaacgggcaattaggtagtgaattacgtcaccttttagacgaacgaactcaagagtatgttgctgttgatgtagctgaaatggatattacaaatgccgagatggtggacaaagtctttgaagaggtgaagccatctttagtttaccattgtgcagcttacacagctgttgatgcggcagaagatgaaggaaaagagctagactttgcaatcaatgtcactggtacagagaatgtcgctaaggctgctgctaaacatgatgcaacacttgtttacatttcgacggactacgtgtttgatggtgaaaaaccagtggggcaagaatgggaagtagatgatctgcctgatcccaaaacagagtacggtcgtacaaaacgtatgggtgaagagttagttgaaaaatatacttcaaaattctataccattcgcacagcgtgggtatttggtaactatggtaaaaactttgtctttacgatgcaaaaccttgcaaaaacacacaaaactctaactgttgttaacgaccaacatggacgaccaacatggacacgtactttggctgagtttatgacttatttagctgaaaatcaaaaagattttggttactatcatttatcaaatgatgctaaagaagatacaacatggtatgattttgcggttgaaatcttaaaagacacagatgtggaggttaagcctgttgattctagtcaattcccagcaaaagcaaaacgtcctttaaattcaactatgagtttggaaaaagcgaaagcaacaggatttgtgattcctacttggcaagatgctttaaaagagttctacaagcaggaagttaaaaaataa

SEQ ID NO: 49637 - protein, 284 aa, Streptococcus agalactiae 2603V/R
MILITGANGQLGSELRHLLDERTQEYVAVDVAEMDITNAEMVDKVFEEVKPSLVYHCAAYTAVDAAEDEGKELDFAINVTGTENVAKAAAKHDATLVYISTDYVFDGEKPVGQEWEVDDLPDPKTEYGRTKRMGEELVEKYTSKFYTIRTAWVFGNYGKNFVFTMQNLAKTHKTLTVVNDQHGRPTWTRTLAEFMTYLAENQKDFGYYHLSNDAKEDTTWYDFAVEILKDTDVEVKPVDSSQFPAKAKRPLNSTMSLEKAKATGFVIPTWQDALKEFYKQEVKK

SEQ ID NO: 49638 - DNA, 849 bp, Oceanobacillus iheyensis HTE831
  CDS (1)..(849): transl_table=11
ttgtggtttacaatgagatttctgattacaggttgtgagggtcaacttgggaaagcgttcatttccaagttaggtcttggtattaacataaagcgcctctcaaaaaaagagatggatataaccgatccaattaaaattgaacaacaaatacaatcctttcaaccagactacgttatccatactgctgcatatacagcagttgatcttagcgaaaaacacccaattcttgctctacaagtaaatgcgattgggacattacatcttgctcgtgcttgtaaaaaatacggagcaaagcttgttttttttagttctgattacgtatttgatggagaaaaaaacaccccttatattgaatccgatcgtccaaatcccaaaaataattatggtttaagtaagtggctagcagaggagtttattctacaaacattaccagagagttatattatacgaacatcatggttgtttggggatggcgaaaataactttgttaatacgattaaaaaaaatgcctacaaaagaaaaccattaaaagttatcaatgatcaaattgggagtccgacctatacctatgatttagttgaagcttgcataccattgctgcaacttccttttggtatttaccatatacgaaatgatggtatttgtagttggtactcctttgcacaaacaatttatgaggaatgcggaactgacccaactttaattacacctgttacgtctaaggaatataaaactctagcaaagagaccgagttactctgttttaagtatgaataagctgaaatcctctggaactaaactccctcgtttttggaaagaagccctttgtaactttattaataaggagtag

SEQ ID NO: 49639 - protein, 282 aa, Oceanobacillus iheyensis HTE831
MWFTMRFLITGCEGQLGKAFISKLGLGINIKRLSKKEMDITDPIKIEQQIQSFQPDYVIHTAAYTAVDLSEKHPILALQVNAIGTLHLARACKKYGAKLVFFSSDYVFDGEKNTPYIESDRPNPKNNYGLSKWLAEEFILQTLPESYIIRTSWLFGDGENNFVNTIKKNAYKRKPLKVINDQIGSPTYTYDLVEACIPLLQLPFGIYHIRNDGICSWYSFAQTIYEECGTDPTLITPVTSKEYKTLAKRPSYSVLSMNKLKSSGTKLPRFWKEALCNFINKE

SEQ ID NO: 49640 - DNA, 1443 bp, Bifidobacterium longum NCC2705
  CDS (1)..(1443): transl_table=11
atggatttcgaaaaagatctgagggctgtggagacgaacatcccgggcttgatcgtgttcgacctgccggtgcatggcgacaaccgtggctggttcaaggagaactggcagcgggcgaagatgaccgcgctcggcctgccggatttcggtccggtgcagaacaacatcagcttcaacgcgaagaagggcgtgacgcgaggcatccacgcggaaccgtgggacaagtacatctcgatcgccacgggcagcgtgttcggcgcgtgggtggacctgcgccccggcgactcgttcggccaggtgtacacgaccgtattggatccatcgaaggcgatctacgtgccgcgtggcgtgggtaacagcttccaggcgttggaggacggcaccgcgtacacgtatctcgtgaacgcgcattggagtctggagcagaagaagacatacacgttcgtgaacctcgccgacccggacctgaacatccagtggccgatcccgctggaggactccgaacgctccgaagcggacctgcaccatccgatgctcagggacgccaagcccatggccccgcgccgcacgatggtcaccggctgcaacggccagctcggccgcgcgatccgcgcctacgtggacgcgcatggtttggagggtttcgagttccacgacatcgacacgttcgacttctccgacccggcccagtacgaccggttcgactggtcgctgtacggcacggtcatcaacgcgggcgcgtacaccgcggtcgacaaggcggagaccccggaggggcgcgtgctggcgtggaaggcgaacgcacagggccctgccctgctcgccaaagtcgcccgcgagcacaacatcaccctggtgcacgtgtcgagcgattacgtgttcgacgggaccgccgaattgcatgacgaggaggaggcgttcgcgccgttgggcgtgtacgggcagtcgaaggccgcgggcgacatcgcggtcgcgaactgtccgcgccattacatcctgcgttcgagctgggtgatcggtgagggccataacttcgtgaagaccatgatgggcctgtccgacagggtcgcgaagggcgaattgccggaggtgacggtggtggacgaccagtacggccgcctcacgttcaccaaggacatggccgaggcgatcttccacctgttcgacggcggcgcggcgtacggcacgtacgacctgaccggttccgggactgtgaagagttgggcggacatcgcgcgcacggtattcgatctgacgaacggcaacggtgggaaggtcaagccgatctcgaccgcggagtatttcgcgaacgcgaaggcgccggtgagccctcgtccgacgtattccgcgctggacctggccaagatcgaggccacgggcctggacgtgcctgattgggaggagtccctgaaggcatacgtcaccaaggaactcaagaagtag

SEQ ID NO: 49641 - protein, 480 aa, Bifidobacterium longum NCC2705
MDFEKDLRAVETNIPGLIVFDLPVHGDNRGWFKENWQRAKMTALGLPDFGPVQNNISFNAKKGVTRGIHAEPWDKYISIATGSVFGAWVDLRPGDSFGQVYTTVLDPSKAIYVPRGVGNSFQALEDGTAYTYLVNAHWSLEQKKTYTFVNLADPDLNIQWPIPLEDSERSEADLHHPMLRDAKPMAPRRTMVTGCNGQLGRAIRAYVDAHGLEGFEFHDIDTFDFSDPAQYDRFDWSLYGTVINAGAYTAVDKAETPEGRVLAWKANAQGPALLAKVAREHNITLVHVSSDYVFDGTAELHDEEEAFAPLGVYGQSKAAGDIAVANCPRHYILRSSWVIGEGHNFVKTMMGLSDRVAKGELPEVTVVDDQYGRLTFTKDMAEAIFHLFDGGAAYGTYDLTGSGTVKSWADIARTVFDLTNGNGGKVKPISTAEYFANAKAPVSPRPTYSALDLAKIEATGLDVPDWEESLKAYVTKELKK

SEQ ID NO: 49642 - DNA, 921 bp, Leptospira interrogans serovar Lai str. 56601
  CDS (1)..(921): transl_table=11
atgatttattatactggaaaaaacggtcagttaggttgggaattggccgaaagatttaaatctaatggattggaagcagtaggatttggtagggaagaatgggatcttgcagatcttgattctgccgcacgaattttgaaggattctcctcggattttagttcattgtggagcttatactgcggtagataaggcagagtccgactcagagaacgcttacaaaatcaattcgttatctgtaaaaaaaatttcggaagaatgtctaaaaagaaaaatccatttaatttatgtatccactgattttgtgtttgatgcaaactcggaaacgatcggtgatacgattcgtttttggaaaccggattctacactttctccaaaaggaatctacggattatcaaaggcggaaggggaaaagtggattcgaaatacatttgtagattctaaacaagcaaatatagttcgtaccagttgggtatattcctctcatggaaataattttccaaaaacaattgtgaaacttttacaagattccaatcgtcatgaattaagagtgatcgaagatcaattgggaagacctacttgggctggtaggcttgcggattttataatattcttaatttatggaattctaaaaggagaatcttatcctgagattctacatttttctaactcaggagttgcgagctggtacgattttgcacttgcggttcgggatttttcacattctttttcattgatagaaaatttgaagccgatttatccaattcctacggaaggttatccaacacctgcacctaggcctagatattcaattttagatttagaagaaactcgaaaaatttttggcgttgttccgcattggagagaggatttaaccctttgtctgaaagaacttgccgaagtttccggaaaaaaagtatga

SEQ ID NO: 49643 - protein, 306 aa, Leptospira interrogans serovar Lai str. 56601
MIYYTGKNGQLGWELAERFKSNGLEAVGFGREEWDLADLDSAARILKDSPRILVHCGAYTAVDKAESDSENAYKINSLSVKKISEECLKRKIHLIYVSTDFVFDANSETIGDTIRFWKPDSTLSPKGIYGLSKAEGEKWIRNTFVDSKQANIVRTSWVYSSHGNNFPKTIVKLLQDSNRHELRVIEDQLGRPTWAGRLADFIIFLIYGILKGESYPEILHFSNSGVASWYDFALAVRDFSHSFSLIENLKPIYPIPTEGYPTPAPRPRYSILDLEETRKIFGVVPHWREDLTLCLKELAEVSGKKV

SEQ ID NO: 49644 - DNA, 987 bp, Shewanella oneidensis MR-1
  CDS (1)..(987): transl_table=11
atgcaggatgtcactcccgcgcgaccaacagtcctcttaactggcgcgcacagccaactggcgaaagcattaatccgaacgcatctcaatggtggattagtatttaatctccatccgcttacgcatgcagccttagatatcagcgataaatacagtgtggctgaggtgtttgcgcaggtgaaacccgactgggtgattaactgcgcggcctataatgcggtcgacaaggctgagacggcggtggatgaggcttatcgcgtcaatagcctcggcccagaattattggcaaccgaatgtgcgctcacgggcgcgcggttagtgcatatttccagtgattatgtttttagcggtctgcttacgggagttgaggcaaatgccttaagtgaaactgtgacaccttcaccattatccgtttatggcaagagtaagctcgccggagagcaagcggtgcagcgtatcttgggtgagcgcgcaattgttattcgtaccgcatggctgtacggggtcgatgggcataattttgtgaaaaccatgctgaggttgatggccgccacgcccgatgctcagccgctctttgtgattgacgatcaaattggctcacctacgtgggtcgatgccctcgcgtcgcttatctggcaactgatgctaaggggcgagtcggggctattccattacgctgggcaggggcaatgcagttggtatgaatttgctgctgaaattcagcagcaagcgttggctctgaagttattaaagaaagccgtgcctatcattgccactgatagcctcagttatgccgccaaagcgcttgagaaaggcaatgtgctggcacaaaggccgagttacagcgcgcttaatagcgctaaactacgagatacgctagggaaggataatcttgccgcaatacaatgtcctgaagtttggcaggattggcgagtacaactcaactgcatgcttaacgcccttataacacaaagtgcaaaaccttaa

SEQ ID NO: 49645 - protein, 328 aa, Shewanella oneidensis MR-1
MQDVTPARPTVLLTGAHSQLAKALIRTHLNGGLVFNLHPLTHAALDISDKYSVAEVFAQVKPDWVINCAAYNAVDKAETAVDEAYRVNSLGPELLATECALTGARLVHISSDYVFSGLLTGVEANALSETVTPSPLSVYGKSKLAGEQAVQRILGERAIVIRTAWLYGVDGHNFVKTMLRLMAATPDAQPLFVIDDQIGSPTWVDALASLIWQLMLRGESGLFHYAGQGQCSWYEFAAEIQQQALALKLLKKAVPIIATDSLSYAAKALEKGNVLAQRPSYSALNSAKLRDTLGKDNLAAIQCPEVWQDWRVQLNCMLNALITQSAKP

SEQ ID NO: 49646 - DNA, 921 bp, Shewanella oneidensis MR-1
  CDS (1)..(921): transl_table=11
atggcaaatatcatggtgacgggcgcaaccggattgctcggcagggcggtggttaaacagttaactgccgcagggcatcgggtgatagccaccggctttagctgcgccgaagcgaatatccataaactcgatttaacccaagcgattgcggtagaagcctttattgcccgcgaacggccagaggttatcgtgcactgcgccgcagagcgtcgccccgatgtgtctgagcagtctccggaacaggctttggcgcttaatcttagtgctagccaaaccctagctaaggccgctaaacagcatggagcttggctgctgtatatctcaaccgactatgtgtttgatggcacaacgccgccctatgccgaagatgccgcgcccaatccggttaacttttatggtgagtctaaattacagggcgaaacctgtgtgctgaataccgacagccgttttgcggtattacgtttaccgatactctacggcgaagtgactcaactgagcgaatctgcggtattagtgttaatcaatcaattgttggatagcaggccgcagcgggtcgatgcttgggctattcgttcgcctacctcgacggcggatattgctggcgccatcgctaagttgatcaagcggcagttacatgctgccgatgtgttagggatttatcattttagttcgccgcaaaccatgactaagtaccaaatgctactgagcttaggtgagttattggcgattgacaccgcgcatttaactccagaacttacaccgatggatagcgctaaaaggccgcagaactgcaccttaagttgcgggcgtttagcggcgctgggcatttattctgagttggaatttagcgcagggcttaatcaggcgctcgctcaatccagtgcagcacttgcagctgttggccttaagcttaaggaataa

SEQ ID NO: 49647 - protein, 306 aa, Shewanella oneidensis MR-1
MANIMVTGATGLLGRAVVKQLTAAGHRVIATGFSCAEANIHKLDLTQAIAVEAFIARERPEVIVHCAAERRPDVSEQSPEQALALNLSASQTLAKAAKQHGAWLLYISTDYVFDGTTPPYAEDAAPNPVNFYGESKLQGETCVLNTDSRFAVLRLPILYGEVTQLSESAVLVLINQLLDSRPQRVDAWAIRSPTSTADIAGAIAKLIKRQLHAADVLGIYHFSSPQTMTKYQMLLSLGELLAIDTAHLTPELTPMDSAKRPQNCTLSCGRLAALGIYSELEFSAGLNQALAQSSAALAAVGLKLKE

SEQ ID NO: 49648 - DNA, 855 bp, Streptococcus mutans UA159
  CDS (1)..(855): transl_table=11
atgattttaatcacaggaagtaatggtcaattaggtacagaattacgtcatttacttgatgaacgtaatgaagactatgtggctgttgatgttgcagagatggatattacaaaagctgaaaaagtggatgaagtctttttacaggttaaaccgagtcttgtctaccattgtgcagcctatacagcagttgatgctgcagaagatgaaggtaaagagttggattatgctatcaatgtgacaggaactgaaaacattgctaaggcttgtgagaaatataatgcaactttggtttacatttcaactgattatgtgtttgatggtgaaaagccagttggtcaagaatgggaagtggatgataagccagatcctaagactgagtatggtcggacaaagcgtttaggtgaagaagcagttgaaaaatacgttaagaacttttacatcatccgtacagcttgggtatttggtaattatggtaaaaattttgtttttactatgcaacatcttgctaaaagtcataacagtttaacggttgttaatgatcagcatggtcgtccgacttggacacgaactttagctgaatttatgacttatctggctgaaaatcaaaaagaatatggttactatcatttatcaaatgatgcaactgaggatacgacttggtatgattttgcacttgaaattttaaaggataccgatgttgtcgtaaaacctgttgactctagtcagttccctgctaaagccaaacggccgttaaattcaactatgagtttgacaaaggctaaggcgacaggatttgttattccgacttggcaagaagctttacaagaattttataagcaggatgtcaaaaaatag

SEQ ID NO: 49649 - protein, 284 aa, Streptococcus mutans UA159
MILITGSNGQLGTELRHLLDERNEDYVAVDVAEMDITKAEKVDEVFLQVKPSLVYHCAAYTAVDAAEDEGKELDYAINVTGTENIAKACEKYNATLVYISTDYVFDGEKPVGQEWEVDDKPDPKTEYGRTKRLGEEAVEKYVKNFYIIRTAWVFGNYGKNFVFTMQHLAKSHNSLTVVNDQHGRPTWTRTLAEFMTYLAENQKEYGYYHLSNDATEDTTWYDFALEILKDTDVVVKPVDSSQFPAKAKRPLNSTMSLTKAKATGFVIPTWQEALQEFYKQDVKK

SEQ ID NO: 49650 - DNA, 855 bp, Streptococcus agalactiae NEM316
  CDS (1)..(855): transl_table=11
atgattttaattacaggggcaaacgggcaattaggtagtgaattacgtcaccttttagacgaacgaactcaagagtatgttgctgttgatgtagctgaaatggatattacaaatgccgagatggtggacaaagtctttgaagaggtgaagccatctttagtttaccattgtgcagcttacacagctgttgatgcggcagaagatgaaggaaaagagctagactttgcaatcaatgtcactggtacagagaatgtcgctaaggctgctgctaaacatgatgcaacatttgtttacatttcgacggactacgtgtttgatggtgaaaaaccagtggggcaagaatgggaagtagatgatctgcctgatcccaaaacagagtacggtcgtacaaaacgtatgggtgaagagttagttgaaaaatatacttcaaaattctataccattcgcacagcgtgggtatttggtaactatggtaaaaactttgtctttacgatgcaaaaccttgcaaaaacacacaaaactctaactgttgttaacgaccaacatggacgaccaacatggacacgtactttggctgagtttatgacttatttagctgaaaatcaaaaagattttggttactatcatttatcaaatgatgctaaagaagatacaacatggtatgattttgcggttgaaatcttaaaagacacagatgtggaggttaagcctgttgattctagtcaattcccagcaaaagcaaaacgtcctttaaattcaactatgagtttggaaaaagcgaaagcaacaggatttgtgattcctacttggcaagatgctttaaaagagttctacaagcaggaagttaaaaaataa

SEQ ID NO: 49651 - protein, 284 aa, Streptococcus agalactiae NEM316
MILITGANGQLGSELRHLLDERTQEYVAVDVAEMDITNAEMVDKVFEEVKPSLVYHCAAYTAVDAAEDEGKELDFAINVTGTENVAKAAAKHDATFVYISTDYVFDGEKPVGQEWEVDDLPDPKTEYGRTKRMGEELVEKYTSKFYTIRTAWVFGNYGKNFVFTMQNLAKTHKTLTVVNDQHGRPTWTRTLAEFMTYLAENQKDFGYYHLSNDAKEDTTWYDFAVEILKDTDVEVKPVDSSQFPAKAKRPLNSTMSLEKAKATGFVIPTWQDALKEFYKQEVKK

SEQ ID NO: 49652 - DNA, 1380 bp, Corynebacterium efficiens YS-314
  CDS (1)..(1380): transl_table=11
atgacctcattcaataaggagttaaccgtccgcgacaccgcgatcgacggcctgctcattgtcgatttccccgtccacggcgacaaccgcggctggttcaaggagaactggcagcggcagaaaatgctagctgtgggcctgcccgatttcggccccgtgcagaacaacatgagtttcaacgccaccgctggcaccacccgtggcctgcatgccgagccgtgggacaagttcgtctccgtcggcaccggccgcgtgttcggtgcgtggtgcgatctgcgggaggggtctgccacctacggcgcggtggtcacgcaggagattaccccggatatcggcgtctacgtcccgcgcggggtggccaacggtttccaggcgctggaggatgagaccctctacacctacctggtcaacgatcactggtcgcccgacgcgcagtactccaacgtcaacctcgccgacccggcgctcggcatcgagtggccgctccccctgactgagatgtccgagaaggacaaaaaccaccccatgcttgtcgacgctaccggcgtcccagcccgcaaggttctggtgacgggcgcgggtggccagttgggcaccgccctgcgggcggtgttcccggatgcggagttcgtcagccggcaggatctggacatcacctccgacctgagttcggcgcgcccgtggaagcagtactccgcgatcatcaacgctgccgcctacaccgcggtggacaaggccgagggtgagggccgcgcggatgcctgggccgtcaacgccaccgccgtggcgaacctcgctgcggtggcacgggagaacaacctcaccctggtgcatgtgtcctcggattatgtcttcgacggcaccgcacctggtgagtacaccgaagatgcaccgttgtccccactcggggtctacggccagaccaaagcagccggtgacctggctgccaccggcgcaccgcagcactatgtggtgcgcacctcctgggtgatcggcgatggtggcaacttcgtgcgcaccatgaaatccctggatgcccgcggtatcaccccatctgtggtggatgatcagatcggtcgcctgagcttcacccaggacatcgccgccggcatcaagcacctgctggacacccgtgccgcgtatggcacatacaacctcaccaactccggggagccggcatcgtgggcggatgtggcgcggatgatcttccgtgaccctgctgcggtgacgggagtgagtacggcggagtatttcgtcgataagcagggcgccgccccgcgcccgctgaactcgcggctggaccttggcaaactgaccgcgacggggttcaccgcgccggattggcgcgcacggctggccgactacctggaggagttataa

SEQ ID NO: 49653 - protein, 459 aa, Corynebacterium efficiens YS-314
MTSFNKELTVRDTAIDGLLIVDFPVHGDNRGWFKENWQRQKMLAVGLPDFGPVQNNMSFNATAGTTRGLHAEPWDKFVSVGTGRVFGAWCDLREGSATYGAVVTQEITPDIGVYVPRGVANGFQALEDETLYTYLVNDHWSPDAQYSNVNLADPALGIEWPLPLTEMSEKDKNHPMLVDATGVPARKVLVTGAGGQLGTALRAVFPDAEFVSRQDLDITSDLSSARPWKQYSAIINAAAYTAVDKAEGEGRADAWAVNATAVANLAAVARENNLTLVHVSSDYVFDGTAPGEYTEDAPLSPLGVYGQTKAAGDLAATGAPQHYVVRTSWVIGDGGNFVRTMKSLDARGITPSVVDDQIGRLSFTQDIAAGIKHLLDTRAAYGTYNLTNSGEPASWADVARMIFRDPAAVTGVSTAEYFVDKQGAAPRPLNSRLDLGKLTATGFTAPDWRARLADYLEEL

SEQ ID NO: 49654 - DNA, 903 bp, Pseudomonas putida KT2440
  CDS (1)..(903): transl_table=11
gtgaaaatcctgctgttggggaaaaacgggcaagtaggctgggagctacagcgcgccttggcgccgctgggtgaggtcattgcgctggatcgtcagggggccgagggcttatgtggcgacttgtccaacctggacggcttggccgctacgattcgtcagctggcgccggacgtgatcgtcaacgctgctgcctacactgcagtggataaagctgagagcgatcaggcactggctgcaatgatcaatgccgcggctcctgctgtattagcacgtgaaacagcagctttgggcgcctggttgattcactattccaccgattatgtatttgacggcagcggcagtcagcgctgggaggaaactgcgcctaccggccccctttcggtctacggccggaccaagctggaaggcgagcatgccattctcgccagcggcgccaaggccgtggtactgcgcaccagctgggtgtatgctgcgcgcgggcacaattttgccaagaccatgctgcgcctggcggcggagcgtgagacgttgagcgtggtagcagaccaatttggcgcacccacgggcgctgacctgatcgccgacgttactgcacacatcctgcggcaaatcttcaatgggcaagacaaccgtcacctggcagggatttaccacttggctgcgtccggtgaaacctcttggcatggttttgctcagttcgtgctggcgcatgctcaacgcactggcgtagcgctgaaagtgacagctgataaggttgccgcaatcagcaccgaagcttatccagtacctgcaccacgtccgcgcaactcgcgcctggcactgggcaaactggaaaacacgttcaatttcaaaatgccgctttgggagcaaggcgtgcaacgtatgctggacgaaatccagtaa

SEQ ID NO: 49655 - protein, 300 aa, Pseudomonas putida KT2440
MKILLLGKNGQVGWELQRALAPLGEVIALDRQGAEGLCGDLSNLDGLAATIRQLAPDVIVNAAAYTAVDKAESDQALAAMINAAAPAVLARETAALGAWLIHYSTDYVFDGSGSQRWEETAPTGPLSVYGRTKLEGEHAILASGAKAVVLRTSWVYAARGHNFAKTMLRLAAERETLSVVADQFGAPTGADLIADVTAHILRQIFNGQDNRHLAGIYHLAASGETSWHGFAQFVLAHAQRTGVALKVTADKVAAISTEAYPVPAPRPRNSRLALGKLENTFNFKMPLWEQGVQRMLDEIQ

SEQ ID NO: 49656 - DNA, 909 bp, Xylella fastidiosa Temecula1
  CDS (1)..(909): transl_table=11
gtgacggtgttggtctttggggcgggtggtcagattggtcaggagttgctgcggtcactgagtggtcgtgtggtgtgtgccgtcacgcgcagtggacggttgccgaatggggtggggtgtgtgcaggcggattttggtcagcccgagacgctgcgcgcattgcttgacgcgcagcggccagtgcaggtggtgaatgcggctgcttatacggcggttgaccgtgcggaatctgagcctgatgtggtgttccgtatcaatgcccaggcaccaggtgtgatcgcgcattggtgtgcggagcatggggtgccgctggtgcattattccactgactatgtgtttgatgggcagggtacgtctccgtacggtgtggatgatcctgtcgcgccgttgaatatttatggtgcgagtaagctggctggggagtgtgcggtccgggcggcgggcgggtgttctctgattttgcgtacgtcctgggtttatgcggcgcatggccacaattttttacgcactatgctgcgtttgggtgcgacatccgagtgtttgcgggtggtggcggatcagatcggcacgccgactgcggcggggttgattgcggatgttactgcgcagttgttggtggagcaggtgcaaagtcggcatgcgggtatttggcatctgacggcggccggtcaaacgagttggcatggttttgctgaggagattttcgtgcaggcgcaggcatgcggtttgatgatgcgggtcccgcaggtacaggccattgggagtgttgtgtatccgactgcggcgcggcgtccggggtattcgtgtctggatacgacggcgttggtggaggcgtttgggatcgtgttaccagattggcgtcagggcgtgcgcggtgtgttggacgagatcgtcaagaggtcgcgttaa

SEQ ID NO: 49657 - protein, 302 aa, Xylella fastidiosa Temecula1
MTVLVFGAGGQIGQELLRSLSGRVVCAVTRSGRLPNGVGCVQADFGQPETLRALLDAQRPVQVVNAAAYTAVDRAESEPDVVFRINAQAPGVIAHWCAEHGVPLVHYSTDYVFDGQGTSPYGVDDPVAPLNIYGASKLAGECAVRAAGGCSLILRTSWVYAAHGHNFLRTMLRLGATSECLRVVADQIGTPTAAGLIADVTAQLLVEQVQSRHAGIWHLTAAGQTSWHGFAEEIFVQAQACGLMMRVPQVQAIGSVVYPTAARRPGYSCLDTTALVEAFGIVLPDWRQGVRGVLDEIVKRSR

SEQ ID NO: 49658 - DNA, 843 bp, Lactobacillus plantarum WCFS1
  CDS (1)..(843): transl_table=11
atggctaaagtaatgattgttggtgccaatggtcagttaggtcatgagttacaacgactattaaatgaacaagagattgcatttgacgcgctgactgaaaaagaattggatattacagacttagacgcagtcaaagctaagattgccgaattacaaccagcggtcttatatgattgtgcggcttacacagcagttgataaggcggaagatgaaggcaaagccctcaattggctggtcaatgttgatggaacaaaaaatttagcccaagtagcagctgaacagggtgttaaattggtttatgtttctactgactacatttttgatggcactaataaaggtgaatatttagaagatgatccagccaaccccaagaatgagtatgggcgtgctaagtgggctggtgaagaagccgttcgtcacagcggtgctgattactatattgttcggactagctgggttttcggtgaatttgggcataactttgtcttcacaatgcagaatttagcaaagacgcatgacaagttgacagtcgtcaatgatcaactcggacggccaacctggacgcgaacattagcagaatttatggcccacctggtgaaaactgaagccgcttcagggacctatcaattaagtaacgataatacagctacttggtatgactttgcgaaggaaattttgaagaatactgatgtggaagtagcaccagttacttctgaacaattcccacaaaaggcttaccggccacagcattcagtgatgaatttggataaggctaaagcaactggttaccatattttgacctggcaggaagcactgagtgagtttctagagagccttgggtag

SEQ ID NO: 49659 - protein, 280 aa, Lactobacillus plantarum WCFS1
MAKVMIVGANGQLGHELQRLLNEQEIAFDALTEKELDITDLDAVKAKIAELQPAVLYDCAAYTAVDKAEDEGKALNWLVNVDGTKNLAQVAAEQGVKLVYVSTDYIFDGTNKGEYLEDDPANPKNEYGRAKWAGEEAVRHSGADYYIVRTSWVFGEFGHNFVFTMQNLAKTHDKLTVVNDQLGRPTWTRTLAEFMAHLVKTEAASGTYQLSNDNTATWYDFAKEILKNTDVEVAPVTSEQFPQKAYRPQHSVMNLDKAKATGYHILTWQEALSEFLESLG

SEQ ID NO: 49660 - DNA, 864 bp, Tropheryma whipplei str. Twist
  CDS (1)..(864): transl_table=11
ttgagtttaaagtgccttataaccggtggcggtggtatgttggggcgggatatacggtctgtgttcccagagagcgttgccctaacgcatgacgagcttgatataacggatgaatatgctgttcttgacgccgccagaaataaagaccttttaattaattgtgctgcatatacacaggttgatgcggcagaaagtaatgctgcaaaagcctatgcggtaaatgaagcgggtgcaagggctgtcgccaaagctgcagcaaggcgttcaattcgagtagtgcatatctcaactgattatgttttttcaggaacggcaatacgtccatacccagaagaccacccgcattctcccctttcggtctacggaaaatctaaggctgctggagaaaaggcagtgttggaggaatattccaaaggaagctttatcatccgtactgcttggctctatggacaatacggcaataacttcgtaaaaagcattctgaaagcgtgtagaacacaggatatcgtcacagttgttaacgaccaatatgggcaaccaacttggagtctggaccttgcaaaacagataaagcttcttgccgagagtgacgctccatgtggcgtgtaccatggaacaaacagcggtaaaacaacctggtttgattttgccgggaaagtggctgccttaggtgggtacgacccgaaacgcattattcccattagctccgcacaatttgtgcgcccagcacgcaggcctggatactcttgtctgggccatgatgcatggactgcagttggcctggaacccatgagaccttgggaagatgccctgaatgatgcatgggctgcgggtgtgtttgcggagtgtatagctgggcagtga

SEQ ID NO: 49661 - protein, 287 aa, Tropheryma whipplei str. Twist
MSLKCLITGGGGMLGRDIRSVFPESVALTHDELDITDEYAVLDAARNKDLLINCAAYTQVDAAESNAAKAYAVNEAGARAVAKAAARRSIRVVHISTDYVFSGTAIRPYPEDHPHSPLSVYGKSKAAGEKAVLEEYSKGSFIIRTAWLYGQYGNNFVKSILKACRTQDIVTVVNDQYGQPTWSLDLAKQIKLLAESDAPCGVYHGTNSGKTTWFDFAGKVAALGGYDPKRIIPISSAQFVRPARRPGYSCLGHDAWTAVGLEPMRPWEDALNDAWAAGVFAECIAGQ

SEQ ID NO: 49662 - DNA, 906 bp, Pseudomonas syringae pv. tomato str. DC3000
  CDS (1)..(906): transl_table=11
atgaaaattcttctgctgggaaaaaacggccaggtcggctgggagctgcaacgctcgctcgcggtattgggcgaagtcgtagcgctcgatcgtcataccgcctcgacggtctacggcgacctttctggcgacctgtccagtctggacgggttgcgcaatacgattcgctgcgttaaacctcaggttatcgtcaacgccgcggcctataccgccgtcgacaaagcagagaccgagcaagagcttgcacacacggtcaacgctctggccagccaggttctggcagaagaagcgcgtcagctcgatgccctgctcgttcattactcgaccgactacgtgttcgacggcaccggaaccagcgcatggaaagaaagcgatgcggtgtcgccggtcaactactacggtgcaaccaagcttgagggtgaacagctcattgtggcgtcaggctgcaaacatctgattttccgcaccagctgggtgtatgcggcacgcggtaacaactttgccaagaccatgctgcgccttgcaaaagatcgtcctgcgctgaatgtgatcgccgatcagattggcgcgcctacaggtgcagagctgctggccgatatagcgacagcggcgctgcagcagacgcttgcaaggccagagctgtgcggtatctaccacctcgcacctgccggcgaagtgtcatggcatgcttatgcgcaatacgtcattgatttcgcccgcgcccacggggaacccttggcggtggaaacgatcaatccaatcggcacgattgaatacccgacacccgcgcaacgccctctgaattcgcgtctgaacacagaaaagctgcgccacaatttttctctgcacctgcctgactggcaaagtggtgtagcccgaatgctcatggaagctctgaataaatga
